United States Patent 11,981,905 (POLYNUCLEOTIDE SEQUENCES AND PROTEINS ENCODED THEREBY USEFUL FOR MODIFYING PLANT CHARACTERISTICS) - sequence listing, part 11

SEQ ID NO: 30103 - DNA, 719 bp, Panicum virgatum
  misc_feature: Ceres CLONE 1896824
  misc_feature: Encodes the peptide sequence at SEQ ID NO. 30104
atcaccatccctcgagacagaggaagggggaggaaaaactccaagccgcgccgcgggcgcccacaccactcctccctcctgccctctcctcctcgccccgctccgccatggccgccgccaggcgggccccggacgccgtgctcctcctggcggtcctcctcccgctcgtggccaccccgtcccgcgccgccgcgccagcggcgagggcggcctccaccgccgcgttccagctccacggcgacgtctaccccacaggccactactatgtcacaatgaaccttgggaacccggcgaagccctacttcctggacgtggacaccggcagcgacctcacatggcttcagtgcgacgcaccctgccggagctgcaacaaggtgccgcacccattgtatcggcctgcacagaacaggcttataccttgtgcagattctctttgcactgcacttcacagtggactgggcactaacaataagtgcccttcaccaaaacaatgtgactaccgaatcaagtacacagacagcgcatcatctcaaggtgtgcttatcaatgacaacttctcgctgcccttgagcaagtcctccaacattcgtcccagcctgacctttggctgtgggtatgatcagcaagtgggaaaaaatggtgcagtgcaagcagtgacagatggcttgcttgggctaaggaggggatcagttagccttctttcacagctcaagccacaa

SEQ ID NO: 30104 - protein, 203 aa, Panicum virgatum
  misc_feature: Ceres CLONE 1896824
  misc_feature: SWISSPROT Homolog: EC 3.4.23.12 Nepenthesin
MAAARRAPDAVLLLAVLLPLVATPSRAAAPAARAASTAAFQLHGDVYPTGHYYVTMNLGNPAKPYFLDVDTGSDLTWLQCDAPCRSCNKVPHPLYRPAQNRLIPCADSLCTALHSGLGTNNKCPSPKQCDYRIKYTDSASSQGVLINDNFSLPLSKSSNIRPSLTFGCGYDQQVGKNGAVQAVTDGLLGLRRGSVSLLSQLKP

SEQ ID NO: 30105 - DNA, 665 bp, Panicum virgatum
  misc_feature: Ceres CLONE 1896834
  misc_feature: Encodes the peptide sequence at SEQ ID NO. 30106
acggcccaattcggcactcaggctgacccggctgaccgccgaccgagcccccgacgggcggcgacgcctggatccctaggcgaagctgctccggcttgccggcgtgcggtggccggcgttgatcgagcagcgcatcggcgttgaccgcggcgagcaaagaacgggcggacggcggcgggagtcccgcgccgccgcgcccagggccccagacaccaccgcaccagcgggtgcgtgggcggcgcgccgcttgctgccttgcgggctgccaggctgcgtctgaccgtgaccggctgtgcccctgtgcttgtgcggaattcctctgctgatagcaagacaacaaccaaggatcactgcaggaaaggaagcatacggtcatcatggttcacttcaagaacaggtatatggtgatggaggtcttcatagatgctggcagaggtgaatctgatcctgttatcctcactcaattcaatgtaaccaaagtaatcagagacagcattcaactcaactttggggagtgtgacctagctgcatctcttggatcgttgcaagtgaagtatgttaatcctgtaacaaagctttgcataattcgggtgtcacatgaagaccaccagaaagtatggactgcaattacaatggtcaggagcattgggaagattccagtatcg

SEQ ID NO: 30106 - protein, 95 aa, Panicum virgatum
  misc_feature: Ceres CLONE 1896834
  misc_feature (7)..(95): Pfam Name: RNase_P_Rpp14 Pfam Description: Rpp14/Pop5 family
  misc_feature: SWISSPROT Homolog: EC 3.1.26.5 Ribonuclease P
  misc_feature: Useful for making plants with modulated biomass
MVHFKNRYMVMEVFIDAGRGESDPVILTQFNVTKVIRDSIQLNFGECDLAASLGSLQVKYVNPVTKLCIIRVSHEDHQKVWTAITMVRSIGKIPV

SEQ ID NO: 30107 - DNA, 748 bp, Panicum virgatum
  misc_feature: Ceres CLONE 1896850
  misc_feature: Encodes the peptide sequence at SEQ ID NO. 30108
acccaaaaacctcccacgaaatccgcgattaaaatcctaaacccgcgtcttcccaaaatgccccccaacccccccgcttatctcctcctcgccctcctcctcctcctcgccggcaccgccgcctcggccgcgcggctccgcccgccgccggcgaacgccacctcggccggcgagcccgtctacctctggccgctgcccaagagcgtcacgtccgggtcccgtaccctcacggtcgacccggacctcgcgctcgacccgcggggccccggcggggcctcgcccgccgtggccgaggcgttcgagcggtacagggggcacgtcttcgcgccgtgggcgcacgcggcgcgcgcggccggcggcggcggcgggtacggcgtcgccaggctcaccgtcgtcgtcgcctccgccaacgagacgcttgcgctgggggtggacgagagctacacgatctacgtgggggcggcgggcggcgtcaactccatcgtcgggggagcaatcatagaggcaaacacaatatatggagctattcgtggactggagacattcagtcaactttgtgtttttaactacgacactaaaaatgtcgaggtgctgcatgccccatggcatattcaagatgagccccgcttcgccttccgtgggctactcctagacacctcacggcattacctcccagttgatgtgattaggcaagtgatcgactctatgtcatttgctaagctgaacgttcttcattggcatatcatcg

SEQ ID NO: 30108 - protein, 230 aa, Panicum virgatum
  misc_feature: Ceres CLONE 1896850
  misc_feature (55)..(189): Pfam Name: Glyco_hydro_20b Pfam Description: Glycosyl hydrolase family 20, domain 2
  misc_feature: SWISSPROT Homolog: EC 3.2.1.52 Beta-N-acetylhexosaminidase
MPPNPPAYLLLALLLLLAGTAASAARLRPPPANATSAGEPVYLWPLPKSVTSGSRTLTVDPDLALDPRGPGGASPAVAEAFERYRGHVFAPWAHAARAAGGGGGYGVARLTVVVASANETLALGVDESYTIYVGAAGGVNSIVGGAIIEANTIYGAIRGLETFSQLCVFNYDTKNVEVLHAPWHIQDEPRFAFRGLLLDTSRHYLPVDVIRQVIDSMSFAKLNVLHWHII

SEQ ID NO: 30109 - DNA, 2763 bp, Panicum virgatum
  misc_feature: Ceres CLONE 1896868
  misc_feature: Encodes the peptide sequence at SEQ ID NO. 30110
ctgcctcactcgaaccgcgccgcgccccaaaccctagcgcagccgcggtgggaggcgcaccgctccaatccaaccccaatagcttcggccccgattctcctgctaccccccccccccctcaaaccccggccgcccttctccgcctccgccgtcctctgtaatttttggaattctgtattgggaatatttgtggtgcttttttggttgtttgtttcaggagcgcgtgtcctcggaggattcgcggcggctgggctagggttttggcgtctcggtcaagggtgcgccatctgctccgtgggatctcccggaaccaggattgctgtcagtcaccatgtcatcatatcctgtgctaaacaaccgaccaattgatcagtggagagttactgatctgaaggatgaactccgtaaaagaaggcttcctgttaagggtttgaaagaggaacttgtgaggcgactttttgaatccattcagagtgaaaaagcagctgatgaagctgatgaagacgcgggagcgaatgcagatgatcagttgcctgatgccaatgctagtgaacaaactacagttaccatcacagaagttcatcatgaaacagtggttcatgtcagtcagcaagttgaagttcctatccccagtgttgatgttgaagcttccttaaatgagacctcagctgccaaaggagaagaacctgaatcaattgatggaggaaatttagctttcgaagaagtgcaaccgcatactgaaagtaataatgagcctattcttgagaagacctcagatgctgaaaccaatgaggcagtcatagtcaatgatgcaatcagtaatgaagtgaagtcagacttggccacttctgaaatcaagtctgatgccactaaagcaaccaaaattcaagaacatgaatcagcaccagcacctgcagatgctagccatatggataccgatgttgtcacagctgcaccagtaagtgatgatggggagaaactggcacccatggatgatttgggtggcaaagtgccaatgtatgatgaagaacacaaagattctgatatcatgaacgaggaacgcgagcccatcgtgtcaaaaccaaataatcaggtacctgaggttagcccagatttagggtctcaaattaagtgtgagtcgatttctagtgatctatcaactaacaaaaagaataatatagaagataacttgaatgctaataattttgatttagaactagagattaagccgaagatggttgaaccatcatccggcattacttccttaggtggagatttgcagcaattggatgatgacaaagagctggttaagaaccagtcatctgttgaagacatagattccatcgctaatgtggactcatacaagaaagatagtcctgaaggttctccagagaaattaaatttagacaggagttcaggtgatgagtcaatggaggaggatgttatggaaattaaacaagttgagtccaatatgaaatctgatgaaaagactgagattaactcagaagatgagaaagaggtgaccctccctgattctgctgttgaggcttcctctgttgataccaaggaggttatagctgaagaaaagtcagcagcttcaacagaaaaaagaaaattcgaagctgaagaagttgttgcaatcactgaaccaataaagcggcagcgccgatggactgcagatggtgccaaagttccagagaaacaaacatcaagtcaaactgtttctgatgctcccaaggatgtttttcagcctgctcttaaacgatcttttgggaggtctgattcaacggctagtgtagattctcctaaggagcggattgtgccaccgtctcagaaacctgcaacaacttctttgagaattgaccgatttgtacgcccatttactctgaaagctgtgcaggagcttcttggtaaaactggatcagtacaaaacttctggatggatcatatcaagactcattgctatgttacattttcctcggttgatgaagctgtggccactagggatgctgtttacaacctacagtggcccccaaacaatggcaataagttgattgccgaatttgttgatcctcaggaagtgaagctcaaggttgagccccctcccccgcctgcagctcctgttagcccagctgctgcaagggtgcctcctgttcaacaggctcaggctaatcaaaatgcgccacgccaagctgctacaccgaaggagcaactgccacctccaccgccccttgctaagccccctgtggctgctgacccagcggcatcagcaagggagaggttaccacccactccaaagaagccagagcctcctgttgtgacactcgatgatctctttaagaagacacagtcatccccgaggatctactacctgcctttgtcagaagaggaggtggcagccaagctcgccgcacaagggaaagggaaaaaggaataggaggcattggtctccatttctcgtctctagtgtcgtggaacatgaagatatgattttgtgaggcgatcacagcagctggcaggtgcatttgctgcagtccatttgaaataacagttggtgctgagttctgtggcaaggagtagttgtagggctgttatgtgaaagactagtgtagaagcagcggcagcttgtatttcctgtagaaggtagttttgattgggttccgtctggaccgtctgagttacttgtttaatttattctgtcaggtactgttgagacgctgggtttagttgtctcggggaaaatactgttgagatgcttggttc

SEQ ID NO: 30110 - protein, 701 aa, Panicum virgatum
  misc_feature: Ceres CLONE 1896868
  misc_feature (12)..(46): Pfam Name: SAP Pfam Description: SAP domain
  misc_feature: SWISSPROT Homolog: EC 5.2.1.8 Peptidylprolyl isomerase
MSSYPVLNNRPIDQWRVTDLKDELRKRRLPVKGLKEELVRRLFESIQSEKAADEADEDAGANADDQLPDANASEQTTVTITEVHHETVVHVSQQVEVPIPSVDVEASLNETSAAKGEEPESIDGGNLAFEEVQPHTESNNEPILEKTSDAETNEAVIVNDAISNEVKSDLATSEIKSDATKATKIQEHESAPAPADASHMDTDVVTAAPVSDDGEKLAPMDDLGGKVPMYDEEHKDSDIMNEEREPIVSKPNNQVPEVSPDLGSQIKCESISSDLSTNKKNNIEDNLNANNFDLELEIKPKMVEPSSGITSLGGDLQQLDDDKELVKNQSSVEDIDSIANVDSYKKDSPEGSPEKLNLDRSSGDESMEEDVMEIKQVESNMKSDEKTEINSEDEKEVTLPDSAVEASSVDTKEVIAEEKSAASTEKRKFEAEEVVAITEPIKRQRRWTADGAKVPEKQTSSQTVSDAPKDVFQPALKRSFGRSDSTASVDSPKERIVPPSQKPATTSLRIDRFVRPFTLKAVQELLGKTGSVQNFWMDHIKTHCYVTFSSVDEAVATRDAVYNLQWPPNNGNKLIAEFVDPQEVKLKVEPPPPPAAPVSPAAARVPPVQQAQANQNAPRQAATPKEQLPPPPPLAKPPVAADPAASARERLPPTPKKPEPPVVTLDDLFKKTQSSPRIYYLPLSEEEVAAKLAAQGKGKKE

SEQ ID NO: 30111 - DNA, 2020 bp, Panicum virgatum
  misc_feature: Ceres CLONE 1896871
  misc_feature: Encodes the peptide sequence at SEQ ID NO. 30112
aacgtgacctccgctctctgccgttcctgtctatcctttcccaggacctcgggaatcccgggattccagaaaaatccggtggtcggtgcccatagacaagtgtgtgcaccacgaggaggaggaacaaggaagcgaggccattccgggggtcaaacgaagagaagcaaagccgagctcccacctttcgcagaatccgcccgaaagactgcaccgttcttcctcctcctcgttccttccctccagccaggggccatggatatagatgatgtgctctgcaacctgcgtgttgtcggtgtgccaacaaaaagcgcaatttacatttggggttataaccacagtggtcagactgcacgaaagggcaaggagtgccacttgaggatccccaagagcctccctcccaaactattcaaattggggaagggaaagagcctcaggtggactgatattgcatgtggccgtgagcatactgctgcagttgcttccgatggatcactcttcacctggggtgctaatgagtttggccagttgggagatgggacagaggagagtgcgcaggaacccaagaaagtcaagtcactggagaccgagcttgtaaaatcggtatcctgtggtgcacattgtacagctgctgttgctgagcctcgagaaaacgatggcacattatccaaaagcaggctttgggtgtggggacaaaatcagggttctgattatcctcgccttttttggggagctttcacaccaaacacagtgattaagcaggtttcttgtggagctgttcatgttgtggctctatctgaggatggtctactgcaagcatggggctacaatgagtatggtcagcttggcagaggttttacttctcaaggacttcagggagctcgtgtgttaactgcttatgcaaggttccttgatgacgcccctgagcaagtgaagattgttagggtgtcatgtggcgagtaccatacagcagctatatcagaaaatggggaggtgtatacttggggattgggaagcatggggcagcttgggcattgctccctccagtctggagataaggagctgatccctaggcgaattgttgcccttgatagaatagtggttagtgacgtgtcttgtggaggggtccactcttgtgctgtaactgaaggtggagctctctatacgtggggcggaggacatgtgggccagctgggagtcgggcctcagagtggcttcttctcttgctcttttaatgaatctgacatgctacttcgcaacatcccagtcctggttataccgtcaggtgttcgtcttgctacctgtgggcactcacacacactggtatctatgaaagatggccgtatatatgggtggggctacaatagttatggtcaggcggcaaatgcaaaatctacttatgcttggttcccctctccagttgattggtgtgttggtgaggtgaggagacttgctgctggaggtgggcactcagctgttctgactgatgcatgttcgctaaaagagctgtgtgagttcaagctagcagagactgtaaacctttctaatgctgagctaatagaagatgttgcatcacggactggtgctgatgccttggcacgcttgtgtgagaaactaagggaacatgtgcatgagcgaggagaatgtgaactcctggaaaagcaggttcctgaagaagcagaagctaaggccggttagaccactgatgaatagttgaagcagtcagaggctgaagccaattaaaccatggcaattcatctcagccttaatatcttgacctcccagtaatgttattcagacaattattgttacggtctatgcgattgtgtctggactcagcaattgattctgattgatctgtaaacccccatttgtgtgcctctcaagtgtatccgagggcattcaggtcgctgtagaacctaattgaaacgtgtgtgcttgtatcttgaaaggcttgtgcgtgcaattgtaacagtcaggttaccatgggacctaatggaaacatgtgtgtgcttgttactcg

SEQ ID NO: 30112 - protein, 480 aa, Panicum virgatum
  misc_feature: Ceres CLONE 1896871
  misc_feature (78)..(127): Pfam Name: RCC1 Pfam Description: Regulator of chromosome condensation (RCC1)
  misc_feature (183)..(241): Pfam Name: RCC1 Pfam Description: Regulator of chromosome condensation (RCC1)
  misc_feature (244)..(296): Pfam Name: RCC1 Pfam Description: Regulator of chromosome condensation (RCC1)
  misc_feature: SWISSPROT Homolog: EC 2.7.11.1 Non-specific serine/threonine protein kinase
MDIDDVLCNLRVVGVPTKSAIYIWGYNHSGQTARKGKECHLRIPKSLPPKLFKLGKGKSLRWTDIACGREHTAAVASDGSLFTWGANEFGQLGDGTEESAQEPKKVKSLETELVKSVSCGAHCTAAVAEPRENDGTLSKSRLWVWGQNQGSDYPRLFWGAFTPNTVIKQVSCGAVHVVALSEDGLLQAWGYNEYGQLGRGFTSQGLQGARVLTAYARFLDDAPEQVKIVRVSCGEYHTAAISENGEVYTWGLGSMGQLGHCSLQSGDKELIPRRIVALDRIVVSDVSCGGVHSCAVTEGGALYTWGGGHVGQLGVGPQSGFFSCSFNESDMLLRNIPVLVIPSGVRLATCGHSHTLVSMKDGRIYGWGYNSYGQAANAKSTYAWFPSPVDWCVGEVRRLAAGGGHSAVLTDACSLKELCEFKLAETVNLSNAELIEDVASRTGADALARLCEKLREHVHERGECELLEKQVPEEAEAKAG

SEQ ID NO: 30113 - DNA, 631 bp, Panicum virgatum
  misc_feature: Ceres CLONE 1896891
  misc_feature: Encodes the peptide sequence at SEQ ID NO. 30114
attccattccactccatcccatccccccctctgccactcggtgcttgcccgaggcccggagaagccttatcgcatcctcctcgcacgccaactgctcgacgcaaccccccaccgcccacccgccgggtgcccgccatgccggggagcaatagcgccgcggccgagaaagtgaagccggcggccagccccgcggcggataagcccgccgagatcgccggcaacatctcctaccacgctcagtacagcccacacttctcgccgctcgcgttcgggcccgaggaggccttctacgccaccgccgagagcgtccgcgaccacctcatcgagagatggaacgacacgtacgtgcatttccacaagacggatccgaagcagacgtactacctgtccatggagtacctacagggccgcgcgctcaccaacgccgtcggcaacctcggcatcaccggggcctacgcggaggcggtgaataagtttggctactagctcgaggccctcgtggggcacgaaaaagatgcacctctaggaaatggtggcttgggtacgcttgcatcttgctttttggattcaatggcaacattgaatttgcctgcttggggctatggcctgcgataccgatctggactattca

SEQ ID NO: 30114 - protein, 116 aa, Panicum virgatum
  misc_feature: Ceres CLONE 1896891
  misc_feature: SWISSPROT Homolog: EC 2.4.1.1 Phosphorylase
MPGSNSAAAEKVKPAASPAADKPAEIAGNISYHAQYSPHFSPLAFGPEEAFYATAESVRDHLIERWNDTYVHFHKTDPKQTYYLSMEYLQGRALTNAVGNLGITGAYAEAVNKFGY

SEQ ID NO: 30115 - DNA, 1701 bp, Panicum virgatum
  misc_feature: Ceres CLONE 1896899
  misc_feature: Encodes the peptide sequence at SEQ ID NO. 30116
accactcgtttcatggaaccctagacgaaaagcaagtaccctccgagcgagatcgctcctctccccctgctgctacagcttcccccacggcccacgccccagcagcagcgcaagagagaagagagatcccgagaaggccgctgcggccggccggcgcgcatatatctgtgtcgtcatcgccatcacccatgccccccggccggagcgagctcctccgattatccacctccccgagtcatctcatctcgtagtagctagtgagcgatcgagcgtcgagccgtccttgctccgtcctcccctccgtccccgaatccatttccgtgtgtgtgtgctgagctagctactagcccctgcgtgcacaagcaagtcgatcataagccgtgggggaagagatagaagagatgatgaacctatcggctgccgccaacgccgcctgcgatgagttcccctacgtcgcctccaacccggttccgccctcgctgctcccaatcatggagcaggagagcagcatccagagggagcatcagctgggatacaacctcgaggccaactccctggccctcctccccccgtccaccgccgccggccaccaccacgccaccatcgccgggcacgacatcctccaattctacccgccctcgcactacctcgccgcctccggcaacccctacggccacttctcggccgggagcaccttccagtcgtactacccgcaggcggcgcaggccgcgcccgagtactacttccccaccctcgtcagctccgccgaggagaacatggcgagcttcgcggccacacagctgggcctcaacctcggctaccggacatacttcccgccacgaggggggtacatctacggccaccacccgccgcgatgccaggccgagggctgcaaggccgatctctccagcgccaagcgctaccaccgccgccacaaggtgtgcgagcaccactccaaggcgcccgtcgtcgtcaccgccggaggtctgcatcagaggttctgccagcagtgcagcagattccatctgctggatgagttcgacgacgcgaagaagagctgcaggaagcgcctagcggaccacaaccgccgccgacgtaagtcaaaaccctccgatgctgatgctggagacaagaaaagggcacatggaaacaaagctgcagctgctaaagacaaagcaggaagtagcagcaagaacatggacattggagacgggttgggtacacagatgctagggagtgcgctcttgtcaaaagatcaagatcaagccatggatcttggagaggtggtgaaagaagcggtggatcccaagggaaaggcctcgatgccacagcatcacggcatgcatcagcacaaccaccacggcttccccttccattcttcgtctgcaggctcttgcttcccccagacccaagcagtgtccggtgataccacatcaaatatagctcaagtgcaagagccgagcttagctttccaccatcaacaccaccaacacagcaacatcttgcagctcgggcaggcgatgttcgatctcgacttcgaacactagtcaatatttgatcagctctctctccccctccctctctatatctcgtttctcctttcttgtttgtgcgcgtaatctgaacggttttttcatatttaaattatctgtgttaattactgtaatgtggacataataatatagcctatgcttgccatgc

SEQ ID NO: 30116 - protein, 381 aa, Panicum virgatum
  misc_feature: Ceres CLONE 1896899
  misc_feature (158)..(237): Pfam Name: SBP Pfam Description: SBP domain
  misc_feature: Useful for making plants with altered terpenoid content
  misc_feature: Useful for making plants with modulated flowering time
MMNLSAAANAACDEFPYVASNPVPPSLLPIMEQESSIQREHQLGYNLEANSLALLPPSTAAGHHHATIAGHDILQFYPPSHYLAASGNPYGHFSAGSTFQSYYPQAAQAAPEYYFPTLVSSAEENMASFAATQLGLNLGYRTYFPPRGGYIYGHHPPRCQAEGCKADLSSAKRYHRRHKVCEHHSKAPVVVTAGGLHQRFCQQCSRFHLLDEFDDAKKSCRKRLADHNRRRRKSKPSDADAGDKKRAHGNKAAAAKDKAGSSSKNMDIGDGLGTQMLGSALLSKDQDQAMDLGEVVKEAVDPKGKASMPQHHGMHQHNHHGFPFHSSSAGSCFPQTQAVSGDTTSNIAQVQEPSLAFHHQHHQHSNILQLGQAMFDLDFEH

SEQ ID NO: 30117 - DNA, 785 bp, Panicum virgatum
  misc_feature: Ceres CLONE 1896902-R
  misc_feature: Encodes the peptide sequence at SEQ ID NO. 30118
ctaggccattttgacgtcaaggtttggatatgtgtctctctcaaattcaatgtgacaaagctaatagaagggatcgaaaaacagatccctaaagttgacaatgaaaacacaggcactgcggcagagctgattgagcaaagattaaaaactaaaaggtttttgcttgtgctagatgatatgtgggaatgtagcaataaggatgaatggaaaaggctattgctcccgctcaaaagttcccaaaaaaagggtaacacaatcctagtcaccactcgacgtccaacagtagcaggaacagttacaaaaactaactactcaatagaactgggaggcttagcctatgaagagtttaaggagctattcctagcatttgtctttgatgatgagcaatctagaatggaccaccctgagctagttgaaactggagataagataatggagaaactaaagggttcacctcttgcagcaaaaactgtatgcacattattgaggaaacatcctgattttaatcattggaacagagttctggaaagtcaagaatggaaggaacaaaaggacaagaatcacattatgcctgcactaaagcttagctatgactgtctacctttttatctgcagccgtgtttttcctactgtgctttgtttccccaagactacagatttggaagagaagagctgattcacctgtggataggactggatgttttgcatttatgcggtgaaaataataaaaggattgaagatataggactgagccatttggaagaactagttgatcatggatttct

SEQ ID NO: 30118 - protein, 261 aa, Panicum virgatum
  misc_feature: Ceres CLONE 1896902-R
  misc_feature (1)..(237): Pfam Name: NB-ARC Pfam Description: NB-ARC domain
LGHFDVKVWICVSLKFNVTKLIEGIEKQIPKVDNENTGTAAELIEQRLKTKRFLLVLDDMWECSNKDEWKRLLLPLKSSQKKGNTILVTTRRPTVAGTVTKTNYSIELGGLAYEEFKELFLAFVFDDEQSRMDHPELVETGDKIMEKLKGSPLAAKTVCTLLRKHPDFNHWNRVLESQEWKEQKDKNHIMPALKLSYDCLPFYLQPCFSYCALFPQDYRFGREELIHLWIGLDVLHLCGENNKRIEDIGLSHLEELVDHGF

SEQ ID NO: 30119 - DNA, 1316 bp, Panicum virgatum
  misc_feature: Ceres CLONE 1896902
agcggcgtcgacaccctcgcctcgggaaaattcaccggatctcgagttcccggcgtcggggcaggcgtctcttgctcagtggatcgtttgctcgggcacagcgagctcaaagatcttgctcagctcgccggcaacgagcaacctctccccatccggatcccgagtgctccacggctgcgccaccgcactcagtgccctgccgctcgccggcgtggttgttcgcacatcaagttctgctcgcgcttcccttgggtgagcaacctcaaaggtccgatcctggggcgtgatcttggactcttggcgccaaacttctgttccaccttcgtcacctcgcccgccgccgcgccccacactgcggttgcgtgacgagacccccggcaggcagcaccagcccactttgtcatacctgaagacgcatcaagatggaacggaactcgtgccctgctgctcccctgtttcttgccgttggtcggaacatgggttctttcgtataggcgccagcggactagcagaggcagcagaggttttgtttccgcgatcaaagttctcctcgtttccgttggggggctagcgacgttcgcaacagttgaggcattgacttaatttccatcgccaaagaatcccggatcgtttgctcgggtaggcggcagaggcagctgcgattgtgtctgcgtaacaacatcgccatcaatcgaagttctgctgatttcccttgggcttgggaacttccaggatttgggttctggcccctgccgttccagtgtccgtgttgccaggcgcgttgggcaggctagctggcaacatggcttctttcgggtagtagcagcctagcaggcaccgaaggcagcatcgactatcaatttcggcaatcgaattctgctcgtttttctcgggcacagcgagcttaaagatcttgcggcggtgccacgagctcacacatcgccgctcgtgaggatggcgtccgccttgatcggtgcagcgttttcagtggtgctcaaggcgctgtccccggtcatggaccctgtgctggaggcgtgggcggccagcaagaatctggaccgcaaggtcttggacctcaagatggagctgctatgcgtgaaggccgtgcttgagggaaacctcgacatggagatacacaacgcggcgctggaagagctgctgcagaacctgcacgacctcgcgtacgacgccgaggacgtcctggatgaactcgattacttccgaatccaggatgaactcgatggcaccttcgacgccgtcgacaagcacccaaaaggatgcgcccacaaccttgtcttcaacactacccacactgc

SEQ ID NO: 30120 - DNA, 1993 bp, Panicum virgatum
  misc_feature: Ceres CLONE 1896908
  misc_feature: Encodes the peptide sequence at SEQ ID NO. 30121
attgcccgcgcagagcgccgctctcctcgctgcggccgttgccatagccgccgccgccttcctcctccccccgtcttcccgcctctcatggacgccgcggggccgcttcgccgacatgatcctggccaacgccaccatctacaccgccgaccccgcccgccccttcgccggcgccatggccgtccgcgccggccgcgtgctccgcgtcggggcctacgaatccgtcaaggagctcaagggtcgccacacgcatgagttgaatctcagcgggaacgtcgtgctgccggggttcatcgactcccatgtgcacttcatcgatggcggcctgcagatagcgagggtgccacttcgaggggtcagaagcaaagatgacttcatcagcagagtcaaggaagctaccagagataaacatcctggacagtggattttaggagggggttggaacaatgatgtttggggaggtgatttcccggctgctgcttggctggacgatatatcacctgataatccagtctggctctcacgcatggatggtcatatgggcatagccaacttattagctatgaagattgctgggattgacaagaccacaaatgatccaattggtggaactatcatgagaacagctgaaggagagcctactggtcttctggtggatactgctatggtgcttatgtttgatgttattgaaaaagtttctatccatgaaagaagggaggcacttcttagagcaagtaggcatgccctaatgaggggggtgactactgttgttgatgttggaagttacttccctggagcctcagctgagaaaacatggcaagatttttcagatgtctatgaatgggctcactctatgcaaaaaatgctgatcagagtatgcttattcttcccaatgcccacatgggctcgtgtttctgatcttatcagtgaaaatggtcgatcgcttagtcaatggatccatctaggtggtgttaaagcttttcttgatggttctctgggttcttcaagtgcattgttccatgagccttatgagggtgatcctggcaattatggtcttcaagtgacagatatggatagtcttctaaatagaactttagaatctgacaaatctggacttcaggtcgcaatacatgcgattggggataaagctaacgacatgctgctggatatggtcgacaaggttgttgatttgaatggagtgaaggaccgtagattccggattgagcatgctcaacatcttgctccagctgcagcaaaccgctttggcaaacaaggtatcatcgcatcggtgcagccagatcatctattagatgatgccgactttgccgcaaagaagattgggtttgaccgcgcacagcgaagttcctatacgtttcggtcactgttagctggtggcgcgcagctagcttttggttctgactggcctgtttcagatatcaaccccttacaagcgattcaaaccgcaatctctcgtaagcctcctggatgggaggtcccctggatccctgcagaacgtttgtcgctcgatgaatcgctgaaagcgcatacgatatctgctgcctacgcctgcttcctggaccacgccgtgggcagcctctctcaagggaaatacgccgatttcgtggtcctgccttccacttcatgggacgccttcgccagcgatctaccagcgcacgtcctggccacttatgtgagcggcaagctggcctacccgtgaagcatacccagatcgggtggtgctcgaaagaatcttgtgagaagttcttcagatgcacctatgccattgccgttgcgtaatcgccattgcttgagaaggcagtatatgtacggtgtgtagaattagcatataccagcatgggttgttttctgttcgtcttgcccaatcttatccttgttttcttttttgaaatgttctaggtaggcaaaacttgaaccagcaactttttgttgcgacctggcctaaatagaagagctagtggcaagagcaactttg

SEQ ID NO: 30121 - protein, 571 aa, Panicum virgatum
  misc_feature: Ceres CLONE 1896908
  misc_feature (92)..(542): Pfam Name: Amidohydro_3 Pfam Description: Amidohydrolase family
  misc_feature (57)..(135): SWISSPROT Homolog: EC 3.5.2.7 Imidazolonepropionase
  misc_feature (460)..(570): SWISSPROT Homolog: EC 3.5.4.28 S-adenosylhomocysteine deaminase
LPAQSAALLAAAVAIAAAAFLLPPSSRLSWTPRGRFADMILANATIYTADPARPFAGAMAVRAGRVLRVGAYESVKELKGRHTHELNLSGNVVLPGFIDSHVHFIDGGLQIARVPLRGVRSKDDFISRVKEATRDKHPGQWILGGGWNNDVWGGDFPAAAWLDDISPDNPVWLSRMDGHMGIANLLAMKIAGIDKTTNDPIGGTIMRTAEGEPTGLLVDTAMVLMFDVIEKVSIHERREALLRASRHALMRGVTTVVDVGSYFPGASAEKTWQDFSDVYEWAHSMQKMLIRVCLFFPMPTWARVSDLISENGRSLSQWIHLGGVKAFLDGSLGSSSALFHEPYEGDPGNYGLQVTDMDSLLNRTLESDKSGLQVAIHAIGDKANDMLLDMVDKVVDLNGVKDRRFRIEHAQHLAPAAANRFGKQGIIASVQPDHLLDDADFAAKKIGFDRAQRSSYTFRSLLAGGAQLAFGSDWPVSDINPLQAIQTAISRKPPGWEVPWIPAERLSLDESLKAHTISAAYACFLDHAVGSLSQGKYADFVVLPSTSWDAFASDLPAHVLATYVSGKLAYP

SEQ ID NO: 30122 - DNA, 701 bp, Panicum virgatum
  misc_feature: Ceres CLONE 1896909
  misc_feature: Encodes the peptide sequence at SEQ ID NO. 30123
gcttcttccattcttcccaccaccacccatccctctctctcctccccgccccggcccttgtctctctttctctctttatctacgcggatcaccccgaccgaccggcggccgatctgtgctagttgcctgtgagcaagtccaatacatggctggcgcagggggtgcgacggcggtgcagcagccggcggcgggggcgccgccggctggggcgaggagtggcggtgccggcgcggcgggggccccggtcgccgacccgcgcgccgaggcgctgcggtgcccgcgctgcgactcggccaacaccaagttctgctactacaacaactactcgctgtcgcagccgcggcacttctgcaaggcctgcaagcgctactggacgcgcgggggcacgctccgcaacgtccccgtcggcggcggctgccgcaagaacaagcgctccaggagcagcagcgcggcgggcgccggcgggaggagcggatcctccgccgccgccgccgtcacgtcctcctcggcggcgtcaacgctgcccctgccgccgccggcggggtcccttccgtcgctcacgtccgcgctcggcctgcccgggggcacctcgctggcgtcgctcctactcggcagcggcaccggcggcgaccacctcggcctcttccaggcggccatgcagtcggttgtctcctcggaggcaaccgcctgctacgagatgc

SEQ ID NO: 30123 - protein, 185 aa, Panicum virgatum
  misc_feature: Ceres CLONE 1896909
  misc_feature (37)..(99): Pfam Name: zf-Dof Pfam Description: Dof domain, zinc finger
  misc_feature: The sequence is a functional homolog of SEQ ID NO 2748 in the 10/374,780 US patent application
  misc_feature: The sequence is a functional homolog of SEQ ID NO 394 in the 10/225,066 US patent application
  misc_feature: The sequence is a functional homolog of SEQ ID NO 1790 in the 10/374,780 US patent application
  misc_feature: The sequence is a functional homolog of SEQ ID NO 2768 in the 10/374,780 US patent application
  misc_feature: The sequence is a functional homolog of SEQ ID NO 410 in the 10/225,066 US patent application
  misc_feature: Useful for making plants with modulated nitrogen use efficiency
  misc_feature: Useful for making plants with altered alkaloid content
MAGAGGATAVQQPAAGAPPAGARSGGAGAAGAPVADPRAEALRCPRCDSANTKFCYYNNYSLSQPRHFCKACKRYWTRGGTLRNVPVGGGCRKNKRSRSSSAAGAGGRSGSSAAAAVTSSSAASTLPLPPPAGSLPSLTSALGLPGGTSLASLLLGSGTGGDHLGLFQAAMQSVVSSEATACYEM

SEQ ID NO: 30124 - DNA, 619 bp, Panicum virgatum
  misc_feature: Ceres CLONE 1896912
  misc_feature: Encodes the peptide sequence at SEQ ID NO. 30125
aaaccaaaccaaaaccgcgtgcagacgaaaccgtcgcgctgcctggctgcctgcgtcgcacgcgctcccctcccgtccgtccctccgcaggcaggccccgcccacagcaccggctaaacccgcagccccacgcggaggaatcacaccgcggaaaggctcgagttccagtgggatcgcgtccccaactcgcataaaagggcgagggccgcggacccgtcgccccgctacggcttccgctgcatgcgccgtactagtactttacttgcgctgccggacgacttggttctcggaaccagggctggcggcggcgtccggcggagaaggggagagagggagggaggcatgtgcacaccaccccccatcaccgagctggtgctgcggggctcagctaggcagcctcagacacgacgacctgtgaggactagggggggggggagggcagctacgacctcgccaccgtgctcgccttcctcgcaggcctccccttaaccatcgctgtctacgacatgcccaggcccacgcccgtctacctcatcgacttcgcctgctacaagcccgccgacgagctcaaggtgtccaaggcggagttcatcgacctggcgcgcaagtcgggcaagtt

SEQ ID NO: 30125 - protein, 37 aa, Panicum virgatum
  misc_feature: Ceres CLONE 1896912
  misc_feature: SWISSPROT Homolog: EC 2.3.1.119 Icosanoyl-CoA synthase
  misc_feature: The sequence is a functional homolog of SEQ ID NO 2 in US patent 7038112
MPRPTPVYLIDFACYKPADELKVSKAEFIDLARKSGK

SEQ ID NO: 30126 - DNA, 697 bp, Panicum virgatum
  misc_feature: Ceres CLONE 1896917
  misc_feature: Encodes the peptide sequence at SEQ ID NO. 30127
atctctctcttctctcttatcctatcatctcacttagcttctctctcttctctagcaggagcttgcggggggagtgcgccggccacctacgcagatcgagcaggggccggccgcctgcagcaaatcgagcggccccccccccccccgcgtctctctcagtctcagtgcgagtgaaggtgtgagcccgcgatggacgctctgctcgtgaccagctacgccgtcgtcgccgcggcggcggcgctcctcggggccgccccgggcgcctccgcggcgccgcgcgccttcttcgtgttcggggactccctcgtcgacaacggcaacaacaactacctcatgaccacggcgcgcgccgacgcgccgccctacgggatcgacttcccgacgcacatgcccacggggaggttctccaacgggctcaacatcccggacatcatcagcgagcacctcggctccgagcccgcgctgccgtacctcagcccctacctccgcgacgacaagctgctcgtcggagccaacttcgcgtccgccggcgtcggcatcctcgacgacaccggcatacaattcgtgaacatcatcaggatcgggcagcagctggagaacttccaggagtaccagcagaagctggcggcgttcgtcggcgaggacgcggcggcgcaggtcgtgaacaacgcgctcgtgctcatcacgctcggcggca

SEQ ID NO: 30127 - protein, 169 aa, Panicum virgatum
  misc_feature: Ceres CLONE 1896917
  misc_feature: SWISSPROT Homolog: EC 3.2.1.51 Alpha-L-fucosidase
MDALLVTSYAVVAAAAALLGAAPGASAAPRAFFVFGDSLVDNGNNNYLMTTARADAPPYGIDFPTHMPTGRFSNGLNIPDIISEHLGSEPALPYLSPYLRDDKLLVGANFASAGVGILDDTGIQFVNIIRIGQQLENFQEYQQKLAAFVGEDAAAQVVNNALVLITLGG

SEQ ID NO: 30128 - DNA, 2603 bp, Panicum virgatum
  misc_feature: Ceres CLONE 1896932
  misc_feature: Encodes the peptide sequence at SEQ ID NO. 30129
aaaataccccaccctaaacccacgcaggagccagcgcagccggagcagcaaaccgccccctcctccccgcgcccgccgcttcgcccccatggagccggtgccgccggcgacggccgccggcatggggggccctggccccgggcccgggcccgggtaccccgagtccacggagtcctccccacgcagccgcggcggggactcgtgggacgagcccttcccgtcctccgcggcgaccgcggccggcggcgggggccggctccgcctgatgtgcagcttcgggggccggatcgtcccgcgcccgacggacaagtccctctgctacctgggcggggagacccggatcgtggccgtcgaccgccacgcctcgctcgccgacgtccacgcgcgcctctcgcggtcgctgctcgggggccggcccttcacgctcaagtaccagctccccaacgaggacctcgactcgctcatctccgtctccaccgacgaggacctcgacaacctcgtcgacgagtacgaccgcatcgccgcctcctcctccggcggcggatcctcgcgcacctcgcggatccgggtcttcctcttccccgccaagcccgagtcctcctcctccctcggctccctcctcgacgactcctccaagtccgagaactggttcgtcgacgccctcaacagcgccatctccggctccctcgacggcatcccccgggggatctccaccgactccgcctccgtcaactgcctcctcggcctcgaggacgactcatccgtgcactcccgcagtggggtgcccaactcggctccctccgaggaccagcgcgccacccagcagaagctcccggccgccgccgtcgccgccggcaggcacccgcacgacgtccagtccgtgccggactcgccgatgctggataagaactcctcgttcggctcgacctcctcggcgccgtcgctatcgaatctgccgcctatacgcgtgcggccggaggaccgcccgccggacgcccgcgtcatgccacctgctaccgtggaggaccacttcgcgcagatggggatctccgagcagcagctgccgcctgctgtggcctacatgcagccgccagcgcaggtgccgatccctgccatggctgttccagttgccagcccctctgaggcgtcgagccgagtgttctccgacgatgataagtccgatcacggtggcggaagtcggaagccacaacctccaaagcaggaggttccacccgttgctgatcccaccaatagagctgtctactacaacgataggtctccaccagcggaacataagcgagatatgccggtgggaactgaagctgccagctaccgcctcccagtatcagctccggatgctgctgccgccgctgcagctgcagcagcaacacagcccccacctggatatgtcttccagatgcatgcgcctccgccacagcagcagccgccaccgcaacaaccacagcagccagctccacaacagattgttactgctggaaatcagcatttcatccacaatccagccactgggaccttcattccaatccagtcatattaccaccaacctgttcctcagcaggcaccccagcctgtgccgcggccacaacaggcacctgcattcgacccgaacactgggatctattacattccaatgcagcagaatgcacctcagccatatagcatgcctcctaatgcacaggtctctttgccaccgccgacccttgttgacacaacgccaaagccaaccattccgattcctcagatggctgtaaagcctgaattgcagcagcaacctagtgtctaccgaacagcagcagctgccgcacctgcacctgcgcccaatgccacaccttgatatgccggagtgggataccaccatgttattcaatcccaccaccacccagcccagcaacccattgcaaacatgacaggcaactatgggtatgaatacactgatccgaatcgcccacaagtctactactcgcaagcagcagcacctccagcattgccacctcagtatcagcccattgtctctcctgatcctggtcagggtgaaaaacattaagctgaagcgcccttcatagcttgaggaggattggtgaattctggtacgttgcaaactctagagacatagttaccctgctgttatcattattgatgctcctgcatgttacatgagtatgtggcaaggtgttgctattaggaagctgtgcgtttggggtcaaaccaagtatgcatccaaccatggactgaaaataagattataaccggatggttcttgtgttggtgagactgaaagaagggtgacattgctggattagattggggagagccaagtgttgttggatccagttccaattgctgtctttttcttcttcttaatttgaataaatatatagtgtccaaaagaacttggtaaaaatgaagaactcatcatttgtgtagccctctgtaaatttgaactcttggaagtcattcaggttgaggtgcagataagtgttattagtttgcttgtagaaacttcattcgagttaaaatatcatatgtatacatcggtccggttttgtactttgatgttgatgttgatatgtttcttatcgttt

SEQ ID NO: 30129 - protein, 588 aa, Panicum virgatum
  misc_feature: Ceres CLONE 1896932
  misc_feature (71)..(166): Pfam Name: PB1 Pfam Description: PB1 domain
MEPVPPATAAGMGGPGPGPGPGYPESTESSPRSRGGDSWDEPFPSSAATAAGGGGRLRLMCSFGGRIVPRPTDKSLCYLGGETRIVAVDRHASLADVHARLSRSLLGGRPFTLKYQLPNEDLDSLISVSTDEDLDNLVDEYDRIAASSSGGGSSRTSRIRVFLFPAKPESSSSLGSLLDDSSKSENWFVDALNSAISGSLDGIPRGISTDSASVNCLLGLEDDSSVHSRSGVPNSAPSEDQRATQQKLPAAAVAAGRHPHDVQSVPDSPMLDKNSSFGSTSSAPSLSNLPPIRVRPEDRPPDARVMPPATVEDHFAQMGISEQQLPPAVAYMQPPAQVPIPAMAVPVASPSEASSRVFSDDDKSDHGGGSRKPQPPKQEVPPVADPTNRAVYYNDRSPPAEHKRDMPVGTEAASYRLPVSAPDAAAAAAAAAATQPPPGYVFQMHAPPPQQQPPPQQPQQPAPQQIVTAGNQHFIHNPATGTFIPIQSYYHQPVPQQAPQPVPRPQQAPAFDPNTGIYYIPMQQNAPQPYSMPPNAQVSLPPPTLVDTTPKPTIPIPQMAVKPELQQQPSVYRTAAAAAPAPAPNATP

SEQ ID NO: 30130 - DNA, 1832 bp, Panicum virgatum
  misc_feature: Ceres CLONE 1896952
  misc_feature: Encodes the peptide sequence at SEQ ID NO. 30131
accggcgcacagtaaactgctgcaactgacaacagagaagaccccccaaatggacactaccgtcgtcgccatcgccggcgacggagacgactccttccgccgccccctcctctcccagaccgaagagatccacccctatgaagaacccccttcctcccagcgcgcgcctccggacgccgcggcggcgcagcccgagcaggagcggaagccgcagcgggtggcctcgctggacgtgttccgtggcttcaccgtcgctatgatgatactcgtagacgacgcgggcggggcgtggccgggcatcaaccacgcgccatggttcggggtgacggtggcggacttcgtcatgcccgccttcctcttcatcatcggcgtctccgccgcacttgtcttcaagaaaatcccaaataagacagcagcaactaagaaggctatggttagggctatcaagcttttcatcttgggtgtgattttgcaaggttatgcttgcccctactttgcagattagcccacatcagcccatccttatcatctattttgcgttggagtttatccttgttatgttttcttactcgtaggaggatacattcatggacggcacaaattaacatatggtgttgatttggatcaaattcgatggctaggtgtgcttcagcggatagctattggatactttctagcagcaatttcagagatttggcttgtcaacggtaatttggtggattcatttgtatcgtttgtgaagaaatacttcatggagtggatcatggccatgatgattacaatactttatgttgccttagtattcggcctttatgttccaaactggcaattcaaagttaaagttagcaatccaaccctttcgaccccaattagtttagttgaaatgaagacgatccactgtggagttagaggtagtcttggaccaccttgcaatgcagttggcttggtagatcgagttttgcttggtgaaaatcacctgtacaagaatccagtctacaaaaggacaaaggaatgcagtattaattctcctgattatggaccgcttccttcgaatgcaccagactggtgcctggctccatttgatcctgagggtttgttaagtacactgatggctgcagtaacttgctttgttggattgcactttggtcatgttttaattcattgcaagaatcattcacagcgaatgctattctggctgctagcttcgatggtgttgacaatctttgcatttttactgctactattaggcatgcctttcagcaagcctttgtatacagtgagttacatgctactcagtgctggagtatctgaattcttgttgctgctgttatactacatagttgatgttattcatatcaagaagccatttattctcttccagtggatgggcatgaatgcgcttatagtctatgttctggctgcctgtgagctgtttcctactcttattcaagggttttattggcggtcacctgagaacaacctggtggacattacagagtctttgctccaggccatcttccactcgaaacgatggggcaccttggcgttcgtcctcctggagatagtcttttggtgcctggccgctggtttcctccacatgaaaggcgtctacttaaagctgtagaaccaatcatggacacatagaactacggctgcttggctacattgtttcatctgtaaatgctgtgtgggttgggacccatgggtgttgtggttgatttcgggatagagaagctgttaagttgtagatagtgctgctgtggggggttttttgtttaccaaaatttgtgctcccatgatctatatcatgctcctccaatttctgagcttgc

SEQ ID NO: 30131 - protein, 151 aa, Panicum virgatum
  misc_feature: Ceres CLONE 1896952
  misc_feature: SWISSPROT Homolog: EC 2.3.1.78 Heparan-alpha-glucosaminide N-acetyltransferase
MDTTVVAIAGDGDDSFRRPLLSQTEEIHPYEEPPSSQRAPPDAAAAQPEQERKPQRVASLDVFRGFTVAMMILVDDAGGAWPGINHAPWFGVTVADFVMPAFLFIIGVSAALVFKKIPNKTAATKKAMVRAIKLFILGVILQGYACPYFAD

SEQ ID NO: 30132 - DNA, 1309 bp, Panicum virgatum
  misc_feature: Ceres CLONE 1896961
  misc_feature: Encodes the peptide sequence at SEQ ID NO. 30133
gcatatctatcactcccaagctgcaatttcacactgcaatagctaggaatcaaaatatagagccttgcagcccttgctctcgcctaagttgtctagctagctagttttgaaggagggggttgagcccgagtggttcctagagccccctcccacgccggcagcccgggttcgatccccggggccggcaccggggggcacctatgcagccctcctactgaaaaaaaaagctagctagttttgagtagcgtcgttgttatacttgctactacctagagctagctaacaatggccgccgcacctgcacgcaccttctccgtgcgctccgtggagcctcttcccgtttcagcttcgctggcggcaaccagaaacaacgaccagcgaggccgcccccgtggccgttccatcatcgcttcggcggcggcgtcgaaaacgctgctgcccagtgattttgacctccagctccaggaacgtaggaacagcgcccgggagattatggccaccatcgacaacctcaagcgcctctgcatcgaccactacttccaggaagagatccagagcgccatgggcgcgtgcttggatctcatccacagcgatgatctcttcgatgcgacacttgcattcaagctcgtgagagaggccggccatgatgtttcagcagatgatgttctacggaggttcactgackacaccggcgagttcaagcttgctcttagcaaagacatcagagggctcctgagcctccacgacatgtcacacctggacatgggagaggagccatcactgcacaaggcagaggagttctcaagcaagcaccttgcatctgccatcaggtacctggagccaggcctcgcaaggtacgtgaggcagtccctcgaccacccctaccacctgagcctgatgcagtacaaggccaggcaccacctcagctacctgcagagcctgcccactagggacactgcaatggaggggctagcaattgcagagttccagctcagcaaacagctgcatcaggaagaaatgcaggaggttaaaagatggtggatggatcttggattgtctcatgagataccagtggtgcgggaccaggtgcccaaatggtacgtgtgggccatgacaagcctccagggaccctccttgtccggatatcggattgataccacaaagataatctcactcgtctatgttgtggatgacatttttgatcttgttggcacaccggaggagctttccctcttcacccaggcaatcaaaatgtggaatactgcggttgccgattcactccccagtggcatgagatcatgctacaagg

SEQ ID NO: 30133 - protein, 341 aa, Panicum virgatum
  misc_feature: Ceres CLONE 1896961
  misc_feature (51)..(220): Pfam Name: Terpene_synth Pfam Description: Terpene synthase, N-terminal domain
  misc_feature: SWISSPROT Homolog: EC 4.2.3.13 (+)-delta-cadinene synthase
  misc_feature (134)..(134): Xaa is any aa, unknown, or other
MAAAPARTFSVRSVEPLPVSASLAATRNNDQRGRPRGRSIIASAAASKTLLPSDFDLQLQERRNSAREIMATIDNLKRLCIDHYFQEEIQSAMGACLDLIHSDDLFDATLAFKLVREAGHDVSADDVLRRFTDXTGEFKLALSKDIRGLLSLHDMSHLDMGEEPSLHKAEEFSSKHLASAIRYLEPGLARYVRQSLDHPYHLSLMQYKARHHLSYLQSLPTRDTAMEGLAIAEFQLSKQLHQEEMQEVKRWWMDLGLSHEIPVVRDQVPKWYVWAMTSLQGPSLSGYRIDTTKIISLVYVVDDIFDLVGTPEELSLFTQAIKMWNTAVADSLPSGMRSCYK

SEQ ID NO: 30134 - DNA, 170 bp, Panicum virgatum
  misc_feature: Ceres CLONE 1896961-R
ggggaagagccgaggaagaggcccaggaagggccggacggaccgcacagggaacacgaccggagggagaacccgagccgcacccccggggacgcggaggcacacaagcggaggcggagcgcgagggagggggaggagcccaacagggagcgcggccccaggaggacccac

SEQ ID NO: 30135 - DNA, 2637 bp, Panicum virgatum
  misc_feature: Ceres CLONE 1896970
  misc_feature: Encodes the peptide sequence at SEQ ID NO. 30136
acgccgttacgcctacgccgcactgcgcgaacccaacagcgagagcctgtagggagccagtggtgtggtaggcggagctgcgagagccccgcggcccgcgagagagcagaggcggccgcgtccaggagaggccggagatttcgccaggtcgccggcgtcgcaggttcccgccggaataggaggaggagcgtcgccgccgccggcaccggcaacgaacctggtttgctcgccgctggccaatgcaggtggactccgccgcgagctcgattaggatgtggtggtgtttgagcccctgttgggcctgggcaggcgaaatgtgactggctcgggtatttagagattggcacacctgttgcgagctgctgctgcaagactctgattgtttcgtcacggattggggctcatggagtcgcgcatggatcagtatgaaatcatggagcagattggccgtggagcatttggtgctgccatccttgtcaatcacaagattgaaaagaagaagtatgtgctgaagaaaatccggcttgcgaggcagacggagcgctgtcgcaagtctgcccatcaagagatggcactgattgctcggttgcagcacccttacatcgttgaattcaaggaggcttgggttgagaagggctgttatgtctgtattgtcacgggctattgtgaaggtggagatatggacgagctgatgaagaaatcaaacggtacttactttcctgaggaggtattgcttaaatggttcgctcaattggtacttgctgtagactacttgcactcgaactatgtcttgcatcgtgacttgaagtgctccaacatatttctcaccaaagatcaggacatacgccttggagactttggcttagcgaagacattaaaagaagatgatctagcttcatcggttgtcggaacaccaaattacatgtgcccagagctgctagctgatattccctatggattcaagtcagacatctggtctcttgggtgctgtatgtatgagatggcagctcatcgaccagccttcaaggcatttgatatggctggactaataagcaagataaaccggtcttccatgggtcccttgcctgcctgctactcagtgtccatgaaaactctaatcaaaagtatgttgagaaagagtccagagcatagacctactgcatctgagatcctgaagaatccatacctgcaaccttatgttaatcaatactgtcctctttatgatgcttcaaacaccatgcggatgccagagaagccactacccacttcacggagcagtcagagaagcatgtctgacagccaaagcagtagcatttctagtagtgacatagacagtacccagagtgacagaagcacatcatgtgcaactacaagtagtgatagaaggaccaatgatactcgaaacactcaagatgtggatcaagctatgtcagatgaaaaatgttcaacacctgaagatcttagaggcaataaagacaattctagtgttcagtttaaaaggcaagattcatctaaatccatacatgttgatatccatcccagaacagagagtaaacagccaaagatcattgagaagattatgacaacccttagagaggagagccggctgagagaaatcacctctcctgtcagaggtggtataaagccaagtactgggctcatcaacaataatcaagtggagcacccattacaggtttcaaggacaaatagtgatatgccatgcagtttaaagtctggaaacattttatctcttgacgaacatgcaaatcaagttgaagcatcaccacccctgaagcaagagtcacctattgctgaacatagtccaaagatcaaaactgctgggccatcaactcctgaacctgccaaacagatcacagaaaatggtgctgtagcttcaggaaaaactaagagcaggacaccaccagctgctagacgcactagccctcagaggcaagctggagtagggacaccaagcctcccagtcacagtgacaagacgagctcataccaaggtcacaacagagagagagaaaactccagaacgaccttcccgtggctcagataatgctctcagtgatcctccgcgtaatgtaatgatttctgctgctccttcagatggacaacatatgaaactggatgatttacaagcaaaatcaacaaatctttgggaatttttctctgtttcaacaaaggaacacaacagtgcttgctcaaattctacagttggttgtactgaaaatatggacagctctaaactatctgagcctgattcacctgtctgcttggtttcaccatgtataggctctgcacccaacactgtcagcgaggagaatgacctaagcatcataatatgttcagaaattagcaccgacaagattattgggactaataatggtggttcgaccctgagatgttctttggagccatcctttctgagttctgaacaagaatttgtttccaaggatgacgtgcaatctaaccagcatggaaagagcaccacatcccaaagtggtgaggataagttcacggttcaagaacttctttcatcagcaccagaagcccctccaattttatcggcctcagaagtagctccttcaatttcattggcaccagaagttgctccttctgttcaagtaac

SEQ ID NO: 30136 - protein, 744 aa, Panicum virgatum
  misc_feature: Ceres CLONE 1896970
  misc_feature (8)..(262): Pfam Name: Pkinase Pfam Description: Protein kinase domain
  misc_feature: SWISSPROT Homolog: EC 2.7.11.1 Non-specific serine/threonine protein kinase
MESRMDQYEIMEQIGRGAFGAAILVNHKIEKKKYVLKKIRLARQTERCRKSAHQEMALIARLQHPYIVEFKEAWVEKGCYVCIVTGYCEGGDMDELMKKSNGTYFPEEVLLKWFAQLVLAVDYLHSNYVLHRDLKCSNIFLTKDQDIRLGDFGLAKTLKEDDLASSVVGTPNYMCPELLADIPYGFKSDIWSLGCCMYEMAAHRPAFKAFDMAGLISKINRSSMGPLPACYSVSMKTLIKSMLRKSPEHRPTASEILKNPYLQPYVNQYCPLYDASNTMRMPEKPLPTSRSSQRSMSDSQSSSISSSDIDSTQSDRSTSCATTSSDRRTNDTRNTQDVDQAMSDEKCSTPEDLRGNKDNSSVQFKRQDSSKSIHVDIHPRTESKQPKIIEKIMTTLREESRLREITSPVRGGIKPSTGLINNNQVEHPLQVSRTNSDMPCSLKSGNILSLDEHANQVEASPPLKQESPIAEHSPKIKTAGPSTPEPAKQITENGAVASGKTKSRTPPAARRTSPQRQAGVGTPSLPVTVTRRAHTKVTTEREKTPERPSRGSDNALSDPPRNVMISAAPSDGQHMKLDDLQAKSTNLWEFFSVSTKEHNSACSNSTVGCTENMDSSKLSEPDSPVCLVSPCIGSAPNTVSEENDLSIIICSEISTDKIIGTNNGGSTLRCSLEPSFLSSEQEFVSKDDVQSNQHGKSTTSQSGEDKFTVQELLSSAPEAPPILSASEVAPSISLAPEVAPSVQV

SEQ ID NO: 30137 - DNA, 552 bp, Panicum virgatum
  misc_feature: Ceres CLONE 1896970-R
  misc_feature: Encodes the peptide sequence at SEQ ID NO. 30138
aaaactgtcagctgccacaccagagaccagcaacggtatcaaggaagaggcatcgccccctaaggaagcacttgatgttacatcatttcggcaacgagctgaggctctcgaagggcttctggagctttccgcggagctgctggagaaccagaggctggaggagctctccatcgttctcaagccatttgggaagaacaaggtgtctccacgagaaactgctatctggctcgccagaagtttcaaagggatgatgagcgacgatgcaggtcgcccgtcgccgtgagctcatttttcttctcttatattccttgttttttggctcggttgatttcacttggagccgcttgatttggtaacagcggtgctctgagttactcaaaacttacagcttgtggagttgcgatgctctttctttcttttttcaatttttgcgaagacagcttgtggcctcttgccagttttgcctcttctgattgctccattctttctggcgtatgttgtacatagccaagaactgtaaacagcaataaagctttgcctccagtgtgacgc

SEQ ID NO: 30138 - protein, 93 aa, Panicum virgatum
  misc_feature: Ceres CLONE 1896970-R
  misc_feature: SWISSPROT Homolog: EC 2.7.11.1 Non-specific serine/threonine protein kinase
KLSAATPETSNGIKEEASPPKEALDVTSFRQRAEALEGLLELSAELLENQRLEELSIVLKPFGKNKVSPRETAIWLARSFKGMMSDDAGRPSP

SEQ ID NO: 30139 - DNA, 611 bp, Panicum virgatum
  misc_feature: Ceres CLONE 1896978
  misc_feature: Encodes the peptide sequence at SEQ ID NO. 30140
accgggggaccgaacgcatccatcgcctgcagggagctagtactacaaggcaacaacagaagacgacggccggggatcggagctagccaatccagatctccaacactccaactaaccaccacggcggcaacaataatggaggaggaggaggggcgctcgtcggcgccgttgctggaggagaagcagcagaccgcctgggtggaagggtgccccgggtgcgccgtggacaggaggaaggcggccaacccgggcatcccctacagcacgcttcatatacgtctggatcgtcaccctctgcgcagctttgccaatatcatcattgttccccttcttgtattttaagataagagacttgaatgttgctaagagaacagaaaatatctgcttctatgccggtgttgaaggagcttcatttatgtttggtacatgcttgacttcaacagcttggggaataccggcggaccgtattgggaggaaaccagttgtcatgtttggcattttctccgtggttgtgttcaatactttgtttgcgcttagtgtcagctattggatggcaattgttacacgatttttgctgggtgcttttaatggtctacttggaccagttaatg

SEQ ID NO: 30140 - protein, 65 aa, Panicum virgatum
  misc_feature: Ceres CLONE 1896978
  misc_feature: Useful for making plants with modulated flowering time
MFGTCLTSTAWGIPADRIGRKPVVMFGIFSVVVFNTLFALSVSYWMAIVTRFLLGAFNGLLGPVN

SEQ ID NO: 30141 - DNA, 1772 bp, Panicum virgatum
  misc_feature: Ceres CLONE 1897003
  misc_feature: Encodes the peptide sequence at SEQ ID NO. 30142
gtgatgtgaagaagcaccaccaggccgcagctcagagcttcctctccgccgcccgacccgatggcgccgccgctcgccggcgtggtccgcctcgccgcggcttcccgcgtgctggtcctggccctctccctcctcgcccgcctcctcttccgcccctacgacacctccgcgtcgctcgccccgccctgcctctcctcttccccctcctcctcctcctccgccgcgtccgcgaatctctccgccgccgtctcgtcgctggccgtctgggacggcgtccacttcgcccgcgccgccgagtgcgggtacgagtacgagcagtccttcgccttcctcccgctcctcccggcctccctcgcgctcctcgcccgatccctgtccgcgccgctggtgccggtgctggggtacagggccgtgctcgtgctctccgggtatgtcctcaacaatgtcgcgttcgtcgccgccgcggcctacttctacagattatccatgttgatcttgaaggaccagagagcagcttatcgagcatctgttctgttctgtttcaaccctgcttctgtattttactcgtcattgtattcggaaagtctttatgcgctgttttctcttggaggactgttctacctgttttcgggtgctaatactgttgcagtgataatgctcgctctctctggttcagctaggtccaatggagcacttaatgctggttatttctgttttcaggccttgctacaagcatatgatgctgctgttcgaaagaaaaggcccttgttggtggtgctgtctcttgtagctgcagctttgtgttccgttttcatatttctaccattctttgctttccaagcatatggatatttgaacatatgcgtacatgggagctctgaggaattgaggccatggtgcaaagcaaaagttccacttttgtatggcttcattcaaagccactactggggagttggtttcttgagatacttccaagtgaagcagctgccaaactttcttttggcctcaccagtattgtcgcttgcaatttattcaatcattcattacacaaaaatgcttcaccaacttttgcaaacaactagcattcacaggcagattatcactgctcttgaggaaaggtcaattgagtcatataaaaaaacagatgatatgacagtgttgaggagtgaactttctgctggactcactaataaagctcatggaaactctaaggttaaacagagaaaatcagttgccaccgagacagcttctgcaacgttccatgacacactgtcggctaaccaaaatatcaaagagaatcaagatgagggctccatattacttgttccatttgttttgcatctggtcttcatgacatttacagctttctttgtaatgcacgtccaggtatcaacacggtttttgtctgctactccccctatttattgggctgctgctcacattttggcttccccaaactgctccaaaagatggggctatttgatatgtgtttatttcattgcgtacattcttcttggtagtctactattctccaacttctatccattcacgtaggaaccgtggcattcctggttgcaatatccaacagtgaactgcaccacaatggatttatagtgctcatctgtttattgctttgggtgcattaactcaactagttggagctaaaggtttccgtaggtaggcgctccccaggttcagcagatatatatgtcgactcacttgtttagaacttgctatatatcagccaatgtattattcgttctacttgttgg

SEQ ID NO: 30142 - protein, 497 aa, Panicum virgatum
  misc_feature: Ceres CLONE 1897003
  misc_feature (1)..(497): Pfam Name: Mannosyl_trans2 Pfam Description: Mannosyltransferase (PIG-V))
MAPPLAGVVRLAAASRVLVLALSLLARLLFRPYDTSASLAPPCLSSSPSSSSSAASANLSAAVSSLAVWDGVHFARAAECGYEYEQSFAFLPLLPASLALLARSLSAPLVPVLGYRAVLVLSGYVLNNVAFVAAAAYFYRLSMLILKDQRAAYRASVLFCFNPASVFYSSLYSESLYALFSLGGLFYLFSGANTVAVIMLALSGSARSNGALNAGYFCFQALLQAYDAAVRKKRPLLVVLSLVAAALCSVFIFLPFFAFQAYGYLNICVHGSSEELRPWCKAKVPLLYGFIQSHYWGVGFLRYFQVKQLPNFLLASPVLSLAIYSIIHYTKMLHQLLQTTSIHRQIITALEERSIESYKKTDDMTVLRSELSAGLTNKAHGNSKVKQRKSVATETASATFHDTLSANQNIKENQDEGSILLVPFVLHLVFMTFTAFFVMHVQVSTRFLSATPPIYWAAAHILASPNCSKRWGYLICVYFIAYILLGSLLFSNFYPFT

SEQ ID NO: 30143 - DNA, 571 bp, Panicum virgatum
  misc_feature: Ceres CLONE 1897017
  misc_feature: Encodes the peptide sequence at SEQ ID NO. 30144
atctgttggttcaaaatctcccttcccattcctctttctctctctctcacccttgttggttggtttggttgggaagagccatggcgctgacgctgcgatcctccacgtcattcctgtcccccggcgagcccctctcgcagccccgccggcaggcctggatccgacaaaaccccgccaaccacctcctccacgacccatggtacccaaggacacggcgttccccttgacggagcgcgaccgcctcggcctccgcggcctgctcccgccgcgggtcatgtccctcgagcagcagtacgagcggatcataaactcgtaccggtcgttggagaagaacacgcggggcgagccggactccatcgtcgcgctggccaagtggaggatcctcaacaggctgcacgaccggaacgagacattgtacttcagggtgctaatcgacaatatcaacgatcttgcgccggtaatatacactcccactgtcggcttggtctgcgagaattacagcggcctgttcagacggcctcgtgggatgtatttcaccgcaaaggataagggggagatgatgtcgatgatt

SEQ ID NO: 30144 - protein, 124 aa, Panicum virgatum
  misc_feature: Ceres CLONE 1897017
  misc_feature (67)..(122): Pfam Name: malic Pfam Description: Malic enzyme, N-terminal domain
  misc_feature: SWISSPROT Homolog: EC 1.1.1.39 Malate dehydrogenase (decarboxylating)
MVPKDTAFPLTERDRLGLRGLLPPRVMSLEQQYERIINSYRSLEKNTRGEPDSIVALAKWRILNRLHDRNETLYFRVLIDNINDLAPVIYTPTVGLVCENYSGLFRRPRGMYFTAKDKGEMMSM

SEQ ID NO: 30145 - DNA, 726 bp, Panicum virgatum
  misc_feature: Ceres CLONE 1897018
  misc_feature: Encodes the peptide sequence at SEQ ID NO. 30146
aaaaatcttccaactctgccgagcgcctgagcccgcctccagctccccgccccttggcaccacactatagcctagtgcctactagctcgcttgctcctccctgttgtccgcaggagcagagccaaaaaacccgtcagctcggcggcaagaacggccatgaagtacgtgctggtgaccggaggggtggtgagcggcctcggcaagggcgtgacggccagcagcatcggcgtcgtgctcaaggcctgcggcctccgcgtaaccactatcaagatcgacccctacctcaacactgatgctggaaccatgtctccatttgagcatggcgaggtctttgttttggatgatggtggagaggtggacctggaccttggaaattatgaacgttttctggatatcaaattgacccgtgacaacaatataaccacaggaaaaatctatcaggctgtcattaacaaagaaagaagaggtgactacctaggaaaaaccgtccaggttgtgccacatattacagatgaaatacaagattggattgaacgcgttgcaatgaatccagttgatggcaaagaaggaccacctgatgtttgtgtcattgaacttggcggcactataggggatattgagtcaatgcctttcattgaagcattaggtcaattttcgtatcgtgttggacctggaaacttctgtttggttcatgtcagtcttgttcctgtcctaaatgtagttggt

SEQ ID NO: 30146 - protein, 189 aa, Panicum virgatum
  misc_feature: Ceres CLONE 1897018
  misc_feature (1)..(187): Pfam Name: CTP_synth_N Pfam Description: CTP synthase N-terminus
  misc_feature: SWISSPROT Homolog: EC 6.3.4.2 CTP synthase
MKYVLVTGGVVSGLGKGVTASSIGVVLKACGLRVTTIKIDPYLNTDAGTMSPFEHGEVFVLDDGGEVDLDLGNYERFLDIKLTRDNNITTGKIYQAVINKERRGDYLGKTVQVVPHITDEIQDWIERVAMNPVDGKEGPPDVCVIELGGTIGDIESMPFIEALGQFSYRVGPGNFCLVHVSLVPVLNVV

SEQ ID NO: 30147 - DNA, 477 bp, Panicum virgatum
  misc_feature: Ceres CLONE 1897021
  misc_feature: Encodes the peptide sequence at SEQ ID NO. 30148
aattcgaagttcaaacacactctactccaagctcggctagctgagcagagggtcggacatgaccaagaagctcacctccgccatggccgggaagcaggattttcgcgaggcgcaattcgatgatcaggggaggcacaggcaccagcaggcttcggttcacggaggcggcaagagcgcggcggcggggttcgggggcagattgatctcctgcccaccgccgcggcggccccggcggcggctccgcggggccggcggcagccgccccggcgcgtctccgtccgcgcctccgcggcggcggcggcggcggccccgcggcgggagacggatccccgtacgcgggtactgatcacggggatggggctggtctccctgttccggaaccacgtcgactcctactacgaccgcctgctcgccgggcagagcggcatcggccccatccaccgcttcgacgcctccaacttccccacccgcttcgcc

SEQ ID NO: 30148 - protein, 40 aa, Panicum virgatum
  misc_feature: Ceres CLONE 1897021
  misc_feature: SWISSPROT Homolog: EC 2.3.1.41 Beta-ketoacyl-acyl-carrier-protein synthase I
MGLVSLFRNHVDSYYDRLLAGQSGIGPIHRFDASNFPTRF

SEQ ID NO: 30149 - DNA, 707 bp, Panicum virgatum
  misc_feature: Ceres CLONE 1897021-R
  misc_feature: Encodes the peptide sequence at SEQ ID NO. 30150
tgtgatgcttaccatatgactgacccaagatccgatggccttggtgtttcatcatgcattaagcaaagtctcgaagatgctggtgtggcgccagaggaggtcaactatatcaattgtcatgccacatccacccttgctggtgatctggcagaggtgaatgccatcaaaaaagtctttaaggacccatctgggatcaaaataaatgcaaccaagtccatgataggacactgccttggtgcagcaggtggtttggaagccattgctaccgttaaagccataactactggatgggtgcatccaagcataaaccaatttaacccagaggaagcagttgaatttgatactgtacctaatgtaaaaaagcagcatgaagtgaatgttggtatctcaaattcctttggattcggaggtcacaattcggtggttgtatttgcgccatttaagccataaggtgttacttgcttcacaaatcttggtcagaacaacgaaggtcgttctaggaatttcgggattaaattaccatgcgttttctttgggggcagatttgttatccggcaatgttacaaatgaactgagtaatgaggtacattacattttagataactccatgttcatttagattgagagcggctgtataacgttgtttgaatcattttgtaattggttgtactctttttcccatgtaatggaaggtgtcctgtagaagc

SEQ ID NO: 30150 - protein, 149 aa, Panicum virgatum
  misc_feature: Ceres CLONE 1897021-R
  misc_feature (1)..(105): Pfam Name: Ketoacyl-synt_C Pfam Description: Beta-ketoacyl synthase, C-terminal domain
  misc_feature: SWISSPROT Homolog: EC 2.3.1.41 Beta-ketoacyl-acyl-carrier-protein synthase I
CDAYHMTDPRSDGLGVSSCIKQSLEDAGVAPEEVNYINCHATSTLAGDLAEVNAIKKVFKDPSGIKINATKSMIGHCLGAAGGLEAIATVKAITTGWVHPSINQFNPEEAVEFDTVPNVKKQHEVNVGISNSFGFGGHNSVVVFAPFKP

SEQ ID NO: 30151 - DNA, 759 bp, Panicum virgatum
  misc_feature: Ceres CLONE 1897039
  misc_feature: Encodes the peptide sequence at SEQ ID NO. 30152
  misc_feature (637)..(637): n is a, c, t, g, unknown, or other
atccagtccccaatccgtcgagaaattcctcccgagccatcgaaatcgaagcgaagcgaagcggcctcccccgatcctctcaaggttccggatcgccaccgcagctccgggaggagagacagagagatccggtcagcgccatggcgaacatcgacatggccgcgatcctggcggacctggaccgcggtgacgccgacacgcgggtgcccaagaccaagctcgtctgcacgctcggcccggcctcccgctccgtccccatgctcgagaagctgctccgagccggcatgaacgtcgcgcgcttcaacttctcccacggcacgcacgagtaccaccaggagacgctcgacaacctcaggcaggccatgcacaacaccggcatcctctgcgccgtcatgctcgacactaagggtcctgagatccgtactggatttttgaaggacggtaaaccaattaagctaaccaagggtcaagaaatcactgtcaccactgattatgatgtcaagggtgatgagaatatgatcgctatgagttacaagaaactacctgttgatgtgaagcctggaaatgtcatactgtgtgcagatggtactatctctctgactgttctctcttgtgatcctgatgctggaactgtgangatgtagtgtgaaaacactgcaatgctcggtgagagaaagaactgcaatttgcctgggaattgtgttgatcttcctacactaactgagaagataaagaggacattttgggatggggcgttcc

SEQ ID NO: 30152 - protein, 167 aa, Panicum virgatum
  misc_feature: Ceres CLONE 1897039
  misc_feature (22)..(167): Pfam Name: PK Pfam Description: Pyruvate kinase, barrel domain
  misc_feature: SWISSPROT Homolog: EC 2.7.1.40 Pyruvate kinase
  misc_feature (166)..(166): Xaa is any aa, unknown, or other
MANIDMAAILADLDRGDADTRVPKTKLVCTLGPASRSVPMLEKLLRAGMNVARFNFSHGTHEYHQETLDNLRQAMHNTGILCAVMLDTKGPEIRTGFLKDGKPIKLTKGQEITVTTDYDVKGDENMIAMSYKKLPVDVKPGNVILCADGTISLTVLSCDPDAGTVXM

SEQ ID NO: 30153 - DNA, 1615 bp, Panicum virgatum
  misc_feature: Ceres CLONE 1897067
  misc_feature: Encodes the peptide sequence at SEQ ID NO. 30154
ctctctctcaccacgtgcggcacgcccagcgcctgtcaccaacccgctcacctcccagtcctcccagtccaacacctcgcgcgcccaggtctgaatcctctccctcgccatcgccatggcgcgcaagaagatccgggagtacgactccaagcgcctcctcaaggagaacctcaagcgcctcgccggcatcgacctcaccatcctctccgcccagatcacacaatcaacagactttgcagagcttgtgagccagcagccatggctgtcaaccacaaagttggtcgtgaagcccgatatgctgtttgggaagcgtggcaagagtggcctggtggccctcaaccttgattttgatcaagtcaaggagtttgtgaaggagcggttgggagtcgagattgagatgggtggctgcaaggctccaatcacgaccttcattgttgaaccatttgtgccccatgatcaagagtattacctatcgattgtgtcagagaggctgggcagcaccatcagcttctcagagtgtggtgggattgagatcgaggagaactgggacaaggttaagacggtttttcttccaactgagaagccaatgacaccagacgcatgtgctcccttgatcgccacccttccattggaggcacgcggaaaaattggtgacttcatcaaaggagtgtttgctgtcttccaagacctggacttctcatttatggagatgaacccatttaccatggtgaatggggagccatatcctctggacatgagaggagaactagatgatacagcagctttcaaaaacttcaagaagtggggagctattgaattccctctaccatttggaagagtactgagccctacagaaagtttcatccatgaactagatgagaagacaagtgcctctctgaagtttacagttttgaacccaaagggacgcatctggacaatggttgctggaggtggtgctagtgtcatatacgctgatactgttggagatttggggtatgcttcagagcttggaaactatgcagagtatagtggtgctcccaacgaggaggaggttctgcattatgctagagtcgtacttgattgtgcgactgctgatcccgatgatcgtaagagggcacttctcattggaggtggcattgctaactttactgatgtggctgccacattcaatggcatcatccgggccttaagagagaaggaatccaagttgaaggcttcaaggatgcacatttatgttcgcagaggtggcccgaattaccaatctggactggctaaaatgcgtaaacttggtgcagagcttggcattccaattgaggtgtatgggccagaagcgacgatgacaggaatctgcaaacaagcaattgaatgcatcatggctgcagcataattgggatctgcaaacgcgaaattgaatgtgtcatagactcggccataaatgagggatggagagtgtagttgcagtagttcacccacacagggttgttccctttttgttgcagatatgttgtagcgtggagttgtttgacggtatctttatagatcattactgcaacaaaatcactgttgtgatgcaataattccgaggtctagtttcgtatccagttgttttgtgagc

SEQ ID NO: 30154 - protein, 423 aa, Panicum virgatum
  misc_feature: Ceres CLONE 1897067
  misc_feature (5)..(204): Pfam Name: ATP-grasp_2 Pfam Description: ATP-grasp domain
  misc_feature: SWISSPROT Homolog: EC 2.3.3.8 ATP citrate synthase
  misc_feature: Useful for making plants with modulated root development
MARKKIREYDSKRLLKENLKRLAGIDLTILSAQITQSTDFAELVSQQPWLSTTKLVVKPDMLFGKRGKSGLVALNLDFDQVKEFVKERLGVEIEMGGCKAPITTFIVEPFVPHDQEYYLSIVSERLGSTISFSECGGIEIEENWDKVKTVFLPTEKPMTPDACAPLIATLPLEARGKIGDFIKGVFAVFQDLDFSFMEMNPFTMVNGEPYPLDMRGELDDTAAFKNFKKWGAIEFPLPFGRVLSPTESFIHELDEKTSASLKFTVLNPKGRIWTMVAGGGASVIYADTVGDLGYASELGNYAEYSGAPNEEEVLHYARVVLDCATADPDDRKRALLIGGGIANFTDVAATFNGIIRALREKESKLKASRMHIYVRRGGPNYQSGLAKMRKLGAELGIPIEVYGPEATMTGICKQAIECIMAAA

SEQ ID NO: 30155 - DNA, 759 bp, Panicum virgatum
  misc_feature: Ceres CLONE 1897080
  misc_feature: Encodes the peptide sequence at SEQ ID NO. 30156
accacttcactcttcgccggcactcggtggagcggtggggctcggggcggaggtcggcggccatgtacaagaaccagctgcaggagctggcgcagcggagctgcttcaacctcccggcgtacacgtgcctgcgggaggggccggaccatgcgccgcggttcaaggcggcggtgaacttcaacggggagcagttcgagagccccgggttcttcaccacgctccgccaggcggagcacgccgccgcggaggtcgcgctcgcggcgcttgcgcagcgcggcccgtcctactcgctcgccgcccgcatcctggatgaaacaggggtttataagaaccttctacaggaagtagctcagagagttggagcgccgttgccttcatatacaacagagcgatctggccttggccacttgctggttttcacatgcacagtagagctcgctggtatcacatttacaggtgatcctgctaagaataagaaacaggctgagaaaaatgcggcttcagcggcatggtctgcactgaaacaactggtacgtgatgaagcgaattcatccaatgaaccggaaaataatgatgagcaagagcagatcaggattgctcgagcccttctcaattatcgcttgaaggagaagatggcaatggccaattatccccatgcttcgccattccccaagaagtttcctaggcagccagagaggaagccttcttttttggcaccttccagtccagctactcgaagatcctccctctattccgccc

SEQ ID NO: 30156 - protein, 232 aa, Panicum virgatum
  misc_feature: Ceres CLONE 1897080
  misc_feature (2)..(68): Pfam Name: dsrm Pfam Description: Double-stranded RNA binding motif
  misc_feature (88)..(153): Pfam Name: dsrm Pfam Description: Double-stranded RNA binding motif
MYKNQLQELAQRSCFNLPAYTCLREGPDHAPRFKAAVNFNGEQFESPGFFTTLRQAEHAAAEVALAALAQRGPSYSLAARILDETGVYKNLLQEVAQRVGAPLPSYTTERSGLGHLLVFTCTVELAGITFTGDPAKNKKQAEKNAASAAWSALKQLVRDEANSSNEPENNDEQEQIRIARALLNYRLKEKMAMANYPHASPFPKKFPRQPERKPSFLAPSSPATRRSSLYSA

SEQ ID NO: 30157 - DNA, 701 bp, Panicum virgatum
  misc_feature: Ceres CLONE 1897086
  misc_feature: Encodes the peptide sequence at SEQ ID NO. 30158
gatgagtgtcattcttgagcttcctggaggaggacgccgtgcacactgtaaaggtgcttcagaaatagtcttggctgcttgtgataagttcatagatgatacaggtagtgttcatcctctggataaaacaaccgctgacaagctcaatggtattattgatagttttgctggtgaagctctaaggacattgtgccttgcttatagggaaatggaagaaggtttttccatcctagatcatataccatcacaagggtacacatgcattggagttgtaggtatcaaagatcctgtccgtccaggtgtgagggagtctgttgctacttgccaggctgccggaattatggtgagaatggtcacaggagataacataaatacagcaaaggcgatcgctcgtgaatgtggtatacttactgaagaaggcatagctattgaaggaccagaattcagagagaaaagcctagatgaactccttaagctggttccaaaaatccaggtaatggcccgatcatcaccactcgacaagcatacacttgtaaagcatttgcgcacaacattcaacgatgttgttgctgttactggtgatggcacaaatgacgctcctgcattgcatgaagcagatattggactcgcaatgggcattgcagggactgaggtggcaaaagagagtgctgatattataattctagatgacaacttctcta

SEQ ID NO: 30158 - protein, 233 aa, Panicum virgatum
  misc_feature: Ceres CLONE 1897086
  misc_feature (22)..(215): Pfam Name: Hydrolase Pfam Description: haloacid dehalogenase-like hydrolase
  misc_feature: SWISSPROT Homolog: EC 3.6.3.8 Calcium-transporting ATPase
MSVILELPGGGRRAHCKGASEIVLAACDKFIDDTGSVHPLDKTTADKLNGIIDSFAGEALRTLCLAYREMEEGFSILDHIPSQGYTCIGVVGIKDPVRPGVRESVATCQAAGIMVRMVTGDNINTAKAIARECGILTEEGIAIEGPEFREKSLDELLKLVPKIQVMARSSPLDKHTLVKHLRTTFNDVVAVTGDGTNDAPALHEADIGLAMGIAGTEVAKESADIIILDDNFS

SEQ ID NO: 30159 - DNA, 1520 bp, Panicum virgatum
  misc_feature: Ceres CLONE 1897088
  misc_feature: Encodes the peptide sequence at SEQ ID NO. 30160
agagtcagaagagaccctgcttcccaaaccaccgggcgagcgagatcgtcgtgggcggcactcgctctcgcgcgcggtgaggcggcgctatcagagcggactccgcctcaaaaccccaccaggtaggtctgctgcactctcaccgcaaccatggccgcggccgccgggctcagccgccgctgcaccgtccgcggacaagtcgcgctttcgccttccgggagcaaccgtcttcgcccggccctggtgttgtagaagaggaaaggttagggggagggggagaggtaaggtgagcggcaatgggggcgattgggggtgatgagctggtgcagtgggataagatggctggaccggaggcggttaatggaggcggaggaggtgcggggaggatggacaggatacaggtgctggtcaggctgaggccgctgagcgagaaggaggttgcgaggggggaacctgcggagtgggagtgcatcaatgacaccaccgtcatgttccggagcaccttcccggaccgaccaacagccccgacggcgtacacatttgatcgggtttttcattctgactgcagcaccaaggaagtctacgatgaaggggttagggaagttgctctattagtagtcagtggcattaactcaagtatttttgcgtatggacaaacaagtagcggaaagacatataccatgaccggagtaacagagtatacagtagcagacatatatgattacattagtaagcatgaagagagagcatttgttctaaagttctcagcaatcgaaatatataatgaagttgtaagggatcttcttagcgcggaaaatactcctcttagactctgggacgatgcagagaagggcacctatgtggagaatcttactgaggttgtattaagggactggaaccacctcaaggggcttatttctgtctgcgaagctcaaagaaggacaggggagacctttttaaatgaaaaaagctccagatctcatcagatactgagattgacagttgaaagttctgctcgggagttcctagggaaggacaagtcaaccacacttgttgctagtgccaactttgttgatttggcaggaagtgagcgtgcatctcaggcattgtctgctggcacaagactaaaagaaggttgtcatattaacagaagtttgcttgccctcggcactgtcattaggaaactaagcatggggagtaatgcacatataccgtatagagattcaaagctcacacgcatattacaaccatctttgggaggtaatacaagaaccgccatcatttgtacactaagcccggccactagtcatattgagcaatcaagaaataccctattatttgggagctgtgcaaaggaagtagttacaaatgcccaagtcaatgtggtcatgtctgataaagcgctagttaaacatttgcaaaaggaagttgctagattggagaatgagttgcggcaaccagcttcaaattccagtcttgaagcattagtaaaggaaaaggacaaccaaatcagaaagatg

SEQ ID NO: 30160 - protein, 407 aa, Panicum virgatum
  misc_feature: Ceres CLONE 1897088
  misc_feature (39)..(356): Pfam Name: Kinesin Pfam Description: Kinesin motor domain
MGAIGGDELVQWDKMAGPEAVNGGGGGAGRMDRIQVLVRLRPLSEKEVARGEPAEWECINDTTVMFRSTFPDRPTAPTAYTFDRVFHSDCSTKEVYDEGVREVALLVVSGINSSIFAYGQTSSGKTYTMTGVTEYTVADIYDYISKHEERAFVLKFSAIEIYNEVVRDLLSAENTPLRLWDDAEKGTYVENLTEVVLRDWNHLKGLISVCEAQRRTGETFLNEKSSRSHQILRLTVESSAREFLGKDKSTTLVASANFVDLAGSERASQALSAGTRLKEGCHINRSLLALGTVIRKLSMGSNAHIPYRDSKLTRILQPSLGGNTRTAIICTLSPATSHIEQSRNTLLFGSCAKEVVTNAQVNVVMSDKALVKHLQKEVARLENELRQPASNSSLEALVKEKDNQIRK

SEQ ID NO: 30161 - DNA, 681 bp, Panicum virgatum
  misc_feature: Ceres CLONE 1897102
  misc_feature: Encodes the peptide sequence at SEQ ID NO. 30162
cccaccagccacccttctctccttcccgtcctcctccgcatctcccttttagcatccccccctcccaccatctcctcgccgccgctgacgaccgccgccgccgcgaaccctcgcgaatcgtcgtcctccgggttgtgggggcacgcatggcgctccggaggctgctgcatgggagcgtcctgccgcgggtgtccggccgggcctttgccccggccgtggcgcccttctccacggaggctggggagaccgtccgcgccacgctcttcccgggtgacggcatcgggcctgagatcgccgagtccgtcaagcaggtattcaatgttgcaggtgtaccaatagaatgggaagaacattatgttggcacagaagttgaccccagaacggagagtttcttgacatgggaaagcctggagtctgtgcgtagaaacaaagttggcttgaaaggacctatggctacaccaattggaaagggccatcgatctttgaatcttacattaaggaaagagcttggtctttatgccaatgtcagaccttgcaacagcctcccaggctacaagaccagatacgatgatgttaaccttgtgacaattcgtgaaaatactgaaggagaatatagtggtcttgagcatcaggttgtgagaggtgttgttgaaagtttgaaaatcatcacccgccaagcaa

SEQ ID NO: 30162 - protein, 178 aa, Panicum virgatum
  misc_feature: Ceres CLONE 1897102
  misc_feature (36)..(178): Pfam Name: Iso_dh Pfam Description: Isocitrate/isopropylmalate dehydrogenase
  misc_feature: SWISSPROT Homolog: EC 1.1.1.85 3-isopropylmalate dehydrogenase
MALRRLLHGSVLPRVSGRAFAPAVAPFSTEAGETVRATLFPGDGIGPEIAESVKQVFNVAGVPIEWEEHYVGTEVDPRTESFLTWESLESVRRNKVGLKGPMATPIGKGHRSLNLTLRKELGLYANVRPCNSLPGYKTRYDDVNLVTIRENTEGEYSGLEHQVVRGVVESLKIITRQA

SEQ ID NO: 30163 - DNA, 1525 bp, Panicum virgatum
  misc_feature: Ceres CLONE 1897119
  misc_feature: Encodes the peptide sequence at SEQ ID NO. 30164
atgcataccgagagcgaggaaccagagagagaggtggccccaccttccccacgcctcagtgagcctgcgcgcgatctctttctccgccgccgcatccgatctcgatccccccccccccccctccccgacgcggcgagtcctccggtcagcgccgctgcctcctcccctctcctgccgccgccgtcgccgccatgaactatatcattggagcattcaagccaccatgtgacatctcgattacattctctgatgcgaggaccaggaagcaggtttctgttaagaaggacaatgggaagacaacaatggtccctgttttccagagcctggaaacaatctctggagaagtatcgatagcaccagtcccaggtaaaaggattgaacacatgggtgttaagatcgagttgctgggccaaatagagctgtattttgaccgagggaacttctatgacttcacttcattagtgcgcgagttggaagttcctggtgaaatctatgaaagaaagacatacccatttgagttttcaactgttgaaatgccatacgagtcttacaatgggacaaatgtcagactgaggtacattttgaaggtgactattggcagaaactatgttgggaatattgtggaataccgggatttctgtgtaagaaactactctcctgtccctacaatcaataatagtattaagatggaagttggaattgaggattgcttacatattgagtttgagtacagcaaaagcaaatatcatctcaatgatgtgattattgggaagatatacttccttcttgttagaataaagataaaaaatatggagctggagattcggcgtagggagtcaacagggtcaggctctaacacatatgttgaaactgagactcttgctaagtttgagctgatggatggtgctcctgtcagaggtgagtctattccagtgaggctgttcctgacgccttatgagctgacaccaacttaccgcaacataaacaacaaattcagcgtcaaatactacctgaatctggtccttgtggatgaggaagataggaggtacttcaagcagcaagagatcacaatgtaccgtctcctagaatctgccccgtcttcctagatcctggcctggagcagcatgatgtttacctctcaggttttgtataattgagtgctgaggttagagcgacgttgtgttacctgtatataactccagaagagcgccgctgttgactgctgctatggccatgcatgctgtcgtgttgtttgtgttcttttttttttcctgctccttaccttgctttaccttgcttatggtctatggcaccgtggttagctgggggtgctagtgaatcacctgcctctatttacttaccattctcgtgaggcttctacaagaatcatgtttgatctgtcgatatttttctgcgggatgttagtttagtctgacagtaatgtaatatgttttggtaagttgaacaatgtagaatttacttggattgccctgttaggtagcagattgtttgtgtttccctcatc

SEQ ID NO: 30164 - protein, 304 aa, Panicum virgatum
  misc_feature: Ceres CLONE 1897119
  misc_feature (8)..(283): Pfam Name: Vps26 Pfam Description: Vacuolar protein sorting-associated protein 26
MNYIIGAFKPPCDISITFSDARTRKQVSVKKDNGKTTMVPVFQSLETISGEVSIAPVPGKRIEHMGVKIELLGQIELYFDRGNFYDFTSLVRELEVPGEIYERKTYPFEFSTVEMPYESYNGTNVRLRYILKVTIGRNYVGNIVEYRDFCVRNYSPVPTINNSIKMEVGIEDCLHIEFEYSKSKYHLNDVIIGKIYFLLVRIKIKNMELEIRRRESTGSGSNTYVETETLAKFELMDGAPVRGESIPVRLFLTPYELTPTYRNINNKFSVKYYLNLVLVDEEDRRYFKQQEITMYRLLESAPSS

SEQ ID NO: 30165 - DNA, 1781 bp, Panicum virgatum
  misc_feature: Ceres CLONE 1897122
  misc_feature: Encodes the peptide sequence at SEQ ID NO. 30166
gcagagaagaaaaaaaaaaagaggaagctttattctctcatcaccgcccctctactcgcgagatcgagatcgacaagacaacacagcagctgcatcagggggagcgacaggcggttggtggccgcgtcgatcggccgctccccatggtcggccccaagcccaaggccaaccggatgtgcaaatccaagagcgccatcgccaccaccgcctcctcgaccacggccgccgccgccgccaccccgaggaaccaccgctcgccgcgcacgaccgccaccagctcctaccccgctgcctactcctactccacctcctcctccaccgcctcctcctccgcggcctccctcgccgcgctccgcgattccctcccggagctgccgctcctcttcaccttcaacgacctcgccaccgccaccgccaaattctcctcctcgcaccgcctcgttcccgccgctccctcctcctcaaattccttccgctgctccctccggggccacccggccgcggtcttccgccgcccgctcagccgcgacccgcgcgaggtcaccgcgcgcctcgccgtcctcgggcactgccaccacgccgccatcgcgcgcctcctcggcgccgccgcgtcgctcgaccgcaccacgctcttcctcgcctacgagctcgtccccgacgccgccccgctctccgcgctgctccggaaccccaagaacccctccttcaccccgctcgccacctggcactcgcgcctccagctcgccgccgacgtctgcgacgcgctctactacgtccacctccaggcggacaccatccacaaccgcctctgcgcgtcctccgtcctcgtctgcggcgacgggcccctcccccgcgccaagatcgcccatttcggcgccgccgacctcgccggcgagctcccggtccaacagaaagacggcggccgccgcgggaggcgcatcgagggcaagcgcgggtacatggcgccggagctggtggcgggcggcccgccgtcgcggtgctccgacgtgttcgcgctgggcgtggtgctgctggagctggtgtccgggcaggagccggtgcggtacgagatggtgaaccggggcacgggcgagtacgagaggacgtcgctgatcgagacggcagaggccgcggcggcggagggcggcggggaggggatgcgccggtgggtggaccgcaggctgagggactcgttccccgtggacgcggcggagtcgctcaccgcgctggcgctgcggtgcgtggccaaggaccccctggcgcggccggacatgtcgtgggtggccgccaaggtctccaagctcttcctggaggcgcaggagtgggcggccaggttccgtgtccccaccgacatctccatctccatcgcccccaggtgatggcagccattgctgctccacgccggcgacggcagccaaggggaagggattttgctgatccttgccatgattagcgagtgctagagttgagatactttttttttttagggattgcactccaactgatcgattgctaatctttctgggaggagtttaggggttacatactagtaccggtgctttgttttttcctcttgttcttattgttgatgtacacaggagcatgcagtaagtatctgcacatactagtaggtatacatgtacagacagacattcagcagccttggctggcaaaaatcttgtgcaattaggcaggctatgattaggcagatggacacgttaccgatggaagaagaaatccttcccggagacatagaatgcatggattaattgggtttggtc

SEQ ID NO: 30166 - protein, 411 aa, Panicum virgatum
  misc_feature: Ceres CLONE 1897122
  misc_feature (110)..(384): Pfam Name: Pkinase_Tyr Pfam Description: Protein tyrosine kinase
  misc_feature: SWISSPROT Homolog: EC 2.7.11.1 Non-specific serine/threonine protein kinase
MVGPKPKANRMCKSKSAIATTASSTTAAAAATPRNHRSPRTTATSSYPAAYSYSTSSSTASSSAASLAALRDSLPELPLLFTFNDLATATAKFSSSHRLVPAAPSSSNSFRCSLRGHPAAVFRRPLSRDPREVTARLAVLGHCHHAAIARLLGAAASLDRTTLFLAYELVPDAAPLSALLRNPKNPSFTPLATWHSRLQLAADVCDALYYVHLQADTIHNRLCASSVLVCGDGPLPRAKIAHFGAADLAGELPVQQKDGGRRGRRIEGKRGYMAPELVAGGPPSRCSDVFALGVVLLELVSGQEPVRYEMVNRGTGEYERTSLIETAEAAAAEGGGEGMRRWVDRRLRDSFPVDAAESLTALALRCVAKDPLARPDMSWVAAKVSKLFLEAQEWAARFRVPTDISISIAPR

SEQ ID NO: 30167 - DNA, 696 bp, Panicum virgatum
  misc_feature: Ceres CLONE 1897127
  misc_feature: Encodes the peptide sequence at SEQ ID NO. 30168
aaaaagcttaagttgagagcgctcgcgcgaaaccagccgagaggtctcgagaagcagtagccagattcccaagccactcccccccactctgctcgtctctgaattttcctccctcgcggggattttccccgggattcattccttgcccagcccggaacggcggcgctcacgaggggaaagaaaagctccaattttcccctgccgagctctcttccgattcccactatcttgagcagcctgcgcgcggccggccagcctcgccgcgggagtttttctgggctttttcctcggccagaattagccattccctggagctaaaggccgagctcggccggggctaaacttcgcatcttctccgcggcggccgcgggggaattcattcttctccccgtcagtcgctgccgtatcgccggcggggcggcatggggctcggcttggtggcgcacctggtgcgcctgggcgtgctgggctccacctccgaccacgcctcggtggtgtccatcaacctgttcgtggcgctgctctgcgcctgcatcgtcctcggccacctcctcgaggagaaccggtgggtcaacgagtccatcaccgcgctcatcatcgggctgtgcaccggcgtggtgatcctgctgacgaccaaggggaagagctcgcacatcctcgtcttcagcgaggacctcttcttcatctacctcctgc

SEQ ID NO: 30168 - protein, 91 aa, Panicum virgatum
  misc_feature: Ceres CLONE 1897127
  misc_feature: The sequence is a functional homolog of SEQ ID NO 2 in US patent 7250560
  misc_feature: Useful for making plants with modulated water use efficiency
  misc_feature: The sequence is a functional homolog of SEQ ID NO 2 in US patent 7041875
  misc_feature: Useful for making plants with modulated drought sensitivity
  misc_feature: The sequence is a functional homolog of SEQ ID NO 4 in US patent 7250560
  misc_feature: The sequence is a functional homolog of SEQ ID NO 4 in US patent 7256326
MGLGLVAHLVRLGVLGSTSDHASVVSINLFVALLCACIVLGHLLEENRWVNESITALIIGLCTGVVILLTTKGKSSHILVFSEDLFFIYLL

SEQ ID NO: 30169 - DNA, 2488 bp, Panicum virgatum
  misc_feature: Ceres CLONE 1897149
  misc_feature: Encodes the peptide sequence at SEQ ID NO. 30170
agttgcagccaccagccgctcttctcggcaggagcggaagcggaggcctcccggctcccaccaccaccacccaggggactcgccacttccatcccccctccctctcgccgcgcgagttccccctacccacccccaccaaccggatggagcgcgcacgccgcctcgcaagccgcgcgctgctgcgccgcctgctggcggcggccgggtccaccacgcccccggtcccgtcccgcgccatctccaccctggcgcccgcgccggcggggaagcagcgcccgcgcgcgcggggcgcgcaccagcacgcgcaggaccggcaggtgtcggcgtcggcgctgaagccgagcgacaccttcccgcggaggcacaactccgccacgcccaccgagcaggccgccatggcgtccgcctgcgggttcagcaccgtcgacgcgctcatcgacgccaccgtcccggccgccatccgcgcgccgccgatgcacttcgccggcaagttcgaccaagggttcaccgagtcccagatgatcgaccacatgcagcgcctcgcgtccatgaacaaggcctacaagtccttcctcgggatgggctactacggcacccacgtcccggcggtgatactgcgcaacctcatggagaaccccgcctggtacacccagtacacgccgtaccaggccgagatcgcgcagggccgcctcgagtccctgctcaacttccagaccatggtcgcggacctcaccagcctccccatgtccaacgcatctttgcttgacgaggccaccgccgctgccgaggccatggctatgtgcctcggcatcgtgaggggcaagaagaagaccttcctcatcgcctccaactgccacccgcagaccatcgacgtctgccagacgcgcgccgccgggttcgacatcaaagtcgtcgtcgcggacgccaaggacttcgactacagcagcggcgacgtgtgcggcgtgctcgtgcagtaccccggcacggagggcgaggtgctcgactacgccgagttcgtcaaggacgcgcacgcccacggcgtcaaggtggtcatggccaccgacctgctcgcgctcaccacgctgcgcccgcccggcgagattggcgccgacatcgccgtgggctccgcccaacggttcggcgtgcccatgggttacgaaggcccgcacgccgcgttcctcgccacgtcgcaggagtacaagcggctcatgcccggccgtatcatcggagttagcgtcgattccaccgggaagcccgcgcttcgcatggcgatgcagacccgggagcagcacatccgccgggacaaggccaccagcaacatctgcactgcccaggccttgctcgccaacatggctgccatgtatgctgtctaccatggtcctgcggggctgaaagcgatcgctgaccgggttcatggcctggctgctaccttcgcccatgggctgaagaagctcgggacagtgacggtgcaggatctgccgttctttgatacagtcaaggtcacgtgtcctgatgcgagtgcaattgccaaggaagctgtcgaaaacgagatgaaccttcgggttgtcgatgcgaacacgataactgtagcgtttgatgagaccaccaccttggaggatgttgacaagctgtttaaggtgttcaacaatggcaaaccagcgagctttaccgctgaatcccttgcaccagaggtctcaagctcaattcctagcagccttgctcgtgagagcccctacctaacgcatccaatcttcagcatgtaccacacagagcacgagcttctccgttacctgcataagttgcagtccaaggatctctcactgtgccacagtatgatccctctcggttcttgcacgatgaaactaaatgctactgctgagatgatgcctgtcacatatcccaactttgcgaacctgcacccatttgcccctactgatcaggctgcaggctatcatgaaatgtttgccgacttgggcgatctgttatgcaagatcacaggatttgattctttctcattgcaaccgaatgctggtgctgcaggagagtatgctggattaatggttatccgtgcgtaccacaagtcaagaggagaccaccaccgtgatgtctgcatcattcctgtctcagcacacggtacaaatcctgcaagtgctgctatggttggaatgaagattgttgctgttggaactgattccaaaggtaacataaacattgaggaattgaggaaagctgcggaagcaaacaaggacaacttgtctactctgatggttacctacccttcaactcacggagtctatgaagaaggcattgatgagatatgcaggatcattcatgataatggcgggcaggtgtacatggacggagctaacatgaatgctcaggttgggttaacaagtcctggttttattggagctgatgtttgccaccttaaccttcacaagacattttgcattccacatggtggaggtggtcctggaatgggacctat

SEQ ID NO: 30170 - protein, 781 aa, Panicum virgatum
  misc_feature: Ceres CLONE 1897149
  misc_feature (72)..(500): Pfam Name: GDC-P Pfam Description: Glycine cleavage system P-protein
  misc_feature: SWISSPROT Homolog: EC 1.4.4.2 Glycine dehydrogenase (decarboxylating)
MERARRLASRALLRRLLAAAGSTTPPVPSRAISTLAPAPAGKQRPRARGAHQHAQDRQVSASALKPSDTFPRRHNSATPTEQAAMASACGFSTVDALIDATVPAAIRAPPMHFAGKFDQGFTESQMIDHMQRLASMNKAYKSFLGMGYYGTHVPAVILRNLMENPAWYTQYTPYQAEIAQGRLESLLNFQTMVADLTSLPMSNASLLDEATAAAEAMAMCLGIVRGKKKTFLIASNCHPQTIDVCQTRAAGFDIKVVVADAKDFDYSSGDVCGVLVQYPGTEGEVLDYAEFVKDAHAHGVKVVMATDLLALTTLRPPGEIGADIAVGSAQRFGVPMGYEGPHAAFLATSQEYKRLMPGRIIGVSVDSTGKPALRMAMQTREQHIRRDKATSNICTAQALLANMAAMYAVYHGPAGLKAIADRVHGLAATFAHGLKKLGTVTVQDLPFFDTVKVTCPDASAIAKEAVENEMNLRVVDANTITVAFDETTTLEDVDKLFKVFNNGKPASFTAESLAPEVSSSIPSSLARESPYLTHPIFSMYHTEHELLRYLHKLQSKDLSLCHSMIPLGSCTMKLNATAEMMPVTYPNFANLHPFAPTDQAAGYHEMFADLGDLLCKITGFDSFSLQPNAGAAGEYAGLMVIRAYHKSRGDHHRDVCIIPVSAHGTNPASAAMVGMKIVAVGTDSKGNINIEELRKAAEANKDNLSTLMVTYPSTHGVYEEGIDEICRIIHDNGGQVYMDGANMNAQVGLTSPGFIGADVCHLNLHKTFCIPHGGGGPGMGP

SEQ ID NO: 30171 - DNA, 192 bp, Panicum virgatum
  misc_feature: Ceres CLONE 1897149-R
tgtgaaacagcctcaagaaactgtaatgcttgcttcctgtaggcgggaagcatcctctcctcttcgtcctttctgcaatgtaaatattacatactagcgcatagcaggtcctgctcccccccacagctgccatcttgtaattctgtacttcattgcctctccattgccattttaaaatcaaatttagctttt

SEQ ID NO: 30172 - DNA, 638 bp, Panicum virgatum
  misc_feature: Ceres CLONE 1897182
  misc_feature: Encodes the peptide sequence at SEQ ID NO. 30173
gaggaggcctaatcactctcgcttcggcttcggcttcggctctgcttcctctccgggcgggggaagggaggagaggcgacctgctccatcgatctcctcctcggtctactaagcggaatttcttatttttggtgagaatgaagcgcatgcacagaatgccaacgaggaagtcccactcatggtggtgggacagtcacattagccccaagaactccaaatggttagctgagaatttggaagagatggataagcaagttaaagagatgctgaagctcatagaggatgaaggtgattcttttgcaaagaaggctgagatgtattaccaaagacggcctttgcttgtaacccatgttgagaacttctatcgcatgtaccgtgcacttgctgagcgttatgacaacgtgactggggaattgcgcaagaatcttccatcatctctgcagtctcaaggctctggtatatctgaaactgattccgagacgcaatcaatttccccatctccagagcctaacatggaacagaagacaccaaaacagaagcgcaaagcaagagcagttggctttgatgtgttccttggttctggtggaagctcagacatttcgaagaagggtagtgaaggatcattgtcttcgtcttct

SEQ ID NO: 30173 - protein, 166 aa, Panicum virgatum
  misc_feature: Ceres CLONE 1897182
  misc_feature (14)..(87): Pfam Name: KIP1 Pfam Description: KIP1-like protein
MKRMHRMPTRKSHSWWWDSHISPKNSKWLAENLEEMDKQVKEMLKLIEDEGDSFAKKAEMYYQRRPLLVTHVENFYRMYRALAERYDNVTGELRKNLPSSLQSQGSGISETDSETQSISPSPEPNMEQKTPKQKRKARAVGFDVFLGSGGSSDISKKGSEGSLSSS

SEQ ID NO: 30174 - DNA, 637 bp, Panicum virgatum
  misc_feature: Ceres CLONE 1897202
  misc_feature: Encodes the peptide sequence at SEQ ID NO. 30175
aaccgaagcggcagcagcagcaatggcggcctccatgatctcgtcgtcagctctggcggcaccggccagggcccagggcctgccgtccctcggccgccgcgcgtcctccttcgccgtcgtctgcggcaccggcaagaagatcaagaccgacaagcccttcgggattggaggtggcctcaccgtcgaccacgatgcctccgggaggaaggtcaagggcaagggcgtgtaccagttcgtcgacaagtacggcgccaacgtcgacggatacagcccaatctacaaagaggaggactggtctcccaccggtgacgtctacgtcggtggaaccaccggacttctgatctgggccgtcaccctcatcgggctccttgccggcggcgccctccttgtttacaacaccagcgccctcgccatctaacaacattattcatgcatagtccatgaaagcgcttgcggccggtccatgtataagatttatcatcagcccgggtgtctgtgtgtaatctagcctgcagcttcgatgcccaatataatgcttggttcatgcaaaaattctctctctccctactgctccgcgctctgcaacatgcaaagcgttgacgtcgcactcgcaacctccccagctccggatccaagc

SEQ ID NO: 30175 - protein, 131 aa, Panicum virgatum
  misc_feature: Ceres CLONE 1897202
  misc_feature (35)..(131): Pfam Name: PsbR Pfam Description: Photosystem II 10 kDa polypeptide PsbR
MAASMISSSALAAPARAQGLPSLGRRASSFAVVCGTGKKIKTDKPFGIGGGLTVDHDASGRKVKGKGVYQFVDKYGANVDGYSPIYKEEDWSPTGDVYVGGTTGLLIWAVTLIGLLAGGALLVYNTSALAI

SEQ ID NO: 30176 - DNA, 2785 bp, Panicum virgatum
  misc_feature: Ceres CLONE 1897210
  misc_feature: Encodes the peptide sequence at SEQ ID NO. 30177
acaacattcccttcccttccttgtatccgccgtcgtcccttccgtaaacaacagaggaaaggaaggcctcgccctccccttccctaatccgggcccctaatcctcctcctcctctcccgcagcgtcgtcccgggttcttgggctcccaggggtttctccttcctcttcctcctctctgggtgcttctggctggggtttaggtggcgccgcgccgcgccggcctcttggcttctttcctttccgggtcccgcgcaaagtttggatcttgccgggtcaattggagctgccgccagaggaggcgagggggctcttgggactcgatggtctgaacagggattccgctttggcacagaagctttcctctgtacatgtgcaacttcgtgtggctcttccgcgtaatctggcggatcttcagcgtcgccttctgacgctccacgccatggtcttcacttcgccgccgccggcggccttgccactggattgagcctcttctcgtgggggaaatttgcccgcgtccttcgtcagtgttcttctggagagttcggctcaagagcgtggaggatagaaaattaaaaagaaaagaaagctgcaaccttgctgcctttgatctcaaggaacccagcggccggctcattgatgtagtgcggtgtcctctgtactgggctttgaagcagcagctgccgctccgggatggcctgccagaaactgggttccagagcagatgtgttcaggaagcaagggcaggaatggtattgcacatctggtcttcctagtgatataactgtggtagttggggagcagtctttccatcttcacaagtttcctctattgtcaaaaagtggcctgttggagaggcgtatcagagagaaaattgataagggggaagatagttgggttgttgatctatctgatatccctggtggagcaaaggcttttgaactagctgctaagttttgctatggtgtaaagtttgaaatgactgcatccaatgtcgtacaccttcgttgtgcttctgattatcttgaaatgacagaagagatatctgagggaaatttaattgcacagacagtgaacttccttacccaaacagtgctcaggagctggaaagactcggtcaaggcgcttcaaacttgtgatgacgtccttgatattgccgaaagattgcaaattgtaaagaggtgtgtggactccattgcaactagatcatgcagtgatcctgatttattcggttggccagtagcccagtatggaggccccatgcagagtcctggagggagcctcttgtggaatggtattagcacaggggcaaggcccagaaatagcagcccagattggtggtatgatgacgtctcatgcttaagccttcccttatacaaaaaactcatctcagccatggagtatcggggcatcaatcaggagattatcgttggatcccttaaccattatgcaaaaaggcgtttgcctggtttgaatcggcgtaaaagcatcagtgatgccagtaactgtctttctataacaagtttaacatccatcccctctgaagatgaccagaagtatcttcttgaggagatcgatagactactacctttccaaaggggtgttacatcttgcaagctactgtttggccttctgcgcacagcgatttttctgaaagccagcacctcctgcttgtccaatttggaaagacggataggtatgcagcttgacaaggccagtctggaagatcttttgataccaaacatctccgagtctgtagaaacactatatgatgtggattgtgtgcagaggattgtagatcatttcttggcaatggaccaagaaactggtggggcctcccctggccttggtgaagaagggcaaatcttagcttcaccatctttaatgccgataacaatggttgctaagttgattgatggttatctggctgaagttgcaccagatgagaacttgaagctgacaaaattccggtctttggcagctgctataccggagtatgcccgtccgatagatgacggactttatcgtgctattgacatatatcttaaggcgcatccatatctgtcagagtcggacaaagaagagctctgccgggtgatggactgccagaagctgtccttggaggcatgcacccacgcggcgcagaacgagcgcctcccgctccgcgtcatcgtgcaggtgctcttcttcgagcagctccagttgcggagttccatcgcggaatgcctcatgatctccgagccccttgatggtggtgtctcgcggcagctaggcggccaacccgtctctggcgagcaccaccgcggtggagccggctggcccctggcgtccagggaaaaccagaccctgcgtgaaggcatggacagcatgaagcagcgggtggccgagctggagaaggagtgcaccgccatgcggcaggacatcgagcggctcggccgcagccggagcgccggcaagagcaggttcccgtttgcgctcgccgccaagccgcaggtttgcagcaccaaggacaaggatgctgctccggagacgtcaaagacagcggcgacggagagcgaggacaatgtggccgtggtgaagggtggtgccggcggtgagggcgcgccgcagctgaagctcaggaagcacaagatgaagctgccaacctgttagctattctacatacatataccagtacagacccgggatgaacttgccgcctgatgaaaataccgtcttatgctaaagttttttttttttgacatttgctaagtggaaaatgcatagcaatatcagcatcttttgttct

SEQ ID NO: 30177 - protein, 652 aa, Panicum virgatum
  misc_feature: Ceres CLONE 1897210
  misc_feature (213)..(479): Pfam Name: NPH3 Pfam Description: NPH3 family
MACQKLGSRADVFRKQGQEWYCTSGLPSDITVVVGEQSFHLHKFPLLSKSGLLERRIREKIDKGEDSWVVDLSDIPGGAKAFELAAKFCYGVKFEMTASNVVHLRCASDYLEMTEEISEGNLIAQTVNFLTQTVLRSWKDSVKALQTCDDVLDIAERLQIVKRCVDSIATRSCSDPDLFGWPVAQYGGPMQSPGGSLLWNGISTGARPRNSSPDWWYDDVSCLSLPLYKKLISAMEYRGINQEIIVGSLNHYAKRRLPGLNRRKSISDASNCLSITSLTSIPSEDDQKYLLEEIDRLLPFQRGVTSCKLLFGLLRTAIFLKASTSCLSNLERRIGMQLDKASLEDLLIPNISESVETLYDVDCVQRIVDHFLAMDQETGGASPGLGEEGQILASPSLMPITMVAKLIDGYLAEVAPDENLKLTKFRSLAAAIPEYARPIDDGLYRAIDIYLKAHPYLSESDKEELCRVMDCQKLSLEACTHAAQNERLPLRVIVQVLFFEQLQLRSSIAECLMISEPLDGGVSRQLGGQPVSGEHHRGGAGWPLASRENQTLREGMDSMKQRVAELEKECTAMRQDIERLGRSRSAGKSRFPFALAAKPQVCSTKDKDAAPETSKTAATESEDNVAVVKGGAGGEGAPQLKLRKHKMKLPTC

SEQ ID NO: 30178 - DNA, 2313 bp, Panicum virgatum
  misc_feature: Ceres CLONE 1897220
  misc_feature: Encodes the peptide sequence at SEQ ID NO. 30179
acgagacaggatcattgcgcctgcgaaatggattaccaaaaacgatagaaaaagaaggccaattgacgggccggggagcagaaggcaggccattaatacttgacacctcccgtttcctgccctcttctcctccatcccctcctccgccattgctccacagaacacgtcgtgcagcacaccccacgcgccagagctcgggaggacttgtcttgactcttgactgaagcgctggctccggaatcccgtctcctcggcgccttcttgcttgtttggttcttgggagcagaaagattcagctttccaggggcttccaggctctgcgcaatctgatcgtgaatgaagcctacaatgcagtagtccacgatgccaaggttgcttcctgactgaccagatccaagcattcagctaattgcagtctctggtcgtcttgtctgataaacagacagttgttgcagcaatggcttccaaagcggtgcctcaaattctcccagaaatctcaagcattccagaactgaagcactgttcaaagagcccatctcctttggagatcccccaggcaaacaattcttgcgcttcaacaccaactgcgcctccagaaacagctaacctgagcaaattgagccataaaccggagccgaaggagcagaaacaagaccaccacatcaaagaatctgttgtggagcacaggaatatgaatggaagctccacttcatttcaaacatatgaaggtagtaatcaaccgaaggttagttcaagtgctaggttgaccgatccatcagagattggtgacagaggcaatagtggaagatgcaggcctagcactagcagtgatgtcagcgatgaaagttcatgtagcagcaagactagcagcacgaagcctcacaaagcgaatgattcacgatgggaggcgattcagatcgtcaggactagagatgggatccttgggctgagtcatttcaggctgttgaagaggctaggctgtggtgatattggcagtgtgtatctctctgaattgaatgggacaaagagctatttcgcaatgaaggttatggacaaggcatcgctagcaagccgtaaaaagttgcttcgagctcaaacggagaaggagattctgcaatgcctggatcaccccttccttcctacactttacactcactttgagaccgacaagttctcctgcctagtaatggagttctgccctgggggagacctgcacacccttcgacagaggcagcctggaaaacattttccagagcaagcagtcaaattctacgtagcagaagttctcctggcactagaatacttgcacatgctcggaatcatataccgtgatcttaagcctgaaaatgtccttgttcgggaagatgggcacatcatgctctcggatttcgacctctcccttcggtgtgcagtcagtcccacactgattaagtcttcgaaccctgatacagaagcactcaggaagaacagccaaggctactgtgttcaaccagcttgtgtggagccctcctgcataattcaaccatcatgtgcagccccaaccacttgcttgggtccacgcttcttctccaagtccaagaaagatcgtaaaccgaaaactgaagttgccacccagatcaacccctggcctgagctcatagcagagcccagtgatgcacgatccatgtcatttgtcggaacacatgagtacctggcccctgagattatcaaaggcgagggccatggcagcgctgttgactggtggacctttgggatattcttgtacgagttgctgtttgggaagacacctttcaagggatccggcaacagggctacactgttcaatgtcattggccagccattgcgctttcctgaatacccagttgtgagcttctcagcaagagatttgattaggggtctacttgtgaaggagccccagcaacggttagcttacaagcgcggtgccacagagatcaagcagcatcctttcttcgagggtgtgaattgggcactgattcggtgtgcaagcccaccggaggtaccaaagcccgtcgagattgagaggccatcaaagctgccttcatcaccatcaggagctgccgacggttccagcggggcaccccagaaaggttctgatggctacttggagtttgatttcttctagcaaacatgtgggttttactatattgtttgtgccattggatgtagtgttttcagcaaatggttggtgctgtagatttgtctcaacctgcttctcttctctgctaccttttaaagtttacatttgtaattcaacatgttcttaatacgctgatcttctgcattgattttcct

SEQ ID NO: 30179 - protein, 561 aa, Panicum virgatum
  misc_feature: Ceres CLONE 1897220
  misc_feature (167)..(505): Pfam Name: Pkinase Pfam Description: Protein kinase domain
  misc_feature: SWISSPROT Homolog: EC 2.7.11.1 Non-specific serine/threonine protein kinase
MASKAVPQILPEISSIPELKHCSKSPSPLEIPQANNSCASTPTAPPETANLSKLSHKPEPKEQKQDHHIKESVVEHRNMNGSSTSFQTYEGSNQPKVSSSARLTDPSEIGDRGNSGRCRPSTSSDVSDESSCSSKTSSTKPHKANDSRWEAIQIVRTRDGILGLSHFRLLKRLGCGDIGSVYLSELNGTKSYFAMKVMDKASLASRKKLLRAQTEKEILQCLDHPFLPTLYTHFETDKFSCLVMEFCPGGDLHTLRQRQPGKHFPEQAVKFYVAEVLLALEYLHMLGIIYRDLKPENVLVREDGHIMLSDFDLSLRCAVSPTLIKSSNPDTEALRKNSQGYCVQPACVEPSCIIQPSCAAPTTCLGPRFFSKSKKDRKPKTEVATQINPWPELIAEPSDARSMSFVGTHEYLAPEIIKGEGHGSAVDWWTFGIFLYELLFGKTPFKGSGNRATLFNVIGQPLRFPEYPVVSFSARDLIRGLLVKEPQQRLAYKRGATEIKQHPFFEGVNWALIRCASPPEVPKPVEIERPSKLPSSPSGAADGSSGAPQKGSDGYLEFDFF

SEQ ID NO: 30180 - DNA, 1470 bp, Panicum virgatum
  misc_feature: Ceres CLONE 1897267
  misc_feature: Encodes the peptide sequence at SEQ ID NO. 30181
  misc_feature (406)..(406): n is a, c, t, g, unknown, or other
agtcgagacgcaatcaactgggagaaaccactcgtcccgtatcttcagtatcaggaacactcatcgtcggcagaagacccggccggggtgggtggggtgggggtctccataaaacctgcagcccatccggcttctctgcactgcccctgctgttcgtttgctcaccagattggatcaggctggttgcttggcttggtcgaccattgtttagtcgccggttacctgaccaggtgttgaatattgctggcagctcggattccggttccggcgcggccccccggagaggagctgctgctgctgctggtcctggagcggaggctgctgaacaagacgtgtgtgagtgtgcctggaaggaagagaactagaggggcgaggaacttgcttcccggggtgagaggaaatcagncggagcgggaagggggggctcggagatggcaggcgggttcggcggcggcggggcggcccccgggagggcggagctctacgagggcaggatcaccagctacttcatcctcgcctgcatcgtcggctccttcggcggatccctcttcggctatgatctcggagtctccagcggcgtgacgtccatggacgacttcctgaagaagttcttcccggacgtgtaccaccggaagcaggcgcacctgcgcgagacggactactgcaagtacgacaaccaggtgctgacgctcttcacctcctcgctctacttcgccggcctcgtctccaccttcggcgcctcctacgtcaccaagcgccgcagccggcgcgccagcatcatggtcggcgccaccagcttcttcctcggcggcgccgtcaacgccgccgccgtcaacatcgccatgctcatcgtcggccgcgtgctcctcggcgtcggcatcggcttcggcaaccaggccgtcccgctctacctctccgagatcgcgccctaccgcatccgcggcgccgtcaaccagctcttccagctcaccacctgcctcggcatcctcgtcgccgacatcatcaactacttcaccgaccgcctgcacccgtgggggtggcgcctctcgctggggctcgccatgggccccgccaccgccatcttcgtcggcgcgctcttcctgccggagacgcccaacagcctcgtcgagcgggggctgttcgaggaggcccgccgcgtgctggagaaggtgcgcggcacgcacaaggtggacgccgagttcgaggacctcaaggaggccagcgaggtggcgcgcgccgtcaagggcacgttccggaacctgctcgccgcgcgcaaccgcccgcagctcatcatcggcgcgctcggcatcccggcgttccagcagttgtcgggcatgaactccatcctcttctactcgcccgtcatcttccagagcctcggcttcggctcctccgccgcgctctactcctccatcatcacgggctccatgctcgtcgtcggcgcgctcatctccatggtcaccgtcgacc

SEQ ID NO: 30181 - protein, 346 aa, Panicum virgatum
  misc_feature: Ceres CLONE 1897267
  misc_feature (29)..(346): Pfam Name: Sugar_tr Pfam Description: Sugar (and other) transporter
MAGGFGGGGAAPGRAELYEGRITSYFILACIVGSFGGSLFGYDLGVSSGVTSMDDFLKKFFPDVYHRKQAHLRETDYCKYDNQVLTLFTSSLYFAGLVSTFGASYVTKRRSRRASIMVGATSFFLGGAVNAAAVNIAMLIVGRVLLGVGIGFGNQAVPLYLSEIAPYRIRGAVNQLFQLTTCLGILVADIINYFTDRLHPWGWRLSLGLAMGPATAIFVGALFLPETPNSLVERGLFEEARRVLEKVRGTHKVDAEFEDLKEASEVARAVKGTFRNLLAARNRPQLIIGALGIPAFQQLSGMNSILFYSPVIFQSLGFGSSAALYSSIITGSMLVVGALISMVTVD

SEQ ID NO: 30182 - DNA, 3279 bp, Panicum virgatum
  misc_feature: Ceres CLONE 1897268
  misc_feature: Encodes the peptide sequence at SEQ ID NO. 30183
agagccgaaggaccgccatgaaagggcgcgcggtgaagctccgtgaggcgcacaagtcaggctcgccggctctctgctccgccgcgtggggcccctgcgggcgacatgtcgtcaccgcgtccgccgccgacaccgccgtcctggtccacgacgccgccgcgttgctcgccggcggccgtttctcgggtttggcgccgttggccacgatgcggttccacaaggacggcgtcactgctctcgcggtcgcgccgggccccggaggctcgctggcatccggatccatcgaccactccgtcaagttctacacctttccagagggagaattcttgagcaatgtcgcccgattcacccttcctatccggtcactttcgttcaacaagaaggggaccctgctggcggccgcaggcgacgacgatggcatcaagctgattgcgacaatcgacaacaccatctccaaggtgctcaaaggccataagggctccgtcaccgggctggatttcgaccccaggaacgattacctggcttctgtggacagcttcggcactgtcatttattgggatctttgcaccggcaatgtggcccgtaccttaacccgcgtcgctcccacattccattcggataattcggtcaggaatgtcctgtgttggagccctgatgggcagacccttgctgttcccgggttgaggaacaatgtggtgctgtatgatagggacacgggcgaggaggtgtccacactgaaaggagatcatgagcagccagtgtgcagcctatgctggtctcctaatgggagatacctggccagtgctggcctggataggcaggtgctcatctgggatgtgaagtcaaagcaggacattgagagacagaagtttgatgagaggatatgctgcttggcctggaaaccagatggaaattctttacttatgattgatgtcatgggcaggtttggcatttgggaatcagtcataccttcaactatgaagtcacctactgagggtataccagacttcaagtccactaaagtttctttgtttgatgatgatgatgacattgatgatgatgatgagaagccgtgtacctctggtggcttggaggatgatattggtgaaagtctttgtgattcaactcttttcagccacaagagactgaagaggaagtccgcatttaatggagacagtgaagatgaggatttaattcatcaattggaatcatccaaaagaatgaaagataagcataaagctacaaaggaagatgctgggaaggcaagaggtgattctgcaacttcagggaggcttgttaatgaaagaatgcaagctgccttccagcctggatcaacaccgcctcagcctggcatgcgaaatttcctcgcctacaatatgctgggtagtatcactaccattgaaaatgaggggcattcgcatgtagaggttgactttcatgacacaggaaggggccctagagttccttccatgacggactattttggtttcacaatggctgcactgaacgaatcaggaagtgtctttgcaaatccatgcaaaggtgacaagaatatgagcactctaatgtaccgcccttttggtagctgggctggtaacagcgagtggtcaatgagatttgagggagaagaagtgaaggctgtggctcttggtgctgggtgggttgctgcagtcacaagcctaaattttttgcgcattttcacagaaggaggcttgcaggtgcatatcctatcagttagtggcccagttgttacggcagcaggtcatggggatcagctagctattgtatctcatgcttccgattgtctgccctcaggagatcaggtgctggatgttaaggtattcaacatatctgaaagagcacaaacattttctggccgccttcttttgactccatcgtcccaattatcctggtttggattcagtgataatggtcaacttagttcatatgattccaagggaatactaagggtcttttccagtcagtttggcggaagttggcttccagtatttagttcggtcaaggcaagaaaatctgaagatgaaagccattgggtggtaggtttggatgctaataatgtattttgcattctatgcaaacaacctcagtcttacccacaggtgatgcccaagcctgtgctaaccatactcgagctgtcatttcccattgcttcatctgaccttggtgctaatagtttggaaaatgagttcatgatgaggaagctacatctgtcacagactcgaaacaagattgatgaaatggctgcattgggtctggacacaactgcatatgacgatgaagaattcaacttggaggcaggacttgaccggtgcattttgaggctcatatctaactgctgcagtggtgataagcttgttcgagctactgagcttgcaaaattattgacactagagaagtcaatgaagggagcactaacactagttacgcgcttgaaacttcccatgctgcaagagaagttcagctccatacttgaggagaggatgttaaacgatagaaaaatagctgaggcagcaagtttttgctccaatgctacaatcacaaggaaccctgcagtgttgaccactcacgcaactgtaccaactaagtttgtgcaaaatggaaacagttcattggaatcttcattacccattcagagtcttggcaatcaagaaagcagtttgattgaactaaagaagccaggaggagaacaggcgagaggaattaacaaaagctcccttaaagtttcacctgcctttactccattggccaaagtacccaaaagtaatgaaacaaagaaagacagcattggagcatcaaatgcatctgtagtcgatcagaacaaaaaaggaggcattgatggggcaagaaagatgagcactgaagactgcgatcgaacagagcctcagcgaccaataacccttttgcaaaatcatcagccagcaaagagcactcaccatccctattggattccataaaaaggatgaaggttgaaactgaaaaggttgaaaaacctagtagcaaggtgaaagtgcaggttcaaaaaaaaaaaggtgaaagtgtaaactgtttttgagtatgcaagtcatggaatacaggagggcaacaaactttttggaatctatttatactaacatctgtactacttagatttttcagttttactgtagtagcttaggtaaccactgggccatttacattctaaatttgtttttaatggcttctgaactttgttgttgtggtatttggttcaagattatgtgtaatatattacccctattt

SEQ ID NO: 30183 - protein, 985 aa, Panicum virgatum
  misc_feature: Ceres CLONE 1897268
  misc_feature (234)..(273): Pfam Name: WD40 Pfam Description: WD domain, G-beta repeat
  misc_feature (143)..(181): Pfam Name: WD40 Pfam Description: WD domain, G-beta repeat
  misc_feature (58)..(97): Pfam Name: WD40 Pfam Description: WD domain, G-beta repeat
  misc_feature: SWISSPROT Homolog: EC 2.3.1.48 Histone acetyltransferase
MKGRAVKLREAHKSGSPALCSAAWGPCGRHVVTASAADTAVLVHDAAALLAGGRFSGLAPLATMRFHKDGVTALAVAPGPGGSLASGSIDHSVKFYTFPEGEFLSNVARFTLPIRSLSFNKKGTLLAAAGDDDGIKLIATIDNTISKVLKGHKGSVTGLDFDPRNDYLASVDSFGTVIYWDLCTGNVARTLTRVAPTFHSDNSVRNVLCWSPDGQTLAVPGLRNNVVLYDRDTGEEVSTLKGDHEQPVCSLCWSPNGRYLASAGLDRQVLIWDVKSKQDIERQKFDERICCLAWKPDGNSLLMIDVMGRFGIWESVIPSTMKSPTEGIPDFKSTKVSLFDDDDDIDDDDEKPCTSGGLEDDIGESLCDSTLFSHKRLKRKSAFNGDSEDEDLIHQLESSKRMKDKHKATKEDAGKARGDSATSGRLVNERMQAAFQPGSTPPQPGMRNFLAYNMLGSITTIENEGHSHVEVDFHDTGRGPRVPSMTDYFGFTMAALNESGSVFANPCKGDKNMSTLMYRPFGSWAGNSEWSMRFEGEEVKAVALGAGWVAAVTSLNFLRIFTEGGLQVHILSVSGPVVTAAGHGDQLAIVSHASDCLPSGDQVLDVKVFNISERAQTFSGRLLLTPSSQLSWFGFSDNGQLSSYDSKGILRVFSSQFGGSWLPVFSSVKARKSEDESHWVVGLDANNVFCILCKQPQSYPQVMPKPVLTILELSFPIASSDLGANSLENEFMMRKLHLSQTRNKIDEMAALGLDTTAYDDEEFNLEAGLDRCILRLISNCCSGDKLVRATELAKLLTLEKSMKGALTLVTRLKLPMLQEKFSSILEERMLNDRKIAEAASFCSNATITRNPAVLTTHATVPTKFVQNGNSSLESSLPIQSLGNQESSLIELKKPGGEQARGINKSSLKVSPAFTPLAKVPKSNETKKDSIGASNASVVDQNKKGGIDGARKMSTEDCDRTEPQRPITLLQNHQPAKSTHHPYWIP

SEQ ID NO: 30184 - DNA, 690 bp, Panicum virgatum
  misc_feature: Ceres CLONE 1897280
  misc_feature: Encodes the peptide sequence at SEQ ID NO. 30185
gagccttcgcccttcgggaagatcaatggcgccgccgtcgccccgtggcatgccgtgcggtccccggctggccgccgtcctcctgctggccgccgccgccgcgctggggttcggcgtccgggccggcgcggcgcagctgtgcgccgagtactacgaccggacgtgccccggcgtgcaccgcgtcgtgcggcgggtgctgaagaaggcgcacgaggcggacgcccgcatctacgccagcctcacccgcctccacttccacgactgcttcgtccagggctgcgacgcctcgatcctgctggacaacagctcgagcatcgtgtcggagaagttcgcgacgcccaacaacaactcggcgcgcgggtaccccgtggtggacgccgccaaggccgcgctggaggaggcctgccccggcgtcgtctcctgcgccgacatcctcgccatcgccgccaagatctccgtcgagctgcatgcaaaacagagaagaaagaacctaagttgtagtacgacgtggacacacgcgcgtcagcatcacgcatcggctctcagcaacacgacgtctctgtccggcgggccccggtggcgcgtgccgctcggccggcgcgacggcaccaccgccaacatcaccgccgccaacagcaacctcccgagccccttcgacaacctcaccgcgctccagcaaaagttcggcgc

SEQ ID NO: 30185 - protein, 221 aa, Panicum virgatum
  misc_feature: Ceres CLONE 1897280
  misc_feature (54)..(221): Pfam Name: peroxidase Pfam Description: Peroxidase
  misc_feature: SWISSPROT Homolog: EC 1.11.1.7 Peroxidase
  misc_feature: Useful for making plants with altered cell wall content and/or composition
MAPPSPRGMPCGPRLAAVLLLAAAAALGFGVRAGAAQLCAEYYDRTCPGVHRVVRRVLKKAHEADARIYASLTRLHFHDCFVQGCDASILLDNSSSIVSEKFATPNNNSARGYPVVDAAKAALEEACPGVVSCADILAIAAKISVELHAKQRRKNLSCSTTWTHARQHHASALSNTTSLSGGPRWRVPLGRRDGTTANITAANSNLPSPFDNLTALQQKFG

SEQ ID NO: 30186 - DNA, 705 bp, Panicum virgatum
  misc_feature: Ceres CLONE 1897287
  misc_feature: Encodes the peptide sequence at SEQ ID NO. 30187
agactcgagcctcgccctccccctcctcccaccaactgcagcagcgagacagagaatggctgcggcgccgtggtccctcgcgtgctcctcccgcgtctcccgccccgcggacctccgccgcacggcggcggcccctgctgatgccccgcagcagctccgcctcggccgctcccgccgccgcgcgcagcgcaccgtcgccatggctggatccggcaagttcttcgtggggggcaactggaagtgcaatggaacaaaggactccattagcaagcttgtctctgaattgaatgctgctacactcgaaactgatgtagatgttgtggtggcacctccattcatttatattgaccaggtcaagaattcactaactggtcgtattgaggtttctgctcagaatgtatggatcggaaaaggaggagcctacactggagagatcaggttgggtactggttcagcgatacctgaaacttgtcccttttctttcccatacatggagattgcagctatgtgtacagtagttgcgataaaaacaacattttgttgtatttgtgttattggatgaaccttgtatgatagttcatgaagggctaggatttgttttgatttctgcttcgctgatagaattttacctttccctaaaaaaactacagtgcagaacaattggtggacataggctgtcaggttattcttgggcactctgagcgt

SEQ ID NO: 30187 - protein, 168 aa, Panicum virgatum
  misc_feature: Ceres CLONE 1897287
  misc_feature (55)..(165): Pfam Name: TIM Pfam Description: Triosephosphate isomerase
  misc_feature: SWISSPROT Homolog: EC 5.3.1.1 Triose-phosphate isomerase
MAAAPWSLACSSRVSRPADLRRTAAAPADAPQQLRLGRSRRRAQRTVAMAGSGKFFVGGNWKCNGTKDSISKLVSELNAATLETDVDVVVAPPFIYIDQVKNSLTGRIEVSAQNVWIGKGGAYTGEIRLGTGSAIPETCPFSFPYMEIAAMCTVVAIKTTFCCICVIG

SEQ ID NO: 30188 - DNA, 1597 bp, Panicum virgatum
  misc_feature: Ceres CLONE 1897309
  misc_feature: Encodes the peptide sequence at SEQ ID NO. 30189
gcagtgcgccccggtcgttcgagccagcagcaaggttgcgctgcgtagcagctagcaagcagagaggtgggggacgacgcctggcgccccggccggagacgccccaagtcttctatacaggacgtgcctgaattctgctgttagccctctggccagtgatatcatcaccatggatgtgtctgatgagaagtgtgctcatccgtcagacctgcctagcgcagttgatgtcgggcaatctgacaatggcaaccctgaacatttggggtctgttgcagtcaatggagctattggaaatgaaggtcattccggcatggattgttctgagcagactgatgatgagcatggtggagatgaagactctcttgttgatgttgaaagcaatgttcataaacaagagaatcaggaaaagattccaatggaagaaacagcgatgagcgatggcacctcgatcacatcgatggaagatgctctggaaccaaacaatgatctcccttcggaggcggaagatatgagcaacaaccacactcctgatctgtcaaacggcaagacttccaatggaaacagtaacgtattccagagtgccaagagtgtgttgacttcaaccaagaaggcgaagaaaacttcatctgcaaatacacggaagccgctgcaatctactaatagaggtaatcaggatgatgggaaatcatcagctggaaagcccacagttccatcaggcccagtcttccgtagcactgaacgagccgagaagcgcagagaattctacatgaagctggaggagaggcaccaagctatggaggaagagaagattcagttggaagccaggctgaagaaagagcaagaagaggctctgaagcagctgaggaagagcctgaccttcaaggccaatccgatgccgagcttctaccacgaggcggcgccgtccccgagggccgagttcaagaagctgccgacgacccgccccaagtccccgaagctcggcaggaggaagcagacggcccccatggagacgtccaactcctcgtcggagagcgagggcgcgaggccctgctgccgcgccagccgcgacggcctcgacagcagttgcaagtgcagcggcggcaaggcgcgggccacgaacgccatgccggcggccaagaagcagccgccgccgccgaagcaccgcgcccacaagatcgccggcgagagcgccatcaacatcgccgtgcactagctgctgctcctgctgcttctgcaagatgacaatggcgtttcttctgaaactacttcttgctcgtttcttctggcggcatgcaggacgacgacaatggcgtgggaacttttttttctctctctaagttatgggagtgtttgacggcttgtggatttggtgtagataataagttatggtgatgacgaagacgagcatgggtgagtcatgctaatcttatttaatctgctgtgctgagggtgtgagggatggcctgtactttgccaatgtacagggttatttgtttgcttttcttcttcagtgaacatagagagtgaacataaaggatgcttgttcccctatttcggaccattttacatcagtagaagtgagaaggaggcctttcct

SEQ ID NO: 30189 - protein, 347 aa, Panicum virgatum
  misc_feature: Ceres CLONE 1897309
  misc_feature (186)..(242): Pfam Name: TPX2 Pfam Description: Targeting protein for Xklp2 (TPX2)
MDVSDEKCAHPSDLPSAVDVGQSDNGNPEHLGSVAVNGAIGNEGHSGMDCSEQTDDEHGGDEDSLVDVESNVHKQENQEKIPMEETAMSDGTSITSMEDALEPNNDLPSEAEDMSNNHTPDLSNGKTSNGNSNVFQSAKSVLTSTKKAKKTSSANTRKPLQSTNRGNQDDGKSSAGKPTVPSGPVFRSTERAEKRREFYMKLEERHQAMEEEKIQLEARLKKEQEEALKQLRKSLTFKANPMPSFYHEAAPSPRAEFKKLPTTRPKSPKLGRRKQTAPMETSNSSSESEGARPCCRASRDGLDSSCKCSGGKARATNAMPAAKKQPPPPKHRAHKIAGESAINIAVH

SEQ ID NO: 30190 - DNA, 984 bp, Panicum virgatum
  misc_feature: Ceres CLONE 1897317
  misc_feature: Encodes the peptide sequence at SEQ ID NO. 30191
atcccctctccccgctcccacccttcttcccttgcccgcctcgattcatccctctccctcccctcccctcctctcccgattcccgcggccgggctcgcggatccacgcgcggcgcggctcccttccttccacacgatgagcagccggcggcgggtcgaggcctgcgactcgtggcgcccgccgcggagccacgccggggcggggccgcagcccgtcctcctccgcgcggggccccggctcccggccttcgcctcgctctccgtccgcgagggcggggaggccgcggccgtcgccaaggcggtggaggagacggtcgtcgcgcgggccggcgaggggacggaggagcggcgggcggcggggggcgaggaggccgggggggagaaggagcggaggaggctgccccccgcggcgcagctggtgcgccacccgctggcgctgctcgccctggtgccccgcggcgccgcgctcttcgccgcgggggccgccgcgggcgccgccgccaagaccgtcaccgcgccgctcgaccgcgtcaagatactcatgcagacgcacagcgtgcgggtggcgggagagagcgccaagaaggcggttgggttcctcgaggctattgcagacattggaaaggaggagggtcttaagggttactggaaaggcaaccttccacaggttattcgcataattccttacagcgcggtgcaactcttctcatatgaagtttacaagaaaatcttccgaagaaaggatggagaactttctgtatttgggagacttgctgctggtgcttgtgcgggcatgacatctacacttgtaatttatttatttgcttacttgctagcagatgtctattcatttctatttttgttggatatgagactttgtatatatttggtttatgctttggtctttaattggttgcggcagataaatttcatcaaaatatgtggtaggacattgttagcacattctgaactttctacttgtact

SEQ ID NO: 30191 - protein, 282 aa, Panicum virgatum
  misc_feature: Ceres CLONE 1897317
  misc_feature (107)..(203): Pfam Name: Mito_carr Pfam Description: Mitochondrial carrier protein
MSSRRRVEACDSWRPPRSHAGAGPQPVLLRAGPRLPAFASLSVREGGEAAAVAKAVEETVVARAGEGTEERRAAGGEEAGGEKERRRLPPAAQLVRHPLALLALVPRGAALFAAGAAAGAAAKTVTAPLDRVKILMQTHSVRVAGESAKKAVGFLEAIADIGKEEGLKGYWKGNLPQVIRIIPYSAVQLFSYEVYKKIFRRKDGELSVFGRLAAGACAGMTSTLVIYLFAYLLADVYSFLFLLDMRLCIYLVYALVFNWLRQINFIKICGRTLLAHSELSTC

SEQ ID NO: 30192 - DNA, 567 bp, Panicum virgatum
  misc_feature: Ceres CLONE 1897317-R
tgcaattccaggcattgtggagcgtgatggtctagttgggctttatagaggttttgtgccaaatgcgttaaaaaatctgccaaatagcagcattaaactgactgcatttgacacggtgaagacactgctagcgactggacagaaggagctggacaaattaatacaagaaaatgaggagaaaacaagctagtgaaatgtgctcaatctttaaggcttcagtagaaggcacaccgttgctatgttcctcctttcctggcgtcatgctttaggatttaggcagcacatgtttctgtttcttttgtcgcattggtcctatttgtgtgttttccttagcatagatattcatagagatagaggaggattggaaggaaacaaggcaatggattgatatctttagtgggggcacagctttagctagcatcagtaggagaatgcaccatacagatcttatttatgttaatagaagatagcgtgtctgtcctcataagttttcatttgctatcaatatacatcatatccagaacatggtgcacacaggctctgtaactcgcaagcagtttctcctag

SEQ ID NO: 30193 - DNA, 1816 bp, Panicum virgatum
  misc_feature: Ceres CLONE 1897320
  misc_feature: Encodes the peptide sequence at SEQ ID NO. 30194
acaaggggtgggtttggggcaaaaaaacgcgtctagcctcccaagccacagccaggctgcagtttcgactttccaagcgctgctgaccgcccccgcctcggcgcctcccaaaatttttccatcgcggccgccccagcccaccgccgccgcgcccgagcgtttcgcttccgggagcggcgagggcgggcggttcacgtggggggagggcgtggcctgaggagcgggccggggaagatggcggccgagggggaggcggcggcgctggagttcacgccgacgtggatcgtggcggcggtctgctcgatcatcgtgctgctctcgctcgtcgccgagcgctgcctccactacctcggcaagaagctcaagaagaagaaccagaagccgctctacgaggcgctgctcaaggtcaaggaagagttgatgcttctggggttcatctccctgctgctgacggtgttccaggggatgatccagaggacatgcatccccgccggatggacggacaacatgctgccatgccaaaagctggatgtgaaggctggcgccaccacggagcatttcgctgctgccgggatccttgacaggatcgggaggcggctgctcagtgaaggcggcgctgaggctgaccactgccagaagggaaaagttccacttctgtcccttgaagccatacatcagctgcacattttcatatttgttctggcgattacacatgttattttcagcgttacaactatgcttttgggaggtgcacagatacaccaatggaaacagtgggagaatggaatccagaaagatgctcctggaaacggtcctaagaaggtaactgatgtgcgtcgtaatgaattcatcaagaaacgttttaagggtattggcaaagattctagaatcttgagttggctgcattcctttggtaagcagttttatagatcagtatctaaaacagattacactacaatgcgccttggttttatcatgactcactgccctggaaacccaaaatttgatttccacagatacatggtgagggttttagaggctgattttaagaaagtagtaggcataagctggtacttgtgggtcttcgtggtgatatttctgcttctgaatgttaatggttggcatacatacttttggattgccttccttcccctttttcttctgttagctattggcactaagctggagcacgtcatagctcagttggcccatgatgtagctgagaagcacacggcaattgagggtgatgtggttgtaaagccatcagatcaccacttctggttcggcaagccaaggattattctttacctaatccacttcatcctctttcagaatgcatttgagattgcgttcttcttctggatactcagcacttatggattcgactcatgcatcatggggcaagttcgttttattgtgccaagacttgttatcggggttgttattcagcttctctgcagctacagcacactacctctgtatgctattgtaacacagatggggagctgctacaaaaaggagatcttcaatgagcatgtgcagcagggtgtcctgggctggacgcagaaggtcaagatgaggaaggggttgaagggggctgcgcgcaaggccgaaccgactagcaacgccgattcagcagggccttctgttaagattgaaatggcgaaagctggggaggacgttgttgccgttgggaacacagagtgatcgaacagtagggcatccatgtttgtaacgatgtagcaggttcatatgccaccatttttgcagatagctgtttgtcccagcagcctgaagtagtgcattagtttgccgg

SEQ ID NO: 30194 - protein, 490 aa, Panicum virgatum
  misc_feature: Ceres CLONE 1897320
  misc_feature (5)..(481): Pfam Name: Mlo Pfam Description: Mlo family
  misc_feature: Useful for making plants with modulated biotic stress sensitivity
MAAEGEAAALEFTPTWIVAAVCSIIVLLSLVAERCLHYLGKKLKKKNQKPLYEALLKVKEELMLLGFISLLLTVFQGMIQRTCIPAGWTDNMLPCQKLDVKAGATTEHFAAAGILDRIGRRLLSEGGAEADHCQKGKVPLLSLEAIHQLHIFIFVLAITHVIFSVTTMLLGGAQIHQWKQWENGIQKDAPGNGPKKVTDVRRNEFIKKRFKGIGKDSRILSWLHSFGKQFYRSVSKTDYTTMRLGFIMTHCPGNPKFDFHRYMVRVLEADFKKVVGISWYLWVFVVIFLLLNVNGWHTYFWIAFLPLFLLLAIGTKLEHVIAQLAHDVAEKHTAIEGDVVVKPSDHHFWFGKPRIILYLIHFILFQNAFEIAFFFWILSTYGFDSCIMGQVRFIVPRLVIGVVIQLLCSYSTLPLYAIVTQMGSCYKKEIFNEHVQQGVLGWTQKVKMRKGLKGAARKAEPTSNADSAGPSVKIEMAKAGEDVVAVGNTE

SEQ ID NO: 30195 - DNA, 2957 bp, Panicum virgatum
  misc_feature: Ceres CLONE 1897324
  misc_feature: Encodes the peptide sequence at SEQ ID NO. 30196
gtggcctgtggagggaaagcactagcaatactggatcccttgtccgttgcctgttgctgctcccccatgtccagctcagcctttggagacaccaccggtccgttgctccagtctcctctttcctctgccacccccgtgaatccgtgatgcacaatgctgccgcactactagtacttggtgacactccttgagtgagctccgagcggtgcaataccacagaacaccggcaagcggccatagaccgcaagaaacacgaagctccctcctactgcttatccatccgctgttctgctgccttcaccattgatctgagctctgaagaaggttttcctggccccttcattgctgcttcggccgctgcaagaaggagaaaccgatccacgattaggcaaagagcagagtgaagcagtaaccacacagtgtcgtggaatcgtctccaatagcgaggccggggcatctcctgcttatcttcttctcggtgtttcttgcgttgctcccggagaccacacagctccagccttcgcaggtatggactctgatcaagatccagcagctcctgaacgaccctccgatgctcagccactggcgccacagcaccgacttctgcggcggcgccggcggcttcatgggccctacgggctcggccgccgtcttgtgctacggcgacaccgtgacgcagctccacatcgccggggccccgggctccccgccgctgcccaggaacttctccgtcggcgcattggtcacgacgctgtccaggctccccgacctcaaggtgctcacgctgtccagcatcggcctctggggtcccctgccagggaagctcggccggctggccgcgctggagatcgtcaatgtcagcgggaacttcctctacggcgacatcccgaggggcatgtcgcggctcgccggcctccagacgctgatcctcgatgacaacctactgggcggcgaactgccggcgtggatcggcgagctgccggcgctggccgtgctgagcctgcggaacaacacgttccgaggcgccgtgccggagtccgtcgggcgcatgccggcgctgaggtcgctcgtgctcgcgtccaacaacctgtccgggaacctgccggacatgagccgcctgaccaacctccaggtgatcgacgccggcggcaactctctcgggccagcattccccaagctcgggaggaaggtggccaccgtggtgctgagccggaacaggttcggcggcggcctcccggaagcgctgggctccttctacctgctggagcggctggacgtgtcctggaaccggttcgtgggtccgttcacggcggcgctgctgtccctaccgtccatccggtacctcagcatcgccgggaacaggttcaccggcacgctgtccgacaagacgccgtgcggcgacaacctccagttcgtcgacctgtcgttgaatctcctcatgggaagcgtgccatcctgcttgagatcaccggacaggaagccgggcgtggtggtgctcgactcgaccaactgcttggacgatggtgatggttcacaacgcccctcgccgttctgtcagaaccaagccctggccgtgggcatagtgcccggcaaggagaagaagagcattgccaggcacgcaggcctcgtggccggcgttgtgatggcggtccttgtcgccgtttcagttgtcggtttcattgtcttcctcggcgtgaggaaggcagcagccatgaaaggttcgaaggcaaggactctggcaacttcagaggaagaaagttcttcgactggctacccttccaagctgctcgctgatgcacgatacatatcgcagacggtgaagctaggagctctggggatcccatcatacagatcgttttctttggtggagcttgaagctgcaactaacaactttgaaaactcttacttactgggacaagactctcttggcgagatgtaccgaggaaggttaggcaatggcaccccagtgacgatcaggaccctgaagatcaagaggagccagactacccaaagcttaaaccgtcacattgataccatctctaggctcaggcatcaaaacttggtcagcgctctaggacactgctttgagtatgatattgatgattccactgtgacccagctgtacattgtgttcgagtacgtgcaaaatgggaaccttaggagcaggatctcacaaggaactgaaggatgcaagcttacttggtcacaaaggatatcagctgccatcggtattgccaagggtattcagttcttgcacggagggatcatacctggtatagttggaaatgatctgaggatcgccaatattcttctagatcagaatcatgttgccaaaatcggcagctacaatataccaatcctagcagagaccatgaaatctgagggaggagctggaaacaagttccaaaccgacagtccgatgtacagcgataaggccgacatcttcgattttggggtgatcctacttgaggttatgtccgggaagaccatcacatccatgtatgaggtggatatactgaaagaactgcttgcctgggccgacgaggaccgggtcaggaggaggagcttcgcggacccgacggtgagcaagggttgctcagacgagtcgctgaggacggtaatggagatctgccagaggtgcctggccaaggagccagcacagcggccttctgtggaggacgtgctctggaacctgcagttcgctgcccaggtgcaggacgactgggaggtggaagcctggagcagcggcggcgggagcccggtgtcctcttcgtccagggtcaccaggtcatctcggctgaacttgagcagatgatcagtgtataaatctttcttcttcttctgttttctttattgttttgctatttagaataaaaataatgatgtgccttttgttgagcgttgcctatacgggagtacaagtaatgattatacctgtcgctgggtagagttctctc

SEQ ID NO: 30196 - protein, 747 aa, Panicum virgatum
  misc_feature: Ceres CLONE 1897324
  misc_feature (441)..(708): Pfam Name: Pkinase_Tyr Pfam Description: Protein tyrosine kinase
  misc_feature (431)..(705): SWISSPROT Homolog: EC 2.7.11.1 Non-specific serine/threonine protein kinase
  misc_feature (85)..(295): SWISSPROT Homolog: EC 4.6.1.1 Adenylate cyclase
MLSHWRHSTDFCGGAGGFMGPTGSAAVLCYGDTVTQLHIAGAPGSPPLPRNFSVGALVTTLSRLPDLKVLTLSSIGLWGPLPGKLGRLAALEIVNVSGNFLYGDIPRGMSRLAGLQTLILDDNLLGGELPAWIGELPALAVLSLRNNTFRGAVPESVGRMPALRSLVLASNNLSGNLPDMSRLTNLQVIDAGGNSLGPAFPKLGRKVATVVLSRNRFGGGLPEALGSFYLLERLDVSWNRFVGPFTAALLSLPSIRYLSIAGNRFTGTLSDKTPCGDNLQFVDLSLNLLMGSVPSCLRSPDRKPGVVVLDSTNCLDDGDGSQRPSPFCQNQALAVGIVPGKEKKSIARHAGLVAGVVMAVLVAVSVVGFIVFLGVRKAAAMKGSKARTLATSEEESSSTGYPSKLLADARYISQTVKLGALGIPSYRSFSLVELEAATNNFENSYLLGQDSLGEMYRGRLGNGTPVTIRTLKIKRSQTTQSLNRHIDTISRLRHQNLVSALGHCFEYDIDDSTVTQLYIVFEYVQNGNLRSRISQGTEGCKLTWSQRISAAIGIAKGIQFLHGGIIPGIVGNDLRIANILLDQNHVAKIGSYNIPILAETMKSEGGAGNKFQTDSPMYSDKADIFDFGVILLEVMSGKTITSMYEVDILKELLAWADEDRVRRRSFADPTVSKGCSDESLRTVMEICQRCLAKEPAQRPSVEDVLWNLQFAAQVQDDWEVEAWSSGGGSPVSSSSRVTRSSRLNLSR

SEQ ID NO: 30197 - DNA, 718 bp, Panicum virgatum
  misc_feature: Ceres CLONE 1897327
  misc_feature: Encodes the peptide sequence at SEQ ID NO. 30198
aagttcccatccgctccccccacccccgccgccagacgccgaccctccagctgcaccgagcagcggccatggtgaagaagcccaacggcgttgccaaggccactgcggcctctgccggcgcggcggccgggccatccaaggcgaatccgtccacccctgggtcgattaagacctcgaagtttaagaagcggaaggccaaggccaaccgggccactgccgccgctgcaactgttgaccaagtcgcgtcggtgggcgcagccacttctggtggcgatgcatctgcttcggcggtcttaccgcagccatcccatgttgctgaagcatcacctcaggcacaaatgccagagtcagacactattgctgaggcatcacctgtgacgcctaagccagccactgctgaagcatcagcttcggttgcaaagccaaagccaaaacccactgatgctgatgctgatgctgatgctgatgctgatgctgatgctgatgctgatgctgcggctgcggctgcggctgcggctgcggctgatgctgatgctgcggctgcggctgcagctgatgctgcggctgcacctgcggcaagcaagggcaagggcgcgggtgctgataatagaagtggtgatggaaggatgaagagcagaagagtgaggtctaggagtggcaaggggaaggagggtgtggaggatggaggaagtaaaggaaaacaaagaaagctgtgggc

SEQ ID NO: 30198 - protein, 216 aa, Panicum virgatum
  misc_feature: Ceres CLONE 1897327
  misc_feature: SWISSPROT Homolog: EC 3.1.1.61 Protein-glutamate methylesterase
MVKKPNGVAKATAASAGAAAGPSKANPSTPGSIKTSKFKKRKAKANRATAAAATVDQVASVGAATSGGDASASAVLPQPSHVAEASPQAQMPESDTIAEASPVTPKPATAEASASVAKPKPKPTDADADADADADADADADAAAAAAAAAAADADAAAAAAADAAAAPAASKGKGAGADNRSGDGRMKSRRVRSRSGKGKEGVEDGGSKGKQRKLW

SEQ ID NO: 30199 - DNA, 691 bp, Panicum virgatum
  misc_feature: Ceres CLONE 1897331
  misc_feature: Encodes the peptide sequence at SEQ ID NO. 30200
aaggcacactcttctactcctctcctgctgcagtcccactcctacactccactcgcagcaagctctagccatggatcccaccaagtaataatcaagcaagtactaatacgacgcgcatggcatgtgggcggcgcgtggcagttccggccgtcgagctcgcacgacggcggcgtgacgacgaccaacgccggcgctcctgtgtggaacgacaacgaggccctgacggtgggcccccgcaggcccatcctgctggaggactaccacctgatcgagaaggtggcccacttcgcccgcgagcgcatcccggagcgcgtcgtccacgcgcgcggcgcctccgccaagggcttcttcgagtgcacccacgacgtgtcggacctcacctgcgccgacttcctccgcggccccggcgcccgcacgccggtgatcgtgcgcttctccacggtgatccacgagcgcggcagcccggagacgatccgcgacccgcgcgggttcgccgtcaagttctacacccgggagggcaactgggacctgctgggcaacaacttccccgtcttcttcatccgcgacggcatcaagttccccgacgtgatccacgccttcaagcccaaccccaggtcgcacgtgcaggagtactggcgcgtcttcgacttcctctcgcaccacccggagagccttcacaccttcttctttc

SEQ ID NO: 30200 - protein, 230 aa, Panicum virgatum
  misc_feature: Ceres CLONE 1897331
  misc_feature (60)..(230): Pfam Name: Catalase Pfam Description: Catalase
  misc_feature: SWISSPROT Homolog: EC 1.11.1.6 Catalase
KAHSSTPLLLQSHSYTPLAASSSHGSHQVIIKQVLIRRAWHVGGAWQFRPSSSHDGGVTTTNAGAPVWNDNEALTVGPRRPILLEDYHLIEKVAHFARERIPERVVHARGASAKGFFECTHDVSDLTCADFLRGPGARTPVIVRFSTVIHERGSPETIRDPRGFAVKFYTREGNWDLLGNNFPVFFIRDGIKFPDVIHAFKPNPRSHVQEYWRVFDFLSHHPESLHTFFF

SEQ ID NO: 30201 - DNA, 763 bp, Panicum virgatum
  misc_feature: Ceres CLONE 1897340
  misc_feature: Encodes the peptide sequence at SEQ ID NO. 30202
gagccaggcaggcgggcagccagatcaagtcgcagagcagtcaagcaaggcacgtcgttctccaggcagctcatggaccagatttatctagccaaaacttatgtcgtcgtcgcgaaggaggccaataacctgcagtttgcggcggagcttagtgcccatgtgcggcgggcgcagagcatcctcacacacgctgcagctcacgggggtacggtgctggagcaggaagcagagaaggcgatcagggatatgtctgtgctgctcttccaggcgcagcagctgcggtatgacagcggcatcacaatcatgaagttgaaaggccagattcaggctctagaggagaagtcgaaagctgaggcagagaagagcacaaaatacgggcagattgctgctgaggagcttccaaaggggctttactgccttggtgtccggttaaccatggaatggttcaagagttctgagcttcagaggaagttttcagataggagccctacagtgcagaacaacctaagggataacagcctttatcatttttgtgtcttctcagacaatatccttgctgtttcagttgttgtcaattctacagctataaactcaaagcaccctgaaaagattgtctttcacctagttaccgatgagttgaactatgctccaatgagggcatggtttgccatgagtgactacagaggggtcactgtggatatacaaaaggtggaggactttacttggctcaatgcatcgtatgttccctgttctaaacagctgc

SEQ ID NO: 30202 - protein, 254 aa, Panicum virgatum
  misc_feature: Ceres CLONE 1897340
  misc_feature: Useful for making plants with altered cell wall content and/or composition
EPGRRAARSSRRAVKQGTSFSRQLMDQIYLAKTYVVVAKEANNLQFAAELSAHVRRAQSILTHAAAHGGTVLEQEAEKAIRDMSVLLFQAQQLRYDSGITIMKLKGQIQALEEKSKAEAEKSTKYGQIAAEELPKGLYCLGVRLTMEWFKSSELQRKFSDRSPTVQNNLRDNSLYHFCVFSDNILAVSVVVNSTAINSKHPEKIVFHLVTDELNYAPMRAWFAMSDYRGVTVDIQKVEDFTWLNASYVPCSKQL

SEQ ID NO: 30203 - DNA, 728 bp, Panicum virgatum
  misc_feature: Ceres CLONE 1897349
  misc_feature: Encodes the peptide sequence at SEQ ID NO. 30204
gaaccaaacctcgccgccgcctccgtctccgtctcttcttctcatcccatctctctctcctataccctccctcccgcaatcccacctccccctctaaacccgcacccgcagcggcactcctagggtttgctccgccccgccgaactccgccgccctccgatcgctctggttccgaggcggcggctgcgagagagcttgcggcatggcggggtacccggaggacaaccagcacgcgctgaacgggtacgaggaggaggaggtcgacgaggaggagggccaccccgggaggcggggaggccgggacgggggctccgggtacggcgatgccggcggagaggacgggaggggcgccgccggcgactcgtcggggaagattttcgtcggaggcgttgcttgggagacgactgaagaaacattctccaagcattttgagaagtatggggcaataactgattctgtaattatgaaggacaagcatactaagatgcctcgtggatttggatttgttacattttctgatccatctgttatagacaaggttttggaggatgagcacgttatagatggcagaacggttgaggtcaagaggacagtccctagggaagaaatgaccaccaaagatggccccaagacaagaaagatcttcattggtgggctaccaccatcattaactgaaggttgaaataaagaaggctgaaccaaagaagcatggatctgatcacagtagt

SEQ ID NO: 30204 - protein, 159 aa, Panicum virgatum
  misc_feature: Ceres CLONE 1897349
  misc_feature (58)..(127): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAGYPEDNQHALNGYEEEEVDEEEGHPGRRGGRDGGSGYGDAGGEDGRGAAGDSSGKIFVGGVAWETTEETFSKHFEKYGAITDSVIMKDKHTKMPRGFGFVTFSDPSVIDKVLEDEHVIDGRTVEVKRTVPREEMTTKDGPKTRKIFIGGLPPSLTEG

SEQ ID NO: 30205 - DNA, 3252 bp, Panicum virgatum
  misc_feature: Ceres CLONE 1897358
  misc_feature: Encodes the peptide sequence at SEQ ID NO. 30206
gcttcacctctgcgcgctgcgcccctcctctcccccaccaatccttgttcattttttttaatcgaagcgactccgcgcccaactcgtcgtgggcgggcgggagcgcgcgcgggggcctagggtttccgcgggcgatggaggcggcggcggcggcctcttccgcatcggcctcggcgtccgggagccggtcgcgcccatccaccagcgccgcgcaggttatcagtattacgggtgtgcgtgctgaggaagaaaatgctgcctccccctatgttttatctgtaattgattcactaaagaagaggatcactgcagatcgtttaacatacatcaagaatagaataggggagaacaaggctaacctcagcacctttacacagaggacttacaatttgtcaaaaaataggcaaaataatacatcaaagggtactgagttagcaccaaatttgctcacgaaaaggcaagatgatgcactatgcaccctgcatagtgttgatgtttgtcctgctgacaaagacggtagcaattttcaagatgaaagtcctttatcctcattgaatgttattttgggtggaaatctcggtgcaaagaatgctatccgaccaattaaactaccagaagtgtcaaagcttccaccctatacaacgtggatatttttggacaggaaccagaggatgtcagaagatcaatccgtacttggtcgacggaggatttactatgatgccagttgtggcgaagcactaatttgcagtgatagcgaagatgaagccattgaggatgaggaggagaaaaaagaatttaaacattcagaagattgcattattcggatgactgttcaagagtgtggcgtgtcagatgctgtatggcaaacgctggctcaatatcttgagagggctactgatgacataaaggccaggtatgagatcctgcatggtgagaaaactcaggattcttgtaagaaagtgactgagcaaaatgtcaaagtggaagatttgtacggtgacaaagatttggatgcagcattggattcctttgacaatctcttctgtcgacgatgtctagtttttgattgcaagctacacgggtgttctcaagatttagtatttcctacagaaaaacagccagcttggaatggcattggtgatggtgtaccctgtggtcgtcattgccataaacaggcctctgatccggattctgtagctgcaattgatcacatgcttattgatggtgaggaaccaactcgttcatcaggcaatgcaacgaacaagccaggcacaaatagaaaaaagaatggctccagcggaaggaagactaaatctcagcaaagcgaaacctcttcaactgcaagggctgtttcggaaagcagtgactcagaagtacatccaataagcaataaacctccacagccctcccctagtccctcaaaagttaaaattggcccaaaaggtggaatcagaaagattaccaatagaagaatcgctgagaaaattcttatgagtgtgaaaaaaggtcaaagagaaatggcatcgtcggattctaattctgttagtgaatcccctttggcagcaagggacataagaattatacttagatctgatgcacgaaacggaaataaggaagcaattgtatcctctgaatacactccaaacacaagaagtaccagaaagatgagtacacctcaagttgggaatagctcagcttcagctgaagctcataatgattcaatggaggaagatggttacgatacttcaaggaaagaagaattcgtcgatgagaatatatgcaagcaagcggataactttagatcctggaagccaattgagcagggacttttagtcaaaggattagagatttttggaaggaacagttgtttaattgctcggaaccttcttggaggaatgaagacatgcagagatgtttttcagtatatgaattatattgaaaacagcagtgcatctggaactcttagtggtgttgattctcttgttaaaggatatataaagggtaatgaattgcgctcgagatcaagatttttcagaaggagaggtaaagtgcgtcgtttgaagtacacctggaaatctgcaggttaccattctataaggaaaaggattacagaaaggaaaggtcagccctgtcgacaatataatccttgtggttgtcaatctgcatgtgggaagcagtgtccatgtctcacaaatgcgacatgctgtgagaaatactgcgggtgttccaaaatttgcaagaaccgttttcgaggttgtcattgcgcaaagagtcagtgtcgcagccgtcaatgcccgtgctttgctgctgatagggaatgtgatcctgatgtttgcagaaactgctgggttgggtgtggtgacggtacattgggagttccaaaccagaggggagataattatgaatgccggaacatgaaactgcttctcaaacaacaacaaagggtcttacttggaagatccgacgtttctggctggggagcgttcctgaagaatagtgtcagtaaacatgaatatcttggcgagtataccggggaactaatctcccacaaggaggcagataagcgtggaaagatatacgatcgtgagaattcatcatttcttttcaacctgaacaatgagtttgttcttgatgcatacagaatgggtgacaagctgaaatttgccaaccattcccctgatccgaattgctatgccaaggttattatggtagctggtgatcatagagtgggcatatttgccaaagaaagaatcctagctggtgaagagttgttttatgattaccgctatgagcctgaccgagcccctgcttgggcccgaaagccagaggattcccgaggaaaggatgatggacaagcatccaatgggcgtgcaaagaagctcgcccaaaataccagaggctgattctgattctttcattggagggcctaaatttggcagccattcaaacctggcgggaacatgtcattcatagccccccagatttatttgaacccattgtcatcgtaacttgaatgtttcatggtttagtttgaattttccattctccacggtggctggtcctgccatccgtagaattaggtggtgggcgactcatcagctgatgcaacatgagttgacaaatacgttgcgtctgctccttgagagcctgattcttgtggagattagagttcttttgaagcaacagagttctaccgcagttcctgtttactgtatccacaaaaaaaagggtaggttcctgtttactgtatcc

SEQ ID NO: 30206 - protein, 922 aa, Panicum virgatum
  misc_feature: Ceres CLONE 1897358
  misc_feature (763)..(891): Pfam Name: SET Pfam Description: SET domain
  misc_feature: SWISSPROT Homolog: EC 2.1.1.43 Histone-lysine N-methyltransferase
MEAAAAASSASASASGSRSRPSTSAAQVISITGVRAEEENAASPYVLSVIDSLKKRITADRLTYIKNRIGENKANLSTFTQRTYNLSKNRQNNTSKGTELAPNLLTKRQDDALCTLHSVDVCPADKDGSNFQDESPLSSLNVILGGNLGAKNAIRPIKLPEVSKLPPYTTWIFLDRNQRMSEDQSVLGRRRIYYDASCGEALICSDSEDEAIEDEEEKKEFKHSEDCIIRMTVQECGVSDAVWQTLAQYLERATDDIKARYEILHGEKTQDSCKKVTEQNVKVEDLYGDKDLDAALDSFDNLFCRRCLVFDCKLHGCSQDLVFPTEKQPAWNGIGDGVPCGRHCHKQASDPDSVAAIDHMLIDGEEPTRSSGNATNKPGTNRKKNGSSGRKTKSQQSETSSTARAVSESSDSEVHPISNKPPQPSPSPSKVKIGPKGGIRKITNRRIAEKILMSVKKGQREMASSDSNSVSESPLAARDIRIILRSDARNGNKEAIVSSEYTPNTRSTRKMSTPQVGNSSASAEAHNDSMEEDGYDTSRKEEFVDENICKQADNFRSWKPIEQGLLVKGLEIFGRNSCLIARNLLGGMKTCRDVFQYMNYIENSSASGTLSGVDSLVKGYIKGNELRSRSRFFRRRGKVRRLKYTWKSAGYHSIRKRITERKGQPCRQYNPCGCQSACGKQCPCLTNATCCEKYCGCSKICKNRFRGCHCAKSQCRSRQCPCFAADRECDPDVCRNCWVGCGDGTLGVPNQRGDNYECRNMKLLLKQQQRVLLGRSDVSGWGAFLKNSVSKHEYLGEYTGELISHKEADKRGKIYDRENSSFLFNLNNEFVLDAYRMGDKLKFANHSPDPNCYAKVIMVAGDHRVGIFAKERILAGEELFYDYRYEPDRAPAWARKPEDSRGKDDGQASNGRAKKLAQNTRG

SEQ ID NO: 30207 - DNA, 1720 bp, Panicum virgatum
  misc_feature: Ceres CLONE 1897380
  misc_feature: Encodes the peptide sequence at SEQ ID NO. 30208
atctggctcctctgtctcggccctggtctcgaaccggtcgggaggtcaggtgggggagcagcacgccagcatggaggcgagcagcggccggggtcggagcgggagctcggctctcaagcgccgcagaggcgccggcgccggcgccagccccggctccgggtcgacggcgcagttgctgaacgacgacatcctccgctccgtcttctcccgcctggacgaccacttcgacctcgcccgatgctccgccgtctgcagctcctggaataggataattgtaacagcccatctcatgagggatctgtattacaagaggaatccaccagcaagaggttcaagctctaacatttcagtgaaaagttactttgaggcgcttgcaatggatgagcatgcatcctctttgtctagtgggcaagctgatgcctatcagtggattggccacccaatgagggctactttgtgccgtatgaggggtggttcgattttaactggagttggagataagtttctccggctttggtctgctgaaacctgcaaattcatgaatgagtaccatgtgccgaatgctaaagcattggtcgacttcgattttgatgaaaataagattgtaggtttgactagctcccaaatttgcatatggagacggagtgaaccaagaagcatatttcaatctggtggagcctcgttcaatcatgggttatgcatgagttttgctgacccagaggttgtaattggctgtgaggatggccgagcctttgtatatgatatgtacagtaggagttgttcaagtatttatcggcttcattcttctcctgtaacatgcttgacaataaccgatgatcagctgattcttggtggttctacatttggaaatgtagctattgcggatcaaacctcaggtcagaagttaggtgttctgaaatcagcttatgcaccattagcaataagatccttatctttcaacacaaattcacacatggtattcgctggctcatctgctggttatgcacattgctgggacttaaggactctgaagcctctttgggaaccaagagtcagcccaaacgtcatctacagtgtacatcacttgccaggtgacacagcaacactggcagtcggtggcattgacggtgtgcttcggttgatatgccaaagaactggtgatatcattcgaagcattatcgtggacacagaccgcccagcagaatccacatcgagatccaggcatcaaactgagaagaagcgtgttcgcgaggttgccccggatgcccaactggacaacatctccacacgcttgcgccctcagattaccagcctgtcagttggcatgaagaaaatcgtgaccacccatggcgaaaactacattagggtcttgaagttttgcccaaaaagatcataaaactgtcattataagtgtgacctagctatcctgttagcccactatttgtaacctgtacgctctctgaatagtatgtgctatgtaactgtatgaatagcttgaaaagctgaaacataggttgatgtactgttgctcttaagatgtctgaatcaggactaatgtctgcgggtcaagagttggacatatatgattgtagaaaaaaaactgtttgtagtcagtctgtgataagtgtttgtagaaaagaatgttttatttctttttgtgaaagacaagaatgtttattctatatttctatgaatagaaaacaaatggcgtcttcagttc

SEQ ID NO: 30208 - protein, 441 aa, Panicum virgatum
  misc_feature: Ceres CLONE 1897380
  misc_feature (31)..(79): Pfam Name: F-box Pfam Description: F-box domain
MEASSGRGRSGSSALKRRRGAGAGASPGSGSTAQLLNDDILRSVFSRLDDHFDLARCSAVCSSWNRIIVTAHLMRDLYYKRNPPARGSSSNISVKSYFEALAMDEHASSLSSGQADAYQWIGHPMRATLCRMRGGSILTGVGDKFLRLWSAETCKFMNEYHVPNAKALVDFDFDENKIVGLTSSQICIWRRSEPRSIFQSGGASFNHGLCMSFADPEVVIGCEDGRAFVYDMYSRSCSSIYRLHSSPVTCLTITDDQLILGGSTFGNVAIADQTSGQKLGVLKSAYAPLAIRSLSFNTNSHMVFAGSSAGYAHCWDLRTLKPLWEPRVSPNVIYSVHHLPGDTATLAVGGIDGVLRLICQRTGDIIRSIIVDTDRPAESTSRSRHQTEKKRVREVAPDAQLDNISTRLRPQITSLSVGMKKIVTTHGENYIRVLKFCPKRS

SEQ ID NO: 30209 - DNA, 1778 bp, Panicum virgatum
  misc_feature: Ceres CLONE 1897389
  misc_feature: Encodes the peptide sequence at SEQ ID NO. 30210
ttttcgaccggaagcgtctcaatcgcggggttcttggtttccgcgggccgagtccttgggcgggcggcggcggcggccatggagccggcggcggcggccgcgggcattgtgaaggaggagctcctggagcagcagccgctgcaggacggcggcggggacgcgccgcgcccgatggaggggctgcacgaggtcgggcccccgccgttcctgaccaagacgttcgacctggtggaggacccggccaccgacgccgtcgtctcctggagccgcgccggcaacagcttcgtcgtctgggacccgcacgtcttcgctgacacgctgctcccgcgcctcttcaagcacagcaacttctccagcttcgtccgacagctcaacacctatctaaatggaacaagatactgtcgatgaagtacgagaaccagattgttttgttctagaagactctactgatcaccttcagatgctataggctttagaaaggttgatcctgatagatgggagtttgcaaatgaaggttttctcaggggtcaaaggcacctactgaagacaataaagagaaggaagccaccatctgctgcgcctcaatcacatcaacagcaggcttccgcttcttgcctggaggttggtgagtttggatttgaggaagagattgacaggctgaagcgtgataagaacatcttaatcacagaagtagtaaagctaaggcaggagcaacaaagtactaaagatcatgtgagagccatggaagagaggctacgtgtgactgagcagaagcaggtacagatgatggggttcttggcaagagcaatgcggaatccagagttcttccagcagttggtccagcagcaagataagaggaaggaacttgaggatgtcatctcaaagaaaagaaggcgaccgattgacaacactccattctacagccctgaggaaacaagtcagagtgaacagcttgattcacagttcatgttcgattctgatgtgcttgatgggctcagtgaacctggaatgcctgagctggagaatttggcagtgaacattcaggagcttggaaagggtagtacagatggtgcaaaaatggatcaagctaatggccagtcagagctgaatgatgacttctgggcagagctactgatcgaagattttggagacaaggcagggcagtcagagttggatggaagacctgaagttgtggagcaccttgctcaacaactggggtatctgagttcttctagcccaaagtagagttgtgtttgtaacggttcatccgacaattgctggtgctttccatactattgcagatcatcttgaacaacctgttaaacggtggagatttgtggctgttctgaggggttcatgtgggaggctcagactgtggaaaccactatgctgaaggctccgtgctgtgagggatccgtgaggtgttggctaacttctccatgctgactgacaaagaagtcctacagacacagaccagagaaaacatacagctgttatcagctcttatccagaagctcttacaaccagaagctgttctactgtaaatgcacgtgcccgtgccatgggtggactttcttcaggttctgcattgggttgtagccttaattttgagtacttgagtcactctgtgaatggtgtaacctgaagacatccttagcttgttgtttagctattaagcatgatgttttgtacactgtgcgtcaggttgcaaaataggaccagatctgaacgatttagcatatattcttcctattgccatcatattgacatatttttcc

SEQ ID NO: 30210 - protein, 109 aa, Panicum virgatum
  misc_feature: Ceres CLONE 1897389
  misc_feature (41)..(109): Pfam Name: HSF_DNA-bind Pfam Description: HSF-type DNA-binding
  misc_feature: Useful for making plants with modulated heat sensitivity
  misc_feature: The sequence is a functional homolog of SEQ ID NO 1685 in the 10/412,699 US patent application
  misc_feature: The sequence is a functional homolog of SEQ ID NO 2660 in the 10/374,780 US patent application
  misc_feature: The sequence is a functional homolog of SEQ ID NO 74 in the 10/225,066 US patent application
  misc_feature: The sequence is a functional homolog of SEQ ID NO 926 in the 10/412,699 US patent application
  misc_feature: The sequence is a functional homolog of SEQ ID NO 1686 in the 10/412,699 US patent application
  misc_feature: The sequence is a functional homolog of SEQ ID NO 1687 in the 10/412,699 US patent application
  misc_feature: The sequence is a functional homolog of SEQ ID NO 200 in the 10/225,068 US patent application
  misc_feature: The sequence is a functional homolog of SEQ ID NO 2428 in the 10/374,780 US patent application
  misc_feature: The sequence is a functional homolog of SEQ ID NO 942 in the 11/435,388 US patent application
  misc_feature: The sequence is a functional homolog of SEQ ID NO 422 in the 10/666,642 US patent application
  misc_feature: The sequence is a functional homolog of SEQ ID NO 816 in the 11/435,388 US patent application
  misc_feature: The sequence is a functional homolog of SEQ ID NO 378 in the 10/374,780 US patent application
  misc_feature: The sequence is a functional homolog of SEQ ID NO 80 in the 10/225,066 US patent application
  misc_feature: The sequence is a functional homolog of SEQ ID NO 950 in the 10/412,699 US patent application
  misc_feature: Useful for making plants with modulated biomass
  misc_feature: The sequence is a functional homolog of SEQ ID NO 2794 in the 10/374,780 US patent application
  misc_feature: The sequence is a functional homolog of SEQ ID NO 82 in the 10/225,066 US patent application
  misc_feature: The sequence is a functional homolog of SEQ ID NO 882 in the 11/435,388 US patent application
  misc_feature: The sequence is a functional homolog of SEQ ID NO 2201 in the 10/666,642 US patent application
  misc_feature: The sequence is a functional homolog of SEQ ID NO 865 in the 10/666,642 US patent application
  misc_feature: The sequence is a functional homolog of SEQ ID NO 136 in the 10/225,066 US patent application
  misc_feature: The sequence is a functional homolog of SEQ ID NO 2276 in the 10/374,780 US patent application
  misc_feature: The sequence is a functional homolog of SEQ ID NO 40 in the 11/375,241 US patent application
  misc_feature: The sequence is a functional homolog of SEQ ID NO 192 in the 10/412,699 US patent application
  misc_feature: Useful for making plants with modulated low light sensitivity
  misc_feature: Useful for making plants with modulated nitrogen use efficiency
  misc_feature: Useful for biocontainment applications
  misc_feature: The sequence is a functional homolog of SEQ ID NO 404 in the 11/479,226 US patent application
  misc_feature: The sequence is a functional homolog of SEQ ID NO 832 in the 11/435,388 US patent application
  misc_feature: The sequence is a functional homolog of SEQ ID NO 1418 in the 10/666,642 US patent application
  misc_feature: The sequence is a functional homolog of SEQ ID NO 142 in the 10/666,642 US patent application
  misc_feature: The sequence is a functional homolog of SEQ ID NO 194 in the 10/412,699 US patent application
  misc_feature: The sequence is a functional homolog of SEQ ID NO 2278 in the 10/374,780 US patent application
  misc_feature: The sequence is a functional homolog of SEQ ID NO 409 in the 11/479,226 US patent application
  misc_feature: The sequence is a functional homolog of SEQ ID NO 782 in the 10/225,066 US patent application
  misc_feature: The sequence is a functional homolog of SEQ ID NO 2203 in the 10/666,642 US patent application
  misc_feature: The sequence is a functional homolog of SEQ ID NO 2205 in the 10/666,642 US patent application
  misc_feature: The sequence is a functional homolog of SEQ ID NO 2207 in the 10/666,642 US patent application
  misc_feature: The sequence is a functional homolog of SEQ ID NO 1805 in the 10/374,780 US patent application
  misc_feature: The sequence is a functional homolog of SEQ ID NO 1026 in the 10/225,066 US patent application
  misc_feature: The sequence is a functional homolog of SEQ ID NO 110 in the 11/375,241 US patent application
  misc_feature: The sequence is a functional homolog of SEQ ID NO 2280 in the 10/374,780 US patent application
  misc_feature: The sequence is a functional homolog of SEQ ID NO 2282 in the 10/374,780 US patent application
  misc_feature: The sequence is a functional homolog of SEQ ID NO 872 in the 10/225,066 US patent application
  misc_feature: The sequence is a functional homolog of SEQ ID NO 918 in the 11/435,388 US patent application
  misc_feature: The sequence is a functional homolog of SEQ ID NO 1233 in the 11/479,226 US patent application
  misc_feature: The sequence is a functional homolog of SEQ ID NO 144 in the 10/666,642 US patent application
MEPAAAAAGIVKEELLEQQPLQDGGGDAPRPMEGLHEVGPPPFLTKTFDLVEDPATDAVVSWSRAGNSFVVWDPHVFADTLLPRLFKHSNFSSFVRQLNTYLNGTRYCR

SEQ ID NO: 30211 - DNA, 636 bp, Panicum virgatum
  misc_feature: Ceres CLONE 1897460
  misc_feature: Encodes the peptide sequence at SEQ ID NO. 30212
atcaatcaatcccacatcgactgagtacaggaaggccacagcacagaggccggccgggagcagcagcagcgagatggcggcggcggagtcctctggcacggcgatagggtcctcgggaagatgggccctccacggcaagacggccctcgtcaccggcggcacgcgcggcatcgggcgtgcggtagtggaggagctggcggcgctaggggcggctgtgcacacctgctcccggaaggaggaggagctcggcgagcgcatcaaggagtgggaggccaggggcttccgcgtcaccggctccgtctgcgacctctccgcgcgtgaccagcgggagcgcctgcttcgcgaggtaaacaatgtgggaacaaacataaggaacccaactactgaattttctgcagaggaatactcattttttatggctactaatcttgaatctgcatatcacttgtgccaaattgcacatcctcttttgaaattatctgggtcaggcagcattatcttcatttcatctgtcgctggagtggtgggcatctttagcggaagtgtatatgctatgactaaaggtgctattaatcagttaaccaagaacttagcatgtgagtgggcaaaagacaacataagagctaactctgttgc

SEQ ID NO: 30212 - protein, 187 aa, Panicum virgatum
  misc_feature: Ceres CLONE 1897460
  misc_feature (22)..(178): Pfam Name: adh_short Pfam Description: short chain dehydrogenase
  misc_feature: SWISSPROT Homolog: EC 1.1.1.206 Tropine dehydrogenase
MAAAESSGTAIGSSGRWALHGKTALVTGGTRGIGRAVVEELAALGAAVHTCSRKEEELGERIKEWEARGFRVTGSVCDLSARDQRERLLREVNNVGTNIRNPTTEFSAEEYSFFMATNLESAYHLCQIAHPLLKLSGSGSIIFISSVAGVVGIFSGSVYAMTKGAINQLTKNLACEWAKDNIRANSV

SEQ ID NO: 30213 - DNA, 733 bp, Panicum virgatum
  misc_feature: Ceres CLONE 1897473
  misc_feature: Encodes the peptide sequence at SEQ ID NO. 30214
atcccccgcacgccacccgggagcggcggaggaagcaggcagccatgtcgtgcggcgggtgcgcctgcgaggcgccggcgggggcgggggcgacggcgtcggaggcgtacctgcggggcgagcaggtgcgggaggcgcgggagctggtggcggagctctgccgccacttctacgcgcaggggtgggtcaccggcaccggcggcagcatcaccgtcaaggtcaacgaccccgccgtgccgctcgccgaccgcctcatcgtcatgtcgccgtccgatgtgcagaaggagaggatggtggcagaagacatgtatgtgatggctgcagatgggaaagtgctctctgcgccaacagctaagccatggccaaacaaacctccaaagtgtacggactgtgctcctctgttcatgaaggcctatttgatgagaggagctggggctgtcattcacagccatggaatggagacttgcatagcaacaatgcttaaccctggtgcaaaggagttcaggatgactcacatggaaatgattaaaggaatcaaaggtcatggctaccgtgatgaattggttattcctattatcgagaacactccttatgagtatgagctcactgactccctaagtgaggcgattgcagcatacccaaagggcactgctgtccttgtacgtaaccatggaatatatgtgtggggtgactcttggatcatgccaagacacaggctgaatgctaccattat

SEQ ID NO: 30214 - protein, 229 aa, Panicum virgatum
  misc_feature: Ceres CLONE 1897473
  misc_feature (33)..(223): Pfam Name: Aldolase_II Pfam Description: Class II Aldolase and Adducin N-terminal domain
  misc_feature: SWISSPROT Homolog: EC 5.1.3.4 L-ribulose-5-phosphate 4-epimerase
MSCGGCACEAPAGAGATASEAYLRGEQVREARELVAELCRHFYAQGWVTGTGGSITVKVNDPAVPLADRLIVMSPSDVQKERMVAEDMYVMAADGKVLSAPTAKPWPNKPPKCTDCAPLFMKAYLMRGAGAVIHSHGMETCIATMLNPGAKEFRMTHMEMIKGIKGHGYRDELVIPIIENTPYEYELTDSLSEAIAAYPKGTAVLVRNHGIYVWGDSWIMPRHRLNATI

SEQ ID NO: 30215 - DNA, 678 bp, Panicum virgatum
  misc_feature: Ceres CLONE 1897496
  misc_feature: Encodes the peptide sequence at SEQ ID NO. 30216
gcggaccacgcgcttgatagtgcaggcgccccccacccaccacggatccccgccgcgacggagaatggaggccgccgccgccgccgccgccgccgccgtgctccccgcgctgatgccctccagtagcgcggtggtggtgctcttcgcctacctcggctacctcgccgccgccggagccatcctcccggggaagctcgttaccggcgccgtcctccccgactcctcccgcctccactaccgctgcaatggtttgctctcgctcctgctgctgctggggctctgcgcgttcggcgtctacgtggggtgggtgactcccacggttgtggctgacaggggactcgagcttctatccgcgaccttcatttttaatgtcgttgtctcttttggactctactttgccggcaccaagtcccgccacaaaagttcttctttgaaaccacatgttagtgggaacttcatagaagattggtggttgggagtgcagcttaatcctcattttatgggagttgacctcaaattcttttttgtgagggcaggaatgatggcatggttatttatcaacctctctttgtttgcgaagagctatctagctggttcggtcaatctttcggtcattctctaccagttcttttgtgcgtggtatgttatagattacttcgtccatgaagaattcatgac

SEQ ID NO: 30216 - protein, 204 aa, Panicum virgatum
  misc_feature: Ceres CLONE 1897496
  misc_feature: SWISSPROT Homolog: EC 1.3.1.70 Delta(14)-sterol reductase
MEAAAAAAAAAVLPALMPSSSAVVVLFAYLGYLAAAGAILPGKLVTGAVLPDSSRLHYRCNGLLSLLLLLGLCAFGVYVGWVTPTVVADRGLELLSATFIFNVVVSFGLYFAGTKSRHKSSSLKPHVSGNFIEDWWLGVQLNPHFMGVDLKFFFVRAGMMAWLFINLSLFAKSYLAGSVNLSVILYQFFCAWYVIDYFVHEEFM

SEQ ID NO: 30217 - DNA, 2032 bp, Panicum virgatum
  misc_feature: Ceres CLONE 1897552
  misc_feature: Encodes the peptide sequence at SEQ ID NO. 30218
actgctagtcgccacttgccagcaacggagcggagcggcaccccagtgtcagtccctccctcccgcgcccccaaaaacctcgcctcccgagtccccactcgccccccgccgcgcggcgcctcccacccacacgcgcccgccgatcgccaccgcacccgcgccagatctgacgaccacctaggtagctaccgcccgccgatcgcttgctccatcttcttcgcccgcgctcacgctagctcattgccagctacgcgcgctcggccgctccagtccgccgccaatgcgggccgcggcgcccggggcatgctactaggggccgacgccgcgggggttgcagcgccgggatggaggccgtgctgggcggcggggacggccggggcaagcgggcccgggtgaaggccgggggcccggacccggaccccgagcccgagcccaagcgcggccggccggcgcccgcgcccgcgccgtggccgccgcacccggcctcgcggatctaccgcgtctcgcgggcctccggcggcaaggaccgccacagcaaggtctacaccgccaagggcatccgggaccgccgcgtccgcctctccgtcgccaccgccatccagttctacgacctgcaggaccgcctcggctacgaccagcccagcaaggccatcgagtggctcatcaaggccgccgccgccgccatcgacaagctgccctcgctcgacgccgccgcgggcttccccgcccacccggcctccgccaaggacctgccggcggccctgccggatgcgccgcccgacgacgaccaccaccaccagcagcagcagctcacgaggtcgggctgcagcagcatgtccgagaccagcaagggctccgtcctctcgctctcccgctccgagagccgggtcaaggccagggagcgcgccagggagcggagcgccgccgcccaggacaaggacaaggaacccgccgccgacgacgccgccacggggcgccgcgccgcgcccaccgcctccgcgcaggccgcgtccttcaccgagctgctcacggggatggccgccgccgagcacaagcagcagccgcagccgcagtcgtctgctccctggcaggcaacggctgtccccgcgaccgctaactacatcgggttcgcgcagccccggaaggcggccggccacgcgatggcgcactccttcgcctccccggctccccatctcggcaacattgcgtccgtcgccatggccccggcgcagcacttcggcttggcgagcggcgccgtaaccatcgcctctggcggcgccgagccgcacgcggagatgacgcacttctcgttcttgcaggaccacttcatgcccgtccacgcggcgccggcttcgggtcccgccggagactacgacctcaacttctccatgtcctcgggtcttgtgggtgtcaacagtagggggacccttcagtccaattcgcagccgcacatctccggccaccaccaccaccagctccagaggctgtctactccactggacgctcccaacatacccttcctgttcagccccgccgccgcggtgaccacacccaccacggcggacaaccagttcgccgcgttccagctctggaacgggttccagcacgcagacatgaaggagaagggcaagaactgaacgacagctgcccaatgcagcgcagtgctttcctgatggatgtgaagacatcaaataattgcaacctatccctgcaagcaccaatcattgcgtgaagcggccataagtgtgctggggatgattcgccgcattcttggaagcagatcatccttcagacgtctaccctggtcaccactgaagaacctcatcgttgttactctgacaaccatctgcatttctttatccgcctgctgttgtattcatttcgtggagggagattttttggagcatgacttgctggagtgccctgtcagaaagccattgtaatcctttccattctagacattgccaaatgccaatggatggatcctgctcttgatcggctctttcgagttccaggatcagttatctccccc

SEQ ID NO: 30218 - protein, 430 aa, Panicum virgatum
  misc_feature: Ceres CLONE 1897552
  misc_feature (43)..(269): Pfam Name: TCP Pfam Description: TCP family transcription factor
MEAVLGGGDGRGKRARVKAGGPDPDPEPEPKRGRPAPAPAPWPPHPASRIYRVSRASGGKDRHSKVYTAKGIRDRRVRLSVATAIQFYDLQDRLGYDQPSKAIEWLIKAAAAAIDKLPSLDAAAGFPAHPASAKDLPAALPDAPPDDDHHHQQQQLTRSGCSSMSETSKGSVLSLSRSESRVKARERARERSAAAQDKDKEPAADDAATGRRAAPTASAQAASFTELLTGMAAAEHKQQPQPQSSAPWQATAVPATANYIGFAQPRKAAGHAMAHSFASPAPHLGNIASVAMAPAQHFGLASGAVTIASGGAEPHAEMTHFSFLQDHFMPVHAAPASGPAGDYDLNFSMSSGLVGVNSRGTLQSNSQPHISGHHHHQLQRLSTPLDAPNIPFLFSPAAAVTTPTTADNQFAAFQLWNGFQHADMKEKGKN

SEQ ID NO: 30219 - DNA, 2178 bp, Panicum virgatum
  misc_feature: Ceres CLONE 1897591
  misc_feature: Encodes the peptide sequence at SEQ ID NO. 30220
actcccaatccaaaacctaaaggctctcggctccgccgccctgttcgctcgccccgccttttgactcccccccagccctagctagctactgcttctgcggagcaacccgaaaatcctagaaaagcaagtggtcaagaaagagtggaagaaaggagcgcggtgatgatgatggcgataagtcgccccatgattctccccatcattccgtcgcctccggggcctgcgcgctgctaaaagggcgtcgccgtccgtcgccgcggtgctggtggtggtgtgcttggccgggggactcgtcgctgcgccgccgccaggccgcaacaatgccgcagtaccaggagctgccatgcggcgggcaggtgctcgacatcgacacggcgctcaagaacggcatcctcgggggcgcgctggagcccggggatgcggcggcgggggacgccgggaagcagccggtcgagctgaggaagatgatggacgagctcgacgcggccggggatgcaggcggggacgaggcggtgccggcggtcttcatctgcccgatctcgctcgagcccatggtggatccggtcacgctctgcacggggcagacgtacgagcgggccaacatctcgcggtggctcgcgctgggccaccgcacctgcccgaccacgatgcaggagctctgggacgacgcgctcacccccaacgccacgctccgccagctcatcgccgcctggttctcgcgacgctacaccaggttcaagaagcgctccgccgacttccacggccgcgccgccgacctcgtccacggcctccggggcacggcggtgcccaggaggcagccgctcaagggccaggcccgcgtcgccgcgctccgggagcttcgcaccctcgccgccacccaccagtccgtcaccaaggctatcgcggagtcgggcggcgtggccctgttgacctcgctgctcggccccttcacgtcccacgccgtggggacggaggccgtcgccattctcgtcagcggcgtgacgctcgacgccgacgcgaagaccgcgctcatgcagccagcgaaggtgtcgctcgtggtggacatgctcaatgagggggcggcggacacaaagatcaactgtgtccggctcatccgcatcctcatggatgagaggggtttccggccggacacagtggcgagcctgagcctcttggttggtgtcgtgcgcctcatccgggacaagcggcatccggacggtgtgttggcggggctcgagctgctgaattcgatttgtgcagtgcataggccggcgaggagtatgattgttagcattggtgcggttccacagctggtggaattgttgccggagctggcaacagagtgtgtcgagccggccttggacatcttggatgccctgtctgcagttccagagggcagggcggctctcaaggattgtccgcggacaatacccaatgctgttcgcttgctgatgagagtttcagaggcatgcacgcgacgggcgctgtcaatgctgtggacggtgtgccgtatggcgcctgaagagtgcgcacctgctgccgtggaggctgggttggctgccaagcttctacttgtcatccaaagtggttgtgcgccggagctgaagcagaaagcctcggagttgctcaagctgtgccggctcaactacacggacaccctcttcatctctaagtgcaaactcacaaggacaattcagtgaggggatggaaatgttgctgctctgatgtgatttgattcgatgatgcgtggtttgtcaattgaccttgctgagttcagagtttgaaggaggtggcattgccgaatggtaatgagcatacatagataaacttgcagatcttgctcatctagctctatcatcttatctgaagagatgctggtgggtgagcagatggcagattggtggcgaccatatccatttgtggagagagggagaagcagtataacagcaatgcagcacaatcagtggcatgttagatggcaagcaggcggatgtacatgcaaattgatgggtggtaagtacagccagttttgccattaggagtcgagagcattaagcaaagccagcacttttagatttttggcaatgtgggtatgtcagggctgtagatgttgctcccttccctgtaattacacagtagtgttgcttcaacactggaatatacattgccattgcttgg

SEQ ID NO: 30220 - protein, 459 aa, Panicum virgatum
  misc_feature: Ceres CLONE 1897591
  misc_feature (64)..(138): Pfam Name: U-box Pfam Description: U-box domain
MPQYQELPCGGQVLDIDTALKNGILGGALEPGDAAAGDAGKQPVELRKMMDELDAAGDAGGDEAVPAVFICPISLEPMVDPVTLCTGQTYERANISRWLALGHRTCPTTMQELWDDALTPNATLRQLIAAWFSRRYTRFKKRSADFHGRAADLVHGLRGTAVPRRQPLKGQARVAALRELRTLAATHQSVTKAIAESGGVALLTSLLGPFTSHAVGTEAVAILVSGVTLDADAKTALMQPAKVSLVVDMLNEGAADTKINCVRLIRILMDERGFRPDTVASLSLLVGVVRLIRDKRHPDGVLAGLELLNSICAVHRPARSMIVSIGAVPQLVELLPELATECVEPALDILDALSAVPEGRAALKDCPRTIPNAVRLLMRVSEACTRRALSMLWTVCRMAPEECAPAAVEAGLAAKLLLVIQSGCAPELKQKASELLKLCRLNYTDTLFISKCKLTRTIQ

SEQ ID NO: 30221 - DNA, 740 bp, Panicum virgatum
  misc_feature: Ceres CLONE 1897613
  misc_feature: Encodes the peptide sequence at SEQ ID NO. 30222
acccacctctctcccctcctccccctccgcctccagtctctccctctctagctcgttccattcctcgctcgcaatggccaagccgcgcaagaacagcgccgccgccgccggcaacagcagcagcagcggcgccgcggcggccggggacgccggggtgcgcgtgaagccgaagcgcacgcggaagagcgtgccccgggagtctccctcgcagcgcagctccatctaccgcggcgtcacccggcacaggtggacggggcggttcgaggcgcacctgtgggacaagaacagctggaacgagacccagaacaagaagggcaagcaagtttacctcggcgcgtacgacgacgaggaggcagcggcgcgggcgtatgacttggcggcattgaagtactggggccccgacaccatcctcaacttcccggcgtccgcgtacgaagaggagctcaaggaaatggaggggcagtccagggaggagtacattggatccctgaggaggtccatgaaatttatccgcaggaaaagcagcgggttctcgagaggtgtctccaaataccgaggcgtcgcgagacaccaccacaacgggagatgggaagcgaggatcggtcgtgttttcgggaacaagtatctctacctcggcacttatgcgacgcaggaggaggcggcgatggcgtacgacatggcggcgatcgagtaccggggcctgaacgccgtcacaactttcgacttcagccgctacaatc

SEQ ID NO: 30222 - protein, 222 aa, Panicum virgatum
  misc_feature: Ceres CLONE 1897613
  misc_feature (49)..(109): Pfam Name: AP2 Pfam Description: AP2 domain
  misc_feature (158)..(210): Pfam Name: AP2 Pfam Description: AP2 domain
  misc_feature: The sequence is a functional homolog of SEQ ID NO 1070 in the 10/225,066 US patent application
  misc_feature: The sequence is a functional homolog of SEQ ID NO 140 in the 11/375,241 US patent application
  misc_feature: The sequence is a functional homolog of SEQ ID NO 1904 in the 10/412,699 US patent application
  misc_feature: The sequence is a functional homolog of SEQ ID NO 2164 in the 10/374,780 US patent application
  misc_feature: The sequence is a functional homolog of SEQ ID NO 458 in the 11/435,388 US patent application
  misc_feature: The sequence is a functional homolog of SEQ ID NO 1314 in the 10/374,780 US patent application
  misc_feature: The sequence is a functional homolog of SEQ ID NO 1459 in the 10/412,699 US patent application
  misc_feature: The sequence is a functional homolog of SEQ ID NO 1900 in the 10/412,699 US patent application
  misc_feature: The sequence is a functional homolog of SEQ ID NO 358 in the 10/666,642 US patent application
  misc_feature: The sequence is a functional homolog of SEQ ID NO 676 in the 11/435,388 US patent application
  misc_feature: The sequence is a functional homolog of SEQ ID NO 104 in the 10/286,264 US patent application
  misc_feature: The sequence is a functional homolog of SEQ ID NO 202 in the 10/374,780 US patent application
  misc_feature: The sequence is a functional homolog of SEQ ID NO 524 in the 11/435,388 US patent application
  misc_feature: The sequence is a functional homolog of SEQ ID NO 574 in the 10/225,066 US patent application
  misc_feature: The sequence is a functional homolog of SEQ ID NO 650 in the 10/412,699 US patent application
  misc_feature: The sequence is a functional homolog of SEQ ID NO 1313 in the 10/374,780 US patent application
  misc_feature: The sequence is a functional homolog of SEQ ID NO 1458 in the 10/412,699 US patent application
  misc_feature: Useful for making plants with altered lignin content
  misc_feature: Useful for making plants with modulated drought sensitivity
  misc_feature: The sequence is a functional homolog of SEQ ID NO 320 in US patent 7157621
  misc_feature: The sequence is a functional homolog of SEQ ID NO 1311 in the 10/374,780 US patent application
  misc_feature: The sequence is a functional homolog of SEQ ID NO 1456 in the 10/412,699 US patent application
  misc_feature: The sequence is a functional homolog of SEQ ID NO 1014 in the 10/225,066 US patent application
  misc_feature: The sequence is a functional homolog of SEQ ID NO 2496 in the 10/374,780 US patent application
  misc_feature: The sequence is a functional homolog of SEQ ID NO 400 in the 10/374,780 US patent application
  misc_feature: The sequence is a functional homolog of SEQ ID NO 592 in the 10/225,066 US patent application
  misc_feature: The sequence is a functional homolog of SEQ ID NO 346 in the 10/374,780 US patent application
  misc_feature: The sequence is a functional homolog of SEQ ID NO 382 in the 10/225,066 US patent application
  misc_feature: Useful for biocontainment applications
  misc_feature: Useful for making plants with modulated flowering time
  misc_feature: Useful for making plants with modulated biomass
  misc_feature: Useful for making plants with modulated asexual embryo production
  misc_feature: The sequence is a functional homolog of SEQ ID NO 1310 in the 10/374,780 US patent application
  misc_feature: The sequence is a functional homolog of SEQ ID NO 1312 in the 10/374,780 US patent application
  misc_feature: The sequence is a functional homolog of SEQ ID NO 1455 in the 10/412,699 US patent application
  misc_feature: The sequence is a functional homolog of SEQ ID NO 1457 in the 10/412,699 US patent application
  misc_feature: The sequence is a functional homolog of SEQ ID NO 139 in the 11/479,226 US patent application
  misc_feature: The sequence is a functional homolog of SEQ ID NO 2210 in the 10/374,780 US patent application
  misc_feature: The sequence is a functional homolog of SEQ ID NO 24 in the 10/412,699 US patent application
  misc_feature: The sequence is a functional homolog of SEQ ID NO 50 in the 11/375,241 US patent application
MAKPRKNSAAAAGNSSSSGAAAAGDAGVRVKPKRTRKSVPRESPSQRSSIYRGVTRHRWTGRFEAHLWDKNSWNETQNKKGKQVYLGAYDDEEAAARAYDLAALKYWGPDTILNFPASAYEEELKEMEGQSREEYIGSLRRSMKFIRRKSSGFSRGVSKYRGVARHHHNGRWEARIGRVFGNKYLYLGTYATQEEAAMAYDMAAIEYRGLNAVTTFDFSRYN

SEQ ID NO: 30223 - DNA, 1897 bp, Panicum virgatum
  misc_feature: Ceres CLONE 1897625
  misc_feature: Encodes the peptide sequence at SEQ ID NO. 30224
acaccgcgccgcctgcctccactctccgcttccttccttcccatctcttcttcccccttccacttcctggcttgctcttctgggaacccttctcgggttcaggcagattggaagttgcagtgaaggcgttggggagagggaccggagcagttggagagcgataaagattgcagcgacaggggagacctgaagggctgcaaggggcttctctcttgcggcaacatgaataagctgctcttggtcttcttcctcttcctgctgggcgtcgcagcagttcatggtgaagatggtgcctacatcggcgtgaacattggcacggccatgtcgtcggtgccggcgccgacgcagatcacgacgctgctccgctcgcagaacatccgccacgtccgcctctacgacaccgaccgggcgatgctggcggcgctcgccaacaccggcatccgcgtcatcgtctccgtgcccaacgagcagctgctcgccatcggcaactccaacgcgacggcggccaattgggtggcgcgcaacgtggccgcgcacttccccgccgtcaacatcacggccattgccgtggggtccgaggtgctctccgcgcaggccaacgcggcgccgctgctcatgcccgccatgcgctacctccagaacgcgctggtggccgcggcgctggaccgatacatcaagatctccacgccgcactcgtcgtccatcatcctcgactccttcccgccgtcccaggccttcttcaaccggtcgctggacaacgtgctggtgccgatgctcaagttcctgcagtccacggggtcgccgctcatgctcaacgtgtacccctactacgactacatgcgctccaacggcgtcatcccgctggactacgcgctgttccggccgctgccgcccaacaaggaggccgtggacgccaacaccctgctgcactacaccaacgtcttcgacgcggtcgtcgacgccgcctacttcgccatgtcgtacctcaacgtcaccaacgtgccggtgatggtgacggagaccggatggccgcacaagggcgacccctcctccgagcctgacgctaccgccgagaacgccgacacctacaacagcaacctcatccggcacgtgatgaacagcaccggcacgccgaagcaccccggcgtggccgtgccgaccttcatctacgagctgtacgacgaggacacccggccggggtcgacttcggagaagtactggggcctgttcgacatgaacggcgtcccggcgtacaccctgcacctgacgggctccggcgtgctgctggccaacgacacgacgaaccagacctactgcgtggcgcgggaggacgcggacccgaagatgctgcaggcggcgctggactgggcgtgcggccccggcaaggtggactgctccgcgctcacgcaggggcagccgtgctacgagccggacaccgtggaggcgcacgcgacgtacgccttcaacgcctactaccacggcatggggatgggctccgggacctgctacttcagcggcgtcgcggtgatcacgacgaccgacccaagtcatggatcctgtgtctacgctgggaagaacgggtcggcgttgctgaacggcacctcgctggcgccgtcgtccaactccacggagggcgactccggcgcgcaccgggcggtcggcgacgtctcggctctcgcccgcatcgtctccgccgcgctgctcttgagcgtcctcctgttgtagagaggcttgtagtttgtagtactaggcacccgcgattatgcagagacttgcagaggagttaggcgttcgcgagagggatgattctttttgctgtcaagtgggatttggcctgggtgttggtttggtggaggggactattgtctctccgaatggaacaggatgtgcttctgtt

SEQ ID NO: 30224 - protein, 500 aa, Panicum virgatum
  misc_feature: Ceres CLONE 1897625
  misc_feature (26)..(348): Pfam Name: Glyco_hydro_17 Pfam Description: Glycosyl hydrolases family 17
  misc_feature (363)..(448): Pfam Name: X8 Pfam Description: X8 domain
  misc_feature: SWISSPROT Homolog: EC 3.2.1.39 Glucan endo-1,3-beta-D-glucosidase
  misc_feature: Useful for making plants with altered carbohydrate content
  misc_feature: Useful for making plants with altered cell wall content and/or composition
MNKLLLVFFLFLLGVAAVHGEDGAYIGVNIGTAMSSVPAPTQITTLLRSQNIRHVRLYDTDRAMLAALANTGIRVIVSVPNEQLLAIGNSNATAANWVARNVAAHFPAVNITAIAVGSEVLSAQANAAPLLMPAMRYLQNALVAAALDRYIKISTPHSSSIILDSFPPSQAFFNRSLDNVLVPMLKFLQSTGSPLMLNVYPYYDYMRSNGVIPLDYALFRPLPPNKEAVDANTLLHYTNVFDAVVDAAYFAMSYLNVTNVPVMVTETGWPHKGDPSSEPDATAENADTYNSNLIRHVMNSTGTPKHPGVAVPTFIYELYDEDTRPGSTSEKYWGLFDMNGVPAYTLHLTGSGVLLANDTTNQTYCVAREDADPKMLQAALDWACGPGKVDCSALTQGQPCYEPDTVEAHATYAFNAYYHGMGMGSGTCYFSGVAVITTTDPSHGSCVYAGKNGSALLNGTSLAPSSNSTEGDSGAHRAVGDVSALARIVSAALLLSVLLL

SEQ ID NO: 30225 - DNA, 1773 bp, Panicum virgatum
  misc_feature: Ceres CLONE 1897629
  misc_feature: Encodes the peptide sequence at SEQ ID NO. 30226
atgcgctttccatttcgcttcctcccccgtcctcctctcctggccgccggctctccccttcctcctcctctctccttccagagcacgaggattcttccgaacagcgaagccctaaccggagagggggatagagatggcgctggcgatcctcgcgaggcggcgcgcggcggaggccgtgctccggcggccgcgggcggcggccgtgtcggcgtggagggcgtacgcggcggcgggcgaggagagcgacgtcgtcgtgctgggcggcgggcccggcgggtacgtcgcggcgatcaaggccgcgcagctcgggctcaagaccacctgcatcgagaagaggggcaccctcggcgggacctgcctcaacgtcgggtgcatcccgtccaaggctcttctgcactcatcacatatgtaccatgaagcaaagacttcttttgcgcaccatggagttaagatctcaaatctggaagtggaccttccagcgatgatggctcagaaagacaaggctgtggcaggactaacaaaagggattgaaggactctttaaaaagaacaaggtgacctatgttaaaggctttgggaaattggcttccccctcagaagtatcagttgatttaattgatggcggtagcactgttgtcaaggggaaaaacataatcattgcaactgggtctgacgtaaaatcacttcctggaataactattgatgagaagaaagttgtttcatctactggtgctttgtgcttgtctgagatcccaaagaaactggtggtaatcggtgcaggttatattggccttgagatgggttcagtctggaaccgccttggttcagaggtcactgttgttgaatttgcgccagatatagtaccatcaatggatggcgaggtcaggaagcagttccaacgcatgttggagaagcagaagttcaagttcatgctcaagacaaaggtagttgggtgtgataccagtggagatggcgtgaagctgacgctcgagcctgcagctggtggtgatcagaccatccttgaagcagatgttgtccttgtctctgctggcagaaccccatttacttctggcatcggactagaaaccattggtgttgagacagataaggctggcaggatcctagttaataagcgcttcatgaccaatgtgaagggagtctatgcaattggggatgccatccctgggcccatgcttgcccataaagctgaagaggatggtgttgcatgtgttgagttcattgctggaaaggaaggccatgttgactatgacacagttccaggtgtagtttatacacatccagaagttgcctctgttggcaagactgaggagcaggtgaaggctctaggaatcgcctaccgtgttggcaaattcccactgctggctaacagccgtgcaaaggccattgacgatgctgaggggctagtcaaggtggtggctgagaagtaaactgacaagattctcggtgtgcacataatggcgcctaatgctggggaaatcatccacgaagctgtgcttgccttgcagtatggagcatcgagcgaagacgttgcccgcacttgccatgcgcatcccactgtgagcgaggccctcaaggaggcttgcttacaaaccttctccaaggctatccacatatgattccttggtttttcttttcttatcacccaaatgttgggtcaggaagttaattttggatctctgggaccaaaaagcctctgattgtcacatttcattttgttcgaaatactgcgaattgagccatgccatcttatagc

SEQ ID NO: 30226 - protein, 437 aa, Panicum virgatum
  misc_feature: Ceres CLONE 1897629
  misc_feature (38)..(352): Pfam Name: Pyr_redox_2 Pfam Description: Pyridine nucleotide-disulphide oxidoreductase
  misc_feature (209)..(306): Pfam Name: Pyr_redox Pfam Description: Pyridine nucleotide-disulphide oxidoreductase
  misc_feature (381)..(437): Pfam Name: Pyr_redox_dim Pfam Description: Pyridine nucleotide-disulphide oxidoreductase, dimerisation domain
  misc_feature: SWISSPROT Homolog: EC 1.8.1.4 Dihydrolipoyl dehydrogenase
MALAILARRRAAEAVLRRPRAAAVSAWRAYAAAGEESDVVVLGGGPGGYVAAIKAAQLGLKTTCIEKRGTLGGTCLNVGCIPSKALLHSSHMYHEAKTSFAHHGVKISNLEVDLPAMMAQKDKAVAGLTKGIEGLFKKNKVTYVKGFGKLASPSEVSVDLIDGGSTVVKGKNIIIATGSDVKSLPGITIDEKKVVSSTGALCLSEIPKKLVVIGAGYIGLEMGSVWNRLGSEVTVVEFAPDIVPSMDGEVRKQFQRMLEKQKFKFMLKTKVVGCDTSGDGVKLTLEPAAGGDQTILEADVVLVSAGRTPFTSGIGLETIGVETDKAGRILVNKRFMTNVKGVYAIGDAIPGPMLAHKAEEDGVACVEFIAGKEGHVDYDTVPGVVYTHPEVASVGKTEEQVKALGIAYRVGKFPLLANSRAKAIDDAEGLVKVVAEK

SEQ ID NO: 30227 - DNA, 716 bp, Panicum virgatum
  misc_feature: Ceres CLONE 1897631
  misc_feature: Encodes the peptide sequence at SEQ ID NO. 30228
acgacacacacgcaccagaggcgaaggtccgatcgaggagcgcgcaggcgcagcgacggcaatggcagcgtcactccaagccgcggccaccctgatgcagccggccaagatcggcggccgcgcctccgcctcgctgccgtcccgtcagccgtctcacgtcgccagggcgttcggcgtcgacaccggcgcggccaggatcacgtgctccctgcagtccgacatcagggaggtcgcgagcaagtgcgtcgacgccgccaagctcgccggcttcgcgctcgccacctcggcgctcctcgtctccggcgcgagcgcggagggcacgcccaggaggctgacctacgacgagatccagagcaagacgtacatggaggtgaaggggaccggcacggcgaaccagtgcccgaccatcgacggcggtgtcgagtccttcccgttcaagcccggcaagtaccagatgaagaagttctgcctggagccgacgtccttcaccgtcaaggccgagggcatcgccaagaacgcgccgcccgagttccagaagaccaagctcatgaagatctcttgcgcacacacccgatcccccccccccccccaacccgtccgcggccgcttcctggcgtgcccttcatgacttgaccgccgcccccaaccccgccgccggcgactgcattcacgacacccgctgcaacccccaaacccgtcgcccgccgcccgcaatc

SEQ ID NO: 30228 - protein, 188 aa, Panicum virgatum
  misc_feature: Ceres CLONE 1897631
  misc_feature (95)..(188): Pfam Name: MSP Pfam Description: Manganese-stabilising protein / photosystem II polypeptide
MAASLQAAATLMQPAKIGGRASASLPSRQPSHVARAFGVDTGAARITCSLQSDIREVASKCVDAAKLAGFALATSALLVSGASAEGTPRRLTYDEIQSKTYMEVKGTGTANQCPTIDGGVESFPFKPGKYQMKKFCLEPTSFTVKAEGIAKNAPPEFQKTKLMKISCAHTRSPPPPQPVRGRFLACPS

SEQ ID NO: 30229 - DNA, 1367 bp, Panicum virgatum
  misc_feature: Ceres CLONE 1897639
  misc_feature: Encodes the peptide sequence at SEQ ID NO. 30230
ccgctcattccctcccctcccctccccccgccgccgcctccttcctccataaaggaggctgcggatttcgatttgggaattgctgcgcgctccctagggagatgggttacattggccaccacggcgtggcgactctgcgccgctacaagtacagcggcgtcgaccactcgctcgtcgccaagtacatcctccagcccttctggtcccgattcgtcaacgtcttcccgctatggttcccaccaaacatgattacactgacaggtttcatgtttctgttgacatcggcattccttggctttttatattcacctcatctagatacagcaccgcccagatgggttcaccttgctcatggattgcttctattcctttatcagacttttgatgctgtggatggaaaacaagcaaggcgtaccaactcatcaagtcctttgggcgagctttttgaccatggatgtgacgcgcttgcctgtgcttttgagtctttggcgtttggaagcacggcaatgtgtggaaaggctaccttctggttttgggtcatttcagctgtcccattttactttgcaacctgtgagcacttttttacgaatacacttattcttcctatagtcaatggaccaactkaaggccttatgctgatctacttgtgccattttttcacctttttcgcaggagctgagtggtgggcacatgatttccagaagtcaatgcccctactgggttgggtgcctcttattcctgaaatccctgtgtatgacatcgtgctgtgccttatgattgcttttgctgtaatcccaacaattggatctaacattcacaatgtatacaaagttgttgcagcaagaaaaggaagcatggtgcgggcactagctatgatctttccttttggtttgctcttggctggagttcttgtgtggtcctatctgtctccttcagatataatgagaaatcagccacatctactaattattggaactggttttgcctttggctttcttgtgggaagactgattctggctcacttatgtgatgaaccgaaaggtctgaaaacagggatgtgcatgtctcttgcatattttccatttgcaatcgcaaatgctctgactgcccagcttgatgatggaaatcctcttgttgatgagcaactagttctcttaatgtactgcttatttacagtggcactgtacatgcattatgcaacatctgttattcatgagatcaccaacgcgcttgggatccactgcttcaagatcactaggaaaaaggcataattcacatccacgagcattggtgttcccctggattgtaatatatcacaagtggtgcctgccaaacaagaaaatatccttatttatcctcattacatc

SEQ ID NO: 30230 - protein, 389 aa, Panicum virgatum
  misc_feature: Ceres CLONE 1897639
  misc_feature (85)..(211): Pfam Name: CDP-OH_P_transf Pfam Description: CDP-alcohol phosphatidyltransferase
  misc_feature: SWISSPROT Homolog: EC 2.7.8.2 Diacylglycerol cholinephosphotransferase
  misc_feature (175)..(175): Xaa is any aa, unknown, or other
MGYIGHHGVATLRRYKYSGVDHSLVAKYILQPFWSRFVNVFPLWFPPNMITLTGFMFLLTSAFLGFLYSPHLDTAPPRWVHLAHGLLLFLYQTFDAVDGKQARRTNSSSPLGELFDHGCDALACAFESLAFGSTAMCGKATFWFWVISAVPFYFATCEHFFTNTLILPIVNGPTXGLMLIYLCHFFTFFAGAEWWAHDFQKSMPLLGWVPLIPEIPVYDIVLCLMIAFAVIPTIGSNIHNVYKVVAARKGSMVRALAMIFPFGLLLAGVLVWSYLSPSDIMRNQPHLLIIGTGFAFGFLVGRLILAHLCDEPKGLKTGMCMSLAYFPFAIANALTAQLDDGNPLVDEQLVLLMYCLFTVALYMHYATSVIHEITNALGIHCFKITRKKA

SEQ ID NO: 30231 - DNA, 373 bp, Panicum virgatum
  misc_feature: Ceres CLONE 1897639-R
gacccggtggatcgaggagtggaactccgtccgcgagaacctcgagttcaacttccgctggacgcgctgcagcctcgccgtcgtcggcctcttcggcctcgccgtccccatcctcgtctacaagggcatcattcgcgcattccacatgcaagacgaggttgaaggaagcccgttgaggaagttcttgttacatcaagaattatgctcactccgtttcaagaaataagtgcttttgccagatctcggcacttttaactggcttgagaaacataataatactcaattctctgtaagcactttaagttgttgtgcgttgctcccagtgtttctttgaggaacctatgtaccttcaatatgtaattgttgttgtgct

SEQ ID NO: 30232 - DNA, 772 bp, Panicum virgatum
  misc_feature: Ceres CLONE 1897671
  misc_feature: Encodes the peptide sequence at SEQ ID NO. 30233
agaggctcagatcagatttccgatcaccccagttccgtccccgatctcgtgttcgctcgtgtcgcggtttccagggacgcctccggctcgtcgctccgcagagatctccgcccccccacaagatgcagatctttgttaagaccctgactggcaagaccatcactcttgaggtcgagagctcggacaccattgacaatgtcaaagccaagatccaggacaaggagggcatccccccggaccagcagaggctcatctttgctggaaagcagctagaggatggtcgcaccctggctgactacaacatccaaaaggagtctactctccaccttgtcctgcgtctgaggggtggcatgcagatttttgtcaagacactcacagggaagacgatcactcttgaggttgagagctccgacaccattgacaatgtcaaggccaagattcaggataaggagggcatccccccagaccagcagaggctcatctttgctggcaagcagcttgaggatggtcgtacactagctgactataacatccagaaggagtccaccctccaccttgttctgcgtctgaggggtggcatgcagatatttgtgaagaccctcactgggaagaccataactcttgaggttgaaagctctgacaccatcgacaatgtcaaggcaaagattcaggacaaagagggaatcccacctgaccagcagaggctcatctttgccggaagcagcttgaggatggtcgtactctggctgactacaatatccaaaagggatct

SEQ ID NO: 30233 - protein, 216 aa, Panicum virgatum
  misc_feature: Ceres CLONE 1897671
  misc_feature (6)..(74): Pfam Name: ubiquitin Pfam Description: Ubiquitin family
  misc_feature (82)..(150): Pfam Name: ubiquitin Pfam Description: Ubiquitin family
  misc_feature (158)..(214): Pfam Name: ubiquitin Pfam Description: Ubiquitin family
  misc_feature: Useful for making plants with modulated nitrogen use efficiency
  misc_feature: Useful for making plants with modulated cold sensitivity
  misc_feature: Useful for making plants with modulated flowering time
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGSSLRMVVLWLTTISKRD

SEQ ID NO: 30234 - DNA, 758 bp, Panicum virgatum
  misc_feature: Ceres CLONE 1897703
  misc_feature: Encodes the peptide sequence at SEQ ID NO. 30235
acgcggtcggcccgtgcgccgccctccacgctcccctgcccagctgcagctccagtccggctgctgcggcagcaccctcccttcccacgacgtctctgttctttctctcggcctcggtcttcctttcctagcggcgacgaccgggcaagttgcgctgcccgttgttcgtcaagcgacggacgcttcgccggcggcgaacatccgacacgggtatgcctgcctattcccctcccttcccatcctgctgcgcgaaatcaaacacccaaacccctaacataaggccgtcactgctactttgggtgccagtgcaatgcccggtggatcttcagctgctgatggtgatgtggaggcagggtttgcaaagctccagggcgaagatttcgagtactacatgcagacatattcaatcatgctgggccgcaacagcaagaaatcgacagtggatgtggatctctcgagcctcggcgggggtatgaacatctcccgccaccatgcccggatattctacgatttccagcgtcgtcgattcgccctcgacgttattggcaagaatggatgccttgttgagggtgttctgcacctccctggaaacccacctgttaagcttgattcgcaggatctgctgcagattgaggacaaaaagttttactttctgctgccgacgcgatccatcttcgcctcagcagctgctgctcgacatgctcccattattcctccacctctccccgccacatcatatgcacgtccaggcccgccct

SEQ ID NO: 30235 - protein, 149 aa, Panicum virgatum
  misc_feature: Ceres CLONE 1897703
  misc_feature (33)..(108): Pfam Name: FHA Pfam Description: FHA domain
  misc_feature: Useful for making plants with altered alkaloid content
  misc_feature: Useful for making plants with altered lignin content
MPGGSSAADGDVEAGFAKLQGEDFEYYMQTYSIMLGRNSKKSTVDVDLSSLGGGMNISRHHARIFYDFQRRRFALDVIGKNGCLVEGVLHLPGNPPVKLDSQDLLQIEDKKFYFLLPTRSIFASAAAARHAPIIPPPLPATSYARPGPP

SEQ ID NO: 30236 - DNA, 1959 bp, Panicum virgatum
  misc_feature: Ceres CLONE 1897709
  misc_feature: Encodes the peptide sequence at SEQ ID NO. 30237
aaaagcgccccccacctcctctcctctcctccaacgacaacctccacctccacctctcgctcccaccaccgccaccgccaccgccaccgccaccgcgccctctcccggccacggcgtgccccgccccgtgcatgaaaccctacccctaaaccccgccccctcctctccggcgatggccaaggcgctgctctcctcctcctcgtccccgctccccgcgctgccccgcgccagcagcgggggcgccgcgggcctgctccctccgctccggctccgcccgggcgtccgccggcgcgccgcggcgtgcgccgtgagggcgggcctccacgggctcgactcgctcgggggtccccacctccaggccgcgctggagcgcgccgaggccgcgctctacacgctcgcggacgccgcggtcgtcgcggccgacgccgccgccgggggaggggacgcggggcaggcggccgcggaggcgcagaagaacggcgggtggttcgggttcatctccgaggccctcgaggtcgtgctcaaggtgctcaaggatggtctttcagcagttcatgtgccgtactcttatggctttgcaatcattctgctcaccatccttgtcaaggctgcgacattgcctctaaccaaaaagcaggtggaatcaactctggcaatgcagaatttacagccgcagattaaggcaatccagcagagatatgcaggaaaccaggaaaggatacagctagagactgctcggttatataggcaagctggagtcaaccccttagcaggatgttttccaacactggcaacaatacctgtctggattggcctttaccaagccctttcaaatgtagcaaatgaggggctgttgactgaaggatttttctggattccgtcattgggaggccctacaacaatcgcagctcggcaaagtggttctggaatttcgtggctcttcccatttgtggatggtcatcctccattaggctgacatgacacaatatgttatcttgtgttgcctgtgctacttgttgcttcccaatatgtctctatggagataatgaagccaccccagagcgatgacccatcacagaagaactcactgctcgtattgaaatttctcccatttatgattggatggttctctttgtccgtgccatcaggactgtccatttattggtttacgaacaatgtcctcagcacagcccagcaggtgtggttacggaaaatgggaggagcaaagcctgcagtcagtgagggaggtagcggaataattacagcgggacgtgcaaaacgctctaatgctcaaccagctggggaaaggtttaggcagctgaaagaacaggagaataggagaaaactgaacaaagcacttgcttcaggagattcaaaagcatcggcatcagcatatgactcagaggatgaagagtcagatgatgagactgaagaagagggagtacctgtggaggaagcatccagcactggcagtgacaagaaacttccaagttactcagggaagaagggcaaaagatcgaagaggaagcgcatggtgcagtaatcattacagcctaattggatgtcgtttttgtcttaactgttgaccagttcagtgccacagttgatctcggagacaattttgatggtctcttggaggcctaaacttgaggtgcacaccaatagacatatccggggtcacaggtaatgtgctggtaagtggtcagaccaactagctcagtatatgctaggcttgagggggtggacaggagaacaggagtcaagtaaatgtacaagcagagggaaaggatgtttagaagtagataaagatactcgtgtgtattctgtaaggtgggttccgaaattgggcagaatctggactgtccaaagcattcatgcacattccctttttctcctctgtaaccttatacaccattatttggagggtatattgcgaagctgacagccatccagtcatac

SEQ ID NO: 30237 - protein, 267 aa, Panicum virgatum
  misc_feature: Ceres CLONE 1897709
  misc_feature (131)..(267): Pfam Name: 60KD_IMP Pfam Description: 60Kd inner membrane protein
MAKALLSSSSSPLPALPRASSGGAAGLLPPLRLRPGVRRRAAACAVRAGLHGLDSLGGPHLQAALERAEAALYTLADAAVVAADAAAGGGDAGQAAAEAQKNGGWFGFISEALEVVLKVLKDGLSAVHVPYSYGFAIILLTILVKAATLPLTKKQVESTLAMQNLQPQIKAIQQRYAGNQERIQLETARLYRQAGVNPLAGCFPTLATIPVWIGLYQALSNVANEGLLTEGFFWIPSLGGPTTIAARQSGSGISWLFPFVDGHPPLG

SEQ ID NO: 30238 - DNA, 698 bp, Panicum virgatum
  misc_feature: Ceres CLONE 1897736
  misc_feature: Encodes the peptide sequence at SEQ ID NO. 30239
gaacgcataactgcctcagtcatccgtctcggtctcatcaatagcttcgacagcgctactgcttctcatggccatggcgatccacggcggcagtactgcttggtgcttcgcgtcggacaccatctccgccagctccaccatctccggtgaccggaccgtcgtgtcgagaggcggcaaattcgagctcggcttcttcagccccgctggtggcggcggcaacaactactacgtggggatctggtacaagaaggtcgtgtcgcagcgcacgcccgtgtgggtcgccaacagggccgcgccggtcgccgacccggcgtcctctcggctcgccgtggcggcggacggcaacctcgtgctcaccaacgaagccggcaagctcgtctggtgctctaacgtcagctccgccagcggctcgaacggtgacgccgccgtggcggtgatcttggacaccggcaacctcgtgctccggcgcgagatcagcggccaggttctgtggcagagcgtggagcacccgaccgacacgtggctccctggagtccaccttggcatgaacaagatcaccggcgaagtgcatgcgctggtttcttggaagaacgccggcgacccggctctcggcatgttcaccttcgggatcgaccccaacgggagcagccagtacttcacgaaatggaacaggaccgtgactttctacggcaccggag

SEQ ID NO: 30239 - protein, 208 aa, Panicum virgatum
  misc_feature: Ceres CLONE 1897736
  misc_feature (63)..(178): Pfam Name: B_lectin Pfam Description: D-mannose binding lectin
MAIHGGSTAWCFASDTISASSTISGDRTVVSRGGKFELGFFSPAGGGGNNYYVGIWYKKVVSQRTPVWVANRAAPVADPASSRLAVAADGNLVLTNEAGKLVWCSNVSSASGSNGDAAVAVILDTGNLVLRREISGQVLWQSVEHPTDTWLPGVHLGMNKITGEVHALVSWKNAGDPALGMFTFGIDPNGSSQYFTKWNRTVTFYGTG

SEQ ID NO: 30240 - DNA, 755 bp, Panicum virgatum
  misc_feature: Ceres CLONE 1897759
  misc_feature: Encodes the peptide sequence at SEQ ID NO. 30241
accatccaaagatccacgtagagcacaacacctgtcacgaagccatgaacggcgccatggcgagcgccttcggtagctcgacgagccccctcgtcccggcggtggtggctcccgctgcctcggccaagtcctctgcatgcccgtccaagaaaacccccgccgccacctacccccgccgcaccgtgtggtgccgggccgccggcgggcgcgacgacgacggcctcctctggctcccccgccgggacgtgctcaccagcctaggcggcgtcgccgccggcctcgtcgggtacccgggcctcgcgtccggcgcccagccggaggcgagctgccgccgcggcgacaaggtgaacgagagcctggtgaagtgcacggaccccaaccgggagttcccatgcccgccgccggcgcacgtcaaggccgtcgacttcacgccggagccgacggtgaagcgcgtccggcagccggcgcacctcctgagccgggagaaccaggagaagtacaaggaggccatcgcccggatgaaggcgctgccggcgagccacccgctgagcttcgcggcgcaggcggcgatccacgagtcctactgcgacgggcactaccggtacgacccggcggagaagaaccggcccttcgacgtgcacttctcgtggatcttcgcgccgtggcaccgcatgtacatctacttctacgagaaggccctcgggcagctcatcggcgacgacaccttcgcgctgcccttctgggactgggacgcg

SEQ ID NO: 30241 - protein, 232 aa, Panicum virgatum
  misc_feature: Ceres CLONE 1897759
  misc_feature: SWISSPROT Homolog: EC 1.10.3.1 Catechol oxidase
MASAFGSSTSPLVPAVVAPAASAKSSACPSKKTPAATYPRRTVWCRAAGGRDDDGLLWLPRRDVLTSLGGVAAGLVGYPGLASGAQPEASCRRGDKVNESLVKCTDPNREFPCPPPAHVKAVDFTPEPTVKRVRQPAHLLSRENQEKYKEAIARMKALPASHPLSFAAQAAIHESYCDGHYRYDPAEKNRPFDVHFSWIFAPWHRMYIYFYEKALGQLIGDDTFALPFWDWD

SEQ ID NO: 30242 - DNA, 680 bp, Panicum virgatum
  misc_feature: Ceres CLONE 1897767
  misc_feature: Encodes the peptide sequence at SEQ ID NO. 30243
agcttctcgctccgaagcttcaactacccatccagttacctgagcagagcacgaaagcagaggcggagaggtagctccctgacctgagcggagctgacagctgagcagattggtgttagggcaatggctgcggcgagtatgatcagggcgccggtcgggcagaatccgaggctcgcggggaggggcggcggcgtggtccggtgctcgttacagggcgcagtggtgggcggccgggcggagtggcagagcagctgcgcggtgctgtccagcaaggtggccgcggtcggcgcgcactccgtcaacggccacgtcgcgccgcccgcgccgccgcagaacggggcggcggtgctggatctgattcccgtgagcagaatcgacggcggcggcggcggcgtcccgacgaagctgccgcagccgctgcgcatcgcggacctgtccccggcgccgatgcacgggtcgcagctgcgcgtggcgtaccagggcgtgccgggcgcgtacagcgagaaggcggccggcaaggcgtacccgggctgcgacgccatcccctgcgaccagttcgaggtggcgttccaggccgtggagctctggatcgcagaccgcgccgtgctccccgtggggaactcgctgggcggcagcatccaccgcaactacgacctgctgctccggcaccggctccacat

SEQ ID NO: 30243 - protein, 185 aa, Panicum virgatum
  misc_feature: Ceres CLONE 1897767
  misc_feature (116)..(185): Pfam Name: PDT Pfam Description: Prephenate dehydratase
  misc_feature: Useful for making plants with altered lignin content
MAAASMIRAPVGQNPRLAGRGGGVVRCSLQGAVVGGRAEWQSSCAVLSSKVAAVGAHSVNGHVAPPAPPQNGAAVLDLIPVSRIDGGGGGVPTKLPQPLRIADLSPAPMHGSQLRVAYQGVPGAYSEKAAGKAYPGCDAIPCDQFEVAFQAVELWIADRAVLPVGNSLGGSIHRNYDLLLRHRLH

SEQ ID NO: 30244 - DNA, 723 bp, Panicum virgatum
  misc_feature: Ceres CLONE 1897799
  misc_feature: Encodes the peptide sequence at SEQ ID NO. 30245
  misc_feature (635)..(635): n is a, c, t, g, unknown, or other
aattttccgcgctgcgcttgtagacatctatccagcagagcgcagcaggatggtgtacgcgctcctgctggtcgccttggcggccgtcgccgccgcggcggtgctccgccactacctcccgctgctccgcggcggcctccccaagggcagcttcggctggcccctcatcggcgagaccatcggcttcctccacgcgcacccgtccaacaccgccggcggcttcctcaaggagcacgtcgccaggtacgggacggtgttcaagtcgcacctcttcggctcgccggcggtggtctcctgcgacgaggagctcaaccacttcgtgctgcacaacgaggagcgcctgttcgagtgcagctaccccggcgccatccgcaccatcctcggcgagtcctccgcgctggtggtcaccggcgagcgccaccgccagatcctggaagagtaccagatcttcatgaaggggatcatctccctccctatcaccctccccgggacagcattttccaagaccgtcaaggcaaggaagaggatatccgagaccatggagaagttcatcgaggacaggaagcgcagcccaaccaagcaggccgtcttcctcgacgtgctcctcgcgaacaaggagctcactcacgacgacnaggtcgccttcctgctggactcgctgctagcaggccacgagaccacctctatgctgctctccattctcgtctatttcattgggaaatc

SEQ ID NO: 30245 - protein, 224 aa, Panicum virgatum
  misc_feature: Ceres CLONE 1897799
  misc_feature: SWISSPROT Homolog: EC 1.14.13.77 Taxane 13-alpha-hydroxylase
  misc_feature (196)..(196): Xaa is any aa, unknown, or other
MVYALLLVALAAVAAAAVLRHYLPLLRGGLPKGSFGWPLIGETIGFLHAHPSNTAGGFLKEHVARYGTVFKSHLFGSPAVVSCDEELNHFVLHNEERLFECSYPGAIRTILGESSALVVTGERHRQILEEYQIFMKGIISLPITLPGTAFSKTVKARKRISETMEKFIEDRKRSPTKQAVFLDVLLANKELTHDDXVAFLLDSLLAGHETTSMLLSILVYFIGK

SEQ ID NO: 30246 - DNA, 2039 bp, Panicum virgatum
  misc_feature: Ceres CLONE 1897809
  misc_feature: Encodes the peptide sequence at SEQ ID NO. 30247
gaatccacccagaggccaccacgccggccgccgcggcaccgaccacgaaagggtggacccagcatcccccctctcggctctttcttcacctgcgagaaagagttggagaggggagggcgggccgggatggagggggcaggcgcggcggaggaggaggccagggccgtggaggagctccgggaggcgttggccgcgcgcgacctgctgccgcccaagtttgatgacaaacacaccatgaggagatttctaaaggcaaggggatttgatattgacaagacaatagacatgtggtcggaaatgctaaaatggagaaaagaatttggtgcagattctatcctgacagattttgtattcgacgaactagaagatgttcttctttattatccacatggctttcatggagtggatagagatggtagacctatttacattgagatacttgggaaggtcgacccaactaagctcttgaatgtgacaacagtggagagattcttaaaatatcatgttcagtcacttgagaggctctttgctgagaagtatccagcatgttctgtagcatcaaagaagcatgttgataccataataacaatacttgatgtgaaaggagtgaactggatgaaagtcagcaaattggctcgtgaggttgtacttcatataaacaaaatagatggagacaattatcctgagattttgcataggatgttcattgttaatgctggcagtggttttagattattgtggggtgctttgagaggtttaattgatccaaatacagctgaaaagatagaggtattgggagaagcataccaatgcagactgcttgaacaaattgataagagtcaactgccagattttcttggtggcgcctgcacttgctcgtgtgagggaggctgtcttaggtcaaacaaaggaccctggaatcagatgatgacttcagataacctttcagaatcagcaccaatggaaaccggacatctctccaatgagaatttggcttgtcaggacatggagccagatgtgcaaatgaagttggagaactccaaatcatctgattcagccagcattccactcaagatgctatcttcccctaatactcctgtcactaggaaggaaaatgtggtcactcccaggctaactacagtcagttcaacagttacatgttttcagttgtgccaccctgtttggtatcaccgattgctgaacttgcttgtagatgtgattaaagctatctttgtatttctatggaggctcctttcagtggctcaactgttctctgctctaaggagggtagcctctcactgcattaacacgagttccacaggtgaacatgtacatacgccaggcatgaagtcaagtgatcccattgacaaagatcgcacggccccatgcttagagagactaaaaaggctagaggacatggtcatggagctgaaccagcgatctccaagaattcctccagaaaaggaaaacctgatagaggagtcaatgaggcggattagatccattgagtgtgatataaagaagactcaacgcgcattgaataggacatcgttgaagcaattgaagctggaacagagagtggaaaattggaaagactccatgttaacaaactcatgtcggttcagttactgcaaggccatttaactggaaacctccatttcgtacatcagagaactaagggtttgttacacggtaaacttgtgcatatataaaaattatagtgtgacgtaggatttaaggtatagactacagctgtatataatgcatatatgtgatgttactacttaccaacatcacaaatcctttgaccactgttcatggacgagagataaatgtaaaagattggttgaggggtttccatttttctttacagccaaactgtttgtatcacagccatcagaatgatggcctttgcatgcataccgctgagaagtgttattgttcagccggaaattggcctgttcccttttctctgaacaccaagatgatctggctttaaaaaccagctgtaagtaaaggatgcatgggtgattttgctg

SEQ ID NO: 30247 - protein, 505 aa, Panicum virgatum
  misc_feature: Ceres CLONE 1897809
  misc_feature (87)..(273): Pfam Name: CRAL_TRIO Pfam Description: CRAL/TRIO domain
  misc_feature (2)..(70): Pfam Name: CRAL_TRIO_N Pfam Description: CRAL/TRIO, N-terminus
MEGAGAAEEEARAVEELREALAARDLLPPKFDDKHTMRRFLKARGFDIDKTIDMWSEMLKWRKEFGADSILTDFVFDELEDVLLYYPHGFHGVDRDGRPIYIEILGKVDPTKLLNVTTVERFLKYHVQSLERLFAEKYPACSVASKKHVDTIITILDVKGVNWMKVSKLAREVVLHINKIDGDNYPEILHRMFIVNAGSGFRLLWGALRGLIDPNTAEKIEVLGEAYQCRLLEQIDKSQLPDFLGGACTCSCEGGCLRSNKGPWNQMMTSDNLSESAPMETGHLSNENLACQDMEPDVQMKLENSKSSDSASIPLKMLSSPNTPVTRKENVVTPRLTTVSSTVTCFQLCHPVWYHRLLNLLVDVIKAIFVFLWRLLSVAQLFSALRRVASHCINTSSTGEHVHTPGMKSSDPIDKDRTAPCLERLKRLEDMVMELNQRSPRIPPEKENLIEESMRRIRSIECDIKKTQRALNRTSLKQLKLEQRVENWKDSMLTNSCRFSYCKAI

SEQ ID NO: 30248 - DNA, 759 bp, Panicum virgatum
  misc_feature: Ceres CLONE 1897830
  misc_feature: Encodes the peptide sequence at SEQ ID NO. 30249
atatttctcctcttgcattgcttcttccccggggcactcctcgtccttatcgtcaaccaccattgctcctttcccccaagcagcgcagctcctccaggacccaatcccgccgcgatcccggcccagccagccatggatccgtacaagcaccgcccgtccagcggcaacaacaccagcttctggaccaccaactccggcgcccccgtctggaacaacaactccgccctcaccgtcggccagcgaggacccatcctccttgaggactaccatctgattgaaaagcttgctcagttcgacagggaacgtatccctgaacgtgtagtccatgcacggggagccagtgccaagggtttctttgaagtaactcacgatgtttctcaccttacatgtgctgattttctccgagctcctgggattcagacccctgttattgttcggttctccacagttgtgcatgagcgtggaagccctgagaccttgagggatccacgtggttttgctgtcaagttctacaccagagagggtaactttgaccttgtgggtaacaacatgcctgtctttttcatccgagatgggatgaaattccctgacatggttcatgctttcaagccaaacccaaagaccaatttgcaggagaactggagaatagtatatttcttctcacaccacccagagagcatgcacatgttcacctttctctttgatgatgttggcatcccactcaactacaggcacatggaggggtttgggtgtgacacc

SEQ ID NO: 30249 - protein, 208 aa, Panicum virgatum
  misc_feature: Ceres CLONE 1897830
  misc_feature (18)..(208): Pfam Name: Catalase Pfam Description: Catalase
  misc_feature: SWISSPROT Homolog: EC 1.11.1.6 Catalase
MDPYKHRPSSGNNTSFWTTNSGAPVWNNNSALTVGQRGPILLEDYHLIEKLAQFDRERIPERVVHARGASAKGFFEVTHDVSHLTCADFLRAPGIQTPVIVRFSTVVHERGSPETLRDPRGFAVKFYTREGNFDLVGNNMPVFFIRDGMKFPDMVHAFKPNPKTNLQENWRIVYFFSHHPESMHMFTFLFDDVGIPLNYRHMEGFGCD

SEQ ID NO: 30250 - DNA, 2719 bp, Panicum virgatum
  misc_feature: Ceres CLONE 1897836
  misc_feature: Encodes the peptide sequence at SEQ ID NO. 30251
aacaacctatctcgaccctcaagattctatcctttgattctcctccgagatgctgccttttcgttgttgttgtacaagtcgtcttcatgcctaggacaaggaaggggagatggagatcgaggaagccgccggcgagatggaggaaatggaggcccccgccgtcagcacggtggcggtggcgatcagcgggagcaggagcagcaggcacgcgctcaagtgggccctcgacaagttcgtccccgaagggagggtcctcttccggatcctccacgtgcgcccggcgatcaccatggtgcccactccaatgggcaattttatcccgatctcacaagtacgggaagacgtagcatctgcatacaggaaagaagcagaatggcaagcgagcaatatgcttcttcctttcaagaagatgtgtgctcagaaaaaggtagaagctgaagctgttttacttgaatcagatgatgttgctgctgcaataagtgaagaaataggaaaattcaatatttccaaattagttttaggttcttcatcaaagaatatattccgaaggaaactcaaaggaagtaagactgcaaccaaaatctctgagtcaactccgagcttctgtacagcatatgttatttcaaaaggaaaacttacattcgtgcgctcagctacatctgacgttgttgaaacacctcgatccatatcttcttcaactgtttcttctcctagttctagaagtctttcctcctgtgcaccttcagaatggagagacacatatggaacaccaaatgtatcgttccaccaaccttccctgccattgcagcgcagccaagcactggcaatcataaacaagttgtcagacaggagagctagctcaggcagtgttgcaagcgaggtctcttgcaatgaagacacagccctgacaagttcacactcaatcgtatcagagatgcagttcagtagtggtagcagtggaaattctatgtacaagagcttccacagagataatttgcctgataactctgatcaggcatcagtttcagaaatttcagaaaatgttcaccattctaatgatcaggatgatctcaggcttcagattgaaaggttgagggttaaattacaacatcttcataagcttcatgaatgttctcagcacgaatcatttgacaccagtcaagaactgaaaaagttgcgcactcaagacattgaagatgaaatcaagcttaaagaaattcaactgacagaggacagagtaagaagattggtaagaaaacaggagatggaagaacacgaagcagggaaagaagctgaatttaagcaatgctctgatcaaattgaagaaaaacacagctataatgaccaagctaatgagaacgaaacaggaaagaagattgcaggatgctcttatgatgaatataataggtataaatgggaggagattcaggcgtcaacgtcatcattctcttctgctctcatgattggtaaggggtcatatggcaccgtttacaaggcgaaatttcaccatacagtagcagctgtcaaagtattgaactcccctgaaggctgtggaagtcagcaattacagcaggagcttgaggtccttggtaaaattcgtcaccctcacctgctgatgatgcttggagcatgccctgaacatggttgcctggtttatgagtacatggaaaatggtagcctggatgacatgctgcaacgcaggaataatacgccaccattgacctggtttgaccgtttcagaataacctgggaggtggccactgctctgatgtttcttcatagttccaaaccagagcctatcatccaccgtgatctgaaacctgcaaacatattgctcgacaggaacttggttagcaagataggtgatgttggcctatcaactttgcttccaagcatgggccagtacttgtctacaatgatcaagaacactgcacctgtgggcacgttgtgctacattgacccagaataccaaaggaccggtgtgctatccatgaaatccgatgtttacgcgctaggcattgtgatcttgcagttgctgacagcaagatcaccgatgggccttgcgcatgttgtggagaccgcactagaggatggttgctttgttgacatacttgatgcatctgctgggcagtggcctttgaatgagacacaacaactggctgctctggcactcaagtgctctgaaatgaggcgtaaagaccggcctgacttgaatgagcatgttcttccgatactggagcgactgaaggatgttgcaaccaaggccagagagtctgttcttcagggtcacacggcacctccaagccatttcatttgccccatacttcaggaagtaatgatggatccatatgttgcatcagatggttacacctatgatcgtaaggcgatagagttgtggctgagtacgaacgacacgtccccgatgaccaacctgcgtttaccgaacaagagcctgataccaaatcactctcttcgttctgcaatcatggactggaggtcgagaagcaagtgatgcatccttttttgctggagcaattgctgacttctcttccaatgaagatgtcagttttttttttccttttgaaatcttatggggaagtagtctccagaaagggttctaggttatgcagctcaagcaaaatgtaaaaaaaaaaaatcgtctgatagcatatatagctacctcgctgtcttaatgaaacatttttatcctttcctttgc

SEQ ID NO: 30251 - protein, 800 aa, Panicum virgatum
  misc_feature: Ceres CLONE 1897836
  misc_feature (446)..(705): Pfam Name: Pkinase Pfam Description: Protein kinase domain
  misc_feature (731)..(800): Pfam Name: U-box Pfam Description: U-box domain
  misc_feature (17)..(172): Pfam Name: Usp Pfam Description: Universal stress protein family
  misc_feature: SWISSPROT Homolog: EC 2.7.11.1 Non-specific serine/threonine protein kinase
MEIEEAAGEMEEMEAPAVSTVAVAISGSRSSRHALKWALDKFVPEGRVLFRILHVRPAITMVPTPMGNFIPISQVREDVASAYRKEAEWQASNMLLPFKKMCAQKKVEAEAVLLESDDVAAAISEEIGKFNISKLVLGSSSKNIFRRKLKGSKTATKISESTPSFCTAYVISKGKLTFVRSATSDVVETPRSISSSTVSSPSSRSLSSCAPSEWRDTYGTPNVSFHQPSLPLQRSQALAIINKLSDRRASSGSVASEVSCNEDTALTSSHSIVSEMQFSSGSSGNSMYKSFHRDNLPDNSDQASVSEISENVHHSNDQDDLRLQIERLRVKLQHLHKLHECSQHESFDTSQELKKLRTQDIEDEIKLKEIQLTEDRVRRLVRKQEMEEHEAGKEAEFKQCSDQIEEKHSYNDQANENETGKKIAGCSYDEYNRYKWEEIQASTSSFSSALMIGKGSYGTVYKAKFHHTVAAVKVLNSPEGCGSQQLQQELEVLGKIRHPHLLMMLGACPEHGCLVYEYMENGSLDDMLQRRNNTPPLTWFDRFRITWEVATALMFLHSSKPEPIIHRDLKPANILLDRNLVSKIGDVGLSTLLPSMGQYLSTMIKNTAPVGTLCYIDPEYQRTGVLSMKSDVYALGIVILQLLTARSPMGLAHVVETALEDGCFVDILDASAGQWPLNETQQLAALALKCSEMRRKDRPDLNEHVLPILERLKDVATKARESVLQGHTAPPSHFICPILQEVMMDPYVASDGYTYDRKAIELWLSTNDTSPMTNLRLPNKSLIPNHSLRSAIMDWRSRSK

SEQ ID NO: 30252 - DNA, 2417 bp, Panicum virgatum
  misc_feature: Ceres CLONE 1897887
  misc_feature: Encodes the peptide sequence at SEQ ID NO. 30253
atctacttgtagtgcgtgtgcgtggtcgtcgtccatccagcttccagccgtcctggagacctggagtagccgcgccatagcccggccggtatcacttgtctcctcacaaacagttcgccgtacggccggggatccatggcaaaggagatcaggacgacgtgaattgaagggcgatgatggcctcgccgtcgccgcacatgatgttgttgttattcctcacatcagctctactagcagcagccgtgcggccagcaacgagctcgtcgtcgccgccgccgtccggcacctcgccggagcccggaccgaccttctgctccgggcaggctcctgactccaacaactcctcctcctccccggctgtcgacgccgtgttccgcgaggacgagtacacggcgaccgtcgtgttcaacgcgacccgccgagcgccgctgccgtactggcgtggcggcaaggcggcggtgaggcgcctcctcgccgccgccgcgagcggcacgacgagcagccacatgtgccgcggcgccggcgcgagcagggccgccgccggggccggcgctggcctgatgatgtacggcctcacgcggtgcgccgccgggacgccgtgcgacgactgccgccgctgccttcgcggcgcgctcgcggctgtcgagaaggggtacaacggcagcgcggggatgcaggtcctgcggctcagctgcatggccaggtacgagagctatcccttctacaacgccacgaccgtgaggaggcgcgcgtttgagcaggccagcggtacgggagcagtcatggggccgcgtttgcctgcgccggctgcacatcctcctccccttgcgccgccccctgccggtcataccccaccaccgcgtttgcctccgccggcagcagtacatagtccccttgcgccccctgcaggttattcgccacggcctccaccagccgcatcgcccgttgaaacacagctcacgcaacaaagccacgggaagaagacgccgaagacactcataatgctgatcctttctattgcaaccggaatagtggttatcaccgtcatccttcttgtacacatctggtatcgtcgtcgaaagcattcaaataagatgcaacatgtcgtagcagctagcattccaggtgagaacatgtatgaccaagaagacgggcaatggagcatggaagatgaagaggacaaggatggagagagaatgacctgccaactctacagctaccaagttcttgaggctgcaacatgtcacttctcaaatagaaacaagctagggagtggtggatttggaacagtgtacaagggcatacttgagaacggaagagaagtggcggtgaaaagactcagggattccaagcggaacctgcaagaacttgagagggagatctccatcgtggccactttgtgccataagaacctcgttaggtttttagggtactgcttccaagacgaagggaagtttctcgtctacgagtatgtacccaataatagcctcgacaaattcgggtacaaagcatgttcccagtcacagaagctagaatgggctacatggttcaacatcatcttaggggtcgcccgtggcctccagtttctccatgacaagggaatcattcatagagatttgaagccacacaatgtacttctcgatgaaaacgtcacccccaagatcgccgacttcgatctcatgaggacgtacgataaacagaagacccacgagagcacggagaaggtcgccggaacatttggttacatagcgcctgaatgcacgtccggccggaagttcctgctgtcgatcaagtccgacgtgtacagctacggcgtcctggtgctggaggtcatcaccggccacaagatctacacgttcgaaggccaaaaatccgaaggcctcgtcgaatacgtgtggcagcactgggaagagaagagagcaggagacatcgtggacggcgacctgctgggcgtcgcgggccaggagctcgcggcgcggcaggcacagaggtgcgtgcacgtcgcgctgctctgcgtgcagtcagatcggtcaaggaggccgaccatggggcaggtcatcgccatgctgacaagtgacgacggcgggatggagctgccagagccgtctctgcccgggtaccttgtcgtcgtccacccaagggctctggtccggctgccatgtctcgggtgtaggtagctagggatgaaaatgaaaatggtaatttcgaagtatcagaaatcgttttcgagattttatcgatttttgtggctaaacggaaactgtagcggttaccgtgaaaacggaaacggaatcggtaatgcaatccgaaaatgagaatgttttgcactcttccgatcactttcgaagattaccataggattcactgtggtgaatttgatcttcggtaaaacaaatcgtcgtgtccattcttgattt

SEQ ID NO: 30253 - protein, 666 aa, Panicum virgatum
  misc_feature: Ceres CLONE 1897887
  misc_feature (358)..(631): Pfam Name: Pkinase Pfam Description: Protein kinase domain
  misc_feature: SWISSPROT Homolog: EC 2.7.11.1 Non-specific serine/threonine protein kinase
MASPSPHMMLLLFLTSALLAAAVRPATSSSSPPPSGTSPEPGPTFCSGQAPDSNNSSSSPAVDAVFREDEYTATVVFNATRRAPLPYWRGGKAAVRRLLAAAASGTTSSHMCRGAGASRAAAGAGAGLMMYGLTRCAAGTPCDDCRRCLRGALAAVEKGYNGSAGMQVLRLSCMARYESYPFYNATTVRRRAFEQASGTGAVMGPRLPAPAAHPPPLAPPPAGHTPPPRLPPPAAVHSPLAPPAGYSPRPPPAASPVETQLTQQSHGKKTPKTLIMLILSIATGIVVITVILLVHIWYRRRKHSNKMQHVVAASIPGENMYDQEDGQWSMEDEEDKDGERMTCQLYSYQVLEAATCHFSNRNKLGSGGFGTVYKGILENGREVAVKRLRDSKRNLQELEREISIVATLCHKNLVRFLGYCFQDEGKFLVYEYVPNNSLDKFGYKACSQSQKLEWATWFNIILGVARGLQFLHDKGIIHRDLKPHNVLLDENVTPKIADFDLMRTYDKQKTHESTEKVAGTFGYIAPECTSGRKFLLSIKSDVYSYGVLVLEVITGHKIYTFEGQKSEGLVEYVWQHWEEKRAGDIVDGDLLGVAGQELAARQAQRCVHVALLCVQSDRSRRPTMGQVIAMLTSDDGGMELPEPSLPGYLVVVHPRALVRLPCLGCR

SEQ ID NO: 30254 - DNA, 693 bp, Panicum virgatum
  misc_feature: Ceres CLONE 1897889
  misc_feature: Encodes the peptide sequence at SEQ ID NO. 30255
tcgctcgctccgtcgcccgcccgaagcaaagcaaggtacccgtcctcccgcccgccgacgaggctgccgcctctcctgtgctcgggcctcgattcgcgccgtctcatcttctcatgctactccatttcaccggaccttacccagcgttcgatgtgttctctttttttttccctcttcctgcagggagttgagttgagttgagtcaccggttgcaaccatgagtaagttgcaatccgaggttctcaaggatgccatctcccagattgttggggatgccaaagagaagaataggaagttcaccgagaccgttgagcttcagattggtctgaagaactatgacccgcagaaggacaagcgtttcagcggctctgttaagctccctcacatcccccgcccaaagatgaaggtgtgcatgcttggtgatgcccagcacgttgaggaggctgagaagattggacttgactacatggatgtcgaggcgctcaagaagatgaacaagaacaagaagcttgtcaagaagcttgccaagaagtaccatgctttcttagcatcagaggccatcatcaagcagattccccgtctccttggtcctggtctcaacaaggcaggcaagttccctacactggttacccaccaggagtctcttgaatccaaagtgaacgagacaaaagctacagtcaagttccagttgaa

SEQ ID NO: 30255 - protein, 158 aa, Panicum virgatum
  misc_feature: Ceres CLONE 1897889
  misc_feature (8)..(157): Pfam Name: Ribosomal_L1 Pfam Description: Ribosomal protein L1p/L10e family
MSKLQSEVLKDAISQIVGDAKEKNRKFTETVELQIGLKNYDPQKDKRFSGSVKLPHIPRPKMKVCMLGDAQHVEEAEKIGLDYMDVEALKKMNKNKKLVKKLAKKYHAFLASEAIIKQIPRLLGPGLNKAGKFPTLVTHQESLESKVNETKATVKFQL

SEQ ID NO: 30256 - DNA, 744 bp, Panicum virgatum
  misc_feature: Ceres CLONE 1897897
  misc_feature: Encodes the peptide sequence at SEQ ID NO. 30257
caaacccaaacgacaagctcgagggtctaagtcgcgcaagtaaagccgggggtgtgccgcagctcgcaggccatcgtcccccttcccgcaggccggctggccggcaaccaccgccttccgaaatcgatggcctcagagacgcgtccaaatcgctatcgccggcttcggaaggcctcggatctctctaacgtcaccaccgcctccccaatcttcaaacggattcgtacgggcaagaaaggcaccagttatgaggacaggatcagcagcttacctgaagagatactactcatgatccttgacaagctagacacacggacaacagtaacaaccatcatcctttcgaaaagatggcgtgatcttcctcgacgtttgcccacatcctataaccttgctgtcgatgacattctcccaccacgctatcaccgcctcaaacgccttaacaaggaggctaaggctgcatatgagacagagaagaatgtgcacaagctgaccgacatctatgccatcaaggctcgtcatgagcgttggatggcaacgatcagaccactcaccgccatcctagaacgctatgagcgccgcgccatgagacgctatgtcaagcaggtgaatgcatttcttatggcttcaaagaatgtgcgtcaacgccggcctgtccagaagctgaggctccaaatgctagggcgttggcatgaaaatattgatgagtggatcaccacagccattgtcaagtggggcgttgaggat

SEQ ID NO: 30257 - protein, 205 aa, Panicum virgatum
  misc_feature: Ceres CLONE 1897897
  misc_feature (43)..(90): Pfam Name: F-box Pfam Description: F-box domain
MASETRPNRYRRLRKASDLSNVTTASPIFKRIRTGKKGTSYEDRISSLPEEILLMILDKLDTRTTVTTIILSKRWRDLPRRLPTSYNLAVDDILPPRYHRLKRLNKEAKAAYETEKNVHKLTDIYAIKARHERWMATIRPLTAILERYERRAMRRYVKQVNAFLMASKNVRQRRPVQKLRLQMLGRWHENIDEWITTAIVKWGVE

SEQ ID NO: 30258 - DNA, 750 bp, Panicum virgatum
  misc_feature: Ceres CLONE 1897907
  misc_feature: Encodes the peptide sequence at SEQ ID NO. 30259
acgccatttacctccccgactccgccgtcacctgcccctccgcctcagcggtttaaggttcacctacagccatgggtaaggagaagtcccacatcaacatcgtggtcattggccacgtcgactctggcaagtcgaccaccaccggccacctgatctacaagcttggcggtatcgacaagcgtgtgatcgagaggttcgagaaggaagccgctgagatgaacaagcggtccttcaagtacgcgtgggtgcttgacaagctgaaggctgagcgtgagaggggtatcacaatcgatatcgccctgtggaagttcgagaccaccaagtactactgcactgtcattgatgcccccggacaccgtgacttcattaagaacatgatcacgggtacctcccaggctgactgtgctgtacttatcatcgactccaccactggtggttttgaggctggtatctccaaggatggccagacccgtgagcatgctctccttgccttcactcttggagtgaagcagatgatctgctgctgcaacaagatggatgccaccactcccaagtactccaaggcccgttatgatgagattgtgaaggaagtctcctcctacctgaagaaggtcggatacaatcctgataagattgccttcgtccccatctctggttttgagggtgacaacatgattgagaggtccacgaaccttgactggtacaagggaccaaccctgcttgaggctcttgaccagatcaacgagcctt

SEQ ID NO: 30259 - protein, 226 aa, Panicum virgatum
  misc_feature: Ceres CLONE 1897907
  misc_feature (5)..(225): Pfam Name: GTP_EFTU Pfam Description: Elongation factor Tu GTP binding domain
  misc_feature: SWISSPROT Homolog: EC 2.7.7.4 Sulfate adenylyltransferase
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDQINEP

SEQ ID NO: 30260 - DNA, 717 bp, Panicum virgatum
  misc_feature: Ceres CLONE 1897917
  misc_feature: Encodes the peptide sequence at SEQ ID NO. 30261
  misc_feature (651)..(651): n is a, c, t, g, unknown, or other
atcctttcagagctctcgcttcgaaactgaaccagcacacccagctgccgttgccgtttctagagaactccccgccgttcgagatcccgctcgccacgatgcctgctctcgccaagcccgcctcgcggcccgccaagaccgccgcggcgccgaagccgaagcccgccgccgccaagcccaaggccgcggccgccgctggcgcctcgcacccgccctacttcgagatgatcaaggaggcgatcacggcgctcaaggagaggaccggctcgagctcgcacgccatcgccaagtacatggaggacaagcacggcccgtcgctgccggccaactacaagaagatgctctccatccagctccgcgggttcgccgccaagggtaagctcgtcaaggtcaaggcctcgtacaagctctccgacgccgccaagaaggaggcgcccaaggccaagcccgctgccgccaagaccgccgcgcccaagccagccaaggccgccgcgaaaccgaagaagagtgccgccgccgccgccaagcccaagaagaccgccgccgggaccaagcgcaaggcgccggagaagaaggtcgtcgcgaagccgaagaagtcccccgcggcgaaggccaaggccaagcccaagacggtcaagtcccccgcctccnagaaggcccggaaggttgccgcatgagatggttccgtaggtcgtaactctgatcgtggggtgtgtc

SEQ ID NO: 30261 - protein, 192 aa, Panicum virgatum
  misc_feature: Ceres CLONE 1897917
  misc_feature (36)..(106): Pfam Name: Linker_histone Pfam Description: linker histone H1 and H5 family
  misc_feature (185)..(185): Xaa is any aa, unknown, or other
MPALAKPASRPAKTAAAPKPKPAAAKPKAAAAAGASHPPYFEMIKEAITALKERTGSSSHAIAKYMEDKHGPSLPANYKKMLSIQLRGFAAKGKLVKVKASYKLSDAAKKEAPKAKPAAAKTAAPKPAKAAAKPKKSAAAAAKPKKTAAGTKRKAPEKKVVAKPKKSPAAKAKAKPKTVKSPASXKARKVAA

SEQ ID NO: 30262 - DNA, 571 bp, Panicum virgatum
  misc_feature: Ceres CLONE 1897941
  misc_feature: Encodes the peptide sequence at SEQ ID NO. 30263
aaatcgaaaaaatggcgctgctgagcccgcgcatgccgcggctgccgccctccgccttcaccgccggcgggacccggtgctgcggccgcggcgcgcggtgccaggcggcggcgtgcgggcggcgtggcgggcgcggggcagaccccgtcctcggagctggaggccatccggtggggcatcgcctagctgcagggcgcccgcaacgagagggaagacgaggtcgtgctccgcacgggctccctcctcgacggcttctccatcgccgacgacatggacggccacgccggcttctccgctgtccagttcctcagggacgagctgtacaaggaatgcgcggccgcgctggacggcgggaaggtgctcagcaccaagaatctcgaggccatcacggcctccatccagcgcgccttctccgaaatcgacgcgaaactctacgactgggttgaacaaatggacaaggacgactactctggagccacggctactgacatgtgtctcaggaacgatgtccttgttgatacgcatattgtgcactcttgcttggtcatagcatgcgatggaagacctgaag

SEQ ID NO: 30263 - protein, 100 aa, Panicum virgatum
  misc_feature: Ceres CLONE 1897941
  misc_feature: SWISSPROT Homolog: EC 3.1.3.16 Phosphoprotein phosphatase
MDGHAGFSAVQFLRDELYKECAAALDGGKVLSTKNLEAITASIQRAFSEIDAKLYDWVEQMDKDDYSGATATDMCLRNDVLVDTHIVHSCLVIACDGRPE

SEQ ID NO: 30264 - DNA, 775 bp, Panicum virgatum
  misc_feature: Ceres CLONE 1897954
  misc_feature: Encodes the peptide sequence at SEQ ID NO. 30265
ccaagcccccaaccccgccggattcctcctccggacccgctcacaaaaccctagcccaacaccgcaaccccgcgcccggcagccgccgccgccgccgccgccggggacgatggcgaagcctcggcgcggccgctccgcctcgcgctcctcctcgggctcctcctcccgctccccgtcccgctccgtctcctccggctccgtctcgtcccgctcccggtcgcgctcccgctccttctcgtcgtcctcctcccagtcccggagccgctcccctcccccacctaagcgcagctcatcgggagcacggaaaggtcaatcaccttcatcacctcctaaaaaaggttcaccctcaaagaaagtccgttcaccatcaccaccgcctaaaacggcttcaccccctaggaaagcatctcctcctgctgagtctgctgttctctgcattgatcatctctcaaggaatgttaatgaggctcacttgaaagagatttttggaaactttggcgaagtggtgaatgtggagctatcaatggaccgattggtcaatcttcctcgtgggtatggatatgttgaattcaagaagagagctgatgctgagaaagctcttctttacatggatggtggtcaaattgatggaaatgttgttaagttgagattcactctgcaaccacgccaaagggctgcatcacctacgaaggttcctccccctccaaaaagagatgctcctccaaatgacaaaggtgctagcagtgctgaaaaggatgcccagcagcgtcctagg

SEQ ID NO: 30265 - protein, 221 aa, Panicum virgatum
  misc_feature: Ceres CLONE 1897954
  misc_feature (108)..(179): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAKPRRGRSASRSSSGSSSRSPSRSVSSGSVSSRSRSRSRSFSSSSSQSRSRSPPPPKRSSSGARKGQSPSSPPKKGSPSKKVRSPSPPPKTASPPRKASPPAESAVLCIDHLSRNVNEAHLKEIFGNFGEVVNVELSMDRLVNLPRGYGYVEFKKRADAEKALLYMDGGQIDGNVVKLRFTLQPRQRAASPTKVPPPPKRDAPPNDKGASSAEKDAQQRP

SEQ ID NO: 30266 - DNA, 741 bp, Panicum virgatum
  misc_feature: Ceres CLONE 1897959
  misc_feature: Encodes the peptide sequence at SEQ ID NO. 30267
aacctcactccccagatcactcgctcgctccccaattcgcctcgccgtacagccaagctcagccttagctccaccggcgggcgcagcagcagagcaggacgggatgccggccggagtggtagacgcggccgccaagggcgtcaggctggagcggcacgcggcggggaccgccgtgctgctgcggcgcgcgtcgggcgccaatcagctcgtgtcggcgtcctcgcacctgctcttccgcgccacggtgctcgccacgctcgcgctcgtcatcctcttcgccgtgcactacccgtccctgctctcccgctccttgagcctctccgccgcgcccttgtccggctcgtcgtcgtcgtcgtccgcggcgcggtcgcggtcgtcgcatcggagcctgctgggctcgagggcctcgtacgggggcgccgcgtgggagcgggaggtgcggcgcggcgccacgccgcggcgcgacgggggcctgtccgtgctggtcaccggcgccgcgggcttcgtgggcgcgcactgctccctggcgctccgcgggcgcggcgacggcgtgctcggcctcgacaacttcaactcctactacgaccccgccctgaagcgcgcgcgccagcggctgctcgcgtcgcgcggggtggtggtgctcgacgccgacatcaacgacgccgcgctgctcgagcggctcttcgccgcggcgccgttcacgcacgtgctgcccctcgccgcgcaggccgggggtgcggt

SEQ ID NO: 30267 - protein, 212 aa, Panicum virgatum
  misc_feature: Ceres CLONE 1897959
  misc_feature: SWISSPROT Homolog: EC 5.1.3.6 UDP-glucuronate 4-epimerase
  misc_feature: Useful for making plants with altered carbohydrate content
  misc_feature: Useful for making plants with altered cell wall content and/or composition
MPAGVVDAAAKGVRLERHAAGTAVLLRRASGANQLVSASSHLLFRATVLATLALVILFAVHYPSLLSRSLSLSAAPLSGSSSSSSAARSRSSHRSLLGSRASYGGAAWEREVRRGATPRRDGGLSVLVTGAAGFVGAHCSLALRGRGDGVLGLDNFNSYYDPALKRARQRLLASRGVVVLDADINDAALLERLFAAAPFTHVLPLAAQAGGA

SEQ ID NO: 30268 - DNA, 1785 bp, Panicum virgatum
  misc_feature: Ceres CLONE 1897971
  misc_feature: Encodes the peptide sequence at SEQ ID NO. 30269
gcttccactgctccgccccccgcctccactccgatccccgcacccccgacccggcagccatggatccggcgccgcagacccacccgatcctctcctacgtgctctcccgcatccccaccctctccaagcccaagcccgccgcctccgagttcgacatcgagcagccgcccgcgcgcaccccgtccccgcggaccccgtccaccgcgggggagttcgagctcgtcgagcgcatgccgggcctgcgccacccgtccgtgctccgcgccatgacccgcgccgtcgccgacgtctccgccgcgcgctccgcgctccaggtgctcggcccgcggcccgaccacgagctcgtcgactcctcccgcgccatcgtggcggctgccgaggcaggggactcgcggatccccgagggcgacgtcgaggcgtgccgcgcgatggtgcggctcgaggagacgcacgacgcctacgaggccctgctgcaggaggccgaggccaggctcgagagggtgtaccggtccgcgatggagggggcggacgtggatgacgaggcggcggagggcgggaaggacgacgggcccgcggcgggcgctgagggcgggggcgccccggtgcaggaggaggtggtagcggtgctcaagcaggccgaagagggcaagccggtggagagcgtgcgcctcgtggatcgccagctgcgccagctccctgaggcgttcgggaggatccaggggctccgcgtgcttgacgtctcgcgcaaccagctcgaggttattcctgatgctataggaggacttgatcatcttgaagagcttcgtcttgctgccaattctttgatttctcttcctgataccattggactgttatccaatctaaaggttctgaatgtgtcaagtaataggctcagagcactgccagatagcatctccaagtgtaggtcactggttgagcttgatgtgagctacaatgggctcatttacctgccaacaaatattggctatgagatggtcaatttgcagaaactctgggtccacatgaacaagttgcgatctcttccatcatctgtctgcgagatgacatcgctctacctcctggatgcccatttcaatgaactatgtggcctgccatctgcctttgggaaacttagcagtcttgaaattctcaaccttggcagcaacttcagtgacttgaaggagctgcccgcttcatttggtgacttgttgaatctgcgtgagcttgacctgagcaataaccagatccatgctcttcctgacacttttggtcgtctggataaattggagaagcttaacctagagcagaaccccctggtaatgccaccaatggatattgtgaacaagggtgtcgacacggtgaaagagtacatgtcaaagaggtggctggacatcttgcttgaggaagaacagaggtgcatcgctgcggagattccacaagcatcatcaactcccaaggcttggctggcgcgcagcgtctcctgggtcacagacgtttctgggagcctcgtagggtaccttagtggaaacgagaagtcagaaaaggatgcatatctggaccagcagttctgattcccgagagttagacctcatttgcctggtgtgtgcgtgtgccgtcatgtacatacaaatatagttttatcaaaccttttcaggtcatacaatctttactcttgttttacttcactgaataaattgtgtggaaactaacaagacttgagagtacactcaagatagctgttatgaagagatcaacctgtattgattttgcccgttttttgctgtg

SEQ ID NO: 30269 - protein, 503 aa, Panicum virgatum
  misc_feature: Ceres CLONE 1897971
  misc_feature: SWISSPROT Homolog: EC 4.6.1.1 Adenylate cyclase
MDPAPQTHPILSYVLSRIPTLSKPKPAASEFDIEQPPARTPSPRTPSTAGEFELVERMPGLRHPSVLRAMTRAVADVSAARSALQVLGPRPDHELVDSSRAIVAAAEAGDSRIPEGDVEACRAMVRLEETHDAYEALLQEAEARLERVYRSAMEGADVDDEAAEGGKDDGPAAGAEGGGAPVQEEVVAVLKQAEEGKPVESVRLVDRQLRQLPEAFGRIQGLRVLDVSRNQLEVIPDAIGGLDHLEELRLAANSLISLPDTIGLLSNLKVLNVSSNRLRALPDSISKCRSLVELDVSYNGLIYLPTNIGYEMVNLQKLWVHMNKLRSLPSSVCEMTSLYLLDAHFNELCGLPSAFGKLSSLEILNLGSNFSDLKELPASFGDLLNLRELDLSNNQIHALPDTFGRLDKLEKLNLEQNPLVMPPMDIVNKGVDTVKEYMSKRWLDILLEEEQRCIAAEIPQASSTPKAWLARSVSWVTDVSGSLVGYLSGNEKSEKDAYLDQQF

SEQ ID NO: 30270 - DNA, 668 bp, Panicum virgatum
  misc_feature: Ceres CLONE 1897973
  misc_feature: Encodes the peptide sequence at SEQ ID NO. 30271
attccgcaccaaccacgccagggcccgagctccgtgctagggtttcctctcccgccgccgccgccgccgccgccggtggaggaggagctgagcgagtagcgccgggaagggaccatggggacgccggagacgtcgcgcgagccgtgcccggaccggatcctggacgacgtgggcggcgcgttcgggatgggcgccgtcggcggctccgtcttccacttcctcaagggcgcctacaactcccccaacgggatgcgcctgtcgggcggcgcgcaggccgtgcgcatgaacgcgccgcgggtggggggcagcttcgccgtctggggcggcctcttctccaccttcgactgcgccatggtctacgcgaggcagaaggaggacccctggaactccatcgtcgccggcgccgccacgggcgggttcctctccatgcgccagggcgcaggggccgcggggcggtcggcgctcatgggcgggatcctcctggccctcatcgagggcgccggcctcatgctcaaccgcgtcctggtaaacccgccgctgcccgccgaggatcctaacctcatgggccccggagggttcccgggcctcccgcaggcgccgccggtcgtggcgcctcctgaggccgcgagctccagcggtgcggctggctggttcgggggcctgttcgg

SEQ ID NO: 30271 - protein, 184 aa, Panicum virgatum
  misc_feature: Ceres CLONE 1897973
  misc_feature (4)..(133): Pfam Name: Tim17 Pfam Description: Tim17/Tim22/Tim23 family
MGTPETSREPCPDRILDDVGGAFGMGAVGGSVFHFLKGAYNSPNGMRLSGGAQAVRMNAPRVGGSFAVWGGLFSTFDCAMVYARQKEDPWNSIVAGAATGGFLSMRQGAGAAGRSALMGGILLALIEGAGLMLNRVLVNPPLPAEDPNLMGPGGFPGLPQAPPVVAPPEAASSSGAAGWFGGLF

SEQ ID NO: 30272 - DNA, 1137 bp, Panicum virgatum
  misc_feature: Ceres CLONE 1898021
  misc_feature: Encodes the peptide sequence at SEQ ID NO. 30273
acaaacacatcgcctccctcccccacttcgcccttctgttctgccgtctcccctctccctctcccctgcctccagtcctccagtgctccacccccgcgccggcacgaaaccctagttcctagacctgtgccgctgtccaccttccctgagagagagagagagagagagagagagagatgtactcggaccagatgtccaccggccgcaagcgttcaatccatgagcgcctcgacggcgacctccccgccggcgctggcgccggcggccgtgcccgccacatggcgtccaagaggcaacggcagatagatgacaaatggaagcatgatctgtatcgagaagatgatgaaccagcttcaaattcaatcggtccaagggatttacgattgaagcttcagaggagaagttctcaacaaggctttaccagctcaacgatttctggtgtgcgtgatctacgggagaagctgtctggaacaatgcacccacagccatcgaatgctgaccccccaaagccaaagccagtatcagaagtcgtcaaaatctcaaggcgtgaagcaactgatgaaatgcctgcacgacaaagtaagaaagcatcaaaacagccttcagtgaagaagacatctcagccaaagactgaaagtccacttgacagtttcctgagttcacttggacttgagaagtattcaattaccttccaggcagaggaggttgacatggcagcccttaggcatatgagtgacggtgatctgaaggctttgggcattccaatgggtcctcggaagaagatcatccttgccttggaatccagagcataaggctgtgcgaaggagcaatgtagaaagttgagggagatttgccaggcattctcaagcgaaggagctgaagaagtaaacctttgtatggatcttggaaagggtacaatgcatgttctgtcctgttgagcatgctcagccaagttaggatgagaaggccatggcgccaatgatgtaacttattggtcacctgttaattaaaaggcgccatatacatgttgaggctattgagttggttttggaatgctgtgttatacgactgcattgtgaattcttccatggggggtatacttgtttgcaatgttctatgatttggtagaattgctgc

SEQ ID NO: 30273 - protein, 211 aa, Panicum virgatum
  misc_feature: Ceres CLONE 1898021
  misc_feature (149)..(211): Pfam Name: SAM_1 Pfam Description: SAM domain (Sterile alpha motif)
MYSDQMSTGRKRSIHERLDGDLPAGAGAGGRARHMASKRQRQIDDKWKHDLYREDDEPASNSIGPRDLRLKLQRRSSQQGFTSSTISGVRDLREKLSGTMHPQPSNADPPKPKPVSEVVKISRREATDEMPARQSKKASKQPSVKKTSQPKTESPLDSFLSSLGLEKYSITFQAEEVDMAALRHMSDGDLKALGIPMGPRKKIILALESRA

SEQ ID NO: 30274 - DNA, 1965 bp, Panicum virgatum
  misc_feature: Ceres CLONE 1898034
  misc_feature: Encodes the peptide sequence at SEQ ID NO. 30275
gtcttcctcttccgcccccgtgcacccgccgtcccgatttctcgaatggcgaaggcgatgatgactctgcgacgcgcggcggcgctcggcgcccgccacatcctgaccgcctcctcctcccgcgtcgtccccctccgccacatgagcgcggacgcgggggccgcgatggagaagatccgggcggcggggctgctcaggacgcaggggctcatcgccggacagtgggtcgacgcatacgacggcaagaccatcgaggtgcaaaacccagctactggtgatgtccttgcaaacgtgtcctgtatgggcagcagagaaacatctgatgctatagcttctgctaacagtacattctattcttggagtaaactcactgcgaacgagaggagcaaagctctgagaaaatggtatgatctgattattgcacacaaggaagagcttgcacttctcatgacattggagcaggggaaacctttgaaagaagcccttggtgaggtaaattatggtgcaagtttcctagaatattttgctgaggaagcaaagcgtatatacggtgatatcattccccctactctgtcagatcgcagactgttggttctgaagcagcctgttggggtggttggagctattacaccatggaattttccattagcaatgataaccagaaaggttggaccagctttggcctgtggctgcactgttgttgtcaagccatcagaattcacacctctgacagcattggctgcagcagaccttgctcttcaagctggaataccagcgggtgcactaaatgttgtgatgggtaatgctcctgagataggtgatgcactactgcagagtacacaggtcagaacgattacattcactggatcaacagctgttggcaaaaaattgatggcaggatctgcaaataccgtgaaaaaggtctctttggaacttggtgggaacgcaccttgcattgtttttgatgatgcagacatcgatgttgctgttaaaggaagtcttgctgccaagttccgtaacagtggacagacatgtgtttgtgcaaacaggatattggtgcaagaaggtatatacgaaaaatttgcaagcgcattcatcaaggctgttcagagtttgcatgttggtaatgggctagaagagagtacatcacagggtcctctgattaatgaagctgctgtccaaaaggtggagaagttcataaatgatgcgacttcaaagggagcaaacatcatgctaggtggtaaaaggcacagcctggggatgacattttatgagccaactgtagtagggaatgtcagcaatgatatgcttcttttcagggaagaagtttttggcccagttgcacctcttataccattcaaaactgaggaagaagcaatccatttggccaatgatacaaacgcaggcttagctgcatacatatttaccaagagcatacctcgttcgtggcgtgtctctgaatctctcgaatacggcttagttggggtaaacgagggaattatttcaacagaggtggcaccatttggtggagtaaagcagtctggtcttgggagagaaggatcaaaatacggggttgacgaattcctggagctcaagtatatctgcatgggcaacatgagttgagccctgaaatcggcctggttagaaacgcctgacagaagatgaaacgaggaaccaaaggaggcaggtgtgctgacacctgatacgcctgggaagtttagctgcaagtgcaagctacagtagatggtatgcatgggagggaacccgtccctggctgtcgggagcagtttagaataaagcgaatgagccgcggggcatgaataaaaaaaaaggtccgaatgagttgtaaatgacgtgaacaataaagcatctccgagcttttgtatacacaatcatggcgctactcgccgatggcgtctttggagacgttcatgctagtacgaaataaaagcttcttggttggac

SEQ ID NO: 30275 - protein, 525 aa, Panicum virgatum
  misc_feature: Ceres CLONE 1898034
  misc_feature (60)..(519): Pfam Name: Aldedh Pfam Description: Aldehyde dehydrogenase family
  misc_feature: SWISSPROT Homolog: EC 1.2.1.24 Succinate-semialdehyde dehydrogenase
MAKAMMTLRRAAALGARHILTASSSRVVPLRHMSADAGAAMEKIRAAGLLRTQGLIAGQWVDAYDGKTIEVQNPATGDVLANVSCMGSRETSDAIASANSTFYSWSKLTANERSKALRKWYDLIIAHKEELALLMTLEQGKPLKEALGEVNYGASFLEYFAEEAKRIYGDIIPPTLSDRRLLVLKQPVGVVGAITPWNFPLAMITRKVGPALACGCTVVVKPSEFTPLTALAAADLALQAGIPAGALNVVMGNAPEIGDALLQSTQVRTITFTGSTAVGKKLMAGSANTVKKVSLELGGNAPCIVFDDADIDVAVKGSLAAKFRNSGQTCVCANRILVQEGIYEKFASAFIKAVQSLHVGNGLEESTSQGPLINEAAVQKVEKFINDATSKGANIMLGGKRHSLGMTFYEPTVVGNVSNDMLLFREEVFGPVAPLIPFKTEEEAIHLANDTNAGLAAYIFTKSIPRSWRVSESLEYGLVGVNEGIISTEVAPFGGVKQSGLGREGSKYGVDEFLELKYICMGNMS

SEQ ID NO: 30276 - DNA, 1652 bp, Panicum virgatum
  misc_feature: Ceres CLONE 1898096
  misc_feature: Encodes the peptide sequence at SEQ ID NO. 30277
attattattggtatgggatcctctgtctccagtgttgccagatccgttcttgcaattaatttaatcaacctcttccccacaacagcagctcaaacagatcgatcggttacttccaagtaaaatgaagaagcttgtcagcaagagctgggaggagtcgaggctgctatggcaggtcgccttcccagcgatcctcaccgaggtgttccagttctccatcgggttcgtcaccaccggtttcgtcgggcacctcggcgaagtcgagctcgccgccgtcaccgtcgtggagaacatcatagagctcttcgccttcggagtcctgttcggcatcgggagcgcgctggacacgctgtgcgggcaggccgtcggcgccgggcagctcgacatgctgggcatctacacccagcagtcgtggctcgtctgcggcgccacggcgatggcgctgacgccggcgtacgccttcacctcgccgatcctgaggtccctcctccggcagcccgccgacgtgtcggccgccgccgggccgtacgcccggtgggcgatcccgcggctgttcgcccacgcggcgaactacccgctcctcaagttcttccagacccagagcagggtctgggccgtggccgccatctccggagcgtcgctcgccgctcacgtcgcgctcacctacgccgccgtgaggcggctggggttcggcctccgcggcgccgccgttgccgggaacatctcccactggctcatcgtcgtcgcgcagctcgtttacatggtgcgaggccggtttccggactcgtggaagggcttctcgattcgtgcgttcaggaaccttggcgcattcgtcaagctgtcgctggcgtctgctgtcatgatctgcttggaggtttggtattacatggcactgctcattcttgtgggtctcctgaagaatgctaaactccagcttgacatcatgtctgtttgcatcaactacgagttctggaccatgatgatggcactgggtttcagcacagcaatcagcgtgagggtgtcgaatgagctgggtgcaaacaggcccaaggtggcacaattctcggttgttgttgcagcagcaacatcggccttcgtcggatcaactttcatggccgtcttcctcgtttggaggactagcttgcccaagttcttcagcgacagcgaagaggtgattcacggagcctcgagattaggatatcttctcgctgtgagcgtccttttaagcaacatctggcctctactatcaggtgtggcggtagggtcagggttgcaagtgcttgtggcattcataaacgttggcacctactacttggtgggaattccattgggggtcctgtttggcttcaagctaaaactcggtacaatggggatatggatgggcatgttgacagggacttcactccaaatagccatacttcttttcattatcgtcagaatgaagtgggagacacagtcgaagcttgctgttgaaaggactgcagagtgggaagcaaagaacaatgaccgggaattgatggcatctatatagggatgtaaattgtacggatatttctatatttggattcgaaccggtttggaaggattttatcaatttgtatctgattccggatattcaatattcgtaaccaatccgtatccggatactaaaagtc

SEQ ID NO: 30277 - protein, 468 aa, Panicum virgatum
  misc_feature: Ceres CLONE 1898096
  misc_feature (21)..(182): Pfam Name: MatE Pfam Description: MatE
  misc_feature (242)..(405): Pfam Name: MatE Pfam Description: MatE
MKKLVSKSWEESRLLWQVAFPAILTEVFQFSIGFVTTGFVGHLGEVELAAVTVVENIIELFAFGVLFGIGSALDTLCGQAVGAGQLDMLGIYTQQSWLVCGATAMALTPAYAFTSPILRSLLRQPADVSAAAGPYARWAIPRLFAHAANYPLLKFFQTQSRVWAVAAISGASLAAHVALTYAAVRRLGFGLRGAAVAGNISHWLIVVAQLVYMVRGRFPDSWKGFSIRAFRNLGAFVKLSLASAVMICLEVWYYMALLILVGLLKNAKLQLDIMSVCINYEFWTMMMALGFSTAISVRVSNELGANRPKVAQFSVVVAAATSAFVGSTFMAVFLVWRTSLPKFFSDSEEVIHGASRLGYLLAVSVLLSNIWPLLSGVAVGSGLQVLVAFINVGTYYLVGIPLGVLFGFKLKLGTMGIWMGMLTGTSLQIAILLFIIVRMKWETQSKLAVERTAEWEAKNNDRELMASI

SEQ ID NO: 30278 - DNA, 1561 bp, Panicum virgatum
  misc_feature: Ceres CLONE 1898101
  misc_feature: Encodes the peptide sequence at SEQ ID NO. 30279
accttcgcaaggcgaccagcagcccagcagggccccagcttttccgtgttctacttctttccccgctctcgccttccacgcgccaacaaatctcgaggcaggcaggggagccgggggcggcgttcgtttcgtcttgcttgcttgggtttctctcggtgcggccggccggcgattttggcgaggttcgtttcgggcggcaggtagaggcgtttcttggcggttggtgagatggacagccacgccgccgggtcgagctccggcggatccggggacggcggcgcggcgcccaggaggaactccaggaagcccaagtactccaagtttacgcagcaggagctcccagcttgcaagccaattcttactccaaaatgggttatttcagtatttgttcttgttggtgtgatttttgtcccaattggtgttgcttcgctgcgagcttcaagacaagttgtcgagattgttgatcggtatgatgacgcatgtgttcccactaatgtgactgacaagcttgcttacatccgggacaaaactataccaaaaacctgcacaaggagcctgacgattacaaaggaaatgaagcggccaatatttgtttattatcagctggataacttctaccagaatcataggaggtatgtcaagagtcgcaatgatgaacagctaagagataaaagtaaggcggggaaaactgacaattgcgatcctgaggccacagtagatggaaagccaatcgtgccttgtggtcttattgcatggagcctgttcaatgatacatatacccttcgccgtaacaatgaaaacttgacagtggacaagaaagacatatcttggaagagtgacagagagcacaaatttgggagtgatgtcttcccaacaaacttccagaaaggacctcttcaaggtggaaaaatacttaattcaactatgccgttgagtgagcaagaggaccttatcgtttggatgcgaactgcagcacttcctacattcagaaagctgtatggtaggatacatgttgatctcaaggtaaacgacaccattacagtccatttggagaacaattacaacacctatagctttggtggcaagaagaagttggtgctttctaccacaacctggcttggtggaaagaacgattttcttggcctagcatatctgactgttggtggactctgcttcttcttggcatttgcattcaccttgctctacttaattaaaccaaggaaattgggagataacaattacttgtcatggaacaggccccctgtaggccgctgatacactttgaaaattaaatgttacacaggcagcgagaacaattcagcttatggttcaaatgtatcatgtactacatagaaatattatttgtgagaattggtgtagaatacatacaaggtaggccatgtacgagtgatagctttggatcaaattgtggacagattgtacattacattgaaacgaaatacctttctgttctccaaattgtatacttggagtcagaagtgagtgtcggttttgattttcaaaactgctgtgaaattccatttatatggtttgcatcttc

SEQ ID NO: 30279 - protein, 348 aa, Panicum virgatum
  misc_feature: Ceres CLONE 1898101
  misc_feature (67)..(337): Pfam Name: CDC50 Pfam Description: LEM3 (ligand-effect modulator 3) family / CDC50 family
  misc_feature: Useful for making plants with modulated nitrogen use efficiency
MDSHAAGSSSGGSGDGGAAPRRNSRKPKYSKFTQQELPACKPILTPKWVISVFVLVGVIFVPIGVASLRASRQVVEIVDRYDDACVPTNVTDKLAYIRDKTIPKTCTRSLTITKEMKRPIFVYYQLDNFYQNHRRYVKSRNDEQLRDKSKAGKTDNCDPEATVDGKPIVPCGLIAWSLFNDTYTLRRNNENLTVDKKDISWKSDREHKFGSDVFPTNFQKGPLQGGKILNSTMPLSEQEDLIVWMRTAALPTFRKLYGRIHVDLKVNDTITVHLENNYNTYSFGGKKKLVLSTTTWLGGKNDFLGLAYLTVGGLCFFLAFAFTLLYLIKPRKLGDNNYLSWNRPPVGR

SEQ ID NO: 30280 - DNA, 1489 bp, Panicum virgatum
  misc_feature: Ceres CLONE 1898105
  misc_feature: Encodes the peptide sequence at SEQ ID NO. 30281
gtaccagcgcataccactagaaagctccttcaaagctggcatgcgctgccactagaaagaagttaacagcacaacagttcaagaaaacagcaactcattgtgtcctcaagcttgccgcttggcgcctcggcctcgacgacgaccgccaggatgacgactagccaagggcaagcagcgcccctcggccggggagacgccgccgaggacgacgccggcgactccacggcggcgcacttcgtgttcgtcccgctgagggagcagggccacctgatcccggccgtcgacaccgcgctgctgctcgccatccacggcgcggtctgcaccatcgtcggccccccgtccacggctgcgctggtgcgccccgccgtcgactccgcccgccggtccggcctgcaggtccgcctcgccgagttcccgctcgactacgccgccgccggcctgccggaaggcgcggacgacggtgccgacagcgtcccggcgatgcacatgtggagcttcttccgcgccatggcgctcctccgcgcaccgatcgagagctacctccgcgcgcacgcgccgttcccgacctgcgtcgtgtcggacttcgtcaacccgtggaccacggagctcgcggccaacctcggcgtcccgcggctaagcttcttcagcatgtgcaccttcggtctcctctgccagcacaacctcgagcgattcggcgcgtgggacggcgtcgaggaccccaaccagccggtcgtcgtgccggggctggagaggaggttcgtggtgacgagggcgcaggcgcccggcttcttccgggggatcccgatcccgtgctgggaggaattcgccgactacgtcgagcgcgcgcgggccgaggccgacggcgtcatcgtcaacaccttcgaggagatggagccggagttcgtcgccgggtacgcggcggcgcggaagatgaaggtctggaccgtcgggccggtgtcaacctaccaccagagcagcccgatgccggcggcgtcggcgctggcgtcgagagggctgcgggcgcccgccatcgaccccgacgagtgcctccggtggctcgacggcaagccggcgggctccgtcgtgtacgtcagcttcgggagcatctcgcaggcgggcgcgaagcaggtggtggagctcggcctcgggctggaggcgtcggggcacccgttcatctgggtggtccggaacgccgacgagtacgacgcggcggcgcgcgggttcctgggcgagctcgaggcgcgcgtggcggggcgcggcctgctcgtccgcgggtgggcgccgcagctgctgatcctgtcccacgccgccgtgggcgggttcgtgacgcactgcgggtggaactcgacgctggaggccgtcgcggcggggctgccggtggtgacgtggccgcacttcacggaccagttcctgaacgagaagatggctgtggaggtgctgggcatcggcgtcagcgtcggggtcaccgagccgctcacgtaccaggcgg

SEQ ID NO: 30281 - protein, 446 aa, Panicum virgatum
  misc_feature: Ceres CLONE 1898105
  misc_feature (40)..(445): Pfam Name: UDPGT Pfam Description: UDP-glucoronosyl and UDP-glucosyl transferase
  misc_feature: SWISSPROT Homolog: EC 2.4.1.238 Anthocyanin 3'-O-beta-glucosyltransferase
  misc_feature: Useful for making plants with altered carbohydrate content
MTTSQGQAAPLGRGDAAEDDAGDSTAAHFVFVPLREQGHLIPAVDTALLLAIHGAVCTIVGPPSTAALVRPAVDSARRSGLQVRLAEFPLDYAAAGLPEGADDGADSVPAMHMWSFFRAMALLRAPIESYLRAHAPFPTCVVSDFVNPWTTELAANLGVPRLSFFSMCTFGLLCQHNLERFGAWDGVEDPNQPVVVPGLERRFVVTRAQAPGFFRGIPIPCWEEFADYVERARAEADGVIVNTFEEMEPEFVAGYAAARKMKVWTVGPVSTYHQSSPMPAASALASRGLRAPAIDPDECLRWLDGKPAGSVVYVSFGSISQAGAKQVVELGLGLEASGHPFIWVVRNADEYDAAARGFLGELEARVAGRGLLVRGWAPQLLILSHAAVGGFVTHCGWNSTLEAVAAGLPVVTWPHFTDQFLNEKMAVEVLGIGVSVGVTEPLTYQA

SEQ ID NO: 30282 - DNA, 656 bp, Panicum virgatum
  misc_feature: Ceres CLONE 1898105-R
gggcgcgcgcgctggcggccaaggcgcgggcggccgcgcagccgggcgggtcgtcgcacgccaacctgctggacctggtcaagcgcttccggccgggcgcggcgcctggcgccgccgtgtcaggggtgtagcggcaagtcgtctcgtccgttgagattccgcatgcaagtggggcggcttgcatcttgagttgagatgtctgattggtccaggaaataaatccgaagtggttgtgtgatttttgcgtttgttgtggtgcttccaagaattggacaattgccgaagcatctcggcaaggtccatttccatgtgtgggcatccgagttcagccggcgatggtggctgcttctgcctgccctccttccgtcgtttctgctcatctgtctcactatctgtctgatacctcaactatgctcaatttgtcggccatcacattcatcaaagggatgttgtatatggtgtttttccaggttactcctgatggaacagagcaatgagctagcaggaaggcagaccagtgaggaatagtacagtacagtccttttgtaatgttgcggattgccaggtgcgtttgggtgcttgtcaacaacttcaaattgggtgtagtttgccttggacaagggccgaatcgaaacgatcttcttggccattttctc

SEQ ID NO: 30283 - DNA, 2233 bp, Panicum virgatum
  misc_feature: Ceres CLONE 1898107
  misc_feature: Encodes the peptide sequence at SEQ ID NO. 30284
ggtccgacctttccatagtcaaaccttccttgttcatcttcccctcgtcctcctccctctcctagtccattcaagagaggcatgcgtgcgggcggtggttgcgcgctccgccaccgccgccgtccgtagtagccgcgaccgcgaggcggttcctcgaagaggaggaggaggaggaggaggcgcgcgacggccgccgacgggatggatcaagggatggaggtcggggaggaggccgtgcgggcgctgggcgcggggttcgacctcacgtccgacttccgcctgcgcttcgccaaggacggcgcggggcggcgcctcgtggagctcggcggggagacccgcgacgtgccgctcccgggcggcgccgggggcgccacgctccgcggcgtgccgctcgacgtcggcgtcgacaagggcgaccgcatccgcttccgctccgacgtgctcgagttcaaccagatgtcagaattacttaatcagaaatcttcagtacacgggaaagttccttctggctattttaatgctctttatgaactaagtggagcatggttgactgatgccagagaaactaaacatctcgcatttgatggatatttcatttccttgtacaacttgcacctaaaagcttctccgttagttcttcgggatgaagtcaaaaaggctgttccatccaagtgggatcctgttgcattagcctggtttatcaaaacttatggaacacatataattgttgaaatggcgataggaggtcaggatgttatatgtgttaaacaaaatcattcttcaacaatttcaactgctgatttaaagctgcatatggaggatcttggtgattttttattttctgatgggaagagtcactccccaatacatcgcaaaacaaagagcaaggtgcctgatgtttttgtcaggatagagcagcaacctaataacctgcacctttctacctactctgaaacatcaaccaaggatggcctgacagttacatgttcgaagaggggaggagaagtatacatacaaaaccactccaaatggctgcaaacagtgccaaggaaacctgatgctattatgttcaaatttgtccctatcacttctcttcttactggtattcctggtagtggttacctcagccatgccatcaatttatatcttcgctataaacctgatcttcaagacttgcagtatttcttggagtttcaagtgcccttacaatgggcacctatgttcaatgagcttgtccttgggcctcaaaagagaaaagggtcctacccttccatgcagttcagatttctcggtcccaaactccatgttagcacctcccaggtatctagttctcagaaacccatagttggcctgcggctatacctggagggcaggaagtgcaaccggctggccatccatgtccagcacctgtcgagtgccccaagcatgctggctgactccatggcatcctcaatgtcagagtggcgcgagtccgaagacaccgaccccggctacatcgaggccatccagtggaagaactactcttgcgtctgcacctccgccgtcaagtacgaccccgagtggcacaagcgagcccccggcggcgtcttcgtcgtcaccggcgcccagctggtcaccaaggggacctggtccaagaaggtcctccagctccgcctcctctacacccacatccccagctgcagcatccataggaccgagtggacgagggctcccgcggcgtcccagaaggggagcttcctgacggccatcagcacgacgctgagctcccccttcacgcagcgcgacgcccaccaccagcagcacgcgccgaggcacgagccggcgcagctcaactccggcgtctaccccgacgggccgccggtgccgctccggtcccggaagctcctcaagttcgtggacatgtcggaggtggtgaaggggccgcacgacgtcccgggccactggctggtgatcgccgcgaagctcgtcaaggagggagggaagatcgggctccacgtgaagttcgcgctgctgggctacgatgggcagcagtcgcagggcgacagcttcgcgagctgagctgatcttcgtacaaaacaacagtgtcagtggctgatcattgtagattgcagggttttgggagaaagcagcgttaggacaaggattttttgttgatttttttccctttttggtcgataggaagtgtacactgtacagaggcagataataaaccaatcagcgctgtgttgacgac

SEQ ID NO: 30284 - protein, 618 aa, Panicum virgatum
  misc_feature: Ceres CLONE 1898107
  misc_feature (122)..(317): Pfam Name: MACPF Pfam Description: MAC/Perforin domain
MDQGMEVGEEAVRALGAGFDLTSDFRLRFAKDGAGRRLVELGGETRDVPLPGGAGGATLRGVPLDVGVDKGDRIRFRSDVLEFNQMSELLNQKSSVHGKVPSGYFNALYELSGAWLTDARETKHLAFDGYFISLYNLHLKASPLVLRDEVKKAVPSKWDPVALAWFIKTYGTHIIVEMAIGGQDVICVKQNHSSTISTADLKLHMEDLGDFLFSDGKSHSPIHRKTKSKVPDVFVRIEQQPNNLHLSTYSETSTKDGLTVTCSKRGGEVYIQNHSKWLQTVPRKPDAIMFKFVPITSLLTGIPGSGYLSHAINLYLRYKPDLQDLQYFLEFQVPLQWAPMFNELVLGPQKRKGSYPSMQFRFLGPKLHVSTSQVSSSQKPIVGLRLYLEGRKCNRLAIHVQHLSSAPSMLADSMASSMSEWRESEDTDPGYIEAIQWKNYSCVCTSAVKYDPEWHKRAPGGVFVVTGAQLVTKGTWSKKVLQLRLLYTHIPSCSIHRTEWTRAPAASQKGSFLTAISTTLSSPFTQRDAHHQQHAPRHEPAQLNSGVYPDGPPVPLRSRKLLKFVDMSEVVKGPHDVPGHWLVIAAKLVKEGGKIGLHVKFALLGYDGQQSQGDSFAS

SEQ ID NO: 30285 - DNA, 1345 bp, Panicum virgatum
  misc_feature: Ceres CLONE 1898153
  misc_feature: Encodes the peptide sequence at SEQ ID NO. 30286
agcaacgccaacaggaggccgcgatatagctggggagtagttcactgccccctacctctcctcgcctctcctccccctctccctcctactccccgtcgcgtcgcccatcctcctacgtctccttcctctccccgcttccgcttcctcccagcgggagcggaagctcgcaagcaatcgccggccttttcttggcgtgcacagttcctgatcggagggcccccagcgggatctcgcttgctggcgtggccgcgcggggttgaggcggggcggctggatttcggagccgctgcgggtggtgttggcggtttgaagccggtccggtgtctggtgcctgatttgatctgcagcggcggcggaggcccggcatggcggcgccgggagggctcgagcagtggcagaaggacgggttcttccaggccgccgaggaggtgcaggagtcggcggacttgatggaatctatctatagaacttggatgcgagaacacagtaatggttctagctcagaggaggtaaatgatttgcaaagggagctacagacagctttagggactgcaaaatggcagttggagcagtttgagagagctgtaagttcaagcaatgataagtattcactggaagagggtacagtggccagacgtcggcagtttgttgtagcaattgaggatcagatttctcgtgtagagaaagaaataaacggttcttcaatggacaatggcaggcaaggtctcaactgggtgaagctagatgatgaggagcgagatgacctagttgcttttctttcagcacctgcagagtttttttcagaaatgagcacagacaatagttaccatattccatctagacaaaacaatgtgccaattggcatgaatgatgacagagatgcggctttgatcattaaagacattcatgaagtaccacgcaggcaaatttctagtgccaagagtgatgtttgtggtctagttgaccaatttcatggccacagaacaaatttgagttctggtgatagtcactggaagattgacattggtaatgagatggatgatgataaaaaatcatctccaaacggggttgaggcctcaaatcagacaactgctttatcaggcatccggagaagcacagaatctttaacaagaatgagatggttctggaatagcttgtggaaacctaagagtgatgaacatcatccaataagatacgatatgccaaataatcttgacttcagggttctgtccttattaacacagagatttaatgggcttactgaaagaagcagaaattatttaacaaagttggaaggagaatttcaagaatttctttcaggacgggtgggcttcatatacaaggc

SEQ ID NO: 30286 - protein, 326 aa, Panicum virgatum
  misc_feature: Ceres CLONE 1898153
  misc_feature (13)..(106): Pfam Name: Syntaxin-6_N Pfam Description: Syntaxin 6, N-terminal
MAAPGGLEQWQKDGFFQAAEEVQESADLMESIYRTWMREHSNGSSSEEVNDLQRELQTALGTAKWQLEQFERAVSSSNDKYSLEEGTVARRRQFVVAIEDQISRVEKEINGSSMDNGRQGLNWVKLDDEERDDLVAFLSAPAEFFSEMSTDNSYHIPSRQNNVPIGMNDDRDAALIIKDIHEVPRRQISSAKSDVCGLVDQFHGHRTNLSSGDSHWKIDIGNEMDDDKKSSPNGVEASNQTTALSGIRRSTESLTRMRWFWNSLWKPKSDEHHPIRYDMPNNLDFRVLSLLTQRFNGLTERSRNYLTKLEGEFQEFLSGRVGFIYK

SEQ ID NO: 30287 - DNA, 485 bp, Panicum virgatum
  misc_feature: Ceres CLONE 1898153-R
ccacaaaccgaggttgtatggctgcatgagtgacaggaaaatgagcacgatggcaaggatcttgattgtgcaacggatgactcagtacatcagaaactcctcaccagcgcataaccatactgaagttaatcagatctattgtcgattcatgctctgttctgatggtggctggtttctgccaaatataggcatctccttctcacctgtttcccccacgaaggcaattgtaaaaagatgtagagctgattggagaagatacagaaaagatgtgtcaaatgattgatttgtatgattgtgtacgaaaaggatgtgtcaaatgactgatttatatgatttgtgtacgtaccgagagtctcggtgaatgaaccgtctgaagtgcctgaaggttattcatggtattgcattcctcaaactgtttgtgttgaggaaggaatgaaccaggttcaaaggcgcttgagttcaacagcctgtcggctacttgcttt

SEQ ID NO: 30288 - DNA, 1138 bp, Panicum virgatum
  misc_feature: Ceres CLONE 1899329
  misc_feature: Encodes the peptide sequence at SEQ ID NO. 30289
accatcacctgctttgtgctttggactaggtgagcgaaaacaagtcactgttcggcgacaagctatcggccaacaagcagccagccttgtcacagaagtttccgctctctctttctccaaccttggcttgcaaaataaaccacgcaccgatcgataaccaaatcaagaagagcttaatttcttgtgcaaatgagactttggggtcatctttattacctaattgcttaatggcagctgctaatcccagtactgatcacgatctgcgaacaggtggtggaggacgaggtgttcccggacgggacggtgctgaggaagggcaccaaggtgatctacgccatgtacaccatggggcggatggagagcatctggggcgacgactgccgcgagtacaggccggagcgctggctccgggacggccgcttcaccggcgagtccgcctacaagttcaccgccttcaacggcgggccgcgcctctgcctcggcaaggacttcgcctactaccagatgaagttcgccgccgcgtccatcctccgccgctaccgcgtccgcgtcgtcgagggccaccccgtcgcgcccaagatggcgctcaccatgtacatgaagcacgggctcaaggtgacgctggccaagagggacaagggcagcagcggcctccgagcttgacaccgttcggagccttgcgtttcagatgcagatgtggtctgcaagtgcagacaagtaccaggagtacagaacttttgtatatgtattgcatatgtgtgatgatgcaaaacgctgaagcttcagatgatgtaacaggggcgtatcattgttcaccaactcgtaggctttcaccagcagaaaatatcccaggtagacggacatcatcgtgagttgttgagatatggttggccaactgcacgctctcacacagaatcaaaacttggttgttcaacttcaagccctgccactccactcttcatagaattcagccacaaagtcctccatgaacttgtgccttttctctgctcttcttttgccagcctactcacagagtgaaactatgtgtcagcatgtggagcaaataagcgagtaatagaacgagtgtatactattgctgatactatggcacatgcattaaaaaaaatgaattgggaac

SEQ ID NO: 30289 - protein, 108 aa, Panicum virgatum
  misc_feature: Ceres CLONE 1899329
  misc_feature: SWISSPROT Homolog: EC 1.3.3.9 Secologanin synthase
  misc_feature: Useful for making plants with modulated heat sensitivity
MYTMGRMESIWGDDCREYRPERWLRDGRFTGESAYKFTAFNGGPRLCLGKDFAYYQMKFAAASILRRYRVRVVEGHPVAPKMALTMYMKHGLKVTLAKRDKGSSGLRA

SEQ ID NO: 30290 - DNA, 655 bp, Panicum virgatum
  misc_feature: Ceres CLONE 1899330
  misc_feature: Encodes the peptide sequence at SEQ ID NO. 30291
aaaccgtcccctcctcgcgtccgtgtgctttcagttcccactcccttccctctcctcgcccccgctctcctctctctccgccgcgggcgggcgcgggcgcagggcaggcaccgacggcgccgtcgcgcatgcaggattcggcggcggcggatgcggcggcgcaggtggcggcggagggggatccctgcccgcggtgcgagtcgcgggacaccaagttctgctactacaacaactacaacacgtcgcagccgcgccacttctgcaagggctgccggcgctactggaccaagggcggcacgctgcgcaacgtccccgtcggcggcggcacccgcaagaagccctcgtcctcgccgccctcgtcctacgcggccgccaccagctccgacaagcccaggaagccgtccaagaagaagcgccgcgtcgtcgccccgcccccggagcccgctccagccgccgccgcagcagctgcagccaccgacgccgccccggccgccgactccgccaagacggcgaccaccacgacgccgacgccgacgacgaccgatcccgcgagcgagatcaccacggagctcgtggtcccggaggctgatgaggaggactccctcgcacacctgctgcagccggacgtcgcgctcgggctcggcatctccgactt

SEQ ID NO: 30291 - protein, 175 aa, Panicum virgatum
  misc_feature: Ceres CLONE 1899330
  misc_feature (13)..(75): Pfam Name: zf-Dof Pfam Description: Dof domain, zinc finger
  misc_feature: Useful for making plants with modulated nitrogen use efficiency
MQDSAAADAAAQVAAEGDPCPRCESRDTKFCYYNNYNTSQPRHFCKGCRRYWTKGGTLRNVPVGGGTRKKPSSSPPSSYAAATSSDKPRKPSKKKRRVVAPPPEPAPAAAAAAAATDAAPAADSAKTATTTTPTPTTTDPASEITTELVVPEADEEDSLAHLLQPDVALGLGISD

SEQ ID NO: 30292 - DNA, 885 bp, Panicum virgatum
  misc_feature: Ceres CLONE 1899342
  misc_feature: Encodes the peptide sequence at SEQ ID NO. 30293
aaccgacccagcatacccaccaccccctcaccgccgcgcgcacccccaaaccctagcgcaggcaccatggcggcggcggcggcgcagcagaagatccggtggggcgagctcgaggaggacgctggctccaggctcaccatggtctccaccgaggagatcctcctcgagcgccccagggccccagggagcaaagctgatgagccagctgcttctggtgacccactggctatggcaagcaagggaggtgctgttctcatggtttgcagaacctgtggcaagaagggcgaccattggacctcaaagtgtccctacaaggacctggcaccgccgactgaaagtttcacggacaggcctccgacgtcggatggccctcctgcagcaggcggtcctgttaagggagcgtacgttcccccaaccatgagaggtggcgctgataggaccggcggagatgtgatgcgccgcaggaacgacgagaactctgtccgtgtgaccaacctctcggaggacacccgcgagcccgacctcctcgagctgtttcgctcgttcggccctgtcagccgtgtctacgtcgcggtggaccagaagactgggtcgagcagagggttcggcttcgtcaactttgtgcacagagaggatgcggagaaggcgatcagcaagctcaatggttatggttatgataaccttatcctccgcgtcgagtgggcgacgccaaggcccaactagtttttttgccgctacttattagagccgcatattttggcaaaaaagttctatattgctatgtctggaatagtacctgtatcatgcgcatgtgctgtgtcgtaaaaacctgctgttatgtgttaatttttgttggacgagaataattatactcactgttgtttt

SEQ ID NO: 30293 - protein, 218 aa, Panicum virgatum
  misc_feature: Ceres CLONE 1899342
  misc_feature (139)..(210): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with altered alkaloid content
MAAAAAQQKIRWGELEEDAGSRLTMVSTEEILLERPRAPGSKADEPAASGDPLAMASKGGAVLMVCRTCGKKGDHWTSKCPYKDLAPPTESFTDRPPTSDGPPAAGGPVKGAYVPPTMRGGADRTGGDVMRRRNDENSVRVTNLSEDTREPDLLELFRSFGPVSRVYVAVDQKTGSSRGFGFVNFVHREDAEKAISKLNGYGYDNLILRVEWATPRPN

SEQ ID NO: 30294 - DNA, 716 bp, Panicum virgatum
  misc_feature: Ceres CLONE 1899352
  misc_feature: Encodes the peptide sequence at SEQ ID NO. 30295
acctcatcgacccagccaaagctgccagagcaaacctcgccgaccccagctcgagcaagagcgtcggcagaggagccgaagatgagcgtggagatcctcgacgggagcacggtccggagcttcgtggaggacgagggcgccttcaactcctccgtcgacggccgcttcgccgcgctggacgccgaccgcgacggcctgctcacgtacgcggagatggccggcgagctcatgagcctccgggtgctggagaagcacttcggcgtggacgaggcggcggcgccggccggcgagctcgccgcgctgtaccgcggcctgttcgcgcggttcgacagggacggcagcggcgaggtggaccgggacgagttccgggcggggatgagggaggtgatgctcgccgtggccaacgggctcggcttcctccccgtgcagatggtcgtcgaggaggggagcttcctcaaggtggccgtcgacagggagctcggccagctcgccagagccgcgtaaagctctactaattgccgaccaccctggcttatatatcacggcagcggatttttcgcatttatttttttccctattcgtaacttcagatgttgtattgagctacatcgttgctaattatgcgtgtaatagttttttttatctggtctgaggatgtaacagttgatagtgagatacgcattatgtgctacaatttttaataagaatattttttt

SEQ ID NO: 30295 - protein, 140 aa, Panicum virgatum; identical to SEQ ID NO: 25242
  misc_feature: Ceres CLONE 1899352
  misc_feature (74)..(102): Pfam Name: efhand Pfam Description: EF hand

SEQ ID NO: 30296 - DNA, 461 bp, Panicum virgatum
  misc_feature: Ceres CLONE 1899391
  misc_feature: Encodes the peptide sequence at SEQ ID NO. 30297
gcacagcatccaatccatcatccatcgacgcgcgccgagaaagaaacagagacagagagctgctagcgggccaatccagccgctggcagcaatggaggaggcgaagaacaagggcctggtgctgctggacttctgggtgagcccgttcgggcagcgctgccgcatcgcgctggcggagatgggcatcccctacgagtactccgagcaggagctcctgggcgccaagagcgacctcctcctccgctccaaccccgtccacaagaagatccccgtcctcctccacgacggccgccccgtctgcgagtccctcgtcatcctcaactacctctgatgcgtgcgacgtggctgcaaataactaaagctgctgtattgttgggtcggtgtcaccaactgttcgtatactccctccctataagttgttcacgacatcgacaccatcttggaaaataactttgaccacc

SEQ ID NO: 30297 - protein, 79 aa, Panicum virgatum
  misc_feature: Ceres CLONE 1899391
  misc_feature (7)..(79): Pfam Name: GST_N Pfam Description: Glutathione S-transferase, N-terminal domain
  misc_feature: SWISSPROT Homolog: EC 4.4.1.5 Lactoylglutathione lyase
  misc_feature: Useful for making plants with modulated drought sensitivity
  misc_feature: Useful for making plants with modulated nitrogen use efficiency
  misc_feature: Useful for making plants with modulated biomass
MEEAKNKGLVLLDFWVSPFGQRCRIALAEMGIPYEYSEQELLGAKSDLLLRSNPVHKKIPVLLHDGRPVCESLVILNYL

SEQ ID NO: 30298 - DNA, 703 bp, Panicum virgatum
  misc_feature: Ceres CLONE 1899420
  misc_feature: Encodes the peptide sequence at SEQ ID NO. 30299
atcagccatcccctcctgctgcaatcttcctctgaattgtgggtctgcggcaatggcggcgctcgctccatcgaagatcctcggcacccagctcaactttgccggctcctcccggtatgccaccactacaccgaccgctggggcgcagaagatcgtctccctcttcaaaaagaagcctgcccagaagcccaagcccgccgccgtatcatcctcatccccggacatcagcgatgagctcgctaagtggtatggccctgacaggaggatcttcctgccggatggtctcttggaccgctcggaggtgccggagtacctcacgggagaggtcgctggagactatggctacgatccttttggtctgggcaagaagccaggggacttcgccaagtaccaggcctacgagctgatccatgccaggtgggccatgcttggcgccgccggtgccgtcatcccggaggcgtgcaacaagttcggcgccaactgcggccctgaggccgtctggttcaagaccggcgccctgctcctggacggcaacaccctcagctacttcggcaacagcatccccatcaacctggtggtggccgtcatcgccgagaggacgcccagcctgtgagcaatgctggctgctgctgcgtttgattttaccgggaaacagagtgtgcgtgagggtctgaactctgaagaatgtggcatgcgtgtaaat

SEQ ID NO: 30299 - protein, 186 aa, Panicum virgatum
  misc_feature: Ceres CLONE 1899420
  misc_feature (83)..(185): Pfam Name: Chloroa_b-bind Pfam Description: Chlorophyll A-B binding protein
MAALAPSKILGTQLNFAGSSRYATTTPTAGAQKIVSLFKKKPAQKPKPAAVSSSSPDISDELAKWYGPDRRIFLPDGLLDRSEVPEYLTGEVAGDYGYDPFGLGKKPGDFAKYQAYELIHARWAMLGAAGAVIPEACNKFGANCGPEAVWFKTGALLLDGNTLSYFGNSIPINLVVAVIAERTPSL

SEQ ID NO: 30300 - DNA, 1407 bp, Panicum virgatum
  misc_feature: Ceres CLONE 1899430
  misc_feature: Encodes the peptide sequence at SEQ ID NO. 30301
gcccagtccctcccacctccgtctcccctcggcccttgccacgcccgggcgccttcgctccaccctctgtcggtctgctgccgtcgtctgcgttgcggcctcgccatggcaccggcgccggcgaacgccgaaaaggacgccgaggacgagctggagatgaaggtggagaaatattcgcgggggaagggtgctgacctgaaggcgctgagggacaagaagttgaaaggccagctcgctgtaaaagagaagctctatggccagtctgcgaaagttgctgcgaaggctgaaaagtggcttatgcctagtgaggagggtttcttagagcctgacgatttggagaagacatatagatttccacaagaatcgattgtgaaggaggtggatcttttgagttcaagaaaaccatttgatatgatcttacctgtacttggttcttatactatagagtacacatcaaatggccgctacatgctagtaggtggacgaaaaggccatcttgctatgatggatatgctgaatatggatctgatcaaggaatttcaggtgagggaaactgttcgcgatgtggcattcttacataatgagcagatgtatgcagtagctcaaaaaaagtacccttacatatataatcgagatggtgtggaaattcattgtctgaaggaacatggcaaagcattgaaactccagtttctgcctaaacacttcctcttggcttcaataaacagctttgggcagctccactaccaagatgtgagcactggtgatatgattgcaaattacaggacaggtctggggcgaactgatgttatgcgggtcaatccctataatgctgtcataggcctcggacatgctggtggcaaagttaccatgtggaagccaacaagtgtgaaacccctggtcaccatgctgtgccatcatggccctgtgactgctgttgcgttcgacaggggtggccatcttatggcaacagcaggtgttgacaggaagataaaaatctgggacctgagaaagtatgaggttataaagtcgtatgcagcgcgtgctcaatccttggatttcaaccagaaggggctattggcctgcagcaacggatctcaagtagagatctacagggatttcggtgggcatgattataggctttacatgaagcacagaatgatgaagggctatcaggttgggaaagttttgttccggccctacgaagatattctggggattgggcactcgatgggcctttcgtccatccttgttccagggtccggtgaaccgaacttcgatacctttattgacaatcccatggagactaccaagcagaagcgggagaaggaaattcatgctctcctcgacaagctcccgccggacactatcatgcttaatccaaattcgatagccactgtcagagctccg

SEQ ID NO: 30301 - protein, 433 aa, Panicum virgatum
  misc_feature: Ceres CLONE 1899430
  misc_feature (345)..(425): Pfam Name: BING4CT Pfam Description: BING4CT (NUC141) domain
  misc_feature (261)..(299): Pfam Name: WD40 Pfam Description: WD domain, G-beta repeat
MAPAPANAEKDAEDELEMKVEKYSRGKGADLKALRDKKLKGQLAVKEKLYGQSAKVAAKAEKWLMPSEEGFLEPDDLEKTYRFPQESIVKEVDLLSSRKPFDMILPVLGSYTIEYTSNGRYMLVGGRKGHLAMMDMLNMDLIKEFQVRETVRDVAFLHNEQMYAVAQKKYPYIYNRDGVEIHCLKEHGKALKLQFLPKHFLLASINSFGQLHYQDVSTGDMIANYRTGLGRTDVMRVNPYNAVIGLGHAGGKVTMWKPTSVKPLVTMLCHHGPVTAVAFDRGGHLMATAGVDRKIKIWDLRKYEVIKSYAARAQSLDFNQKGLLACSNGSQVEIYRDFGGHDYRLYMKHRMMKGYQVGKVLFRPYEDILGIGHSMGLSSILVPGSGEPNFDTFIDNPMETTKQKREKEIHALLDKLPPDTIMLNPNSIATVRA

SEQ ID NO: 30302 - DNA, 712 bp, Panicum virgatum
  misc_feature: Ceres CLONE 1899441
  misc_feature: Encodes the peptide sequence at SEQ ID NO. 30303
agccctcagcaaaacgagtcctccagccatggcgctcgtgctggcctctccaatggcgcccctctccttccgctcggggaggatctccgcggcggctatcggcggcgtcgcccgcgctggcagggcggccccggtgggcgcctccgccgcctccccgttcctcaggagctccttcgtctcgtcctcctccacgtcgtccgcctccgcctcgctgtcggcggcggtctcggcgtcgctggccttcacgtcctcttcctcgttctccggttcatctttgggaattgagttcagctacaacagaatgacaacacgaagatcgcgtggtctgcagattagggctggaaaggctgccctctgcatgaccaagaggtcaaaatctaggaagtcacttgcccggacacatggtttccgcaggcggatgcggactacttctggaaggaaggtactgaagcgcaggcgtgccaaaggcaggaaggttctgtgcacaagaacaaactcacccactgggaagaaaagaatattctaattccactgcaatatgacgtgcatgcaacttcaagtatgctttctacatccaatcttctgagcctccttctatctgtaacaatcatgtagcatcctatttctgttttttcggttaatacatctgaatcaccttgtccacacaatttcaagttaccttttttggatgtccctgttgctttggtggaac

SEQ ID NO: 30303 - protein, 165 aa, Panicum virgatum
  misc_feature: Ceres CLONE 1899441
  misc_feature (112)..(153): Pfam Name: Ribosomal_L34 Pfam Description: Ribosomal protein L34
MALVLASPMAPLSFRSGRISAAAIGGVARAGRAAPVGASAASPFLRSSFVSSSSTSSASASLSAAVSASLAFTSSSSFSGSSLGIEFSYNRMTTRRSRGLQIRAGKAALCMTKRSKSRKSLARTHGFRRRMRTTSGRKVLKRRRAKGRKVLCTRTNSPTGKKRIF

SEQ ID NO: 30304 - DNA, 706 bp, Panicum virgatum
  misc_feature: Ceres CLONE 1899457
  misc_feature: Encodes the peptide sequence at SEQ ID NO. 30305
ataggaaccaagccaaagcacagaagggagggaaaaagagaggagagccacgatgatgcccgccgccgccgccaccagcactggcgggttccgcctcgtgctccccgcggtgcacaggcggccgcctccgcttcctagtcttgcaatcagctccgctagaggaggacaaggaggaaagctacgagcggccgcagaagcggcatcaggagacgtcgtcgtcgccggcggcggcggcgccgcgctgctggggcggcccctggaggacgtgtacaaggtgcgcgtggagcgcggcgcggcggcgcgggcgcgcgcggaggcgctgcgcgtggtggagacatggtcgttgtggcgcacgggcgggcggtgccggatgccgtgggactggcaggtggaccagctcgtgtacatcgtgtccggcgaggtcaaggtcatccccgccggcgccgtccacggcgacgactacatgcacttcgtcgctggggacctcgtcaggtacccgcgctggttcgaggccgacctctacttcgacggcccctacgaggagcgctaccgcttcctcgcctacggagacgacaactaggcccctagtcttcaacatgctcattgtcagcagcttatcctgtactcttatcatttcttgtttcagctttactagtttttaggcttattgttaggtaccctacccgttggagaaacatacgcagtt

SEQ ID NO: 30305 - protein, 175 aa, Panicum virgatum
  misc_feature: Ceres CLONE 1899457
  misc_feature (88)..(166): Pfam Name: Cupin_3 Pfam Description: Protein of unknown function (DUF861)
MMPAAAATSTGGFRLVLPAVHRRPPPLPSLAISSARGGQGGKLRAAAEAASGDVVVAGGGGAALLGRPLEDVYKVRVERGAAARARAEALRVVETWSLWRTGGRCRMPWDWQVDQLVYIVSGEVKVIPAGAVHGDDYMHFVAGDLVRYPRWFEADLYFDGPYEERYRFLAYGDDN

SEQ ID NO: 30306 - DNA, 689 bp, Panicum virgatum
  misc_feature: Ceres CLONE 1899475
  misc_feature: Encodes the peptide sequence at SEQ ID NO. 30307
acgccccaccgccgccgccgccgccgccgctcgcaccgtcgcatctccgcagggttcgcaaagatggcggtgcctctgctgacgcagaagatcgtgaagaagcgggtcaagcagttcaagaggccccacctcgaccgctacaagtgcctcaagccaagctggcgcaggcccaagggtattgactcccgcgtcaggcggaagttcaagggatgcaccttgatgcccaacattggatatggctctgacaagaagacaaggcactacctccccaacaaattcaagaagtttgttgttcacaatgtctctgagctggagctgtttatgatgcacaacaggacgtactgtgcggaaattgcccacaacgtctccaccagcaagtgcaaggagattgttgagcgtgctgcacagctggacatcgtggtcaccaacaagcttgccaggctccgcagccaggaggatgagtgaaatgttcagtagttgcaattgtgttgttcttagaacagtaccgagttggagatactcttcaaccatttttatgcttacgttagacatgttctgtggtcgtaattttgctacgagtgtactagtgatggcaaatgccatgtagttttgatctgacatcatgaaagcgtgccaatgacctccccatgcttaaggtttgtgagtataaattttgttcctgtgcgtcc

SEQ ID NO: 30307 - protein, 133 aa, Panicum virgatum
  misc_feature: Ceres CLONE 1899475
  misc_feature (14)..(123): Pfam Name: Ribosomal_L32e Pfam Description: Ribosomal protein L32
MAVPLLTQKIVKKRVKQFKRPHLDRYKCLKPSWRRPKGIDSRVRRKFKGCTLMPNIGYGSDKKTRHYLPNKFKKFVVHNVSELELFMMHNRTYCAEIAHNVSTSKCKEIVERAAQLDIVVTNKLARLRSQEDE

SEQ ID NO: 30308 - DNA, 620 bp, Panicum virgatum
  misc_feature: Ceres CLONE 1899492
  misc_feature: Encodes the peptide sequence at SEQ ID NO. 30309
acacacagctcacgcgcagcatcaccaccggagcatcagggagcacgggagagagcagagcgccacaggccgtccgatcctccgcgcgaagcagatcagatggctctcgctctctactgctctgccgcgctccgcgccgcgctggcctcgctggccccgcgggccgccgccgggggctacgcggcgtcagcggcgtccgggggcatgcggcgaggggaggacagcggaggatggggaggacgacgaaggcagaggcggggaagagggcgcggaccccgcgcggcaggatgccctggtccgccgggccgccccccccgccctacttccacatgatctgggaggccatcctgtcccaggacggcctggcgggggcgagcccgtacgcgatcggcaagcacatggaggagaagcaccgggacgttctcccggccaactaccgcaaggtgctggccgtgcggctgcgcagcttcgccgctgagggtcggctcgtcaaggtcaacgcctccttcatgctcgccgcggccgaggagaagaaggccgcctccgccgcgaaggccatgccgacgccggcgccggcggctgccgctccctagcgcaagacgaccgcggtccccgccgcg

SEQ ID NO: 30309 - protein, 120 aa, Panicum virgatum
  misc_feature: Ceres CLONE 1899492
  misc_feature (29)..(97): Pfam Name: Linker_histone Pfam Description: linker histone H1 and H5 family
MGRTTKAEAGKRARTPRGRMPWSAGPPPPPYFHMIWEAILSQDGLAGASPYAIGKHMEEKHRDVLPANYRKVLAVRLRSFAAEGRLVKVNASFMLAAAEEKKAASAAKAMPTPAPAAAAP

SEQ ID NO: 30310 - DNA, 754 bp, Panicum virgatum
  misc_feature: Ceres CLONE 1899500
  misc_feature: Encodes the peptide sequence at SEQ ID NO. 30311
ctgttttattattgcggccacctcaccgctcccatcccgccttgtcctctcctctgcctctctctaatctctagcctccctcctcttcctcatcctccgacgacgctgttagctgagagcgggggaggccctggtctacgcccgccagcccgccttgctggtgcgctgcgacgtcggcggcgccgagccggccgccgtgctctgctgcgccgactaggccacgctctgctccggctgccaccgccgcgtcctccgtgccgactagctcgccgaccagcaccgccgcatcgcgcttctccctccctccggcggaggcggcggcgggggcggaagcagcggcggctgcagcagcatctccgactacctcaccagcatctgccccggctggcgcgtcgacgacctcctcttcgacgacgccgcgttctccgccgcctcggaggaggccaggcgcgacgagcacgagcaggttccgtccctggacgccgacctcttcgacgtggtcgccggccggccggggaagcgcggcgcgtggtacggcggctcgatgggcctcgagaaggtgcctgctgctgctgcctccattgcggtcccgacggcggctaagcagcacgtgcgcgtgagggagaggcactggagctgcgacagcgacagcgacgtgttcgcggtgtcggagatctcgcagccgccgccagccaagaaggcgcggccgccggcgccgacgttctggtgcttctgatcgagctgcgcacccttc

SEQ ID NO: 30311 - protein, 63 aa, Panicum virgatum
  misc_feature: Ceres CLONE 1899500
  misc_feature: The sequence is a functional homolog of SEQ ID NO 1024 in the 10/666,642 US patent application
  misc_feature: The sequence is a functional homolog of SEQ ID NO 1646 in the 10/374,780 US patent application
  misc_feature: The sequence is a functional homolog of SEQ ID NO 1672 in the 10/412,699 US patent application
MGLEKVPAAAASIAVPTAAKQHVRVRERHWSCDSDSDVFAVSEISQPPPAKKARPPAPTFWCF

SEQ ID NO: 30312 - DNA, 645 bp, Panicum virgatum
  misc_feature: Ceres CLONE 1899515
  misc_feature: Encodes the peptide sequence at SEQ ID NO. 30313
aatcccaatcccgatcccgctagaggagcagaccctctgattgctcggtccattgatctgcatcgcaatgtccggcgacaaggcggcggtgcaggcgggcggcgacgcgcagcagcagaagcccggcggcggcgggaaccggattcaggtgtccagctccaagaagccgctcttcttctacgtcaacctctccaagaggtacatgcagcagcacggcgacgtcgagctctctgcgctcgggctggccatatcaacagtggtgaccattgcggagattctaaagaacaatggtcttgccattgaaaagaagattagaacatccactgtcgaaatcagcgacgaaatgagaggccggtcgatccaaaaggctaagattgagatattgctgggaaagaccgacaacttcgatgagctgatggccgccagcgctggagaggcaaccgcaggagatgccgaagggcagtcctagaaagttgaagtgtctagtttttccttacatttttttttctttttgccttctgggtattttgctggctctggttaaattatgagatgctggtgctcgagatgaattgtgttttggtgtgtccacttgctgtgtggcgtttctgaaacaatatatatgaatttgaattacattccttt

SEQ ID NO: 30313 - protein, 133 aa, Panicum virgatum
  misc_feature: Ceres CLONE 1899515
  misc_feature (22)..(91): Pfam Name: Alba Pfam Description: Alba
  misc_feature: Useful for making plants with modulated nitrogen use efficiency
MSGDKAAVQAGGDAQQQKPGGGGNRIQVSSSKKPLFFYVNLSKRYMQQHGDVELSALGLAISTVVTIAEILKNNGLAIEKKIRTSTVEISDEMRGRSIQKAKIEILLGKTDNFDELMAASAGEATAGDAEGQS

SEQ ID NO: 30314 - DNA, 722 bp, Panicum virgatum
  misc_feature: Ceres CLONE 1899532
  misc_feature: Encodes the peptide sequence at SEQ ID NO. 30315
caacatgtaccgcaagatctacgcgggcaggttccggtgcccgagctggttctcgccggcgctgcgcgacctgctgcgccgccttctggacccgaacccggactcccgcaccgacgcggacggcatcgtgggccacccgtggttctgccacggcgccggcgacgaggagctggcgcgcctcatgcgcggccacgaggaagagccctggttcaagcccgagttcaaggaggaggacatggcgagggagatgacggcgttcgacatcctgagcttctccgccgggtccgacctgtcggcgctcttcggtgccgggccgggcaaggagcgggtgttcgtgagcgagcccgccgccgcggtgctgagccgcgtggaggcggctgggcggaaggaagggtaccgcgtgaggagggaagggaagcggggcaccgggccggtctacctggaggaggagagcggcggcggcatcgtggccaaagtgagcgtcttcaagctcgccgacgcggtgtcagtggtggaggtcgtcaagggcgacggcgcggaggcggcactcttctggaccgagcggctcgagccggccgtgaagcccccggtgctgagctgagctgaaagctgatcggggccgccgccgagggttcctgctctgctcctgggaggcgccgccgctgccgcttgccgggaacgggattcgtttcctgttgttgtgatggtaaattcatttggtt

SEQ ID NO: 30315 - protein, 199 aa, Panicum virgatum
  misc_feature: Ceres CLONE 1899532
  misc_feature (79)..(136): Pfam Name: NAF Pfam Description: NAF domain
  misc_feature: SWISSPROT Homolog: EC 2.7.11.1 Non-specific serine/threonine protein kinase
NMYRKIYAGRFRCPSWFSPALRDLLRRLLDPNPDSRTDADGIVGHPWFCHGAGDEELARLMRGHEEEPWFKPEFKEEDMAREMTAFDILSFSAGSDLSALFGAGPGKERVFVSEPAAAVLSRVEAAGRKEGYRVRREGKRGTGPVYLEEESGGGIVAKVSVFKLADAVSVVEVVKGDGAEAALFWTERLEPAVKPPVLS

SEQ ID NO: 30316 - DNA, 680 bp, Panicum virgatum
  misc_feature: Ceres CLONE 1899542
  misc_feature: Encodes the peptide sequence at SEQ ID NO. 30317
acacgcggacacgccactagctagcctcctcccggtctgagcagctcatcaacgccgccggcggcaaggtgatcgccgtcgagtgcatcctgccggtgaacccggaggcgacgcccaaggcgcagggcgtgttccacgtcgacatgatcatgctcgcgcacaaccccggcatcaggggggtcaacttcgacctgccccacgtgatctccgaggcgccgccgttccccggcgtggagcacgtcggcggggacatgttcaaggccgtgcccgccggtgacgccatcctcatgaagtggatcctccacgactggagcgacgcccactgcgcggcgatcctcaagaactgctacgacgcgctccccgccggcggcaaggtgatcgccggcttcaccgggttcaaggccacctacatctacgccaacgcatgggccatcgagttcaccaagtagatctgttgtcgcgcatgtgcttgtgcttaatttgctttcttcatcatcatcttcatcctgctgctggcctgcctgccggcctccatggccggaccaccatcgatccttgttctggattccaaattctaatggttgtatgtgttgagatgtctctaccatgtaccattaataaataataacagccaatgtactcttatatatatacatattgtaacaccccagttgttaatc

SEQ ID NO: 30317 - protein, 101 aa, Panicum virgatum
  misc_feature: Ceres CLONE 1899542
  misc_feature (1)..(97): Pfam Name: Methyltransf_2 Pfam Description: O-methyltransferase
  misc_feature: SWISSPROT Homolog: EC 2.1.1.68 Caffeate O-methyltransferase
  misc_feature: Useful for making plants with altered carbohydrate content
  misc_feature: Useful for making plants with altered cell wall content and/or composition
  misc_feature: Useful for making plants with altered lignin content
  misc_feature: Useful for making plants with modulated time to senescence
MIMLAHNPGIRGVNFDLPHVISEAPPFPGVEHVGGDMFKAVPAGDAILMKWILHDWSDAHCAAILKNCYDALPAGGKVIAGFTGFKATYIYANAWAIEFTK

SEQ ID NO: 30318 - DNA, 739 bp, Panicum virgatum
  misc_feature: Ceres CLONE 1899552
  misc_feature: Encodes the peptide sequence at SEQ ID NO. 30319
aaccgctagttacttctctcataaatcttcggtgaggcttagggacgcccaaaaaaccctccggcccttcctccccaccgtcgtcggcgatctccacctacgtcgccgccgatggatctctccgacgtccaggccgccctctccgacaagtcctactcctctctagcccccctctgcgacgaactcctcctccaggccgcgtccaggggaaccaccaccgacgaatggccccacgccgtccacctcctcgcccatctgtacctcaacgacttgaacagcgcgaggttcttctggaagtcgctgccgcaggaggtgaaggacgcgcgtccggagctcgccgccgtctggaggatcggccagtgcctctggaatcgcgactacgctggtgtctacacggccgcacaggggtttgagtggggccctgaccttgctgacttcatcactgccttcctagaaagctacagaaagaggatattccagcttttaacttctgcgtattccacaatcagcgttgctgatgtggctcacttcatgggcatgagtgaggaggattctacaaacttgcatccatttccccctacatttttttgaccgttatatgataactagtttgacagatgctgtgcaaaatggttggagtttggatgcagggaccaagatgcttaccgtcaagaaacaaaggctcagaccaaccagaagcttgatgcaagcaaactgcagcgtttgacagagtgtgttt

SEQ ID NO: 30319 - protein, 159 aa, Panicum virgatum
  misc_feature: Ceres CLONE 1899552
  misc_feature: Useful for making plants with modulated light quality sensitivity
  misc_feature: Useful for making plants with modulated low light sensitivity
MDLSDVQAALSDKSYSSLAPLCDELLLQAASRGTTTDEWPHAVHLLAHLYLNDLNSARFFWKSLPQEVKDARPELAAVWRIGQCLWNRDYAGVYTAAQGFEWGPDLADFITAFLESYRKRIFQLLTSAYSTISVADVAHFMGMSEEDSTNLHPFPPTFF

SEQ ID NO: 30320 - DNA, 762 bp, Panicum virgatum
  misc_feature: Ceres CLONE 1899556
  misc_feature: Encodes the peptide sequence at SEQ ID NO. 30321
acggtacccgtttctctcacacctcgcgcagcatcggagcactagagaggaatccagcccagcagcccaagcaatggagtgcgtcctgggcgtggtcggccgcgacttcgcggtggtggcggcggacacctccgccgtgcagagcatcctcgtccacaagacggacgaggacaaggtgatggtcctcgactcgcacaagctgatgggcgcctcgggggagcccggcgaccgggtgcaattcacggagtacatacagaagaacctccacctgtaccagttccgcaacaccaccccgctctccaccgccgccaccgccaacttcacccgcggcgagctcgccacagccctccggaagaatccatacatggtcaacgttatacttggtggttatgataagaatgttggcgcttccttgtactacatcgactacattgcaaccttgcacaagattgacaagggtgcttttgggtacggctcctacttctgtttgtcgctaatggacaagctgtaccacccggacatgactgttgaggaagcagtagatcttgttgacaagtgcatcaaggagatccgtctgaggttggtcgttgcgcctcagaactttgtaatcaagatcgtggataaggatggggcgagggagtatgcgaggcgtgagctcgtcggtgacaacacatcagcatcagcatcagcatcagcgggagctgcagcaactacagttgccggctgagggcgtgactcgttggagcttgcatattgtttatt

SEQ ID NO: 30321 - protein, 217 aa, Panicum virgatum
  misc_feature: Ceres CLONE 1899556
  misc_feature (1)..(182): Pfam Name: Proteasome Pfam Description: Proteasome A-type and B-type
  misc_feature: SWISSPROT Homolog: EC 3.4.25.1 Proteasome endopeptidase complex
MECVLGVVGRDFAVVAADTSAVQSILVHKTDEDKVMVLDSHKLMGASGEPGDRVQFTEYIQKNLHLYQFRNTTPLSTAATANFTRGELATALRKNPYMVNVILGGYDKNVGASLYYIDYIATLHKIDKGAFGYGSYFCLSLMDKLYHPDMTVEEAVDLVDKCIKEIRLRLVVAPQNFVIKIVDKDGAREYARRELVGDNTSASASASAGAAATTVAG

SEQ ID NO: 30322 - DNA, 583 bp, Panicum virgatum
  misc_feature: Ceres CLONE 1899588
  misc_feature: Encodes the peptide sequence at SEQ ID NO. 30323
catgaaccaccctgggcagattggcaacggttatgccccagtgctggactgccacacctcccacattgctgtcaagttcgctgagcttattaccaagattgacaggcggtctggcaaggagcttgagaaggagcccaagttcctcaagaatggcgacgctggtatggtgaagatggttcccacaaagcccatggtggtggagacgttctctgagtaccctcctcttggtcgctttgctgtccgtgacatgaggcaaacggttgctgttggagtcatcaagagcgtggagaagaaggacccaaccggcgccaaggttaccaaggctgctgccaagaagaaatgatgcgcctggtgctttatcctgcgtctgcttttgctatacctagatgctattttattattataccagttttgtttgcatgtcatcgctgttatcgttgaacatttaaggtctgctggtggtgtgacatttgtatgtttaggtactgtcttcttatttcagcttaggcaaaacttgaatgctctgagacctatgtgtgtccattttggtggtggttggaatcgtctagttatatctttttgc

SEQ ID NO: 30323 - protein, 113 aa, Panicum virgatum
  misc_feature: Ceres CLONE 1899588
  misc_feature (1)..(96): Pfam Name: GTP_EFTU_D3 Pfam Description: Elongation factor Tu C-terminal domain
  misc_feature: The sequence is a functional homolog of SEQ ID NO 576 in the 10/666,642 US patent application
MNHPGQIGNGYAPVLDCHTSHIAVKFAELITKIDRRSGKELEKEPKFLKNGDAGMVKMVPTKPMVVETFSEYPPLGRFAVRDMRQTVAVGVIKSVEKKDPTGAKVTKAAAKKK

SEQ ID NO: 30324 - DNA, 619 bp, Panicum virgatum
  misc_feature: Ceres CLONE 1899644
  misc_feature: Encodes the peptide sequence at SEQ ID NO. 30325
gtgctctctcagaggtgggttggcttctcctccccctccagttcggttcggttcgggttcgtgaggttcttggggttccgttcgggggtgagaggaagagatggaggcgtcggatgttgagtaccgctgcttcgtcggcggccttgcctgggccaccgacgacaactcgctccacaacgccttcagcacctacggcgaggtcctcgagtccaagatcatcctcgatcgtgagacccagaggtcccgcggcttcggcttcgtcaccttctcgagcgagcaggcgatgcgcgacgccatcgaggggatgaacggcaaggagctggacggccgcagcatcaccgtcaacgaggcccagtcccgcggcggcccgcgctccggcggcggcggcggctacgggcgccgcgagggctgcggtggctgcggcggcgggtgcggtgcctgacgccggtgttgcgcgggctgctactggatgggactgatggggaacaataatagtgatggtgctgagatgtcgtcggcgtcgccgccgccgtcgtgtccttcctcccccgccagtcgggcacctgtggcggtgctctagcagtgtgttgtgtgtgcagcagaccatgctctgatcttt

SEQ ID NO: 30325 - protein, 113 aa, Panicum virgatum
  misc_feature: Ceres CLONE 1899644
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with modulated flowering time
  misc_feature: Useful for making plants with altered lignin content
  misc_feature: Useful for making plants with modulated nitrogen use efficiency
  misc_feature: Useful for making plants with altered alkaloid content
  misc_feature: Useful for making plants with modulated biomass
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
  misc_feature: The sequence is a functional homolog of SEQ ID NO 1042 in the 10/374,780 US patent application
  misc_feature: The sequence is a functional homolog of SEQ ID NO 852 in the 10/666,642 US patent application
MEASDVEYRCFVGGLAWATDDNSLHNAFSTYGEVLESKIILDRETQRSRGFGFVTFSSEQAMRDAIEGMNGKELDGRSITVNEAQSRGGPRSGGGGGYGRREGCGGCGGGCGA

SEQ ID NO: 30326 - DNA, 666 bp, Panicum virgatum
  misc_feature: Ceres CLONE 1899656
  misc_feature: Encodes the peptide sequence at SEQ ID NO. 30327
agtccttgcttgctgctgcttctatatatcctcgtccagcttgcttcaactctcatcctcctcctattagctccttcttcgattcattgttgggataacgcaaggtgatcgtgaggaatgtcggcccagatcgcgccgccgccggagcatgtgtgctacgtgcactgcaacttctgcaacacaattctcgcggtcagtgtcccgagcaatagcatgctgaacattgtgacagtccgttgtgggcattgcactagcctgctgtcagtgaacttgagaggactgatcccatcacttcctgtccagaatcactcacagttggtgcaggagaatttcaaggttcacaatatcagctttactgaaaactactctgagtatgcacctacgtcttcaaaataccggatgccaatgatgttctcaacaaaaggagatcaggatcatatgctgcatgtgcgcgctccagagaagaggcaacgtgttccatcagcatacaatagatttattaaggaagagatacggaggattaaagcaagcaaccccgccataagtcacagagaagcattcagcactgcagcaaagaattgggcacattttccaaacatacattttggcctagggacccatgagagcagcaagaatctcgatgaggccattggtgcggcaggtggt

SEQ ID NO: 30327 - protein, 182 aa, Panicum virgatum
  misc_feature: Ceres CLONE 1899656
  misc_feature (3)..(165): Pfam Name: YABBY Pfam Description: YABBY protein
  misc_feature: The sequence is a functional homolog of SEQ ID NO 414 in the 10/666,642 US patent application
  misc_feature: The sequence is a functional homolog of SEQ ID NO 888 in the 11/435,388 US patent application
  misc_feature: The sequence is a functional homolog of SEQ ID NO 1506 in the 10/666,642 US patent application
  misc_feature: The sequence is a functional homolog of SEQ ID NO 420 in the 10/666,642 US patent application
MSAQIAPPPEHVCYVHCNFCNTILAVSVPSNSMLNIVTVRCGHCTSLLSVNLRGLIPSLPVQNHSQLVQENFKVHNISFTENYSEYAPTSSKYRMPMMFSTKGDQDHMLHVRAPEKRQRVPSAYNRFIKEEIRRIKASNPAISHREAFSTAAKNWAHFPNIHFGLGTHESSKNLDEAIGAAG

SEQ ID NO: 30328 - DNA, 607 bp, Panicum virgatum
  misc_feature: Ceres CLONE 1899696
  misc_feature: Encodes the peptide sequence at SEQ ID NO. 30329
ggacataagatttaagacacgaaagatgctggtgaaaggagttaaagaaggaaggtggactgaaaagttcatctcacgaataaaatttaaagaggatatattaatctcgtcacctgatgtatctctggtagagcttggaccggatgtggaatttcttatactagcaactgacggtctttgggattacatgaaaagctctgaagctgtagcatttgtcagagatcaactacgtcagcatggtgatgtccagttggcctgtgaggcacttggtcagaaagctctggatgaacggtcacaagacaatattagcatagtcatagctgacttggggaggacaaactggaaggcgttgcccgtggaaagcccaaacttgttcttggaactaagtcaagcagttgtgactgtaggggttgtcgctgtaggaatttggttctcatcgctgcttacattacagtaggactagttctgttcagatgtgtacattacttattgaattacatgttccgctggtagctgcaaatatatgtatattcttatagggtcgattaatatagtgtaatctgttgtataatgatgaacgggtgaagtactgatgaagatcgtatag

SEQ ID NO: 30329 - protein, 151 aa, Panicum virgatum
  misc_feature: Ceres CLONE 1899696
  misc_feature: SWISSPROT Homolog: EC 3.1.3.16 Phosphoprotein phosphatase
DIRFKTRKMLVKGVKEGRWTEKFISRIKFKEDILISSPDVSLVELGPDVEFLILATDGLWDYMKSSEAVAFVRDQLRQHGDVQLACEALGQKALDERSQDNISIVIADLGRTNWKALPVESPNLFLELSQAVVTVGVVAVGIWFSSLLTLQ

SEQ ID NO: 30330 - DNA, 556 bp, Panicum virgatum
  misc_feature: Ceres CLONE 1899702
  misc_feature: Encodes the peptide sequence at SEQ ID NO. 30331
cggacccccacggccaccccagcccagcctgccctgcgccgcgccgcgctgtccctgacccggcggccatggcggaggagcagcagcggcagaggtggcaggagggccaccgcctgtgcgccaacaactgcggcttcttcggcagccccgccacgctggacctctgctccaagtgctaccgcgacctcaaccacaaccagcccgcccccgtgccaccgccgccggcctgcacgccgccatccgcctccgtctcagctcccgaggcgggcgccgccgcggcctcttccgcccccgggcctccgccgacgccccctgccctggccggaaggtgcgcgacctgccggaagcgcatgggcctgacggcgttcgcgtgccactgctagcactgccttctgcagtgtgctccggcacccgcaccgccctgcgtgcgacttcgaattcggctccgagggccataactcccttgagcacgccgtcccgatcatcaaggatgatctttgatgggaggtgggctaatgctcacgctactctgacggatggatgactacgactacta

SEQ ID NO: 30331 - protein, 104 aa, Panicum virgatum
  misc_feature: Ceres CLONE 1899702
  misc_feature (14)..(38): Pfam Name: zf-A20 Pfam Description: A20-like zinc finger
  misc_feature: Useful for making plants with altered lignin content
MAEEQQRQRWQEGHRLCANNCGFFGSPATLDLCSKCYRDLNHNQPAPVPPPPACTPPSASVSAPEAGAAAASSAPGPPPTPPALAGRCATCRKRMGLTAFACHC

SEQ ID NO: 30332 - DNA, 674 bp, Panicum virgatum
  misc_feature: Ceres CLONE 1899706
  misc_feature: Encodes the peptide sequence at SEQ ID NO. 30333
acagcacgcgctttccatcgtcgccgtgccgccaccaccgcccgtggccgtcggagcagggctgcgccacctctccgacgtccggaggttgctgcgtaggcagtaggcacatacacgcaggcggcggcggcggcggcggcggcggccatggcgtcgcgcaagcttctcctgagcctcaccgccgggaggcggctccggtcccgcactcaacaactcttctgcgccgccagtctccctgaagctaccacctctcgctccctcgcggccgccgttgccgccgcgcagcagtcgggcgggtcgccagtggctcatctcttctcttcgaggaccatctcgtcgacgcgccccgcgacacagtccgctcgagatgcgcccagttcatctgcggtggaccaccacaagttggtaatgcctgaggacgagtttcataaattagcagatgagacgattcacgatttgcttgaaaaacttgaggaatatggtgactccattcagatggatggtttcgacattgactacgggaatcaggttttgacattgaggcttggggatttgggaacatatgttgtaaacaagcaaacaccaaacagacaaatctggttatcttcacctgtgagtgggccttctaggtttgattgggatgcatcaacagatggttgggtatacaaacggaa

SEQ ID NO: 30333 - protein, 175 aa, Panicum virgatum
  misc_feature: Ceres CLONE 1899706
  misc_feature (88)..(175): Pfam Name: Frataxin_Cyay Pfam Description: Frataxin-like domain
MASRKLLLSLTAGRRLRSRTQQLFCAASLPEATTSRSLAAAVAAAQQSGGSPVAHLFSSRTISSTRPATQSARDAPSSSAVDHHKLVMPEDEFHKLADETIHDLLEKLEEYGDSIQMDGFDIDYGNQVLTLRLGDLGTYVVNKQTPNRQIWLSSPVSGPSRFDWDASTDGWVYKR

SEQ ID NO: 30334 - DNA, 2633 bp, Panicum virgatum
  misc_feature: Ceres CLONE 1899722
  misc_feature: Encodes the peptide sequence at SEQ ID NO. 30335
aagaaaagaccctactctctcacagggggagtccacctccccctccacgcttctcccgctgaccctacccaacacggccaccgccgccgccgccgcggccggcaagcgccatgcggccttcctcgcgcatactcgcggcgggccacctccaccgcggcttccggcttgaaccatcccagaccgccgccgccgccgccgccgccgtattccggcggctgaacggagccagcaggccgggcgtgccgaaacctctcaccaaccctctcctcggaggcttcggacccaactgtggcatcccgcccgggaaagggggcctttttggccgcctcggcagcttcctgcccgactctgcctacccgccgcacggcgcgcggcttccccgggacacgagaggacatgcattctccacatctgcaaatgctgtgacagttggaaagccggataatgacaaggtgaagaaagatgcttcaaaaaaggatgttgatgagcagatagcagattctcagatactgaaaaaccttgggaagtacttattattgaatgacagccctgacttccgcttcaggcttgtgttgtcgctgggcctattagttggtgcaaaggttattaatgttcaagtgcctttcttgtttaagcttgctatcgattggcttgcagcccttggtggtgctgaagcctcacttgcatcgttcacggaaactaatgccaccctattggctctctttgcaagcccagcagctgtgctggttggttatggaattgcacgatcaggagtgtcggcgtgtacagagcttcgaaatgctgtattttctaaagtgaccttgagagccatccgttcagtatccagaatggtattttctcacttgcatgagcttgatcttcgttatcatctaagccgacaaactggtgctctaaatcgcataattgatcgaggcagccgtgcaataaattacattctgacagtgatggtattcaatgttgtgcctacaatactagagattggtatggtctcaagcatacttgcgtacaagtttggttccacttttgcttggattacttctgtttcagttgctacttatattgctttcactttggctgtcacacagtggcggactaaattcaggacagccatgaataaagctgataatgcttccagtacagtggcagttgactctcttctgaattatgagactgtgaagtacttcaacaatgaacaatttgaagttgagaagtacgacaaatatttaagaaaatatgaggatgctgcattgaagacccaaagtagccttgcctacctgaattttggtcaaaatgttatctttagctcggctttatcaacagcaatggttttgagctcatatggagtaatgagtggtgctcttactgttggtgatttggtcatggttaatggacttttattccagctctcattgcctctaaatttccttgggagtgtgtatcgagaatctagacaaagcctgattgacatgaagtctatgtttcagttgcttgaggaaaaacctggaataaaggatgagcctcatgcacaacctttgcagttcaagggaggatgcattgaattcgaaaatgttcattttgggtatgtaccagaaaggaagattcttgatggtgctactttcactgtacctgcaggacagagcgtggccattgtaggaactagtggcagcgggaaatcaaccattcttagacttctgttcagatttttcgaatcaacatcaggatctatacggattgatgggcaagatatccgaggagtaacactagagagccttagaaaatgtcttggtgttatgcctcaggacactgtactttttaatgacacgattaagcataatatacagtatgggcggttatcagcaaaagacgaggaggtctatgatgctgcccgacgtgctgctattcatgatacaattatgaacttcccagacaagtatgacacagtagtaggagaacgaggattgaagctaagtggtggggagaaacaacgagtgtcaatagctcgtgtattcttgaaggagccctcaattctattatgtgatgaagcaacaagtgctcttgatagtactactgaagcctccattttgaattctctgaaatctttatccgttgatcgaacatcaatctttattgctcatcgactcacgactgcaatgcagtgtgatcagataattgttttggagaatgggaaggtaatagaacaaggacctcatgatgttcttctgtcaaagggtgggcgatacgcagaattgtggtttcagcagaacaacagtgatgccattgaccctgctgcagttaacctagaggtttgattgacattgtatacttttcccttctgcaagggaaaacagtcttgtaactgagaggggagcaggtttcaatttatctgcgccttgtaaatggagtaggattttagatatgcggggacataaggagagagagatctccattccaagatagcctgggcgattctttttcccctttgagattatatagacaatcccatctgtttttttcatggcaatgtaacatttctgtagcacaaggaataagtttagtaaatatttacttgtctcagctcaattaccattttggtatagatgctgttactgtgt

SEQ ID NO: 30335 - protein, 739 aa, Panicum virgatum
  misc_feature: Ceres CLONE 1899722
  misc_feature (515)..(699): Pfam Name: ABC_tran Pfam Description: ABC transporter
  misc_feature (153)..(443): Pfam Name: ABC_membrane Pfam Description: ABC transporter transmembrane region
  misc_feature: SWISSPROT Homolog: EC 3.6.3.42 Beta-glucan-transporting ATPase
MRPSSRILAAGHLHRGFRLEPSQTAAAAAAAVFRRLNGASRPGVPKPLTNPLLGGFGPNCGIPPGKGGLFGRLGSFLPDSAYPPHGARLPRDTRGHAFSTSANAVTVGKPDNDKVKKDASKKDVDEQIADSQILKNLGKYLLLNDSPDFRFRLVLSLGLLVGAKVINVQVPFLFKLAIDWLAALGGAEASLASFTETNATLLALFASPAAVLVGYGIARSGVSACTELRNAVFSKVTLRAIRSVSRMVFSHLHELDLRYHLSRQTGALNRIIDRGSRAINYILTVMVFNVVPTILEIGMVSSILAYKFGSTFAWITSVSVATYIAFTLAVTQWRTKFRTAMNKADNASSTVAVDSLLNYETVKYFNNEQFEVEKYDKYLRKYEDAALKTQSSLAYLNFGQNVIFSSALSTAMVLSSYGVMSGALTVGDLVMVNGLLFQLSLPLNFLGSVYRESRQSLIDMKSMFQLLEEKPGIKDEPHAQPLQFKGGCIEFENVHFGYVPERKILDGATFTVPAGQSVAIVGTSGSGKSTILRLLFRFFESTSGSIRIDGQDIRGVTLESLRKCLGVMPQDTVLFNDTIKHNIQYGRLSAKDEEVYDAARRAAIHDTIMNFPDKYDTVVGERGLKLSGGEKQRVSIARVFLKEPSILLCDEATSALDSTTEASILNSLKSLSVDRTSIFIAHRLTTAMQCDQIIVLENGKVIEQGPHDVLLSKGGRYAELWFQQNNSDAIDPAAVNLEV

SEQ ID NO: 30336 - DNA, 2530 bp, Panicum virgatum
  misc_feature: Ceres CLONE 1899731
  misc_feature: Encodes the peptide sequence at SEQ ID NO. 30337
agcgtgctcataaaccaaccccgccccgtcatcgcgggggtagcggcttggcctgtcgccgccgccgctgtccgacgccgcgttctcgaacgttccggtcgcctacaactatccggcatccaaggccggcgaggccgacgtggccgatcgaactcccccacatctggaagcgacccgacctggtttccccttccttccaccagctgattcacgcgctcgacgacgggagcgtctgtctaggaacaagatggaagagagcagaatagctcgaatttcagtcacctggaggggcagacagcttgatgtggatgcagatccaagctgcacggtgaaagaatttgggcaactgctgcaggatttgactagtgttaaacctgatacattgaagctaatcgtgccacagtctacaaacaaaggctccaagttgatcacaccattttcggatccacattcaagcctgacactgaatgaagcggctattagtgagggaaaacctattagaatgatgggtgtttttgatgatgaaatcgaggaagtatctgacaatggcaaaaggccagatctacgtataattggatttgacgaggaagaacagcggcataggcaacggtcaacaggcaggccacaaatttcactcaaacttccccagggacaatacatcttctgtgattttcgtacacttcacttgcctgggattgagctgaatcctccaccttcggaagccctgaaaaggatgcacatgcttgcatgtgaccctggtataattgcgatcatgaacaagcataaatggcgagttggaatcatgactgaaatggcccctgtcggatatgtaggagtcagtccgaaatgcattttaggcttcaataagaacatgggggaggaaatatctcttcgtctacgaacagatgacttgaagggattccggaagtatgaaagtatcaagaagactctacttcatgaacttgcgcatatggtgcactctgagcacgatgcaaacttttttgctcttaataagcagttaaatgaggaagctgcttcattggactggaccaagtctagaggtcatatgttgaatggtcgcaaagtctttgattcttatgaagatgaatttgttctggaaccaggtataactgtttccggtcacaggcttgggggagagttaagttcgctggctagtgctcgtgtgttgtccggggctgctgcttatcagtgtttcttaaatgcatctgcaaaggaggaccatgtatcaggcactgaaactgaatataatccagttggtgttcctcaagatttttttcagggaactgtgaaggtagagcctgatccagatgatgctatgcatattgattcagcaatgggttctagatcagtggcaggacaacatactattggctactctgagcctaatggtgttggcaagcaaagttcttttggttgcctagaacctgatcctgatgactctcaaaatgttaatattttgaatcaggagctgaggtttgatggaagacaccatagtgaacctgatcctgatgatggtactaatggattcgttctggaatctggaaacaagatggaagtggatagtgaactgacaaacagcaccacagttttgaagtctgagcctgaccctgatgattccttaaatactgttgtcaatcagaagttggtcattgatgggaagcatggtgaagaacctgatcctgatgatactacttgtctaattgttccaaaatctggagatgagacacaagtgataacagagcagagtagaaactccaaagttttgaagttggaacctgatcctgacgatcgttttagagatttaaacagcaatgagctgcaaaggatcgaagaacccgtggcagccctctgtgcacgactccagaagtccattgaaatgctccggttgcaagcaacacctacagaggcagagtctgctattcaaacactttttaagattatcaagaatgtgatagagcacccaaacgatattaagtataagagattgcgtaagtccaatccacatttccaaaggagtgtagcaaactataaagctgcaatggaggtccttgaattgatcggcttctgtgaggatgtcgtctcaaatgagattgggcgtgcagagacttacctggtgttgaaaaggaacgatcctggattgttatggctggcaaagtcctcacttgaagtatccctggcttgataaaagttgataccaatggttgttgttttctctgtggatatattgagcaagaaacttagctattggaatgtactgttttcctgtataggcataattgtatacgtgtatatgaacacccaagaatggagtgctgcgctcataactttcttttcttatctatgccttgtcttgactggcttgcaatcccatgcgatgtactgatgaaacctagccacatgtcagcaaggtaccaagaagacatacatgaagccttgaattgccagattattctgcagccaggccagtgtatatctgacgatggagcaattttcactgtgagcttcctac

SEQ ID NO: 30337 - protein, 651 aa, Panicum virgatum
  misc_feature: Ceres CLONE 1899731
  misc_feature (139)..(324): Pfam Name: WLM Pfam Description: WLM domain
MEESRIARISVTWRGRQLDVDADPSCTVKEFGQLLQDLTSVKPDTLKLIVPQSTNKGSKLITPFSDPHSSLTLNEAAISEGKPIRMMGVFDDEIEEVSDNGKRPDLRIIGFDEEEQRHRQRSTGRPQISLKLPQGQYIFCDFRTLHLPGIELNPPPSEALKRMHMLACDPGIIAIMNKHKWRVGIMTEMAPVGYVGVSPKCILGFNKNMGEEISLRLRTDDLKGFRKYESIKKTLLHELAHMVHSEHDANFFALNKQLNEEAASLDWTKSRGHMLNGRKVFDSYEDEFVLEPGITVSGHRLGGELSSLASARVLSGAAAYQCFLNASAKEDHVSGTETEYNPVGVPQDFFQGTVKVEPDPDDAMHIDSAMGSRSVAGQHTIGYSEPNGVGKQSSFGCLEPDPDDSQNVNILNQELRFDGRHHSEPDPDDGTNGFVLESGNKMEVDSELTNSTTVLKSEPDPDDSLNTVVNQKLVIDGKHGEEPDPDDTTCLIVPKSGDETQVITEQSRNSKVLKLEPDPDDRFRDLNSNELQRIEEPVAALCARLQKSIEMLRLQATPTEAESAIQTLFKIIKNVIEHPNDIKYKRLRKSNPHFQRSVANYKAAMEVLELIGFCEDVVSNEIGRAETYLVLKRNDPGLLWLAKSSLEVSLA

SEQ ID NO: 30338 - DNA, 657 bp, Panicum virgatum
  misc_feature: Ceres CLONE 1899733
  misc_feature: Encodes the peptide sequence at SEQ ID NO. 30339
agagctcgtcacctcttcctcctcagctccacgcctcgctcgcgcgcgcgccccggacgcaccaccaccagcagagatggccgccctcgccgcctcctccacggccgccttcgccgccaagccgcgcctgccccgcgcgcgcctctccgtggcctgctccgccaccggcggagagggagaagaggaagaagaaggggaacggggtggtgctgttcaacttcggcgactccaacagcgacacgggcggcgtggcggcggtgatggggatccgcatcgcgccgccggagggccgggcctacttccaccaccccacggggaggctctccgacggccgcgtcatcctcgacttcatctgcgagagcctgggcacgcaccatctgagcccgttcatgaagccgctggactccaacttcaccaacggcgtgaacttcgccatcgcagggtccacggccatgccaggggtcaccacattctcgctggacgtgcaggtcgaccagttcatcttcttcaaggagagatgccttgatgccatcgagagaggtgagagtgccccggttgatgagatggggttccaaactgctttatacaccatggacatcgggcacaatgatatcaatggcgttctccacatgccctatgatgaaatgcttgccaatc

SEQ ID NO: 30339 - protein, 218 aa, Panicum virgatum
  misc_feature: Ceres CLONE 1899733
  misc_feature (70)..(218): Pfam Name: Lipase_GDSL Pfam Description: GDSL-like Lipase/Acylhydrolase
  misc_feature: SWISSPROT Homolog: EC 3.2.1.51 Alpha-L-fucosidase
SSSPLPPQLHASLARAPRTHHHQQRWPPSPPPPRPPSPPSRACPARASPWPAPPPAEREKRKKKGNGVVLFNFGDSNSDTGGVAAVMGIRIAPPEGRAYFHHPTGRLSDGRVILDFICESLGTHHLSPFMKPLDSNFTNGVNFAIAGSTAMPGVTTFSLDVQVDQFIFFKERCLDAIERGESAPVDEMGFQTALYTMDIGHNDINGVLHMPYDEMLAN

SEQ ID NO: 30340 - DNA, 700 bp, Panicum virgatum
  misc_feature: Ceres CLONE 1899747
  misc_feature: Encodes the peptide sequence at SEQ ID NO. 30341
cgccgccgtgggtggtgctcgccatgggcgccgccatgaacctcgcggggtacctgatgatctacctcgccatcgacggccgtacggcgcggccccccgtgcggccccccgtgtggctcatgtgcatctacatctgcgtgggggccaactcgcagtccttcgccaacacgggggcgctcgtcacctgcgtcaagaacttcccggagagccgcggcatggtgctgggcctgctcaagggcttcgtcggcctcagcggcgccatcttcacgcagctctacctcgccatctacggcgacgacgccaagtcgctcgtgctgctcatcgcctggctccccgccgccatctccatcctcttcgtccacaccatccgcatcatgccgtacccccggcgcggccgcggcgcgggctcgccggcggcggcgaccagcaacgacgccttcttctgcttcctctacatctccatcgccctcgccacctacctcctcgtcatgatcgtcgtgcagaagcaggtcaacttctcgcacgccgcctacgcggtgtcggccgcggcgctgctcctcgtcctcttcctgacgctcgccgtcgtcgtcaagcaggagtacaagatccagaaggagctcgaggagtccctccgggagccccccacggtgaccgtcgagaatccagctgcctcgctgcagatggcatcggcagctgagcc

SEQ ID NO: 30341 - protein, 232 aa, Panicum virgatum
  misc_feature: Ceres CLONE 1899747
  misc_feature (1)..(196): Pfam Name: Nodulin-like Pfam Description: Nodulin-like
PPWVVLAMGAAMNLAGYLMIYLAIDGRTARPPVRPPVWLMCIYICVGANSQSFANTGALVTCVKNFPESRGMVLGLLKGFVGLSGAIFTQLYLAIYGDDAKSLVLLIAWLPAAISILFVHTIRIMPYPRRGRGAGSPAAATSNDAFFCFLYISIALATYLLVMIVVQKQVNFSHAAYAVSAAALLLVLFLTLAVVVKQEYKIQKELEESLREPPTVTVENPAASLQMASAAE

SEQ ID NO: 30342 - DNA, 748 bp, Panicum virgatum
  misc_feature: Ceres CLONE 1899748
  misc_feature: Encodes the peptide sequence at SEQ ID NO. 30343
acgcaagctctgctgcgctttcttctcttgcttttgacttgaggggtgccctgcggacgggagacgcgcacggagtgaagctaagctaggttgagggaacatagatgagctctcgggagagggaaatggcggggttcgatccgctcgaccccggagccgacccgcccgccagggcgctcacgggggaccaggtcaagcgctgcaagaaggcgctcaaggcgctcgagaagaagctcagggaacccaccgctctctcaaaggagttctacagcctcccggatataagagtgcttcagtcgagtactgttgctcggagacctgaaaatagggcaagaaatcgctatattgatgttttgccatttgatgaaaccagggtgcgattaaactcttcaacaggcaatgattacatcaatgccagccttatagagattgatggaagagatcgaacaaagttcatttctactcaaggaccactgaccaatatgtttgaagatttttggcagatggtatatgataatcgatgtcctgcgattgttatggtcaccaaatttgacagccttaagtgcgatgagtatcccccattgagcaagagccatgatatttttggaaaatttaccattgagatcacaaagatcagaaaagatggtcaattagtgttgcgtggtgtgaaggtgcaacgtgatgagtcagaagtagtgcactcactcctccatattgagtattctgagtggcctgaccatggggtgcc

SEQ ID NO: 30343 - protein, 207 aa, Panicum virgatum
  misc_feature: Ceres CLONE 1899748
  misc_feature (67)..(207): Pfam Name: Y_phosphatase Pfam Description: Protein-tyrosine phosphatase
  misc_feature: SWISSPROT Homolog: EC 3.1.3.48 Protein-tyrosine-phosphatase
MAGFDPLDPGADPPARALTGDQVKRCKKALKALEKKLREPTALSKEFYSLPDIRVLQSSTVARRPENRARNRYIDVLPFDETRVRLNSSTGNDYINASLIEIDGRDRTKFISTQGPLTNMFEDFWQMVYDNRCPAIVMVTKFDSLKCDEYPPLSKSHDIFGKFTIEITKIRKDGQLVLRGVKVQRDESEVVHSLLHIEYSEWPDHGV

SEQ ID NO: 30344 - DNA, 2123 bp, Panicum virgatum
  misc_feature: Ceres CLONE 1899752
  misc_feature: Encodes the peptide sequence at SEQ ID NO. 30345
agctcccgctctccccctttcaaatcaaatcccctcccccgggggcctctctctataaaccctagcccaggcgagggagcgcgcaccgcaactccacgatccgttacaccgcgtcgccgccgccgccgccgcctcatggcgacctctctgccgccgcagccgccgaggagcgtctcctgcggctcccttctccaggaactgcaggaattatggggagaaattggtcaggatgagatggaaagggataggatgatactgcagctggaggaggattgtctcaacgcatacaggaaaaaagtggatcaaactacgaggcagaaggctgacctgcttcaagctctgtccgttggtgaagctgatatagataaaatcctttctgctcttggagagcgtgaatcctttcccaggtcagagaagctcgggggcacattaatggaacaacttgcgaaagtagagccagtgctacgagatttgagacaaaagagggatgagcgagtgaaagagttcagggctgttctgttgcagatagttcatctgcaatcagaaatttcaggaaccattgatcatggggatcccactgctcctgtggtagatgagaatgatctatccttaaagagattaggggcattgaagttgcagctcaatgagcttcaggcagaaaagaatctcaggctggaaaagatcgacatacaggtcaactgtattaatgaaatgtgcagcataatgtctcttgatcttaagaaggcactgtatgatgttcatcccagttatgctgagttgggaagaagcaaacctgtgagtattagcaatagcacactcgagaggcttgcagggaaagttcaagcattaaatcatgaaaagaaacaaagacttaggaagctacaagatcttggcagcacactcattgagttatggaacctcatggacacaccagttgatgaacaaagatgttttgaccatgttacttctcttattaaagtttcacctaatacagcgatgcctgaaggatgcctggcacatgaccttattgagaaggtcgagattgaggttaagagactgacccatttgaaagccagcaaaatgaaagaactagtcttcaagaaattgactgaggttgaagaaatctatagaagtgttcatatggatattgatagtggctctgagcagcagatcctcaatgatctaattgattccggtagagcagatctctcggaattgttggcaggaatggatggtcgaattgcagaggcaaaagaacatgctctaagcagaaaagacataatagaaaaggtggagaagtggaaatcgacatatgaagagcagacttggcttgatgaatatgaaagggatcagaaccgctacaatgctggtcgaggagctcacataaatctcaagcgtgcggagaaagctagggtattggtcagcaaaattccatctcttctggagaatttgactgctaaaattaaagtgtgggagaaagagaagggtattccatttatgtttgataaggtgaggctgttggatagtttagaagagtacacctctacaagacagcgaaaagaagaggagaagcgtcaatcaagggaactgaagaagctgcaggaacagtttgcagcagagcaaggtgccaagtttggaataaagccaagccctatccgtcctcttcctgcaaggaaacctcttgggcagagctctaatgccaatattgttgttggaactccaacaagccgccgtgtttctccgccgatgtcatggaagggagggctgtcatctggaaaggtgaaggaagctgcgaagacaactgtggcatcagcaaactatgttgcaattccgaaggattgctcagacaattcttccctttgagcatagtcaccacctataagttggagctagtctaaccattgcttgatttctcattctgtggacctatataggttagcttcttgctaatgcctaaaagttgcttgaaccccaatgcctgatgcttactttcagactaagtttctattttccatagtataattctttctcctcctttgaacagttggaaattatggtactgttttgtcgcataattgttatgggtgcattcctgcctccttatagatatcctcaagttttgc

SEQ ID NO: 30345 - protein, 575 aa, Panicum virgatum
  misc_feature: Ceres CLONE 1899752
  misc_feature (35)..(574): Pfam Name: MAP65_ASE1 Pfam Description: Microtubule associated protein (MAP65/ASE1 family)
MATSLPPQPPRSVSCGSLLQELQELWGEIGQDEMERDRMILQLEEDCLNAYRKKVDQTTRQKADLLQALSVGEADIDKILSALGERESFPRSEKLGGTLMEQLAKVEPVLRDLRQKRDERVKEFRAVLLQIVHLQSEISGTIDHGDPTAPVVDENDLSLKRLGALKLQLNELQAEKNLRLEKIDIQVNCINEMCSIMSLDLKKALYDVHPSYAELGRSKPVSISNSTLERLAGKVQALNHEKKQRLRKLQDLGSTLIELWNLMDTPVDEQRCFDHVTSLIKVSPNTAMPEGCLAHDLIEKVEIEVKRLTHLKASKMKELVFKKLTEVEEIYRSVHMDIDSGSEQQILNDLIDSGRADLSELLAGMDGRIAEAKEHALSRKDIIEKVEKWKSTYEEQTWLDEYERDQNRYNAGRGAHINLKRAEKARVLVSKIPSLLENLTAKIKVWEKEKGIPFMFDKVRLLDSLEEYTSTRQRKEEEKRQSRELKKLQEQFAAEQGAKFGIKPSPIRPLPARKPLGQSSNANIVVGTPTSRRVSPPMSWKGGLSSGKVKEAAKTTVASANYVAIPKDCSDNSSL

SEQ ID NO: 30346 - DNA, 690 bp, Panicum virgatum
  misc_feature: Ceres CLONE 1899758
  misc_feature: Encodes the peptide sequence at SEQ ID NO. 30347
aagcgagcggctcaacaagctcaacccgaccaaatgccgctgctcctcacctcctcctcctcctccctgcgggcgctgccgccgccgttggccgccgcctcgcccagggcctgcgtcagggtcgcggcttccgcctccgccccggacggggtcggcgccactgcgagcgggttcccttcattcattccccgagcggtgcagcgcatccgcgacggcgccgccatccgcctcgccaagcgaatcgagcgggtgcccgtccagaccagtttctcggggagtccaattctgagcagctacgtgaggccgctcaagcagcagcaggacgccgacccgatcgtcctgctccatggcttcgacagttcttgtctagagtggagatacacctacccgttgcttgaggaggctggactggaggcatgggctgtggacatccttggttggggcttctctgatttagcaacacggccaccatgtgatgttgcgtccaagcgggagcatctttaccagttctggaaatcctacatcaaaaggcctatggtgttagtcgggcccagccttggtgctgctgttgccattgatttctcagtcaattatccggaagcggtttcaaaactgatcttcattggtgcaagtgtatactccgagggcccaaaagatatgactaggatgcctaaatttttttcatatgct

SEQ ID NO: 30347 - protein, 218 aa, Panicum virgatum
  misc_feature: Ceres CLONE 1899758
  misc_feature: SWISSPROT Homolog: EC 3.3.2.10 Soluble epoxide hydrolase
MPLLLTSSSSSLRALPPPLAAASPRACVRVAASASAPDGVGATASGFPSFIPRAVQRIRDGAAIRLAKRIERVPVQTSFSGSPILSSYVRPLKQQQDADPIVLLHGFDSSCLEWRYTYPLLEEAGLEAWAVDILGWGFSDLATRPPCDVASKREHLYQFWKSYIKRPMVLVGPSLGAAVAIDFSVNYPEAVSKLIFIGASVYSEGPKDMTRMPKFFSY

SEQ ID NO: 30348 - DNA, 730 bp, Panicum virgatum
  misc_feature: Ceres CLONE 1899787
  misc_feature: Encodes the peptide sequence at SEQ ID NO. 30349
cgacgacaggtggtggcgagcctgcgagggggaccagagatggcggcgaagaaggtgctcctgctctgcggcgactacatggaggactacgaggttatggtcccgttccaagcgctgcaagcgtatggggtctccgtggatgccgtctgccccggcaagaaggccggcgacgtctgccgcactgccgtccatcagggaatcggccaccagacatactctgagacgagaggacataatttcgcactaaatgcttcatttgatgagattactgccaatggatatgatggattggtaatccctggaggccgtgcaccagaataccttgcaatggatgaaaaggtgcttgacatagtcagaaagttctctgatgctaagaagcctattgcatcagtttgccatggacagttgattttggcagcagcaggagtagttcagaaacgtacctgcacagcatatccagctgttaaaccagttttggttgctgctggtgctaagtgggatgaacctgacaccatggcaaaatgcactgttgatggcaacctcatcactgcagcgacttacgattctcatcctgaattcatcagcctatttgtcaaagcacttggaggctctgtggcaggctcagacaagaaaatattgttcctctgtggggactacatggaggattatgaggttatggtgccattccagtctcttcaagctcttggctgccatgtcgatgctgtttgcc

SEQ ID NO: 30349 - protein, 230 aa, Panicum virgatum
  misc_feature: Ceres CLONE 1899787
  misc_feature (32)..(189): Pfam Name: DJ-1_PfpI Pfam Description: DJ-1/PfpI family
MAAKKVLLLCGDYMEDYEVMVPFQALQAYGVSVDAVCPGKKAGDVCRTAVHQGIGHQTYSETRGHNFALNASFDEITANGYDGLVIPGGRAPEYLAMDEKVLDIVRKFSDAKKPIASVCHGQLILAAAGVVQKRTCTAYPAVKPVLVAAGAKWDEPDTMAKCTVDGNLITAATYDSHPEFISLFVKALGGSVAGSDKKILFLCGDYMEDYEVMVPFQSLQALGCHVDAVC

SEQ ID NO: 30350 - DNA, 743 bp, Panicum virgatum
  misc_feature: Ceres CLONE 1899796
  misc_feature: Encodes the peptide sequence at SEQ ID NO. 30351
atcaaaaagcaacaagcacacatagtttcggagagacgtgtaagactcaacagtgtcgccacttgaagacgggcagggttttgagaggagagaggatggcacggcaaggcgcagcctccatgttcgctacggctttgctcctcgtggtctttgccaacatctcaccaagcgtggagtccgtcggggtgtcctacggcatgagcggcgacaacctgccgccggcgagcaccgtcgtcggcatgtacaaggccaacggcatcccgctgatgcggatctacgcgccggaccaggcggccctccaggcggtgggcggcacgggcatccgcgtcgtcgtcggcgcgcccaacgacgtgctgtccagcctcgccgccagccccgccgcggccgcctcctgggtccgcaacaacatcgaggcctacccggacgtcaccttccgctgcgtctgcgttggcaacgaggtggagggcggcgcggcgcaggacctggtcccggccatggagaacgtccgcgccgcgctcgccgccgccggcctggacggcatcaaggtcaccacgtcggtgtcgcaggccatcctgggcgggtacaagccgccctccgccgccgacttcaccgccgaggcccaggggttcatgggccccgtcctcgccttcctggcccgcaccggcgcgcccctcatggccagcgtctacccctacttcatctacgccaccaacccgtccgccatggacctcagctacgcgctc

SEQ ID NO: 30351 - protein, 215 aa, Panicum virgatum
  misc_feature: Ceres CLONE 1899796
  misc_feature (29)..(215): Pfam Name: Glyco_hydro_17 Pfam Description: Glycosyl hydrolases family 17
  misc_feature: SWISSPROT Homolog: EC 3.2.1.39 Glucan endo-1,3-beta-D-glucosidase
  misc_feature: Useful for making plants with altered carbohydrate content
MARQGAASMFATALLLVVFANISPSVESVGVSYGMSGDNLPPASTVVGMYKANGIPLMRIYAPDQAALQAVGGTGIRVVVGAPNDVLSSLAASPAAAASWVRNNIEAYPDVTFRCVCVGNEVEGGAAQDLVPAMENVRAALAAAGLDGIKVTTSVSQAILGGYKPPSAADFTAEAQGFMGPVLAFLARTGAPLMASVYPYFIYATNPSAMDLSYA

SEQ ID NO: 30352 - DNA, 579 bp, Panicum virgatum
  misc_feature: Ceres CLONE 1899804
  misc_feature: Encodes the peptide sequence at SEQ ID NO. 30353
aaaaataccgatagcaatccgcagccgcaaccagcctctccgccgcttgctctcctccccgtctcgtgaagctttcggcacgcacgtatggcggcggtggcgggcccgacgagggcagaggcgctgtccctcttccggtccctcctccgcacggcgaagcagttctccgactacaacatccgggagtacacgcgccgccgcgccgcggacgccttccgcgagaaccgcgccctccccgacgcggcggccgcggcggcggcgttcgcggaggggaagaagcagctcgaggtcgcgaagcggcaggcggtggtgtactcgctctacacccccaagtccaagagcgtgatggagttgaaggtgcagtgatggacgagggagagaggtgttgcgcccttttcttctcttcctcgtcgtccccccttttgcggatttgtgccttttatgtgatgatgatgcaactggaactgccctgttatcacgtttgctagatgactgtcattatacagctgctttctgtgcaataaattactaaattttactgccatgatctcatatatatgtttggcatgctattgtctg

SEQ ID NO: 30353 - protein, 92 aa, Panicum virgatum; identical to SEQ ID NO: 26644
  misc_feature: Ceres CLONE 1899804
  misc_feature (7)..(71): Pfam Name: Complex1_LYR Pfam Description: Complex 1 protein (LYR family)

SEQ ID NO: 30354 - DNA, 690 bp, Panicum virgatum
  misc_feature: Ceres CLONE 1899808
  misc_feature: Encodes the peptide sequence at SEQ ID NO. 30355
attcgaaaccattccgcactagaaaatccaaatcgctacgctccgaaaccctaaccttagtctaccctcccgccaaccacccgccccaatggcgaagccggtgaagtacgaggacgaggacgaggagatctcgtcctccgccgaggaggaggaggaccagtccgacgccgccggctccggatctggcgaggagggggacgaggacgaggaggacgccgcggcacctcccgcgggggaggaggaggagactgagggggaggggcagcaggagttggaggaggaggtcgatgaggaggagatcgaggccgtcactaccggcgccggcgccgaggaggaggaggacgccggcgctgcggcccctgcggaaggcgatgacgagtcccagtccaccgaggacgacgaggcggccccgggcgacaacggcgacgagactgatgcagtggtcgggaagcgtgagaaagcaaggctaaaggagctccagaaaaagaagaggcaaaaaatccaagaaatattggatactcaaaatgctgccattgatgctgacatgaacaataaagggaagggacgattgaaataccttcttcagcagacggaaatatttgctcactttgcaaaaggaagtcaatctaaagagaaaaaaccacgtgggcggggacgacatgcgtcgaagatgacggaagaagaggaaga

SEQ ID NO: 30355 - protein, 200 aa, Panicum virgatum
  misc_feature: Ceres CLONE 1899808
  misc_feature: The sequence is a functional homolog of SEQ ID NO 1582 in the 10/412,699 US patent application
  misc_feature: The sequence is a functional homolog of SEQ ID NO 1581 in the 10/412,699 US patent application
  misc_feature: The sequence is a functional homolog of SEQ ID NO 1044 in the 10/225,066 US patent application
  misc_feature: The sequence is a functional homolog of SEQ ID NO 1846 in the 10/412,699 US patent application
  misc_feature: The sequence is a functional homolog of SEQ ID NO 2554 in the 10/374,780 US patent application
  misc_feature: The sequence is a functional homolog of SEQ ID NO 790 in the 10/412,699 US patent application
MAKPVKYEDEDEEISSSAEEEEDQSDAAGSGSGEEGDEDEEDAAAPPAGEEEETEGEGQQELEEEVDEEEIEAVTTGAGAEEEEDAGAAAPAEGDDESQSTEDDEAAPGDNGDETDAVVGKREKARLKELQKKKRQKIQEILDTQNAAIDADMNNKGKGRLKYLLQQTEIFAHFAKGSQSKEKKPRGRGRHASKMTEEEE

SEQ ID NO: 30356 - DNA, 738 bp, Panicum virgatum
  misc_feature: Ceres CLONE 1899814
  misc_feature: Encodes the peptide sequence at SEQ ID NO. 30357
acgtcccacgatgaccaatctggcaacgaccgcggcggcgtggaccagggaggaggacaaggcgttcgagaacgcggtcgcggccaccgcggcgccgcccggggacggaccgcctgacgacggctggttcacggcgctcgccgcgagcgtgccggcgcggatggcggaggaggtgcggcggcactacgaggcgctgttggaggacgtggcctccatagaggccggccgcgtcccgctcccgcgctacgccggggaggagtccgccgccgcggcgcccgacagcgccgccggtgctgcgtccacgccgaaggacggcggcggcggaggggggcaccggcgcgaggagcggaagagcggcgtcgacgtggggaagagctgctccaaggcggagcaggagcggcgcaagggcatcccgtggacggaggaagagcacaggttattcttgctggggctggacaagttcggcaagggcgactggcggagcatctcgcgcaatttcgtcatgtcgcggacgccgacgcaggtggcgagccacgcgcagaagtacttcatccgcctcaactccatgaaccgcgaccggcgccgctcaagcattcacgacatcaccagcgtcaccgcgggcgaggtcgcggcggccggcgccccgatcacgggcggccccgccgccgcatgcgcgatgccgatggggccagcaggcatgaagcaccaccacccgccggggccgccgatgggcatgta

SEQ ID NO: 30357 - protein, 242 aa, Panicum virgatum
  misc_feature: Ceres CLONE 1899814
  misc_feature (133)..(180): Pfam Name: Myb_DNA-binding Pfam Description: Myb-like DNA-binding domain
  misc_feature: Useful for making plants with modulated nitrogen use efficiency
  misc_feature: The sequence is a functional homolog of SEQ ID NO 36 in the 10/286,264 US patent application
  misc_feature: The sequence is a functional homolog of SEQ ID NO 864 in the 10/412,699 US patent application
  misc_feature: The sequence is a functional homolog of SEQ ID NO 120 in the 11/375,241 US patent application
  misc_feature: The sequence is a functional homolog of SEQ ID NO 2680 in the 10/374,780 US patent application
  misc_feature: The sequence is a functional homolog of SEQ ID NO 654 in the 10/225,066 US patent application
MTNLATTAAAWTREEDKAFENAVAATAAPPGDGPPDDGWFTALAASVPARMAEEVRRHYEALLEDVASIEAGRVPLPRYAGEESAAAAPDSAAGAASTPKDGGGGGGHRREERKSGVDVGKSCSKAEQERRKGIPWTEEEHRLFLLGLDKFGKGDWRSISRNFVMSRTPTQVASHAQKYFIRLNSMNRDRRRSSIHDITSVTAGEVAAAGAPITGGPAAACAMPMGPAGMKHHHPPGPPMGM

SEQ ID NO: 30358 - DNA, 737 bp, Panicum virgatum
  misc_feature: Ceres CLONE 1899815
  misc_feature: Encodes the peptide sequence at SEQ ID NO. 30359
gtctttccttctatttccttcgattcgcgttcgaatctgccgccccgaggttccaaaccctagcttcgtcccatcgtccgcgaaccctacctagatccgaaatccaccaccagtcatcccctcatccccgatcctaacccttctctttgcagtcgatcctaccccggcccgttcgtttctcttttcctccgtccccgagatctcgaggcagcatggtggaggcgaaggacaacgaggtgtacgaggaggatctcgtcgactacgaggaggaggtggagaatgtcgccgacggcgccccaaccaacggctccgccgatgtcgtcaaaaaggggtacgtggggatccacagctcggggttcagagacttcctgctcaagccggagcttctccgggccatccaggattgcggatttgagcatccttccgaagtgcaacatgaatgcatccctcaagccattcttggaatggatgttatctgtcaagcaaaatctgggatgggtaagactgcggtttttgtcctctcaactcttcagcagattgatcctgttgctggtcaagtaactgcacttgtgttgtgccacacaagagagctagcttaccagatttgccatgaatttgagagatttagcaaatacctgcctgaattaagagttgctgtcttctatggtggtggtcacataaaaaatcataaggatctgttgaagaatgaatggccccatattgtggttggcacgcct

SEQ ID NO: 30359 - protein, 174 aa, Panicum virgatum
  misc_feature: Ceres CLONE 1899815
  misc_feature (71)..(171): Pfam Name: DEAD Pfam Description: DEAD/DEAH box helicase
  misc_feature: Useful for biocontainment applications
  misc_feature: Useful for making plants with modulated biomass
  misc_feature: Useful for making plants with modulated cold sensitivity
MVEAKDNEVYEEDLVDYEEEVENVADGAPTNGSADVVKKGYVGIHSSGFRDFLLKPELLRAIQDCGFEHPSEVQHECIPQAILGMDVICQAKSGMGKTAVFVLSTLQQIDPVAGQVTALVLCHTRELAYQICHEFERFSKYLPELRVAVFYGGGHIKNHKDLLKNEWPHIVVGT

SEQ ID NO: 30360 - DNA, 725 bp, Panicum virgatum
  misc_feature: Ceres CLONE 1899838
  misc_feature: Encodes the peptide sequence at SEQ ID NO. 30361
ctctctcttcccagtccgctcggccaccagctttgaccgcctcctccgctcccctccgctcctgctcctcccatcccactcccccgcaggagcggcggcggcggcggcggctaggcgtaccccccacctcggcgagcggcaccggcggcggcaaaggcaagatgttcgggcgcgcgccgaagaagagcgacaacaccaagtactacgagatcctcagggtgcccaagtccgcgtcccaggacgacctcaagaaggcctaccgcaaggccgccatcaagaaccaccccgacaagggcggcgaccccgagaagttcaaggagcttgcacaagcttatgaggttttgagtgacccagagaagcgtgagatttatgatcagtatggtgaagatgccctcaaggaaggaatgggtggaggaggagcccatgtagatccatttgacatcttctcatcattctttgggccctctttcggaggaggtggtggcagcagcagaggcagaaggcaaaggaggggagaagatgttgtgcacccacttaaagtttctctagaggatctttacaatggtacctcaaagaagctctcgctttcgcgtagtgtcatctgctcgaagtgcaagggcaagggctccaagtctggtgcttcaatgaggtgcccaggttgccagggttcaggtatgaaggtcaccatccgccagctgggtccttccatgatacagcagatgcag

SEQ ID NO: 30361 - protein, 187 aa, Panicum virgatum
  misc_feature: Ceres CLONE 1899838
  misc_feature (13)..(71): Pfam Name: DnaJ Pfam Description: DnaJ domain
  misc_feature (135)..(187): Pfam Name: DnaJ_CXXCXGXG Pfam Description: DnaJ central domain (4 repeats)
MFGRAPKKSDNTKYYEILRVPKSASQDDLKKAYRKAAIKNHPDKGGDPEKFKELAQAYEVLSDPEKREIYDQYGEDALKEGMGGGGAHVDPFDIFSSFFGPSFGGGGGSSRGRRQRRGEDVVHPLKVSLEDLYNGTSKKLSLSRSVICSKCKGKGSKSGASMRCPGCQGSGMKVTIRQLGPSMIQQM

SEQ ID NO: 30362 - DNA, 709 bp, Panicum virgatum
  misc_feature: Ceres CLONE 1899851
  misc_feature: Encodes the peptide sequence at SEQ ID NO. 30363
gcgtcagttcttgctcatcaccccccccccccccctcccccaagccatcagcgactaattggaaggcccactcagagcagagagagagagagagagagagagagagagagagaggagccttacttcttcctcctccccggccgccggcggcgagagatcgacgagcgagcgagatggtgctgtcccacggcgtcggcggcggctccgatgagtcggtgcactcgacgttcgcgtcccgctacgtccgcgcctccctccccaggttccggatgccggagcagtcgatcccgaaggaggcggcgtaccagatcatcaacgacgagctgatgctggacgggaacccgcggctgaacctggcgtccttcgtcaccacgtggatggagcccgagtgcgacaagctcatccaggcctccctcaacaagaactacgtcgacatggacgagtaccccgtcaccaccgagctccagaatcggtgcgtgaacatgatcgcccatctgttcaacgcccctctcggcgattctgaaactgccgtcggggtcggcaccgtcggctcgtccgaggccatcatgctcgccgggctggcgttcaagaggcgttggcagaacaagatgagggccgccggcaagccctgcgacaagcctaacatcgtcaccggcgccaacgtccaagtctgctgggagaagttcgcgcgttttttcgaggtggagct

SEQ ID NO: 30363 - protein, 178 aa, Panicum virgatum
  misc_feature: Ceres CLONE 1899851
  misc_feature (34)..(178): Pfam Name: Pyridoxal_deC Pfam Description: Pyridoxal-dependent decarboxylase conserved domain
  misc_feature: SWISSPROT Homolog: EC 4.1.1.15 Glutamate decarboxylase
  misc_feature: Useful for making plants with modulated nitrogen use efficiency
MVLSHGVGGGSDESVHSTFASRYVRASLPRFRMPEQSIPKEAAYQIINDELMLDGNPRLNLASFVTTWMEPECDKLIQASLNKNYVDMDEYPVTTELQNRCVNMIAHLFNAPLGDSETAVGVGTVGSSEAIMLAGLAFKRRWQNKMRAAGKPCDKPNIVTGANVQVCWEKFARFFEVE

SEQ ID NO: 30364 - DNA, 705 bp, Panicum virgatum
  misc_feature: Ceres CLONE 1899854
  misc_feature: Encodes the peptide sequence at SEQ ID NO. 30365
attatatgggtgtcgtctgatttgttgcttgttcttcctcttggctgtggtcgcagggttggaggctcgggaggaccggagaagtagattgtgttctcgccatggagcagcagaagggaggagcggtttctgcgccggcggccgccgccgccaacgggaccggggagctgatcgggtacgtcgacgtgcacgtgcggagcgcgcgggacatccagaacatctgcatctaccacaagcaggacgtgtacgcgcgggtgtctctgccgggggacggcgcgccggtggcgtccacgcaggtggttaacggcggcggccgcaacccggtgttcgaccagtcgctgcgcctcggcgtgcgcgcgggggacgtcgacgccgcgctccgctgcgaggtctggatgctcagccggatcaagaactacctggaggaccagctgctggggttcgcgctcgtgccgctcccggaggtcatcgccgccgacggcggcacgctcgcccgggagttcccgctcaccaccagcgacctcttccagacgccctcggggttcctccagctcgagctgtcctacatcggggtcgtgccggaggtcgtgcccatctctccgacgcccaagccggcgctggccgacccggaggaggtgccggggactaacgccggcgccaccgctgggagcgggaacgagtacgggaagatcgagttccccgacc

SEQ ID NO: 30365 - protein, 201 aa, Panicum virgatum
  misc_feature: Ceres CLONE 1899854
  misc_feature (27)..(116): Pfam Name: C2 Pfam Description: C2 domain
MEQQKGGAVSAPAAAAANGTGELIGYVDVHVRSARDIQNICIYHKQDVYARVSLPGDGAPVASTQVVNGGGRNPVFDQSLRLGVRAGDVDAALRCEVWMLSRIKNYLEDQLLGFALVPLPEVIAADGGTLAREFPLTTSDLFQTPSGFLQLELSYIGVVPEVVPISPTPKPALADPEEVPGTNAGATAGSGNEYGKIEFPD

SEQ ID NO: 30366 - DNA, 653 bp, Panicum virgatum
  misc_feature: Ceres CLONE 1899862
  misc_feature: Encodes the peptide sequence at SEQ ID NO. 30367
  misc_feature (79)..(79): n is a, c, t, g, unknown, or other
tcggaccacgcgacgcgaccaccccgaggggcgggcgggagagagagagatgagcggggcggaggaggctgcggcgggnggaggagggtccggcgggggcagcagcggcgcggggtcgtcggggggcgggagcgggggcggggccgcgcggcggatgttcgacgacaagggcctcgtcgcgcgcacctcgctcatcctctggcacacgcaccagaacgacgtcggcgccgtgcgcaagctgctcgaggaggacgccgcgctcgtcaacgcccgcgactacgacagccgcacgccgctccacgtcgccgcgctccatggctggcacgacgtcgccgagtgcctcatcgccaacggcgccgacgtcaacgcgcaggaccgctggcagaacacgccactagctggtactcgtgctgggagatcccatctctctcctcctctcccatcctccgctcgcctagggtttcgcgccctcgtcacccggcgaggcccagcccggcgtagggcggtcgtctgcatcgccggccagagagatggctggcgggtttcgagtactgcatcttgtcaggccctttctggctttcttgccagaagttcagagtgctgataggaaaataccattcagagagaacgtgatctaccccgtcatttctctc

SEQ ID NO: 30367 - protein, 184 aa, Panicum virgatum
  misc_feature: Ceres CLONE 1899862
  misc_feature (78)..(110): Pfam Name: Ank Pfam Description: Ankyrin repeat
  misc_feature: SWISSPROT Homolog: EC 2.7.11.1 Non-specific serine/threonine protein kinase
MSGAEEAAAGGGGSGGGSSGAGSSGGGSGGGAARRMFDDKGLVARTSLILWHTHQNDVGAVRKLLEEDAALVNARDYDSRTPLHVAALHGWHDVAECLIANGADVNAQDRWQNTPLAGTRAGRSHLSPPLPSSARLGFRALVTRRGPARRRAVVCIAGQRDGWRVSSTASCQALSGFLARSSEC

SEQ ID NO: 30368 - DNA, 747 bp, Panicum virgatum
  misc_feature: Ceres CLONE 1899867
  misc_feature: Encodes the peptide sequence at SEQ ID NO. 30369
gaagcgacgacgcggaaagccaagagaagccgcccgccgctgttggattgttccgttcttcgattcccccgcggaggaccggagtcttctctcctcggggatcgtcggcgccctcttatccgcgccctctactggtgctggactgccgtggggtggagatcggcttgaatcaactcttcttgtagtctgttggtgctgcgaaaatgagtgacaacttgatggacaaggttagcgcctttggcgagcgcctcaagatcactgggacggaggtcagcaagaagatgacggccggcatgagctccatgagcttcaagatgaaggaattgttccaggggcagactccggccgacaagatcgttgaggatgccacttcggagaacctggatgggcctgactggaacttgaacttggagatttgcgacctgatcaacactgagaaggttaacagtgtggagctcatccgtggcatcaagaagcagatcatgctgaaggatgcgaggatccagtacctctccttaatcctgctcgagactattgtgaagaactgcgagaaggccttctcggaggttgcggctgagcgggttcttgacgagatggttaggctgattgatgaccctcagacagttgtcaataacaggaacaaggcccttatgctgattgaagcgtggggggagtctggtgatgagctacgctacctgccagtctatgaggaaacctacaagagcttgaaatcaagaggagtgcggt

SEQ ID NO: 30369 - protein, 181 aa, Panicum virgatum
  misc_feature: Ceres CLONE 1899867
  misc_feature (42)..(179): Pfam Name: VHS Pfam Description: VHS domain
MSDNLMDKVSAFGERLKITGTEVSKKMTAGMSSMSFKMKELFQGQTPADKIVEDATSENLDGPDWNLNLEICDLINTEKVNSVELIRGIKKQIMLKDARIQYLSLILLETIVKNCEKAFSEVAAERVLDEMVRLIDDPQTVVNNRNKALMLIEAWGESGDELRYLPVYEETYKSLKSRGVR

SEQ ID NO: 30370 - DNA, 502 bp, Panicum virgatum
  misc_feature: Ceres CLONE 1899879
  misc_feature: Encodes the peptide sequence at SEQ ID NO. 30371
ccgtgctctctcagaggtgggttggcttctccccctcttaccaagtcctcggttctagggttttagttggaaggggagatggcggcggcggatgtggagtaccgctgcttcgtcggcggcctcgcctgggccaccgacaacgcgtccctccagcaggccttcgcctcctacggcgacgtcctcgactccaaggtcatcaccgaccgtgagacggggaggtcccgcgggttcggcttcgtcaccttctcaaccgagcagtcgatgctcgacgccatcgaagccatgaacggcaaggagctcgacggccgcaacatcaccgtcaaccaggcccaatcccgcggcggtggcggcggcggcggcggcggcggttactgcggcggtcgccatggaagctacagcggcggcggctgcggctcccgcggcagtcgacgtgagggcggtttcagtggcggctgctacgacggggggtgcgtcggatccggttcccctctccgtctcggca

SEQ ID NO: 30371 - protein, 141 aa, Panicum virgatum
  misc_feature: Ceres CLONE 1899879
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with altered alkaloid content
  misc_feature: Useful for making plants with modulated flowering time
  misc_feature: Useful for making plants with altered lignin content
  misc_feature: Useful for making plants with modulated nitrogen use efficiency
  misc_feature: Useful for making plants with modulated biomass
  misc_feature: The sequence is a functional homolog of SEQ ID NO 1042 in the 10/374,780 US patent application
  misc_feature: The sequence is a functional homolog of SEQ ID NO 852 in the 10/666,642 US patent application
MAAADVEYRCFVGGLAWATDNASLQQAFASYGDVLDSKVITDRETGRSRGFGFVTFSTEQSMLDAIEAMNGKELDGRNITVNQAQSRGGGGGGGGGGYCGGRHGSYSGGGCGSRGSRREGGFSGGCYDGGCVGSGSPLRLG

SEQ ID NO: 30372 - DNA, 696 bp, Panicum virgatum
  misc_feature: Ceres CLONE 1899886
  misc_feature: Encodes the peptide sequence at SEQ ID NO. 30373
cataggtgtaatcaagttctggaacttggatttccgttaggaggattagccaaattattcgctcaagattgggaaggtgatgtcacagtcgttatgccagccactcttgcacagtattccaagatgatacagaacccatcttatgctgagcttcagaaggctgcaaaccaaggtaggagatgcacttgggaaaagttatcagccatcagggcgaattgtgctattgaacttgcattggatgaatgtgttgccctcctgaaccacttgcgtaggctaaagaggagtgcggaaagagcatctgcctcacaaggacatggtcgtacaatcaggctctgcccatcgaggaggattccatcatggaatctcatagcaagagagaattcaactggttctcttgaagaagaaattcttacatctcctactcgtacaaatcatcaaggacctggaggagttgctgcattatctaacagaaaccagtatctccagagaattgcacatgacagcagtgatagtgaatcggagagtatagatctacactcttggacaagaagtggtgggcctcttatgaggacagcctcagccaacaagttcatcagctttgttcagaatcttgagattgacacagaattcagagcaattccatcgagggaagacgaatctgatcttgtgacaccaaatgctagtagcttggcagct

SEQ ID NO: 30373 - protein, 231 aa, Panicum virgatum
  misc_feature: Ceres CLONE 1899886
  misc_feature: SWISSPROT Homolog: EC 3.1.1.3 Triacylglycerol lipase
HRCNQVLELGFPLGGLAKLFAQDWEGDVTVVMPATLAQYSKMIQNPSYAELQKAANQGRRCTWEKLSAIRANCAIELALDECVALLNHLRRLKRSAERASASQGHGRTIRLCPSRRIPSWNLIARENSTGSLEEEILTSPTRTNHQGPGGVAALSNRNQYLQRIAHDSSDSESESIDLHSWTRSGGPLMRTASANKFISFVQNLEIDTEFRAIPSREDESDLVTPNASSLA

SEQ ID NO: 30374 - DNA, 774 bp, Panicum virgatum
  misc_feature: Ceres CLONE 1899887
  misc_feature: Encodes the peptide sequence at SEQ ID NO. 30375
ctccgcctgtccctctcgctacctcccagttccaagaacccgtgaagtgaagtggaagaggtgggcggaactccggcgagatgatcgcccgcggcctcctcagatccagtgccgccacctcgcagtttagcaggctggtgaaatatgtagctagtgctggaagcttgcaaggaacacacaattttgcagagcctgccagatactacagctctgaaccatcacttcaggaaacagaggaaaatggatttaagggtcatagcatgctggctccattcacagctgggtggcagagctccgatttgcatccgcttgttatagatagatctgagggctcttacgtttatgacatcaatgggaagaagtatatagatgctcttgcaggactgtggtgtacagctttaggtggtaatgagcctcgattaatcaaagctgcaactgagcaactaaacaaattacccttctaccattccttttggaaccgtacaaccaaaccctcattggatcttgcaaatgaaattctcagcatgttcactgcaaggaaaatgggcaaggtattcttcacaaatagtggttcagaagcaaatgactcccaggttaaactagtatggtattataacaatgcactaggaaggccaaacaagaagaaatttattgctcggtcaaaatcatatcatggatcaacattaatagcagctagtctatcgggtttgcctgcacttcatcagaggtttgatctaccagcaccttttggtctgcacacagactgccctcact

SEQ ID NO: 30375 - protein, 231 aa, Panicum virgatum
  misc_feature: Ceres CLONE 1899887
  misc_feature (78)..(231): Pfam Name: Aminotran_3 Pfam Description: Aminotransferase class-III
  misc_feature: SWISSPROT Homolog: EC 2.6.1.62 Adenosylmethionine--8-amino-7-oxononanoate transaminase
MIARGLLRSSAATSQFSRLVKYVASAGSLQGTHNFAEPARYYSSEPSLQETEENGFKGHSMLAPFTAGWQSSDLHPLVIDRSEGSYVYDINGKKYIDALAGLWCTALGGNEPRLIKAATEQLNKLPFYHSFWNRTTKPSLDLANEILSMFTARKMGKVFFTNSGSEANDSQVKLVWYYNNALGRPNKKKFIARSKSYHGSTLIAASLSGLPALHQRFDLPAPFGLHTDCPH

SEQ ID NO: 30376 - DNA, 760 bp, Panicum virgatum
  misc_feature: Ceres CLONE 1899908
  misc_feature: Encodes the peptide sequence at SEQ ID NO. 30377
cacacgctcccctcggctcgccgctgcggttgccgggcacctgtcactccggccctccttttttctttcgatgcagctgcttgttggttagccggcccgtcgtctaccacctggccctgctgccccggccaggccgcgaccgcgattggacgccggccggcccagccggcctcgcgtgcgcgcgccgcgcgcggcggccttttaaacggcacctcgccctgagctcacgggctgctgcttgcctgtgctctcggcggcggcagaacatatatatatctaggtggcgcgcggccggtggggtagatggggcggcagccgtgctgcgacaagctggggatgaagcgggggccgtggacggcggaggaggaccggaagctcatcagcttcatcctgagcaacggccattgctgctggcgcgcggtgccgaagctagccggcctgctgcgctgcggcaagagctgccgcctgcgctggaccaactacctccgcccggacctcaagcgcggcctcctcaccgacgccgaggagcaggtcgttatcgacctccacgccaagctcggcaacagatggtcaaagattgctgccaagctaccgggaaggactgacaacgagatcaagaaccactggaacacccacatcaagaagaagctgatcaagatgggcatcgacccggtcacgcacgagaccctcgacccgaagaccagcagcccggccacaacctcgcagtccgtcgtcacggccgattcaccaaagtccgacg

SEQ ID NO: 30377 - protein, 152 aa, Panicum virgatum
  misc_feature: Ceres CLONE 1899908
  misc_feature (14)..(61): Pfam Name: Myb_DNA-binding Pfam Description: Myb-like DNA-binding domain
  misc_feature (67)..(112): Pfam Name: Myb_DNA-binding Pfam Description: Myb-like DNA-binding domain
  misc_feature: Useful for making plants with altered carbohydrate content
  misc_feature: Useful for making plants with altered alkaloid content
  misc_feature: Useful for making plants with modulated nitrogen use efficiency
  misc_feature: The sequence is a functional homolog of SEQ ID NO 1094 in the 10/225,066 US patent application
  misc_feature: The sequence is a functional homolog of SEQ ID NO 386 in the 10/374,780 US patent application
  misc_feature: Useful for making plants with altered cell wall content and/or composition
  misc_feature: The sequence is a functional homolog of SEQ ID NO 442 in the 10/412,699 US patent application
  misc_feature: The sequence is a functional homolog of SEQ ID NO 1118 in the 10/225,066 US patent application
  misc_feature: The sequence is a functional homolog of SEQ ID NO 1396 in the 11/479,226 US patent application
  misc_feature: The sequence is a functional homolog of SEQ ID NO 2488 in the 10/374,780 US patent application
  misc_feature: The sequence is a functional homolog of SEQ ID NO 658 in the 10/412,699 US patent application
  misc_feature: The sequence is a functional homolog of SEQ ID NO 836 in the 10/412,699 US patent application
  misc_feature: The sequence is a functional homolog of SEQ ID NO 1040 in the 10/225,066 US patent application
  misc_feature: The sequence is a functional homolog of SEQ ID NO 2864 in the 10/374,780 US patent application
  misc_feature: The sequence is a functional homolog of SEQ ID NO 296 in the 11/479,226 US patent application
  misc_feature: The sequence is a functional homolog of SEQ ID NO 824 in the 10/412,699 US patent application
  misc_feature: The sequence is a functional homolog of SEQ ID NO 2564 in the 10/374,780 US patent application
  misc_feature: The sequence is a functional homolog of SEQ ID NO 276 in the 10/225,066 US patent application
  misc_feature: The sequence is a functional homolog of SEQ ID NO 818 in the 10/412,699 US patent application
  misc_feature: The sequence is a functional homolog of SEQ ID NO 1052 in the 11/479,226 US patent application
  misc_feature: The sequence is a functional homolog of SEQ ID NO 456 in the 10/412,699 US patent application
  misc_feature: The sequence is a functional homolog of SEQ ID NO 1072 in the 10/374,780 US patent application
  misc_feature: The sequence is a functional homolog of SEQ ID NO 996 in the 11/435,388 US patent application
  misc_feature: The sequence is a functional homolog of SEQ ID NO 2572 in the 10/374,780 US patent application
  misc_feature: The sequence is a functional homolog of SEQ ID NO 636 in the 10/225,066 US patent application
  misc_feature: The sequence is a functional homolog of SEQ ID NO 838 in the 10/412,699 US patent application
  misc_feature: Useful for making plants with altered lignin content
  misc_feature: The sequence is a functional homolog of SEQ ID NO 134 in the 10/412,699 US patent application
  misc_feature: The sequence is a functional homolog of SEQ ID NO 321 in the 11/479,226 US patent application
  misc_feature: The sequence is a functional homolog of SEQ ID NO 2221 in the 10/666,642 US patent application
  misc_feature: The sequence is a functional homolog of SEQ ID NO 998 in the 11/435,388 US patent application
  misc_feature: The sequence is a functional homolog of SEQ ID NO 1000 in the 11/435,388 US patent application
  misc_feature: The sequence is a functional homolog of SEQ ID NO 2223 in the 10/666,642 US patent application
  misc_feature: The sequence is a functional homolog of SEQ ID NO 1064 in the 10/374,780 US patent application
  misc_feature: The sequence is a functional homolog of SEQ ID NO 1306 in the 10/412,699 US patent application
  misc_feature: The sequence is a functional homolog of SEQ ID NO 990 in the 11/435,388 US patent application
  misc_feature: The sequence is a functional homolog of SEQ ID NO 1068 in the 10/374,780 US patent application
  misc_feature: The sequence is a functional homolog of SEQ ID NO 984 in the 11/435,388 US patent application
  misc_feature: The sequence is a functional homolog of SEQ ID NO 1684 in the 11/479,226 US patent application
  misc_feature: The sequence is a functional homolog of SEQ ID NO 2582 in the 10/374,780 US patent application
  misc_feature: The sequence is a functional homolog of SEQ ID NO 30 in the 11/375,241 US patent application
  misc_feature: The sequence is a functional homolog of SEQ ID NO 854 in the 10/412,699 US patent application
  misc_feature: The sequence is a functional homolog of SEQ ID NO 1011 in the 11/479,226 US patent application
  misc_feature: The sequence is a functional homolog of SEQ ID NO 434 in the 10/412,699 US patent application
  misc_feature: The sequence is a functional homolog of SEQ ID NO 1004 in the 11/435,388 US patent application
  misc_feature: The sequence is a functional homolog of SEQ ID NO 1002 in the 11/435,388 US patent application
  misc_feature: The sequence is a functional homolog of SEQ ID NO 1006 in the 11/435,388 US patent application
  misc_feature: The sequence is a functional homolog of SEQ ID NO 1008 in the 11/435,388 US patent application
  misc_feature: The sequence is a functional homolog of SEQ ID NO 569 in the 10/374,780 US patent application
  misc_feature: The sequence is a functional homolog of SEQ ID NO 1069 in the 10/374,780 US patent application
  misc_feature: The sequence is a functional homolog of SEQ ID NO 988 in the 11/435,388 US patent application
  misc_feature: The sequence is a functional homolog of SEQ ID NO 1067 in the 10/374,780 US patent application
  misc_feature: The sequence is a functional homolog of SEQ ID NO 1309 in the 10/412,699 US patent application
  misc_feature: The sequence is a functional homolog of SEQ ID NO 1071 in the 10/374,780 US patent application
  misc_feature: The sequence is a functional homolog of SEQ ID NO 994 in the 11/435,388 US patent application
  misc_feature: The sequence is a functional homolog of SEQ ID NO 110 in the 10/412,699 US patent application
  misc_feature: The sequence is a functional homolog of SEQ ID NO 259 in the 11/479,226 US patent application
  misc_feature: The sequence is a functional homolog of SEQ ID NO 156 in the 10/412,699 US patent application
  misc_feature: The sequence is a functional homolog of SEQ ID NO 164 in the 10/412,699 US patent application
  misc_feature: The sequence is a functional homolog of SEQ ID NO 1754 in the 10/412,699 US patent application
  misc_feature: The sequence is a functional homolog of SEQ ID NO 1978 in the 10/374,780 US patent application
  misc_feature: The sequence is a functional homolog of SEQ ID NO 353 in the 11/479,226 US patent application
  misc_feature: The sequence is a functional homolog of SEQ ID NO 369 in the 11/479,226 US patent application
  misc_feature: The sequence is a functional homolog of SEQ ID NO 40 in the 10/374,780 US patent application
  misc_feature: The sequence is a functional homolog of SEQ ID NO 776 in the 10/225,066 US patent application
  misc_feature: The sequence is a functional homolog of SEQ ID NO 1070 in the 10/374,780 US patent application
  misc_feature: The sequence is a functional homolog of SEQ ID NO 992 in the 11/435,388 US patent application
  misc_feature: The sequence is a functional homolog of SEQ ID NO 1065 in the 10/374,780 US patent application
  misc_feature: The sequence is a functional homolog of SEQ ID NO 1307 in the 10/412,699 US patent application
  misc_feature: The sequence is a functional homolog of SEQ ID NO 986 in the 11/435,388 US patent application
  misc_feature: The sequence is a functional homolog of SEQ ID NO 108 in the 10/412,699 US patent application
  misc_feature: The sequence is a functional homolog of SEQ ID NO 1740 in the 10/412,699 US patent application
  misc_feature: The sequence is a functional homolog of SEQ ID NO 1964 in the 10/374,780 US patent application
  misc_feature: The sequence is a functional homolog of SEQ ID NO 255 in the 11/479,226 US patent application
  misc_feature: The sequence is a functional homolog of SEQ ID NO 908 in the 11/435,388 US patent application
  misc_feature: The sequence is a functional homolog of SEQ ID NO 1010 in the 11/435,388 US patent application
  misc_feature: The sequence is a functional homolog of SEQ ID NO 122 in the 10/412,699 US patent application
  misc_feature: The sequence is a functional homolog of SEQ ID NO 126 in the 11/375,241 US patent application
  misc_feature: The sequence is a functional homolog of SEQ ID NO 148 in the 10/286,264 US patent application
  misc_feature: The sequence is a functional homolog of SEQ ID NO 34 in the 10/374,780 US patent application
  misc_feature: The sequence is a functional homolog of SEQ ID NO 438 in the 10/225,066 US patent application
  misc_feature: The sequence is a functional homolog of SEQ ID NO 1073 in the 10/374,780 US patent application
  misc_feature: The sequence is a functional homolog of SEQ ID NO 58 in the 10/666,642 US patent application
  misc_feature: The sequence is a functional homolog of SEQ ID NO 116 in the 10/412,699 US patent application
  misc_feature: The sequence is a functional homolog of SEQ ID NO 280 in the 11/479,226 US patent application
  misc_feature: The sequence is a functional homolog of SEQ ID NO 1066 in the 10/374,780 US patent application
  misc_feature: The sequence is a functional homolog of SEQ ID NO 1308 in the 10/412,699 US patent application
  misc_feature: The sequence is a functional homolog of SEQ ID NO 1660 in the 11/479,226 US patent application
  misc_feature: The sequence is a functional homolog of SEQ ID NO 840 in the 10/412,699 US patent application
  misc_feature: The sequence is a functional homolog of SEQ ID NO 136 in the 10/412,699 US patent application
  misc_feature: The sequence is a functional homolog of SEQ ID NO 325 in the 11/479,226 US patent application
  misc_feature: The sequence is a functional homolog of SEQ ID NO 271 in the 11/479,226 US patent application
  misc_feature: The sequence is a functional homolog of SEQ ID NO 112 in the 10/412,699 US patent application
  misc_feature: The sequence is a functional homolog of SEQ ID NO 267 in the 11/479,226 US patent application
  misc_feature: The sequence is a functional homolog of SEQ ID NO 1041 in the 11/479,226 US patent application
  misc_feature: The sequence is a functional homolog of SEQ ID NO 112 in the 10/225,066 US patent application
  misc_feature: The sequence is a functional homolog of SEQ ID NO 20 in the 11/375,241 US patent application
  misc_feature: The sequence is a functional homolog of SEQ ID NO 2052 in the 10/374,780 US patent application
  misc_feature: The sequence is a functional homolog of SEQ ID NO 450 in the 10/412,699 US patent application
  misc_feature: The sequence is a functional homolog of SEQ ID NO 822 in the 10/412,699 US patent application
  misc_feature: Useful for biocontainment applications
  misc_feature: The sequence is a functional homolog of SEQ ID NO 1411 in the 11/479,226 US patent application
  misc_feature: The sequence is a functional homolog of SEQ ID NO 2492 in the 10/374,780 US patent application
  misc_feature: The sequence is a functional homolog of SEQ ID NO 52 in the 10/225,066 US patent application
  misc_feature: The sequence is a functional homolog of SEQ ID NO 18 in the 11/375,241 US patent application
  misc_feature: The sequence is a functional homolog of SEQ ID NO 426 in the 10/374,780 US patent application
  misc_feature: The sequence is a functional homolog of SEQ ID NO 458 in the 10/225,066 US patent application
  misc_feature: The sequence is a functional homolog of SEQ ID NO 2394 in the 10/374,780 US patent application
  misc_feature: The sequence is a functional homolog of SEQ ID NO 544 in the 10/225,066 US patent application
  misc_feature: The sequence is a functional homolog of SEQ ID NO 999 in the 11/479,226 US patent application
  misc_feature: The sequence is a functional homolog of SEQ ID NO 188 in the 10/412,699 US patent application
  misc_feature: The sequence is a functional homolog of SEQ ID NO 2274 in the 10/374,780 US patent application
  misc_feature: The sequence is a functional homolog of SEQ ID NO 704 in the 10/225,066 US patent application
  misc_feature: The sequence is a functional homolog of SEQ ID NO 168 in the 10/412,699 US patent application
  misc_feature: The sequence is a functional homolog of SEQ ID NO 377 in the 11/479,226 US patent application
  misc_feature: The sequence is a functional homolog of SEQ ID NO 593 in the 10/374,780 US patent application
  misc_feature: The sequence is a functional homolog of SEQ ID NO 782 in the 11/435,388 US patent application
  misc_feature: The sequence is a functional homolog of SEQ ID NO 1901 in the 11/479,226 US patent application
  misc_feature: The sequence is a functional homolog of SEQ ID NO 310 in the 10/374,780 US patent application
  misc_feature: The sequence is a functional homolog of SEQ ID NO 842 in the 10/225,066 US patent application
  misc_feature: The sequence is a functional homolog of SEQ ID NO 1680 in the 11/479,226 US patent application
  misc_feature: The sequence is a functional homolog of SEQ ID NO 202 in the 10/666,642 US patent application
  misc_feature: The sequence is a functional homolog of SEQ ID NO 852 in the 10/412,699 US patent application
  misc_feature: The sequence is a functional homolog of SEQ ID NO 148 in the 10/412,699 US patent application
  misc_feature: The sequence is a functional homolog of SEQ ID NO 2266 in the 10/374,780 US patent application
  misc_feature: The sequence is a functional homolog of SEQ ID NO 341 in the 11/479,226 US patent application
  misc_feature: The sequence is a functional homolog of SEQ ID NO 58 in the 11/375,241 US patent application
  misc_feature: The sequence is a functional homolog of SEQ ID NO 1074 in the 10/412,699 US patent application
  misc_feature: The sequence is a functional homolog of SEQ ID NO 590 in the 10/374,780 US patent application
  misc_feature: The sequence is a functional homolog of SEQ ID NO 726 in the 11/435,388 US patent application
  misc_feature: The sequence is a functional homolog of SEQ ID NO 1031 in the 11/479,226 US patent application
  misc_feature: The sequence is a functional homolog of SEQ ID NO 1804 in the 10/412,699 US patent application
  misc_feature: The sequence is a functional homolog of SEQ ID NO 2050 in the 10/374,780 US patent application
  misc_feature: The sequence is a functional homolog of SEQ ID NO 444 in the 10/412,699 US patent application
  misc_feature: The sequence is a functional homolog of SEQ ID NO 598 in the 10/225,066 US patent application
  misc_feature: The sequence is a functional homolog of SEQ ID NO 620 in the 11/435,388 US patent application
  misc_feature: Useful for making plants with modulated low light sensitivity
  misc_feature: The sequence is a functional homolog of SEQ ID NO 794 in the 11/435,388 US patent application
  misc_feature: The sequence is a functional homolog of SEQ ID NO 263 in the 11/479,226 US patent application
  misc_feature: The sequence is a functional homolog of SEQ ID NO 478 in the 11/435,388 US patent application
  misc_feature: The sequence is a functional homolog of SEQ ID NO 54 in the 10/666,642 US patent application
  misc_feature: The sequence is a functional homolog of SEQ ID NO 112 in the 11/375,241 US patent application
  misc_feature: The sequence is a functional homolog of SEQ ID NO 2398 in the 10/374,780 US patent application
  misc_feature: The sequence is a functional homolog of SEQ ID NO 466 in the 10/412,699 US patent application
  misc_feature: The sequence is a functional homolog of SEQ ID NO 580 in the 10/225,066 US patent application
  misc_feature: Useful for making plants with altered terpenoid content
  misc_feature: Useful for making plants with modulated biomass
  misc_feature: The sequence is a functional homolog of SEQ ID NO 594 in the 10/374,780 US patent application
  misc_feature: The sequence is a functional homolog of SEQ ID NO 784 in the 11/435,388 US patent application
  misc_feature: The sequence is a functional homolog of SEQ ID NO 430 in the 10/412,699 US patent application
  misc_feature: The sequence is a functional homolog of SEQ ID NO 995 in the 11/479,226 US patent application
  misc_feature: The sequence is a functional homolog of SEQ ID NO 184 in the 10/412,699 US patent application
  misc_feature: The sequence is a functional homolog of SEQ ID NO 397 in the 11/479,226 US patent application
  misc_feature: The sequence is a functional homolog of SEQ ID NO 46 in the 10/374,780 US patent application
  misc_feature: The sequence is a functional homolog of SEQ ID NO 590 in the 11/435,388 US patent application
  misc_feature: The sequence is a functional homolog of SEQ ID NO 6 in the 10/225,068 US patent application
  misc_feature: The sequence is a functional homolog of SEQ ID NO 788 in the 11/435,388 US patent application
  misc_feature: The sequence is a functional homolog of SEQ ID NO 796 in the 11/435,388 US patent application
  misc_feature: The sequence is a functional homolog of SEQ ID NO 792 in the 11/435,388 US patent application
  misc_feature: The sequence is a functional homolog of SEQ ID NO 1033 in the 10/412,699 US patent application
  misc_feature: The sequence is a functional homolog of SEQ ID NO 540 in the 10/374,780 US patent application
  misc_feature: The sequence is a functional homolog of SEQ ID NO 428 in the 10/374,780 US patent application
  misc_feature: The sequence is a functional homolog of SEQ ID NO 54 in the 11/375,241 US patent application
  misc_feature: The sequence is a functional homolog of SEQ ID NO 870 in the 10/225,066 US patent application
  misc_feature: The sequence is a functional homolog of SEQ ID NO 592 in the 10/374,780 US patent application
  misc_feature: The sequence is a functional homolog of SEQ ID NO 786 in the 11/435,388 US patent application
  misc_feature: The sequence is a functional homolog of SEQ ID NO 1072 in the 10/412,699 US patent application
  misc_feature: The sequence is a functional homolog of SEQ ID NO 1073 in the 10/412,699 US patent application
  misc_feature: The sequence is a functional homolog of SEQ ID NO 588 in the 10/374,780 US patent application
  misc_feature: The sequence is a functional homolog of SEQ ID NO 589 in the 10/374,780 US patent application
  misc_feature: The sequence is a functional homolog of SEQ ID NO 730 in the 11/435,388 US patent application
  misc_feature: The sequence is a functional homolog of SEQ ID NO 790 in the 11/435,388 US patent application
  misc_feature: The sequence is a functional homolog of SEQ ID NO 1917 in the 10/374,780 US patent application
  misc_feature: The sequence is a functional homolog of SEQ ID NO 743 in the 10/666,642 US patent application
  misc_feature: The sequence is a functional homolog of SEQ ID NO 2574 in the 10/374,780 US patent application
  misc_feature: The sequence is a functional homolog of SEQ ID NO 278 in the 10/225,066 US patent application
  misc_feature: The sequence is a functional homolog of SEQ ID NO 1071 in the 10/412,699 US patent application
  misc_feature: The sequence is a functional homolog of SEQ ID NO 587 in the 10/374,780 US patent application
  misc_feature: The sequence is a functional homolog of SEQ ID NO 728 in the 11/435,388 US patent application
  misc_feature: The sequence is a functional homolog of SEQ ID NO 1681 in the 10/374,780 US patent application
  misc_feature: The sequence is a functional homolog of SEQ ID NO 1656 in the 11/479,226 US patent application
  misc_feature: The sequence is a functional homolog of SEQ ID NO 834 in the 10/412,699 US patent application
  misc_feature: The sequence is a functional homolog of SEQ ID NO 1100 in the 10/225,066 US patent application
  misc_feature: The sequence is a functional homolog of SEQ ID NO 158 in the 10/412,699 US patent application
  misc_feature: The sequence is a functional homolog of SEQ ID NO 2268 in the 10/374,780 US patent application
  misc_feature: The sequence is a functional homolog of SEQ ID NO 357 in the 11/479,226 US patent application
  misc_feature: The sequence is a functional homolog of SEQ ID NO 480 in the 11/435,388 US patent application
  misc_feature: The sequence is a functional homolog of SEQ ID NO 116 in the 11/375,241 US patent application
  misc_feature: The sequence is a functional homolog of SEQ ID NO 1648 in the 11/479,226 US patent application
  misc_feature: The sequence is a functional homolog of SEQ ID NO 2566 in the 10/374,780 US patent application
  misc_feature: The sequence is a functional homolog of SEQ ID NO 632 in the 10/225,066 US patent application
  misc_feature: The sequence is a functional homolog of SEQ ID NO 650 in the 11/435,388 US patent application
  misc_feature: The sequence is a functional homolog of SEQ ID NO 826 in the 10/412,699 US patent application
  misc_feature: The sequence is a functional homolog of SEQ ID NO 2570 in the 10/374,780 US patent application
  misc_feature: The sequence is a functional homolog of SEQ ID NO 634 in the 10/225,066 US patent application
  misc_feature: The sequence is a functional homolog of SEQ ID NO 832 in the 10/412,699 US patent application
  misc_feature: The sequence is a functional homolog of SEQ ID NO 2556 in the 10/374,780 US patent application
  misc_feature: The sequence is a functional homolog of SEQ ID NO 272 in the 10/225,066 US patent application
  misc_feature: The sequence is a functional homolog of SEQ ID NO 528 in the 11/435,388 US patent application
  misc_feature: The sequence is a functional homolog of SEQ ID NO 126 in the 10/412,699 US patent application
  misc_feature: The sequence is a functional homolog of SEQ ID NO 186 in the 10/412,699 US patent application
  misc_feature: The sequence is a functional homolog of SEQ ID NO 178 in the 10/412,699 US patent application
  misc_feature: The sequence is a functional homolog of SEQ ID NO 389 in the 11/479,226 US patent application
  misc_feature: The sequence is a functional homolog of SEQ ID NO 160 in the 10/412,699 US patent application
  misc_feature: The sequence is a functional homolog of SEQ ID NO 214 in the 10/225,068 US patent application
  misc_feature: The sequence is a functional homolog of SEQ ID NO 2270 in the 10/374,780 US patent application
  misc_feature: The sequence is a functional homolog of SEQ ID NO 361 in the 11/479,226 US patent application
  misc_feature: The sequence is a functional homolog of SEQ ID NO 462 in the 10/225,066 US patent application
  misc_feature: The sequence is a functional homolog of SEQ ID NO 482 in the 11/435,388 US patent application
  misc_feature: The sequence is a functional homolog of SEQ ID NO 504 in the 10/666,642 US patent application
  misc_feature: The sequence is a functional homolog of SEQ ID NO 896 in the 11/435,388 US patent application
  misc_feature: The sequence is a functional homolog of SEQ ID NO 2178 in the 10/374,780 US patent application
  misc_feature: The sequence is a functional homolog of SEQ ID NO 2696 in the 10/374,780 US patent application
  misc_feature: The sequence is a functional homolog of SEQ ID NO 344 in the 10/225,066 US patent application
  misc_feature: The sequence is a functional homolog of SEQ ID NO 1672 in the 11/479,226 US patent application
  misc_feature: The sequence is a functional homolog of SEQ ID NO 846 in the 10/412,699 US patent application
  misc_feature: The sequence is a functional homolog of SEQ ID NO 176 in the 10/412,699 US patent application
  misc_feature: The sequence is a functional homolog of SEQ ID NO 385 in the 11/479,226 US patent application
  misc_feature: The sequence is a functional homolog of SEQ ID NO 200 in the 10/666,642 US patent application
  misc_feature: The sequence is a functional homolog of SEQ ID NO 830 in the 10/412,699 US patent application
  misc_feature: Useful for making plants with modulated flowering time
  misc_feature: The sequence is a functional homolog of SEQ ID NO 446 in the 10/412,699 US patent application
  misc_feature: The sequence is a functional homolog of SEQ ID NO 1564 in the 10/374,780 US patent application
  misc_feature: The sequence is a functional homolog of SEQ ID NO 196 in the 10/225,066 US patent application
  misc_feature: The sequence is a functional homolog of SEQ ID NO 2900 in the 10/374,780 US patent application
  misc_feature: The sequence is a functional homolog of SEQ ID NO 1566 in the 10/374,780 US patent application
  misc_feature: The sequence is a functional homolog of SEQ ID NO 1563 in the 10/374,780 US patent application
  misc_feature: Useful for making plants with modulated drought sensitivity
  misc_feature: The sequence is a functional homolog of SEQ ID NO 156 in the 10/225,068 US patent application
  misc_feature: The sequence is a functional homolog of SEQ ID NO 262 in the 10/374,780 US patent application
  misc_feature: The sequence is a functional homolog of SEQ ID NO 282 in the 10/225,066 US patent application
  misc_feature: The sequence is a functional homolog of SEQ ID NO 1565 in the 10/374,780 US patent application
  misc_feature: The sequence is a functional homolog of SEQ ID NO 1075 in the 10/412,699 US patent application
  misc_feature: The sequence is a functional homolog of SEQ ID NO 591 in the 10/374,780 US patent application
  misc_feature: The sequence is a functional homolog of SEQ ID NO 1916 in the 10/412,699 US patent application
  misc_feature: The sequence is a functional homolog of SEQ ID NO 2176 in the 10/374,780 US patent application
MGRQPCCDKLGMKRGPWTAEEDRKLISFILSNGHCCWRAVPKLAGLLRCGKSCRLRWTNYLRPDLKRGLLTDAEEQVVIDLHAKLGNRWSKIAAKLPGRTDNEIKNHWNTHIKKKLIKMGIDPVTHETLDPKTSSPATTSQSVVTADSPKSD

SEQ ID NO: 30378 - DNA, 708 bp, Panicum virgatum
  misc_feature: Ceres CLONE 1899931
  misc_feature: Encodes the peptide sequence at SEQ ID NO. 30379
gtcttacctagccacacagaaggtgtctctctttcttggtgtctcctcctacgctgcaacttcttctgcccctgttccagaccagccatcacaattgggcatggctaggaagtgctccagttgtggaaacaatggccacaactccagaacttgcagtggccacagaggccatgggagcagcattagtaccagcagtaacagcagtgctagtactagctgtggtggcttgaggctgtttggggtgcagctgcaggtagcatcccctcctctgaagaagtgcctcagcatggagtgcctatcaccagctgcctactatggagctgctgctacctccagcttgtcgccttctgtatcatcatcttcgtcttcgcttgtgtcaatagaggagagcgcggagagggtctccagtgggtacacgtcggatggccttatgggcaggattcaggagaggaagaaaggagttccatggaccgaggaagagcaccggatgttccttgccggcctcgagaagctcgggaagggcgactggcgaggcatttcccggcacttcgtcacaacacggaccccaacacaggtggccagccatgcccagaagtacttcctgaggcagaacagcttcacacagaagaagaggaggtccagcctctttgatgcggttgaaggtgccaagaaggtagcaatgccgaggaccgcatcagtatccgagct

SEQ ID NO: 30379 - protein, 202 aa, Panicum virgatum
  misc_feature: Ceres CLONE 1899931
  misc_feature (120)..(167): Pfam Name: Myb_DNA-binding Pfam Description: Myb-like DNA-binding domain
  misc_feature: The sequence is a functional homolog of SEQ ID NO 1072 in the 10/225,066 US patent application
  misc_feature: The sequence is a functional homolog of SEQ ID NO 130 in the 10/412,699 US patent application
  misc_feature: The sequence is a functional homolog of SEQ ID NO 2258 in the 10/374,780 US patent application
  misc_feature: The sequence is a functional homolog of SEQ ID NO 306 in the 11/479,226 US patent application
  misc_feature: The sequence is a functional homolog of SEQ ID NO 1045 in the 11/479,226 US patent application
  misc_feature: The sequence is a functional homolog of SEQ ID NO 452 in the 10/412,699 US patent application
MARKCSSCGNNGHNSRTCSGHRGHGSSISTSSNSSASTSCGGLRLFGVQLQVASPPLKKCLSMECLSPAAYYGAAATSSLSPSVSSSSSSLVSIEESAERVSSGYTSDGLMGRIQERKKGVPWTEEEHRMFLAGLEKLGKGDWRGISRHFVTTRTPTQVASHAQKYFLRQNSFTQKKRRSSLFDAVEGAKKVAMPRTASVSE

SEQ ID NO: 30380 - DNA, 774 bp, Panicum virgatum
  misc_feature: Ceres CLONE 1899937
  misc_feature: Encodes the peptide sequence at SEQ ID NO. 30381
aaaacgcaagagacgagcaccatccgctgatctcttcagtacagtagtagcagcaggctacccacgcttccgatccgccgctccctcgccgtccggagatggcttccgccgccttggccgtcgcctcgccggcggcctccgccgtcgccgcccggtccaaggtgcttggagggggaaagaatcaggggagaaatggctgccgcgtggggatcacgaggaagagctttggccatgttatgatggcccttgcagtggatgtttctcgttttgagggagtgccaatggctcctccagacccaattcttggggtttcagaggcctttaaagcagataaaaatgacctgaagctcaatcttggtgttggtgcctatagaacagaagagttgcagccctatgtcctcaatgtagtcaagaaggctgaaaatcttatgttggagaaaggagaaaacaaagagtatcttcctattgaaggcttagcagcatttaacaaagcaactgcagagctactgcttggagctgacaaccccgtcatcaagcaaggactggttgctacacttcaatctctctcaggcactggatcgctacgacttgctgcagcatttatacaaagatacttccctgaagccaaagtacttatatcatcacccacgtgggggaaccacaagaacatcttcaatgatgctagggtaccttggtcagagtaccggtactatgaccccaagactgtttgggttagatttcgaggggatgatagctgacattggaggctggctc

SEQ ID NO: 30381 - protein, 219 aa, Panicum virgatum
  misc_feature: Ceres CLONE 1899937
  misc_feature: SWISSPROT Homolog: EC 2.6.1.1 Aspartate transaminase
  misc_feature: Useful for making plants with modulated nitrogen use efficiency
MASAALAVASPAASAVAARSKVLGGGKNQGRNGCRVGITRKSFGHVMMALAVDVSRFEGVPMAPPDPILGVSEAFKADKNDLKLNLGVGAYRTEELQPYVLNVVKKAENLMLEKGENKEYLPIEGLAAFNKATAELLLGADNPVIKQGLVATLQSLSGTGSLRLAAAFIQRYFPEAKVLISSPTWGNHKNIFNDARVPWSEYRYYDPKTVWVRFRGDDS

SEQ ID NO: 30382 - DNA, 513 bp, Panicum virgatum
  misc_feature: Ceres CLONE 1899940
  misc_feature: Encodes the peptide sequence at SEQ ID NO. 30383
atctatcgatcagatccatcgcaaacaccaagcaagcgtcgtagccagccaagccgcctctcgcctcgagaaaaccagcgagcctaaacctcgcgcaatggccgccgccggtaatggcatcgtggtggtgttcgacttcaacaagaccatcatcgacgtcgacagcgacaactgggtggtggacagcctgggcctcacggaggagttcgagcgccttctccccaccatgccgtggaacaccctcatggacaccatgatgggggagctccacgcgcgcggggcgaccctggccgacgtcgccgcggggctgcgcgcggcgcccatcgacccgcgcgtgccggccgccttccgcgcggacgcctcgctcgtgtgcgacctgcgcgtcctcaacgactccaacgccttcttcttcgagaccgtcctcgagctcctcggccttcgcggctgcttcatggaagtcgacaccagaccccagccacgtgccacgccggctgccccctccgcatctagccc

SEQ ID NO: 30383 - protein, 138 aa, Panicum virgatum
  misc_feature: Ceres CLONE 1899940
  misc_feature (8)..(138): Pfam Name: Put_Phosphatase Pfam Description: Putative Phosphatase
  misc_feature: SWISSPROT Homolog: EC 3.1.3.74 Pyridoxal phosphatase
MAAAGNGIVVVFDFNKTIIDVDSDNWVVDSLGLTEEFERLLPTMPWNTLMDTMMGELHARGATLADVAAGLRAAPIDPRVPAAFRADASLVCDLRVLNDSNAFFFETVLELLGLRGCFMEVDTRPQPRATPAAPSASS

SEQ ID NO: 30384 - DNA, 705 bp, Panicum virgatum
  misc_feature: Ceres CLONE 1899955
  misc_feature: Encodes the peptide sequence at SEQ ID NO. 30385
gcgcgcgagactcctgcggcctcgtgggggaactggggattgggtccgggtcgatttcggcgtgattgatcgattggcccgttcgttcgtgctgggtgcaggccgcgggtggtggggtggcctccggttcggcgccggccgaacaaggtcaagttcgtcaaggtggctgtggccggcgcgccgtaccagcgcaaggtggacctcgaggcgtacgcgggctaccaccagctgctcgccgcgctccaggacaagttcaccgcccacttcaccgtccgccggggggcgaacgaggagatggagctcgtcgacgtcgtgagcggcgtcgagtacgtgccgacttacgaggacaaggacggcgactggatgctcgtcggagacgtcccctggagaatgtttgtggaaacctgccaacgtcttcgtctgatgaaaagctccgaggtggtaaacttggcaccaagagctggcgaatgacagtatgaggcacacccacactcgttttctacggactgcttgctgaggttggtcttgtaagagtgacagagagaaacgtgtacagccatcgacttctactttgggttttggttccagcatgagctgagaaaagtttgtagcctgtagcatcaccaattattggtgcctacatacatatagacgagcaagatgtttatgcttttgaaatacatctatagttttgtcatatgacga

SEQ ID NO: 30385 - protein, 58 aa, Panicum virgatum
  misc_feature: Ceres CLONE 1899955
  misc_feature: The sequence is a functional homolog of SEQ ID NO 738 in the 10/374,780 US patent application
  misc_feature: The sequence is a functional homolog of SEQ ID NO 736 in the 10/374,780 US patent application
  misc_feature: The sequence is a functional homolog of SEQ ID NO 2006 in the 10/374,780 US patent application
  misc_feature: The sequence is a functional homolog of SEQ ID NO 288 in the 10/412,699 US patent application
  misc_feature: The sequence is a functional homolog of SEQ ID NO 664 in the 11/479,226 US patent application
  misc_feature: The sequence is a functional homolog of SEQ ID NO 2002 in the 10/374,780 US patent application
  misc_feature: The sequence is a functional homolog of SEQ ID NO 644 in the 11/479,226 US patent application
  misc_feature: The sequence is a functional homolog of SEQ ID NO 2004 in the 10/374,780 US patent application
  misc_feature: The sequence is a functional homolog of SEQ ID NO 660 in the 11/479,226 US patent application
  misc_feature: Useful for making plants with modulated nitrogen use efficiency
  misc_feature: Useful for making plants with altered alkaloid content
  misc_feature: Useful for making plants with altered terpenoid content
  misc_feature: The sequence is a functional homolog of SEQ ID NO 739 in the 10/374,780 US patent application
  misc_feature: The sequence is a functional homolog of SEQ ID NO 890 in the 10/412,699 US patent application
  misc_feature: The sequence is a functional homolog of SEQ ID NO 636 in the 11/479,226 US patent application
  misc_feature: The sequence is a functional homolog of SEQ ID NO 648 in the 11/479,226 US patent application
  misc_feature: The sequence is a functional homolog of SEQ ID NO 204 in the 10/225,066 US patent application
  misc_feature: The sequence is a functional homolog of SEQ ID NO 292 in the 10/412,699 US patent application
  misc_feature: The sequence is a functional homolog of SEQ ID NO 40 in the 10/225,068 US patent application
  misc_feature: The sequence is a functional homolog of SEQ ID NO 82 in the 10/374,780 US patent application
  misc_feature: The sequence is a functional homolog of SEQ ID NO 1780 in the 10/412,699 US patent application
  misc_feature: The sequence is a functional homolog of SEQ ID NO 2008 in the 10/374,780 US patent application
  misc_feature: The sequence is a functional homolog of SEQ ID NO 678 in the 11/479,226 US patent application
  misc_feature: The sequence is a functional homolog of SEQ ID NO 290 in the 10/412,699 US patent application
  misc_feature: The sequence is a functional homolog of SEQ ID NO 674 in the 11/479,226 US patent application
  misc_feature: The sequence is a functional homolog of SEQ ID NO 598 in the 10/666,642 US patent application
  misc_feature: The sequence is a functional homolog of SEQ ID NO 904 in the 11/435,388 US patent application
  misc_feature: The sequence is a functional homolog of SEQ ID NO 667 in the 11/479,226 US patent application
  misc_feature: The sequence is a functional homolog of SEQ ID NO 686 in the 11/479,226 US patent application
  misc_feature: The sequence is a functional homolog of SEQ ID NO 1757 in the 11/479,226 US patent application
  misc_feature: Useful for making plants with altered lignin content
  misc_feature: The sequence is a functional homolog of SEQ ID NO 574 in the 10/666,642 US patent application
  misc_feature: The sequence is a functional homolog of SEQ ID NO 982 in the 11/435,388 US patent application
MELVDVVSGVEYVPTYEDKDGDWMLVGDVPWRMFVETCQRLRLMKSSEVVNLAPRAGE

SEQ ID NO: 30386 - DNA, 760 bp, Panicum virgatum
  misc_feature: Ceres CLONE 1899960
  misc_feature: Encodes the peptide sequence at SEQ ID NO. 30387
aaaatcaaacaagcctagccggcagaacaaatctcccccaaatcctgtaccatggcgatcggcggcggctccggcagcggcggcggcgggagctggagcatccacggccgtgccgacgttacctcccgctacgaggtcctcggccgcgcgggctctggcgcctacgccgacgtctaccgcggccgccgccgctccgacggcgccactgttgcgctcaaggaggtccacgacgccgtcagcgcccgccgcgaggctgaggccctcctcgccgtaggcccttctccgcacgtcgtcgcgctcctcgaccactttcccggcggcgactgcgacgacgacgtcctcgtcctcgagtggctgccgctcgacctcgccgccgtcgtgcgcgacgccaggaggcgcgctgccggcggagggggcggcatcgccggcgctcagctaaagcggtggatgcttcaggtgctcgagggcgtcgcggcgtgccaccgcgccggcgtcgtgcaccgcgacctcaagcccgcaaacctgcttatctccgaggacggaatgctcaaggtagctgactttggtcaggccaggatacttcagcagacagcttctacataccaagatatgcacccacatgatcataactcaggcatggaaccttgggtttcacaacaaccagcagtgctaaaagggacagatgaggaatctccatattatgaatcattggttcctgctacccaagggccagagaccctaactgcagctgactacctgc

SEQ ID NO: 30387 - protein, 236 aa, Panicum virgatum
  misc_feature: Ceres CLONE 1899960
  misc_feature (27)..(236): Pfam Name: Pkinase Pfam Description: Protein kinase domain
  misc_feature: SWISSPROT Homolog: EC 2.7.11.23 [RNA-polymerase]-subunit kinase
MAIGGGSGSGGGGSWSIHGRADVTSRYEVLGRAGSGAYADVYRGRRRSDGATVALKEVHDAVSARREAEALLAVGPSPHVVALLDHFPGGDCDDDVLVLEWLPLDLAAVVRDARRRAAGGGGGIAGAQLKRWMLQVLEGVAACHRAGVVHRDLKPANLLISEDGMLKVADFGQARILQQTASTYQDMHPHDHNSGMEPWVSQQPAVLKGTDEESPYYESLVPATQGPETLTAADYL

SEQ ID NO: 30388 - DNA, 716 bp, Panicum virgatum
  misc_feature: Ceres CLONE 1899961-R
  misc_feature: Encodes the peptide sequence at SEQ ID NO. 30389
tgaccgctccgtcatcaagggcatgctcgccgacggcatcgacgggcccatgctcatctaccccatgctcaagagccagtgggaccccaacacgtcggtggcgctgccggagggcgagatcttctacctggtggcgctgctgcgcttctgccgcgccggcgggccggcggtggacgagctggtggcgcagaacggcgccatcctccgcgcgtgccgcgccaacgggtacgaccacaaggcctacttccccagctaccgcggcgaggccgagtgggcgcgccatttcggcgccgccaggtggaggcgcttcgtggagcgcaaggcccgctacgacccgctggcgatcctcgcgccgggccagaagatcttccccagggccccggcgacctccgtcgccgtgcagctgtagcggggatcgggggaggaccagcgatcgatcgcccccggggtaatgatggtgattgcgccgccgctgatcctggtgatgatgggcgatcgaggagggaagggctaccgcgggggccgtggcgatcgatcgagcagggcaatgatggcgatcgggccaccgttaggtgcgtccggccgatcttggggggtggctggctgcctgccgcccaaagggattggcgtgcgtgcgtgcgtgcgtgtgttgtgctccgtggagatctgcatgaattttccatggaggaaacggaaaaaaacaagtatgaaggcgc

SEQ ID NO: 30389 - protein, 135 aa, Panicum virgatum
  misc_feature: Ceres CLONE 1899961-R
  misc_feature (1)..(123): Pfam Name: Cytokin-bind Pfam Description: Cytokinin dehydrogenase 1, FAD and cytokinin binding
  misc_feature: SWISSPROT Homolog: EC 1.5.99.12 Cytokinin dehydrogenase
DRSVIKGMLADGIDGPMLIYPMLKSQWDPNTSVALPEGEIFYLVALLRFCRAGGPAVDELVAQNGAILRACRANGYDHKAYFPSYRGEAEWARHFGAARWRRFVERKARYDPLAILAPGQKIFPRAPATSVAVQL

SEQ ID NO: 30390 - DNA, 498 bp, Panicum virgatum
  misc_feature: Ceres CLONE 1899961
agcgccagcgagcagaggagagcgccgcggtgacatcacaaacccaggcagcagcttgtagttgtagctcagctagctagctgctctgcccgcctcagcgtcagctcgctcggctgcacctggacatcagcagcagcagccgcaaggccacgctccctcgcgcaaggcaggcaggatgatgctcgcgtacatggaccgcgcggcggcggcggccgagccggaggacgccggggaggcggcgggcgtggcggccgggtgcgcggcggcggcgacggacttcggcgggctggcgagcgccatgactgctgatttggacagcccctcgagagagcaggacagggtgaacaccttccagacaacatcgatgaccgtggggctcagtcgaggccacgactgaagaatagtaaagacgagcctgaggaagcaacacctaagtatcggctaggcctggacctgaacaggcatgcgagcttccgccgccacaataagtgaattgcg

SEQ ID NO: 30391 - DNA, 730 bp, Panicum virgatum
  misc_feature: Ceres CLONE 1899965
  misc_feature: Encodes the peptide sequence at SEQ ID NO. 30392
aaccatactcaagcagctcaaaaccgccagccagctaccaagaaatggctcttcttgcttctgccctgacgagtcacagtgcacatcctggcctaagaagccccataggacccaatggtggcaatttgtcatggcacctgtcttcatcaaagaagagtaaaagaaggtgtgaccttagatcacgagcagaaacgatgagcagcgagcttgcacaagagcatctgatgccctgggaaatcccaaggaaggagtggttcccccacgggttcatctttggcgccgccacttcagcgtaccaaattgaaggtgcttggaatgagcatggcaaggggccaagcatatgggaccacttctgccacaatcatcctgaaaggatagctgattggagcaatggggatgttgcagtgaactcctaccatctgtatgaagaggatgtcaagttgctgaaggaaatgggcatggacgcctataggttctccatctcttggtccagaatactgccaaaggggacgctggaaggtgggataaactataaaggcctgcagtactacaaaaacctgatcaacacgttgaaagagaatggcatagagccatatgtaacaattttccactgggacactcctcaagcactggaggacaagtatggcagcttcttaaatcggaggattgtaaaagattacacagactttgccaagcatgctccctgggaggtgctcaccagggcacaatt

SEQ ID NO: 30392 - protein, 228 aa, Panicum virgatum
  misc_feature: Ceres CLONE 1899965
  misc_feature (67)..(228): Pfam Name: Glyco_hydro_1 Pfam Description: Glycosyl hydrolase family 1
  misc_feature: SWISSPROT Homolog: EC 3.2.1.21 Beta-glucosidase
  misc_feature: Useful for making plants with altered cell wall content and/or composition
MALLASALTSHSAHPGLRSPIGPNGGNLSWHLSSSKKSKRRCDLRSRAETMSSELAQEHLMPWEIPRKEWFPHGFIFGAATSAYQIEGAWNEHGKGPSIWDHFCHNHPERIADWSNGDVAVNSYHLYEEDVKLLKEMGMDAYRFSISWSRILPKGTLEGGINYKGLQYYKNLINTLKENGIEPYVTIFHWDTPQALEDKYGSFLNRRIVKDYTDFAKHAPWEVLTRAQ

SEQ ID NO: 30393 - DNA, 742 bp, Panicum virgatum
  misc_feature: Ceres CLONE 1899967
  misc_feature: Encodes the peptide sequence at SEQ ID NO. 30394
aaaacgcccgcccctcctcgtcactccaactaacccccctcgtcgtcggctcgtcgcccaacattgtactatcctagcaagaaaaagagcttggcagagcaaaggtcctagctagctagcgtatattaccaaaccggagaggggggagagagagatggcaggcggcgaggtatggcggccgttgctcgccggcgcctggctgctgtggcttctcccgtgggcatcggccgtccgccggagagacttcccggcggcgttcctcttcggcaccgccacttcctcgtaccagatcgaaggtgcatacctcgagggcaacaaaagtttaagcaattgggatgtgctcactcatctaccagggagagtcaacgatggaagcaccggggacatcgcggatgatcactaccatcgtttcgaagacgacgttgagctgatccactctcttggcacaaacgcctacaggttatctatatcatgggccagaatccttccaagagggagattcggcaaagtgaacccagcaggcatcgagttctacaacaaactcatcgacgcactcttgctcaaaggaatagagccgttcgtcacgctgaaccactacgacatcccgcaagagctggaggacaggtacggggcgtggctcagcgccgagatccggcgcgacttcggccacctcgccgacgtgtgcttcgcggcgttcggcgaccgcgtcaagtactggggtaccttcaacgagcccaacgtc

SEQ ID NO: 30394 - protein, 195 aa, Panicum virgatum
  misc_feature: Ceres CLONE 1899967
  misc_feature (27)..(195): Pfam Name: Glyco_hydro_1 Pfam Description: Glycosyl hydrolase family 1
  misc_feature: SWISSPROT Homolog: EC 3.2.1.21 Beta-glucosidase
  misc_feature: Useful for making plants with altered carbohydrate content
  misc_feature: Useful for making plants with altered cell wall content and/or composition
MAGGEVWRPLLAGAWLLWLLPWASAVRRRDFPAAFLFGTATSSYQIEGAYLEGNKSLSNWDVLTHLPGRVNDGSTGDIADDHYHRFEDDVELIHSLGTNAYRLSISWARILPRGRFGKVNPAGIEFYNKLIDALLLKGIEPFVTLNHYDIPQELEDRYGAWLSAEIRRDFGHLADVCFAAFGDRVKYWGTFNEPN

SEQ ID NO: 30395 - DNA, 703 bp, Panicum virgatum
  misc_feature: Ceres CLONE 1899972
  misc_feature: Encodes the peptide sequence at SEQ ID NO. 30396
acaaaccgctcccgacccgcgagctcgcccccggccggatcgaacagctagggtttcggaggaggaagaagcgcgcggcgacgagatgttcgggcgcgcgccgaagaagagtgacaacacgcggtactacgagatcctcggcgtgcccaaggacgcgtcccaggatgacctcaagaaggcctaccgcaaggccgccatcaagaaccaccccgacaagggcggggaccctgagaagttcaaggagctagctcaggcttatgagatcctcagtgatcctgaaaagcgcgagatttatgatcagtatggtgaggatgccctcaaggagggaatgggaggtggaggaaggatgcatgacccatttgatatcttccaatccttctttggtggtggaagcccctttggaggtggtggtagcagtaggggcaggaggcagcgtaggggtgaagatgttgttcaccctctgaaggtttctctggaggaattgtacaatggcacctcgaagaagctctcactgtcgcgcaatgtactctgctccaagtgcaatggcaagggctcaaagtctggagcttcatcaaggtgtgctggttgccaaggctctgggtataaggtccaaatccggcagctgggaccaggaatgattcagcaaatgcagcatccttgcaatgagtgcaagggtactggggagactatcagcgataaggac

SEQ ID NO: 30396 - protein, 205 aa, Panicum virgatum
  misc_feature: Ceres CLONE 1899972
  misc_feature (13)..(71): Pfam Name: DnaJ Pfam Description: DnaJ domain
  misc_feature (136)..(205): Pfam Name: DnaJ_CXXCXGXG Pfam Description: DnaJ central domain (4 repeats)
MFGRAPKKSDNTRYYEILGVPKDASQDDLKKAYRKAAIKNHPDKGGDPEKFKELAQAYEILSDPEKREIYDQYGEDALKEGMGGGGRMHDPFDIFQSFFGGGSPFGGGGSSRGRRQRRGEDVVHPLKVSLEELYNGTSKKLSLSRNVLCSKCNGKGSKSGASSRCAGCQGSGYKVQIRQLGPGMIQQMQHPCNECKGTGETISDK

SEQ ID NO: 30397 - DNA, 762 bp, Panicum virgatum
  misc_feature: Ceres CLONE 1899980
  misc_feature: Encodes the peptide sequence at SEQ ID NO. 30398
attattactcgtggcccctcgttagcttgctctcttcctctttatcagtttcccttgcatttgcatgcctttacattgcaatcgcaagccccctcctactaccaccctcttccctctcaaagcagccaagcaagaagccaggcagcgagcgagcgagcaagaagccgcgcgagctagcagagggaacaagaaggcgaggaggtgacgagctgagcgaggtggctgcggcagcaatggcggcggacctggggttcgaggagaccgagctccggctgggcctgcccggcggcggcggaggcggagggggagatggcgaggggacaaagagcgcctccggcaagaggggcttcgccgagaccatcgacctcaagctgaagctggagccggcggcggccgccgtcgtggaagaggagaaggaggtggtggatgccgccgaggaggccgcgacggccgaggagtccccggccgggaagatgaagcggtcgcccagccagagcagcgtcgtcaccgccgccgcgcagcccgaccccgccgagaagccgcgcgcccccaaggctcaggtggtcggatggccgccggtgcgctcgttccggaagaacatcatgtccgtgcagtccgagaagggcaccggcagcaaggacgccgacgccgacaagtcctcgccggcagccggcggcggcgccgcgttcgtgaaggtgagcctggacggcgcgccgtacctgcgcaaggtggacctcagatgtacaagagctaccaggagct

SEQ ID NO: 30398 - protein, 176 aa, Panicum virgatum
  misc_feature: Ceres CLONE 1899980
  misc_feature (5)..(176): Pfam Name: AUX_IAA Pfam Description: AUX/IAA family
MAADLGFEETELRLGLPGGGGGGGGDGEGTKSASGKRGFAETIDLKLKLEPAAAAVVEEEKEVVDAAEEAATAEESPAGKMKRSPSQSSVVTAAAQPDPAEKPRAPKAQVVGWPPVRSFRKNIMSVQSEKGTGSKDADADKSSPAAGGGAAFVKVSLDGAPYLRKVDLRCTRATRS

SEQ ID NO: 30399 - DNA, 747 bp, Panicum virgatum
  misc_feature: Ceres CLONE 1899982
  misc_feature: Encodes the peptide sequence at SEQ ID NO. 30400
gagacgcatcgccgccggtcactccctccccgccgctcctctctctgtctggtggaggcggagatccgcgcaggcgaggggtctgctccgctcgcgttgctgtttgtggacgaagcaggtcagaaggagcacactcgtgtttggtttgtactgtacctgactgaggagattaggtctacgcatgggggctccaaagcagaggtggacttctgaggaagaggctgctcttagaactggagtcgcaaaacatggagttggaaattggcgcacaatattgaatgatccagaacttagttccacattgcgctaccgctcgaatgttgacctaaaggacaagtggcgtaacatgaatgtaactgtcaccgcttcgagttctcgtgacaaggcaaggactgccatgaagaaaacccgagctgctcctaagaacaatgaccacacggcagcaatcatcacagttacttctgatgctgatgatgagattgttgatgcaaagcctatagcatcagtgtctgctgaagcgtggaatacttctacatcaaagaaatctcactcgaggctagacaatattataatggaggctataaagaacttgaatgagcctacggggtcacacagaactactattgctaattacatagaggagcaatattggccacctagtgattttgatcacttattatctgcaaaactgaaggacttggcctccagtgggaaattgataaaggtgaatcggaagtacaggatagc

SEQ ID NO: 30400 - protein, 188 aa, Panicum virgatum
  misc_feature: Ceres CLONE 1899982
  misc_feature (5)..(57): Pfam Name: Myb_DNA-binding Pfam Description: Myb-like DNA-binding domain
  misc_feature (122)..(183): Pfam Name: Linker_histone Pfam Description: linker histone H1 and H5 family
  misc_feature: The sequence is a functional homolog of SEQ ID NO 1220 in the 10/666,642 US patent application
  misc_feature: The sequence is a functional homolog of SEQ ID NO 1221 in the 10/666,642 US patent application
  misc_feature: Useful for making plants with altered alkaloid content
MGAPKQRWTSEEEAALRTGVAKHGVGNWRTILNDPELSSTLRYRSNVDLKDKWRNMNVTVTASSSRDKARTAMKKTRAAPKNNDHTAAIITVTSDADDEIVDAKPIASVSAEAWNTSTSKKSHSRLDNIIMEAIKNLNEPTGSHRTTIANYIEEQYWPPSDFDHLLSAKLKDLASSGKLIKVNRKYRI

SEQ ID NO: 30401 - DNA, 1899 bp, Panicum virgatum
  misc_feature: Ceres CLONE 1899993
  misc_feature: Encodes the peptide sequence at SEQ ID NO. 30402
aaaaaaccatatccatccatccatccttccagcttccaacaaccaacttccatccatcctcttgaatcttggtacacacacacactgactgtctagtctgacacagagttgcagtgagatcggctgccgacgccgacggcatggccataggcgccttcgcggaaggccccgccggcgccggctacagcggccgggtcacgtccttcgtggtgctctcctgcatcgtggccggcagcggcggcatcctcttcggctatgacctcggaatctcaggtggggttacctccatggagtccttcctcagcaagttcttcccggacgtgtatcaccagatgaaaggggacaagaacgtcagcaactactgccgtttcgacagcgagctcctcaccgtcttcacctcctccctctacgtcgccggcctcgtcgccacgctcttcgcctcctccgtcacaaggaggttcggccgccgcgcctccattctcatcggcggcactgtcttcatcgtcggctccgtcttcggcggggcagccgtcaacgtctacatgctcctcctcaacaggatcctgctcggcataggactaggcttcaccaaccagtctattccactgtacctatcagaaatggcgccaccccagtaccgtggggccatcaacaatggctttgagctctgcataagcattggcatcctcatcgcaaacctcatcaacgtcggagttgagaaaattgcagatggatggggctggagaatctctctctccctggcagctgtgccagctgcattcctaaccatgggcgcaatattcctgcctgagacacccagcttcataatccaacgtgatggcaacattgatgaggcaaagatcctgctccagaggctacgtggcacaactagaatccagaaagagcttgatgatttggtctctgctagcaatgtctcgaggacaatacaacatccactccggaagatattcaagaggaagtacaggccacagcttgtcatagcactctcggttccattctttaaccagatcacaggaatcaacgtcatcaacttctatgcgccagtcatgttccgaaccatcgggctcaaggagagcgcatccctcatgtcagcggttgtcacacgaatctgtgcaacagttgctaacattgtagcaatggttgtcgttgacaggtttggtcgtaggaagctcttcctagtaggtggcattcagatgatcttgtcacagatcatggtaggggcagtcctagctgcaaagttcaaggaccacggaggaatggaaaaggagtatgcatacctagtcttgatcatcatgtgtgtgttcgttgcaggctttgcatggtcttggggacctctaacctacttggtcccgacagagatttgcccactggagatcaggtcagccgggcagagtattgtcattgctgtgatcttcttggtgacatttgtgattggccagaccttcctcgcaatgttatgccatctcaagtttggaacattcttcctctttggtggatgggtgtgtgtgatgacactcttcgtatacttcttcttgccagagacaaagcaactgccaatggagcaaatggagcaggtatggaggaggcactggttttggaaaaggattgtaggggaggaagaggaagagagagaggcaagaagcatagctttgtccaacacatagtgattttcttttagggtcaagtttatttggtgaaacctacagaaatggtacaccattctgattagtaaatatgcatgcatcaaggtatattattgtatagctgcacaaattgtaactagtaactgcattagtctcctaatttgacacttctggcattgtgtaacctttaagaggggcttccagaattatagcaagtaataagaactttcagtgc

SEQ ID NO: 30402 - protein, 514 aa, Panicum virgatum
  misc_feature: Ceres CLONE 1899993
  misc_feature (26)..(487): Pfam Name: Sugar_tr Pfam Description: Sugar (and other) transporter
MAIGAFAEGPAGAGYSGRVTSFVVLSCIVAGSGGILFGYDLGISGGVTSMESFLSKFFPDVYHQMKGDKNVSNYCRFDSELLTVFTSSLYVAGLVATLFASSVTRRFGRRASILIGGTVFIVGSVFGGAAVNVYMLLLNRILLGIGLGFTNQSIPLYLSEMAPPQYRGAINNGFELCISIGILIANLINVGVEKIADGWGWRISLSLAAVPAAFLTMGAIFLPETPSFIIQRDGNIDEAKILLQRLRGTTRIQKELDDLVSASNVSRTIQHPLRKIFKRKYRPQLVIALSVPFFNQITGINVINFYAPVMFRTIGLKESASLMSAVVTRICATVANIVAMVVVDRFGRRKLFLVGGIQMILSQIMVGAVLAAKFKDHGGMEKEYAYLVLIIMCVFVAGFAWSWGPLTYLVPTEICPLEIRSAGQSIVIAVIFLVTFVIGQTFLAMLCHLKFGTFFLFGGWVCVMTLFVYFFLPETKQLPMEQMEQVWRRHWFWKRIVGEEEEEREARSIALSNT

SEQ ID NO: 30403 - DNA, 747 bp, Panicum virgatum
  misc_feature: Ceres CLONE 1900013
  misc_feature: Encodes the peptide sequence at SEQ ID NO. 30404
aattccgagcaccgtcaccgtggcgtcatcgcccaattccccgcccccggcctagcacccagttctgaattcctccacatctccatcgccccggcaggaacatcccatgcaccgcaggcgtctcccctataaaaccccgtctagtcccccgccctgatggcaccggcgcacacacggcggagaattcatcgatcgagtcaattcgcccgcttctccgcgcccctgctagcctgcttgtgtgattctgaagggagatttagtcgagcaggatgaatgcattggcagcaaccagcaggaacttcaagcaggcagctaagctgctggccctcgactccaagctggagaagagcttgctcatcccgttccgggagatcaaggttgaatgcacaatcccaaaagatgatgggactttagcgtcctatgttggttttagggttcaacatgacaatgctaggggacctatgaagggtggaatcagataccaccatgaggttgagcctgatgaggtcaatgccttggcacaactaatgacatggaaaacagctgtggccaacataccgtatggaggagctaaaggtggaataggatgcaatcctggagaactgagcatctctgagcttgagcggcttacccgagtttttactcagaaaatccatgacttgattggcatccatactgatgttccagctccagatatgggtaccaactcacagacaatggcatggatacttgatgagtactcaaagt

SEQ ID NO: 30404 - protein, 159 aa, Panicum virgatum
  misc_feature: Ceres CLONE 1900013
  misc_feature (31)..(159): Pfam Name: ELFV_dehydrog_N Pfam Description: Glu/Leu/Phe/Val dehydrogenase, dimerisation domain
  misc_feature: SWISSPROT Homolog: EC 1.4.1.3 Glutamate dehydrogenase (NAD(P)(+))
MNALAATSRNFKQAAKLLALDSKLEKSLLIPFREIKVECTIPKDDGTLASYVGFRVQHDNARGPMKGGIRYHHEVEPDEVNALAQLMTWKTAVANIPYGGAKGGIGCNPGELSISELERLTRVFTQKIHDLIGIHTDVPAPDMGTNSQTMAWILDEYSK

SEQ ID NO: 30405 - DNA, 679 bp, Panicum virgatum
  misc_feature: Ceres CLONE 1900026
  misc_feature: Encodes the peptide sequence at SEQ ID NO. 30406
atttgccgcgctcgcgcgctcccgccccacacacacacacaccccgaccttccacgcttctccagcctcactcttcctggtcaggtgggagcgcaggagacagggctgggaggatggcgtcggtttccagggctgtctgcggcctgcagatgccgtgcttgaacggcagggaggcgcccgccggccgccaatcggtcgcggcgccgagggcccggaacgccaaacggggcgtcatccgctccgtgtccgcctccgcctccgcctccggctccggctccgtctccggccgcggccagcattgcgcgcctgccaacgccgtcgccgacgccgcgccgattacggcgacgaagagggtgttccccttcggcaagggcaagagcgagggcaacaggggcatgaaggacctgctgggcggcaagggcgcgaacctggcggagatgtcgagcatcgggctgtcggtgccgccggggttcacggtgtcgacggaggcgtgccagcagtaccaggaggccgggcggtcgctgcccgcggggctgtgggccgagatcctcgacggcctggcgtgggtggaggagtacatgggcgcgcgcctcggcgacccgcagcgcccgctcctgctctccgtccgctccggcgccgcggtgtcgatgcccggcatgatggacacggtgctcaacct

SEQ ID NO: 30406 - protein, 188 aa, Panicum virgatum
  misc_feature: Ceres CLONE 1900026
  misc_feature: SWISSPROT Homolog: EC 2.7.9.1 Pyruvate, phosphate dikinase
MASVSRAVCGLQMPCLNGREAPAGRQSVAAPRARNAKRGVIRSVSASASASGSGSVSGRGQHCAPANAVADAAPITATKRVFPFGKGKSEGNRGMKDLLGGKGANLAEMSSIGLSVPPGFTVSTEACQQYQEAGRSLPAGLWAEILDGLAWVEEYMGARLGDPQRPLLLSVRSGAAVSMPGMMDTVLN

SEQ ID NO: 30407 - DNA, 1296 bp, Panicum virgatum
  misc_feature: Ceres CLONE 1900027
  misc_feature: Encodes the peptide sequence at SEQ ID NO. 30408
agagaggaaaacagagagtccccggcccaaggaagagagacagagagtcccaaacacttgtacgcgcggcgcgcgccaagcactggaaaatcgcagagggagggagggggcggcgcgcgcgcgctgtggcgctggccatgagccggggccgcgcctggccggcacccgatagccgccgcgccgccgctctactcctcctgctgctgggagtcgccgtcggtgggcgcgggagcggtgccgccgcggaggtcgagaagggggaggaggcggcggcggtggactacggcgcggcgctgtccaacagcctgctctacttcgaggcgcagcggtcggggcggctgccgcacaaccagcgggtgcggtggcggggccgctcgggcctcaccgacgggctgcagcagggggtggacctcgtcggcggctactacgacgcgggcgaccacgtcaagttcggcctgcccatggccttcaccgtcaccatgctctcctggggcgccatcgagttcggggacgacgtcgcggccgccggcgagtgggggcacgcgctcgaggccatcaagtggggcaccgactacttcgtcaaggcgcacaccgagccattcgtctactgggcagaggtgggcgacggcgacacggaccactactgttggcagcgccccgaggacatgacgacgtcgcggcaggcgtaccgcatcgacagggacaacccgggctccgacctcgccggcgagaccgccgcggcgctcgccgccgcctccatcgtcttccgccgctccaacccgcattactcccacctcctcctgcaccacgccaagcagctgttcgagttcggcgaccggtaccggggcacgtacgacagcagcatcgcggaggcgcgcagctactacgcgtccgtgagcgggtaccgcgacgagctgctgtgggcggcgctgtggctgcaccgcgccacggggcgcgccgagtacctcgactacgccgccgccatggccgacgagttcggcggcgtcggctgggccatgaccgagttcagctgggacgtcaagtacgccggcgtccaggtgctcgccgccaagctgctgctggagggcgacccgcaagccctgcagcaccgcgcggtgctggagcagtacaaggccaaggcggagcactacctgtgcgcgtgcctgggcctcaacggcggcaacggcagcgacaacgtggaccagagccccggcgagatgctctacgtgcgccagtggaacaacctccagtacgtctccagcgccgccttcctcctcaccgcctactcccgctacc

SEQ ID NO: 30408 - protein, 386 aa, Panicum virgatum
  misc_feature: Ceres CLONE 1900027
  misc_feature (48)..(386): Pfam Name: Glyco_hydro_9 Pfam Description: Glycosyl hydrolase family 9
  misc_feature: SWISSPROT Homolog: EC 3.2.1.4 Cellulase
  misc_feature: Useful for making plants with altered carbohydrate content
  misc_feature: Useful for making plants with altered cell wall content and/or composition
  misc_feature: Useful for making plants with altered lignin content
MSRGRAWPAPDSRRAAALLLLLLGVAVGGRGSGAAAEVEKGEEAAAVDYGAALSNSLLYFEAQRSGRLPHNQRVRWRGRSGLTDGLQQGVDLVGGYYDAGDHVKFGLPMAFTVTMLSWGAIEFGDDVAAAGEWGHALEAIKWGTDYFVKAHTEPFVYWAEVGDGDTDHYCWQRPEDMTTSRQAYRIDRDNPGSDLAGETAAALAAASIVFRRSNPHYSHLLLHHAKQLFEFGDRYRGTYDSSIAEARSYYASVSGYRDELLWAALWLHRATGRAEYLDYAAAMADEFGGVGWAMTEFSWDVKYAGVQVLAAKLLLEGDPQALQHRAVLEQYKAKAEHYLCACLGLNGGNGSDNVDQSPGEMLYVRQWNNLQYVSSAAFLLTAYSRY

SEQ ID NO: 30409 - DNA, 776 bp, Panicum virgatum
  misc_feature: Ceres CLONE 1900027-R
  misc_feature: Encodes the peptide sequence at SEQ ID NO. 30410
cccggggctcctccgctgcccgcgcggggcggcggcgccggccgagctgctggccctggcgcgctcgcaggcggactacatcctgggccgcaacccgctgcggctcagctacatggtcggctacggccgccggtacccggtccgcgtgcaccaccgcggcgcctccatcgtcgcgcacaaggccaacagccgcttcatcggctgcatgcaggggttcgacgactggttcggccgggggcgggccaaccccaatgtgctcgccggcgccatcgtcggcgggcccaactgccgggacgagttccgggacgaccgcgggaactacatgcagaccgaggcctgcacgtacaacacggcgcccatggtcggcgttttcgccaggctccaccgcctggccacggcggaggggtgccgccggaggggggcggctgatgaggcggcggagtgtagataaatgaagggggatggtttcggtgggtgtccaaggcggggaaattcttttttctttctcgtaataagctcgattattactactagcttccataaaattaattttttgaagtgttaatatgagaaagataaagaaagagagagttttgagtagtgaaagaaagaacaggaatcatagtagtggaggaaataaggatgagaaaaaaaaaggtgtgtgcaaaagtacctgtatgttttatgtagatgtcacagaactgaaaagaagtgtaatgtttactggagaacagtaaatacataatcaacatagacaattacatgcatcttacagc

SEQ ID NO: 30410 - protein, 149 aa, Panicum virgatum
  misc_feature: Ceres CLONE 1900027-R
  misc_feature: SWISSPROT Homolog: EC 3.2.1.4 Cellulase
  misc_feature: Useful for making plants with altered carbohydrate content
  misc_feature: Useful for making plants with altered cell wall content and/or composition
  misc_feature: Useful for making plants with altered lignin content
PGLLRCPRGAAAPAELLALARSQADYILGRNPLRLSYMVGYGRRYPVRVHHRGASIVAHKANSRFIGCMQGFDDWFGRGRANPNVLAGAIVGGPNCRDEFRDDRGNYMQTEACTYNTAPMVGVFARLHRLATAEGCRRRGAADEAAECR

SEQ ID NO: 30411 - DNA, 698 bp, Panicum virgatum
  misc_feature: Ceres CLONE 1900030
  misc_feature: Encodes the peptide sequence at SEQ ID NO. 30412
gtcactcgccacagccgaactcccccccactcgcccgcctcctctgcaaccaaattcgcacgccacgcctcggcaaattctagctccttcctcgtcgtcgagctgcgcatggcgaggtccatggagagcggcgacggcagcaatgggggcagcggcgggctgatggtgacggagctgagccacatcaaggagctggtgcggcagctggaggcgcacctcggcggctccgacgagttctgcaggcacctcaccacggagatcttctccctcaccgagcgctccatcggcatcatcaccgccgcctcctcctcctccggcctcgacgcccggaagcgggagtacgccgggctcgcctcgcctttcccggccacgcccaccagcgacgtcgccgacgggcctttcaggagcaccaagaagaggaaggtgatggagaagaggaagcagcaggtgcgcgtgagctcgccccgcggcggcgccggcgagaacccggtggacgacggccacagctggcggaagtacggccagaaggagattcttggagccaagcacccaaggggctactaccgctgcacgcaccgccactcccagggatgcttggcgacgaagcaggtgcagcgcaccgacgaggacccggcgctcttcgacgtcatctaccacggcgaccacacctgcgttcagaggccggcggtggcggcggc

SEQ ID NO: 30412 - protein, 192 aa, Panicum virgatum
  misc_feature: Ceres CLONE 1900030
  misc_feature (124)..(186): Pfam Name: WRKY Pfam Description: WRKY DNA -binding domain
MESGDGSNGGSGGLMVTELSHIKELVRQLEAHLGGSDEFCRHLTTEIFSLTERSIGIITAASSSSGLDARKREYAGLASPFPATPTSDVADGPFRSTKKRKVMEKRKQQVRVSSPRGGAGENPVDDGHSWRKYGQKEILGAKHPRGYYRCTHRHSQGCLATKQVQRTDEDPALFDVIYHGDHTCVQRPAVAA

SEQ ID NO: 30413 - DNA, 727 bp, Panicum virgatum
  misc_feature: Ceres CLONE 1900050
  misc_feature: Encodes the peptide sequence at SEQ ID NO. 30414
acttttaccttcatcattccttgcagaacctgctggctaccggaggtggagtgcacagtgcccaattgcatgctgtatacttccacagacctggcaactccgagagcttgtaactcccttgccccgccttgcgctgagatggggaggctttcttgctgctacaatctaaagttgagaaaggggctctggtctcctgaggaggatgataagctcatgaatcacataacaaagcatggccatggctgctggagttctgttcccaaactcgcagggctccaaaggtgcggaaagagttgcaggctgagatggataaactatctgaggccagacctcaagagaggggcattctctcaagaggaagaagacctcatcgttgagctgcatgctgtccttgggaacaggtggtctcaaattgcagcacagctgcctggaaggactgacaacgagatcaagaatctatggaactcatgcatcaagaagaagctgaggcagaaaggcattgatcccaacacccacaagccgcttgctgaggctgatcgcaacggtgcagctcccaccatcagcaccgagaggacctcagggtccagcgacgtcaacccgtcgagcactggggctctggggaacttgagccacctcctcagtgagacggctcaatcatcaatgctgctgccagtgtatgacaagaatcaatctgaagctccacatttggcacgccctaaggtgccac

SEQ ID NO: 30414 - protein, 196 aa, Panicum virgatum
  misc_feature: Ceres CLONE 1900050
  misc_feature (14)..(61): Pfam Name: Myb_DNA-binding Pfam Description: Myb-like DNA-binding domain
  misc_feature (67)..(112): Pfam Name: Myb_DNA-binding Pfam Description: Myb-like DNA-binding domain
  misc_feature: The sequence is a functional homolog of SEQ ID NO 1660 in the 11/479,226 US patent application
  misc_feature: The sequence is a functional homolog of SEQ ID NO 840 in the 10/412,699 US patent application
  misc_feature: The sequence is a functional homolog of SEQ ID NO 136 in the 10/412,699 US patent application
  misc_feature: The sequence is a functional homolog of SEQ ID NO 325 in the 11/479,226 US patent application
  misc_feature: Useful for biocontainment applications
  misc_feature: The sequence is a functional homolog of SEQ ID NO 188 in the 10/412,699 US patent application
  misc_feature: The sequence is a functional homolog of SEQ ID NO 2274 in the 10/374,780 US patent application
  misc_feature: The sequence is a functional homolog of SEQ ID NO 704 in the 10/225,066 US patent application
  misc_feature: The sequence is a functional homolog of SEQ ID NO 824 in the 10/412,699 US patent application
  misc_feature: The sequence is a functional homolog of SEQ ID NO 1000 in the 11/435,388 US patent application
  misc_feature: The sequence is a functional homolog of SEQ ID NO 2223 in the 10/666,642 US patent application
  misc_feature: The sequence is a functional homolog of SEQ ID NO 2221 in the 10/666,642 US patent application
  misc_feature: The sequence is a functional homolog of SEQ ID NO 998 in the 11/435,388 US patent application
  misc_feature: The sequence is a functional homolog of SEQ ID NO 1006 in the 11/435,388 US patent application
  misc_feature: The sequence is a functional homolog of SEQ ID NO 1008 in the 11/435,388 US patent application
  misc_feature: The sequence is a functional homolog of SEQ ID NO 428 in the 10/374,780 US patent application
  misc_feature: The sequence is a functional homolog of SEQ ID NO 54 in the 11/375,241 US patent application
  misc_feature: The sequence is a functional homolog of SEQ ID NO 870 in the 10/225,066 US patent application
  misc_feature: The sequence is a functional homolog of SEQ ID NO 1070 in the 10/374,780 US patent application
  misc_feature: The sequence is a functional homolog of SEQ ID NO 992 in the 11/435,388 US patent application
  misc_feature: Useful for making plants with altered alkaloid content
  misc_feature: Useful for making plants with modulated nitrogen use efficiency
  misc_feature: The sequence is a functional homolog of SEQ ID NO 1068 in the 10/374,780 US patent application
  misc_feature: The sequence is a functional homolog of SEQ ID NO 984 in the 11/435,388 US patent application
  misc_feature: The sequence is a functional homolog of SEQ ID NO 1094 in the 10/225,066 US patent application
  misc_feature: The sequence is a functional homolog of SEQ ID NO 386 in the 10/374,780 US patent application
  misc_feature: Useful for making plants with modulated biomass
  misc_feature: The sequence is a functional homolog of SEQ ID NO 1065 in the 10/374,780 US patent application
  misc_feature: The sequence is a functional homolog of SEQ ID NO 1307 in the 10/412,699 US patent application
  misc_feature: The sequence is a functional homolog of SEQ ID NO 986 in the 11/435,388 US patent application
  misc_feature: The sequence is a functional homolog of SEQ ID NO 1073 in the 10/374,780 US patent application
  misc_feature: Useful for making plants with altered carbohydrate content
  misc_feature: The sequence is a functional homolog of SEQ ID NO 1069 in the 10/374,780 US patent application
  misc_feature: The sequence is a functional homolog of SEQ ID NO 988 in the 11/435,388 US patent application
  misc_feature: Useful for making plants with altered cell wall content and/or composition
  misc_feature: The sequence is a functional homolog of SEQ ID NO 1010 in the 11/435,388 US patent application
  misc_feature: The sequence is a functional homolog of SEQ ID NO 1067 in the 10/374,780 US patent application
  misc_feature: The sequence is a functional homolog of SEQ ID NO 1309 in the 10/412,699 US patent application
  misc_feature: The sequence is a functional homolog of SEQ ID NO 1071 in the 10/374,780 US patent application
  misc_feature: The sequence is a functional homolog of SEQ ID NO 994 in the 11/435,388 US patent application
  misc_feature: The sequence is a functional homolog of SEQ ID NO 134 in the 10/412,699 US patent application
  misc_feature: The sequence is a functional homolog of SEQ ID NO 321 in the 11/479,226 US patent application
  misc_feature: The sequence is a functional homolog of SEQ ID NO 2574 in the 10/374,780 US patent application
  misc_feature: The sequence is a functional homolog of SEQ ID NO 278 in the 10/225,066 US patent application
  misc_feature: The sequence is a functional homolog of SEQ ID NO 430 in the 10/412,699 US patent application
  misc_feature: The sequence is a functional homolog of SEQ ID NO 995 in the 11/479,226 US patent application
  misc_feature: The sequence is a functional homolog of SEQ ID NO 1066 in the 10/374,780 US patent application
  misc_feature: The sequence is a functional homolog of SEQ ID NO 1308 in the 10/412,699 US patent application
  misc_feature: The sequence is a functional homolog of SEQ ID NO 271 in the 11/479,226 US patent application
  misc_feature: The sequence is a functional homolog of SEQ ID NO 2572 in the 10/374,780 US patent application
  misc_feature: The sequence is a functional homolog of SEQ ID NO 636 in the 10/225,066 US patent application
  misc_feature: The sequence is a functional homolog of SEQ ID NO 838 in the 10/412,699 US patent application
  misc_feature: The sequence is a functional homolog of SEQ ID NO 112 in the 10/412,699 US patent application
  misc_feature: The sequence is a functional homolog of SEQ ID NO 267 in the 11/479,226 US patent application
  misc_feature: Useful for making plants with altered lignin content
  misc_feature: Useful for making plants with altered terpenoid content
  misc_feature: The sequence is a functional homolog of SEQ ID NO 1041 in the 11/479,226 US patent application
  misc_feature: The sequence is a functional homolog of SEQ ID NO 112 in the 10/225,066 US patent application
  misc_feature: The sequence is a functional homolog of SEQ ID NO 20 in the 11/375,241 US patent application
  misc_feature: The sequence is a functional homolog of SEQ ID NO 2052 in the 10/374,780 US patent application
  misc_feature: The sequence is a functional homolog of SEQ ID NO 450 in the 10/412,699 US patent application
  misc_feature: The sequence is a functional homolog of SEQ ID NO 18 in the 11/375,241 US patent application
  misc_feature: The sequence is a functional homolog of SEQ ID NO 426 in the 10/374,780 US patent application
  misc_feature: The sequence is a functional homolog of SEQ ID NO 458 in the 10/225,066 US patent application
  misc_feature: The sequence is a functional homolog of SEQ ID NO 569 in the 10/374,780 US patent application
  misc_feature: The sequence is a functional homolog of SEQ ID NO 1680 in the 11/479,226 US patent application
  misc_feature: The sequence is a functional homolog of SEQ ID NO 202 in the 10/666,642 US patent application
  misc_feature: The sequence is a functional homolog of SEQ ID NO 852 in the 10/412,699 US patent application
  misc_feature: The sequence is a functional homolog of SEQ ID NO 1033 in the 10/412,699 US patent application
  misc_feature: The sequence is a functional homolog of SEQ ID NO 540 in the 10/374,780 US patent application
  misc_feature: The sequence is a functional homolog of SEQ ID NO 148 in the 10/412,699 US patent application
  misc_feature: The sequence is a functional homolog of SEQ ID NO 2266 in the 10/374,780 US patent application
  misc_feature: The sequence is a functional homolog of SEQ ID NO 341 in the 11/479,226 US patent application
  misc_feature: The sequence is a functional homolog of SEQ ID NO 58 in the 11/375,241 US patent application
  misc_feature: The sequence is a functional homolog of SEQ ID NO 822 in the 10/412,699 US patent application
  misc_feature: The sequence is a functional homolog of SEQ ID NO 1681 in the 10/374,780 US patent application
  misc_feature: The sequence is a functional homolog of SEQ ID NO 2570 in the 10/374,780 US patent application
  misc_feature: The sequence is a functional homolog of SEQ ID NO 634 in the 10/225,066 US patent application
  misc_feature: The sequence is a functional homolog of SEQ ID NO 832 in the 10/412,699 US patent application
  misc_feature: The sequence is a functional homolog of SEQ ID NO 592 in the 10/374,780 US patent application
  misc_feature: The sequence is a functional homolog of SEQ ID NO 786 in the 11/435,388 US patent application
  misc_feature: The sequence is a functional homolog of SEQ ID NO 1672 in the 11/479,226 US patent application
  misc_feature: The sequence is a functional homolog of SEQ ID NO 846 in the 10/412,699 US patent application
  misc_feature: The sequence is a functional homolog of SEQ ID NO 126 in the 10/412,699 US patent application
MGRLSCCYNLKLRKGLWSPEEDDKLMNHITKHGHGCWSSVPKLAGLQRCGKSCRLRWINYLRPDLKRGAFSQEEEDLIVELHAVLGNRWSQIAAQLPGRTDNEIKNLWNSCIKKKLRQKGIDPNTHKPLAEADRNGAAPTISTERTSGSSDVNPSSTGALGNLSHLLSETAQSSMLLPVYDKNQSEAPHLARPKVP

SEQ ID NO: 30415 - DNA, 741 bp, Panicum virgatum
  misc_feature: Ceres CLONE 1900058
  misc_feature: Encodes the peptide sequence at SEQ ID NO. 30416
aagaacatcgcggaatccacaggacacagccagagctctctctcaaccaccagcagcagccggagctgaggagagcgttgcggtttcagagtgggagggagaaatcaaggagccagcttgatcaattgcagcttcagctttgccggccgatcagcgatcgccatgggagtgccggtgaggagggagagggacgcggaggcggagctgaacctgccgccggggttccggttccacccgacggacgacgagctggtggagcactacctgtgccggaaggcggcggggcagcgcctcccggtgcccatcatcgcggaggtggacctgtacaagttcgacccctgggacctgccggagcgcgcgctgttcggcacccgggagtggtacttcttcacgcccagggaccgcaagtaccccaacggctcgcgccccaaccgcgccgccgggaacggctactggaaggccaccggcgccgacaagcccgtcgcgccgcgggggcgcacgctggggatcaagaaggcgctcgtgttctacgccggcaaggcgccgcgcggggtcaagaccgactggatcatgcacgagtacaggctggccgacgccggccgcgccgccgcggccaagaagggatcgctcagggtaagcgattgattctctgaataacaataattttgttttgttcttctggaaattgaagacgatcgcgttgatcgggtttgggggttgacaaattttactgaattctat

SEQ ID NO: 30416 - protein, 160 aa, Panicum virgatum
  misc_feature: Ceres CLONE 1900058
  misc_feature (17)..(143): Pfam Name: NAM Pfam Description: No apical meristem (NAM) protein
  misc_feature: The sequence is a functional homolog of SEQ ID NO 853 in the 10/374,780 US patent application
  misc_feature: The sequence is a functional homolog of SEQ ID NO 891 in the 10/374,780 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 104 in the 10/225,068 US patent application
  misc_feature: The sequence is a functional homolog of SEQ ID NO 2014 in the 10/374,780 US patent application
  misc_feature: The sequence is a functional homolog of SEQ ID NO 22 in the 10/286,264 US patent application
  misc_feature: The sequence is a functional homolog of SEQ ID NO 314 in the 10/412,699 US patent application
  misc_feature: The sequence is a functional homolog of SEQ ID NO 734 in the 11/479,226 US patent application
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: The sequence is a functional homolog of SEQ ID NO 890 in the 10/374,780 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: Useful for making plants with altered terpenoid content
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: Useful for making plants with modulated water use efficiency
  misc_feature: The sequence is a functional homolog of SEQ ID NO 1157 in the 11/479,226 US patent application
  misc_feature: The sequence is a functional homolog of SEQ ID NO 1416 in the 10/666,642 US patent application
  misc_feature: The sequence is a functional homolog of SEQ ID NO 30 in the 10/286,264 US patent application
  misc_feature: The sequence is a functional homolog of SEQ ID NO 430 in the 11/435,388 US patent application
  misc_feature: The sequence is a functional homolog of SEQ ID NO 518 in the 10/412,699 US patent application
  misc_feature: The sequence is a functional homolog of SEQ ID NO 854 in the 10/374,780 US patent application
  misc_feature: Useful for making plants with modulated light quality response
  misc_feature: Useful for making plants with modulated oxidative stress sensitivity
  misc_feature: The sequence is a functional homolog of SEQ ID NO 2110 in the 10/374,780 US patent application
  misc_feature: The sequence is a functional homolog of SEQ ID NO 304 in the 10/225,066 US patent application
  misc_feature: The sequence is a functional homolog of SEQ ID NO 954 in the 11/435,388 US patent application
  misc_feature: Useful for making plants with altered cell wall content and/or composition
  misc_feature: Useful for making plants with altered lignin content
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: The sequence is a functional homolog of SEQ ID NO 851 in the 10/374,780 US patent application
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: Useful for making plants with altered alkaloid content
  misc_feature: The sequence is a functional homolog of SEQ ID NO 1012 in the 11/435,388 US patent application
  misc_feature: The sequence is a functional homolog of SEQ ID NO 612 in the 11/435,388 US patent application
  misc_feature: The sequence is a functional homolog of SEQ ID NO 1064 in the 10/225,066 US patent application
  misc_feature: The sequence is a functional homolog of SEQ ID NO 2838 in the 10/374,780 US patent application
  misc_feature: The sequence is a functional homolog of SEQ ID NO 682 in the 11/435,388 US patent application
  misc_feature: The sequence is a functional homolog of SEQ ID NO 2472 in the 10/374,780 US patent application
  misc_feature: The sequence is a functional homolog of SEQ ID NO 520 in the 11/435,388 US patent application
  misc_feature: The sequence is a functional homolog of SEQ ID NO 974 in the 10/225,066 US patent application
  misc_feature: The sequence is a functional homolog of SEQ ID NO 852 in the 10/374,780 US patent application
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: The sequence is a functional homolog of SEQ ID NO 2592 in the 10/374,780 US patent application
  misc_feature: The sequence is a functional homolog of SEQ ID NO 288 in the 10/225,066 US patent application
  misc_feature: The sequence is a functional homolog of SEQ ID NO 320 in the 10/374,780 US patent application
  misc_feature: The sequence is a functional homolog of SEQ ID NO 850 in the 10/225,066 US patent application
  misc_feature: Useful for making plants with modulated light quality sensitivity
  misc_feature: The sequence is a functional homolog of SEQ ID NO 2 in US patent 7230164
  misc_feature: The sequence is a functional homolog of SEQ ID NO 6 in US patent 7230160
  misc_feature: The sequence is a functional homolog of SEQ ID NO 116 in the 10/225,066 US patent application
  misc_feature: The sequence is a functional homolog of SEQ ID NO 2476 in the 10/374,780 US patent application
  misc_feature: The sequence is a functional homolog of SEQ ID NO 88 in the 11/375,241 US patent application
  misc_feature: The sequence is a functional homolog of SEQ ID NO 2776 in the 10/374,780 US patent application
  misc_feature: The sequence is a functional homolog of SEQ ID NO 416 in the 10/225,066 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 326 in the 10/412,699 US patent application
  misc_feature: The sequence is a functional homolog of SEQ ID NO 760 in the 11/479,226 US patent application
  misc_feature: The sequence is a functional homolog of SEQ ID NO 2418 in the 10/374,780 US patent application
  misc_feature: The sequence is a functional homolog of SEQ ID NO 554 in the 10/225,066 US patent application
  misc_feature: The sequence is a functional homolog of SEQ ID NO 68 in the 10/286,264 US patent application
  misc_feature: The sequence is a functional homolog of SEQ ID NO 2590 in the 10/374,780 US patent application
  misc_feature: The sequence is a functional homolog of SEQ ID NO 286 in the 10/225,066 US patent application
  misc_feature: Useful for making plants with modulated biomass
  misc_feature: Useful for biocontainment applications
  misc_feature: The sequence is a functional homolog of SEQ ID NO 1729 in the 11/479,226 US patent application
  misc_feature: The sequence is a functional homolog of SEQ ID NO 328 in the 10/374,780 US patent application
  misc_feature: The sequence is a functional homolog of SEQ ID NO 852 in the 10/225,066 US patent application
  misc_feature: The sequence is a functional homolog of SEQ ID NO 1270 in the 10/374,780 US patent application
  misc_feature: The sequence is a functional homolog of SEQ ID NO 1423 in the 10/412,699 US patent application
  misc_feature: The sequence is a functional homolog of SEQ ID NO 898 in the 10/666,642 US patent application
  misc_feature: Useful for making plants with altered carbohydrate content
  misc_feature: The sequence is a functional homolog of SEQ ID NO 2416 in the 10/374,780 US patent application
  misc_feature: The sequence is a functional homolog of SEQ ID NO 914 in the 10/225,066 US patent application
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: The sequence is a functional homolog of SEQ ID NO 106 in the 10/225,068 US patent application
  misc_feature: The sequence is a functional homolog of SEQ ID NO 2348 in the 10/374,780 US patent application
  misc_feature: The sequence is a functional homolog of SEQ ID NO 340 in the 10/412,699 US patent application
  misc_feature: The sequence is a functional homolog of SEQ ID NO 778 in the 11/479,226 US patent application
  misc_feature: The sequence is a functional homolog of SEQ ID NO 476 in the 10/666,642 US patent application
  misc_feature: The sequence is a functional homolog of SEQ ID NO 2840 in the 10/374,780 US patent application
  misc_feature: The sequence is a functional homolog of SEQ ID NO 450 in the 10/225,066 US patent application
  misc_feature: Useful for making plants with modulated nitrogen use efficiency
  misc_feature: The sequence is a functional homolog of SEQ ID NO 2168 in the 10/374,780 US patent application
  misc_feature: The sequence is a functional homolog of SEQ ID NO 370 in the 10/666,642 US patent application
  misc_feature: The sequence is a functional homolog of SEQ ID NO 492 in the 11/435,388 US patent application
  misc_feature: The sequence is a functional homolog of SEQ ID NO 741 in the 11/479,226 US patent application
  misc_feature: The sequence is a functional homolog of SEQ ID NO 160 in the 10/666,642 US patent application
  misc_feature: The sequence is a functional homolog of SEQ ID NO 634 in the 10/412,699 US patent application
  misc_feature: The sequence is a functional homolog of SEQ ID NO 638 in the 11/435,388 US patent application
  misc_feature: The sequence is a functional homolog of SEQ ID NO 2470 in the 10/374,780 US patent application
  misc_feature: The sequence is a functional homolog of SEQ ID NO 798 in the 10/225,066 US patent application
  misc_feature: The sequence is a functional homolog of SEQ ID NO 194 in the 10/374,780 US patent application
  misc_feature: The sequence is a functional homolog of SEQ ID NO 898 in the 10/225,066 US patent application
  misc_feature: The sequence is a functional homolog of SEQ ID NO 1365 in the 11/479,226 US patent application
  misc_feature: The sequence is a functional homolog of SEQ ID NO 2474 in the 10/374,780 US patent application
  misc_feature: The sequence is a functional homolog of SEQ ID NO 744 in the 10/225,066 US patent application
  misc_feature: The sequence is a functional homolog of SEQ ID NO 240 in the 10/225,068 US patent application
  misc_feature: The sequence is a functional homolog of SEQ ID NO 368 in the 10/374,780 US patent application
  misc_feature: The sequence is a functional homolog of SEQ ID NO 108 in the 10/666,642 US patent application
  misc_feature: The sequence is a functional homolog of SEQ ID NO 332 in the 10/412,699 US patent application
  misc_feature: The sequence is a functional homolog of SEQ ID NO 1196 in the 10/412,699 US patent application
  misc_feature: The sequence is a functional homolog of SEQ ID NO 865 in the 10/374,780 US patent application
  misc_feature: The sequence is a functional homolog of SEQ ID NO 162 in the 10/225,068 US patent application
  misc_feature: The sequence is a functional homolog of SEQ ID NO 2414 in the 10/374,780 US patent application
  misc_feature: The sequence is a functional homolog of SEQ ID NO 428 in the 11/435,388 US patent application
  misc_feature: The sequence is a functional homolog of SEQ ID NO 508 in the 10/412,699 US patent application
  misc_feature: The sequence is a functional homolog of SEQ ID NO 728 in the 10/225,066 US patent application
  misc_feature: The sequence is a functional homolog of SEQ ID NO 854 in the 11/435,388 US patent application
  misc_feature: The sequence is a functional homolog of SEQ ID NO 745 in the 11/479,226 US patent application
  misc_feature: The sequence is a functional homolog of SEQ ID NO 344 in the 10/666,642 US patent application
  misc_feature: The sequence is a functional homolog of SEQ ID NO 582 in the 10/666,642 US patent application
  misc_feature: The sequence is a functional homolog of SEQ ID NO 310 in the 10/666,642 US patent application
  misc_feature: The sequence is a functional homolog of SEQ ID NO 1816 in the 11/479,226 US patent application
  misc_feature: The sequence is a functional homolog of SEQ ID NO 2112 in the 10/374,780 US patent application
  misc_feature: The sequence is a functional homolog of SEQ ID NO 886 in the 10/412,699 US patent application
  misc_feature: The sequence is a functional homolog of SEQ ID NO 1452 in the 10/666,642 US patent application
  misc_feature: The sequence is a functional homolog of SEQ ID NO 158 in the 10/225,066 US patent application
  misc_feature: The sequence is a functional homolog of SEQ ID NO 226 in the 10/666,642 US patent application
  misc_feature: The sequence is a functional homolog of SEQ ID NO 242 in the 10/714,887 US patent application
  misc_feature: The sequence is a functional homolog of SEQ ID NO 242 in the 11/435,388 US patent application
  misc_feature: The sequence is a functional homolog of SEQ ID NO 280 in the 10/374,780 US patent application
  misc_feature: The sequence is a functional homolog of SEQ ID NO 68 in the 10/225,068 US patent application
  misc_feature: The sequence is a functional homolog of SEQ ID NO 142 in the 10/286,264 US patent application
  misc_feature: The sequence is a functional homolog of SEQ ID NO 324 in the 10/412,699 US patent application
  misc_feature: The sequence is a functional homolog of SEQ ID NO 756 in the 11/479,226 US patent application
  misc_feature: The sequence is a functional homolog of SEQ ID NO 1198 in the 10/412,699 US patent application
  misc_feature: The sequence is a functional homolog of SEQ ID NO 867 in the 10/374,780 US patent application
  misc_feature: The sequence is a functional homolog of SEQ ID NO 100 in the 10/374,780 US patent application
  misc_feature: The sequence is a functional homolog of SEQ ID NO 318 in the 10/412,699 US patent application
  misc_feature: The sequence is a functional homolog of SEQ ID NO 749 in the 11/479,226 US patent application
  misc_feature: The sequence is a functional homolog of SEQ ID NO 884 in the 10/225,066 US patent application
MGVPVRRERDAEAELNLPPGFRFHPTDDELVEHYLCRKAAGQRLPVPIIAEVDLYKFDPWDLPERALFGTREWYFFTPRDRKYPNGSRPNRAAGNGYWKATGADKPVAPRGRTLGIKKALVFYAGKAPRGVKTDWIMHEYRLADAGRAAAAKKGSLRVSD

SEQ ID NO: 30417 - DNA, 720 bp, Panicum virgatum
  misc_feature: Ceres CLONE 1900060
  misc_feature: Encodes the peptide sequence at SEQ ID NO. 30418
acaccagcgcaaagcaactcgcataaataaaaaatagaaaaaagaaaacccccgcagccacagaggaagaataatccattcgccttgcttgcgcctcccgtctgcgtgcgatcgacgcagagaaggcgcgggcgctcaacgccaccgccaccctccggctccgatccgatggccttcatgcgctcgcactgtgttgattattctctgcagtcaaatgcatcttccggcatgggagttgctcccaacatcagggagacattcgtcgagcttcagatgaagaaggcattccgatatgttatcttcaaaatcgagaaaaagcaaaagcaggtggttgttgagaagaccggtgctactactgaaagctatgatgactttttggcctccctcccagaaaatgattgcagatacgctctgtatgattttgatttcgtcactggggagaatgtgcagaaaagcaagatatttttcattgcctggtccccatcgacttcccgcattcgtgcaaagatgctgtactccacctccaaggaccgcatcaagcatgagcttgatgggttccactacgagatccaggcaaccgacccatcagaggtggacatcgaagtcctcagggagcgggctcactgaagctggtttacctatgaaggggacctgtggagggccttggaacttcagccagattcaaattctatattcaatgatgctccagccatggtattt

SEQ ID NO: 30418 - protein, 152 aa, Panicum virgatum
  misc_feature: Ceres CLONE 1900060
  misc_feature (25)..(152): Pfam Name: Cofilin_ADF Pfam Description: Cofilin/tropomyosin-type actin-binding protein
  misc_feature: Useful for making plants with modulated time to senescence
MAFMRSHCVDYSLQSNASSGMGVAPNIRETFVELQMKKAFRYVIFKIEKKQKQVVVEKTGATTESYDDFLASLPENDCRYALYDFDFVTGENVQKSKIFFIAWSPSTSRIRAKMLYSTSKDRIKHELDGFHYEIQATDPSEVDIEVLRERAH

SEQ ID NO: 30419 - DNA, 689 bp, Panicum virgatum
  misc_feature: Ceres CLONE 1900069
  misc_feature: Encodes the peptide sequence at SEQ ID NO. 30420
aactgaacagcagcctccatacctgctcctgtagagctagtttggaaacgagagagctaacccagggaggtacgccctggaaagtgaattctgcggcaaatgctctcatcgtctctttcctaggtaacgacttcaaccaagttttccgttcactcgaaaacttggagaaaggtacatcggatcaaaaaggaaacacaccacttttttaccatatttctgggttgccaaaatcatactacaacaggctattacccagagaaagtgtccatctctttcactcctcttccagccttcactggcggtcgcaggtacctgaggtactggaagcaagtagagatgccttgctaaacaaagataacatttacatctcagaggccagtacatcatttgtagtaaagtgcttcagagagcagtttaataaggacttctctaccttcctaaagctgcgtcatgaagaacttgtgtatggagggaaaatggttctaacattttgtggaaggaaggatgaaaatgtatacaatggagatctcaacaaactttttggattacttgctatgtcactgcaatctcttatcacaaagggtcttgtggagagcgaaaagctagactccttcaatttaccattttatgggccatcaatttctgaagtgaagtatatagtaatgcaaagccacatgtttgaaatggat

SEQ ID NO: 30420 - protein, 228 aa, Panicum virgatum
  misc_feature: Ceres CLONE 1900069
  misc_feature (1)..(228): Pfam Name: Methyltransf_7 Pfam Description: SAM dependent carboxyl methyltransferase
  misc_feature: SWISSPROT Homolog: EC 2.1.1.141 Jasmonate O-methyltransferase
LNSSLHTCSCRASLETRELTQGGTPWKVNSAANALIVSFLGNDFNQVFRSLENLEKGTSDQKGNTPLFYHISGLPKSYYNRLLPRESVHLFHSSSSLHWRSQVPEVLEASRDALLNKDNIYISEASTSFVVKCFREQFNKDFSTFLKLRHEELVYGGKMVLTFCGRKDENVYNGDLNKLFGLLAMSLQSLITKGLVESEKLDSFNLPFYGPSISEVKYIVMQSHMFEM

SEQ ID NO: 30421 - DNA, 410 bp, Panicum virgatum
  misc_feature: Ceres CLONE 1900070
  misc_feature: Encodes the peptide sequence at SEQ ID NO. 30422
atccaccaccgcctccaccaccaccgcagcctctcgccggctcgccgcgacgcgcggaaaccctagccccacccgccggcgcccctccccctcctcgctcgccccgtccgttctccggtccggtgagccatggcaagcttcggcgtcgacccccggcccgccgccgcggcctcgagtggtggactgggagggcgctgaaatggcggggtgcagagtcggaggacgaggcttccattgcttgattatgctgttcgacaacaccatccccgtgccggaggtccccgccgccaccgccgccgcgggcgaggctgatactgacatcccgcacagcggccgcaccacgtctgaaccaacatgaccagagaacacccttccggactctactggctcgcctctgcagcatgaggttg

SEQ ID NO: 30422 - protein, 52 aa, Panicum virgatum
  misc_feature: Ceres CLONE 1900070
  misc_feature: The sequence is a functional homolog of SEQ ID NO 1132 in the 10/374,780 US patent application
  misc_feature: The sequence is a functional homolog of SEQ ID NO 1331 in the 10/412,699 US patent application
MAGCRVGGRGFHCLIMLFDNTIPVPEVPAATAAAGEADTDIPHSGRTTSEPT

SEQ ID NO: 30423 - DNA, 1639 bp, Panicum virgatum
  misc_feature: Ceres CLONE 1900095
  misc_feature: Encodes the peptide sequence at SEQ ID NO. 30424
acagagctcctcggaccgcctattcccctgccatcccaccccctcgcgccggcggcgctgggcgccgttctcgccggtggcggggtgggcagacccgtcggctacgcacccgggcggagctggggcactcgccggcgcggcgtagggtcgcgcaagggctgcccgcgacgagctgcggcggcggcaggagaggccagcgcaaggagaacacggcgaggtcgccatggctgcctagaggccgagctccgcccccatcttcaatactccgtccacgagccaaattaatccaattcctcacagggatagcagctccatgacctcctccatcgatcccctaacctagccggccgaatcccccgccgaagagacgtcgtgccgtcacgccatgatcctctagaacaacctacctcgacctctccgctcgtttgacgaggaacgcagagttgccgccgcgggcgctggtggccatgccgatgaatgtcgccggcgcgttcttcctcgtctcgggcgagctccagtcaccgtctacctgtgccaagtgcgtcaccgcgtgtgcctcaaatttctgaacactgtgcatgactgtttacttctttgcaaaggaagagctcaactgcaatttagcagcagtgaaagaagaccttattaagccagttactgttagcttcaaaaagggtcttggtcaaaaattcaggcaaccttcagggacaggaatcgacttttcagtgtttgaggaatctgatttattaaagcagggggacatggatgtatatccacttgctgttaaagctgaaacagcatcagttgatcaaccattggaaggggaagaccaaaagacgaaaactcctaactcacagatcacacaggctgtgtttgagaagaaagaaaatggggagtatcaagtacgagttgtttgtcagatcctatgggtcaatgggactaggtatgaactgcaggaaatatatggaatagggaactccatggaaggtgatgctgatgcaaatgatccagggaaagaatgtgtcatttgcctctcagagccaagggatactactgttctcccttgtaggcatatgtgcatgtgcagtgagtgcgccaaggtcctacggtaccaaaccacccggtgccccatctgcaggcagccagttgagcgtctccttgagatcaaagtcaacaacaaaactgaagatcagcaacagacgccccaatcaccgccgctgccaccgccaaccccgcagcaggaagaggtgtacccatgattttaaaaaaatatcagcgctcaaacactatatgggtctagtttgcagcctccgggctttccctgaatgttgctcttcccatttgagcaacgggggaatgtaatcgatactttacctttagcatatgtaagcttctggcatcgcatggctaggcccggtctccactgtatctggactctggaggtgggagaccgagatggtgccatgaagggtatgtgtaccatatacatcgtgcatgcgtgtgccgtggctacctgaagaagtgtagggaggactcatgccagatcggcttccccgtcagggaaagaaagggaagcgagggcggactctgaatttgtacaaaatgactgtatttcaccttgatgccaagtcttctttcc

SEQ ID NO: 30424 - protein, 226 aa, Panicum virgatum
  misc_feature: Ceres CLONE 1900095
  misc_feature (148)..(186): Pfam Name: zf-C3HC4 Pfam Description: Zinc finger, C3HC4 type (RING finger)
  misc_feature: Useful for biocontainment applications
  misc_feature: Useful for making plants with altered alkaloid content
  misc_feature: Useful for making plants with altered terpenoid content
  misc_feature: Useful for making plants with modulated nitrogen use efficiency
MTVYFFAKEELNCNLAAVKEDLIKPVTVSFKKGLGQKFRQPSGTGIDFSVFEESDLLKQGDMDVYPLAVKAETASVDQPLEGEDQKTKTPNSQITQAVFEKKENGEYQVRVVCQILWVNGTRYELQEIYGIGNSMEGDADANDPGKECVICLSEPRDTTVLPCRHMCMCSECAKVLRYQTTRCPICRQPVERLLEIKVNNKTEDQQQTPQSPPLPPPTPQQEEVYP

SEQ ID NO: 30425 - DNA, 689 bp, Panicum virgatum
  misc_feature: Ceres CLONE 1900096
  misc_feature: Encodes the peptide sequence at SEQ ID NO. 30426
acagtcctggacccgactcttccagaaggggcagcaagaacaggccacagaaagaacaatcccagcaatggcagcaaggtgtgctctttctgccccatccagcgtggttcgccaacccctctacggcaacaagctcgccaagaatctcactccatgcctgccgtcgccaagagccgtgagggtgagagtgaatgctgcaaagcttcctccaggggttgaggtgcccagggtgcagccgaagctgagcgagcccttcttggggttcacccagactgccgagatctggaactccagggcctgcatgatgggcctcatcggcaccttcatcgtggagctggtgctgaacaaggggattcttcagataattggggtggaggtggggaagggcctcgaccttcctctttaattgccattggcaaagctgattgcaagccttactctctctctctctctcttttgaaacctaggagtacctattatattgctctaaacattattctgtcgaatatagatactcatgcaattctgttgcgtaacatccccaagcataccaatacaacaagaaaggaatccccaatggctcatcgcgtcctcctcctcctctccctcgccgcggcggccgcagtagccgccgccaccgccgaagccgaggaccccctgatccgccaggtggtgcccggcggcgacga

SEQ ID NO: 30426 - protein, 112 aa, Panicum virgatum; identical to SEQ ID NO: 9912
  misc_feature: Ceres CLONE 1900096
  misc_feature: SWISSPROT Homolog: EC 4.99.1.1 Ferrochelatase

SEQ ID NO: 30427 - DNA, 749 bp, Panicum virgatum
  misc_feature: Ceres CLONE 1900101
  misc_feature: Encodes the peptide sequence at SEQ ID NO. 30428
tctatgtaaccaatcaaccaagggaaagcaaatgcacatggccaggagctccggccactgctctccacggcgcgccgccgcgacggcgctggtgctcgcgaccgccgggcttctcctgctgctgccgccgccggcacgcgggtcggcgcccgagcagcagcagaatgccgaccgcatcctggggctgccggggcagcccaacggtgtggcgttcgacatgtacggcggctacgtcaccgtcgacgagcaggccggccgcgcgctctactactggttccaggaggccgaccagccggaggcagcgccgctcctcctgtggctgaacggcgggcccgggtgctcctccatcggtggcggcgcgctggaggagctcggcgcctttcgcgtccacaccgacggccagacgctcctgctcaacgagtacgcatggaacaaagcggcgaacgtgctcttcttggagtcgccggccggcgtggggttctcttacagcaacaccagctccgacctcgtcgtcggcgacgacagaacggctcaggacgcgtacattttcctggtgaaatggttcgagagatttcctcagtacaagtaccgtgatttctacattgcgggagagagctacgcaggtcactatgttccacagctgtcccagcttgtgtacaagaacaacatcggtgtagagaagcctgatatcaacttcaaaggattcatggtcggaaacggcgtgaccgacgaccgcatcgacactatcg

SEQ ID NO: 30428 - protein, 237 aa, Panicum virgatum
  misc_feature: Ceres CLONE 1900101
  misc_feature (51)..(237): Pfam Name: Peptidase_S10 Pfam Description: Serine carboxypeptidase
  misc_feature: SWISSPROT Homolog: EC 3.4.16.6 Carboxypeptidase D
MARSSGHCSPRRAAATALVLATAGLLLLLPPPARGSAPEQQQNADRILGLPGQPNGVAFDMYGGYVTVDEQAGRALYYWFQEADQPEAAPLLLWLNGGPGCSSIGGGALEELGAFRVHTDGQTLLLNEYAWNKAANVLFLESPAGVGFSYSNTSSDLVVGDDRTAQDAYIFLVKWFERFPQYKYRDFYIAGESYAGHYVPQLSQLVYKNNIGVEKPDINFKGFMVGNGVTDDRIDTI

SEQ ID NO: 30429 - DNA, 685 bp, Panicum virgatum
  misc_feature: Ceres CLONE 1900110
  misc_feature: Encodes the peptide sequence at SEQ ID NO. 30430
agagacgaccaggcatttcgcgctccgcggcctatccagcactctccagcagacaccacacacacgccgagacacgcgaacgcaaaggaacgccacgaggatggcatccgtggtcgcgttctcgcggttgccgccgctcctcctgctgctcctcctggcgacggcgtcacgggcgctcaagatcggcgacctgctcgggacgcccccagcggtaagacgacagcgggggaaccaagtctgaatttttgtgtgcgggatttcttttgcagctatcggtttccgtcgtccgccatggactcgtttgctttgcgcaggggagccaggactgtagccggacatgcgaatcctcgttctgcgtagtcccgccgctgctgaggtacgggaagtactgcgggatcatgtacagcggctgccccggcgagaagccctgcgacgccctcgacgcctgctgcatggtccacgaccactgcgtcgacacccacaacaatgactacctgaacacgcggtgcaacgagaacctgctgagctgcctggaccgggtgagcccggcggggccgacgttcccggggaacgagtgcgacgtcggccagacggcgtccgtcatacgcggggtcatcgagacggccgtgctcgccgggaagatcctgcacaagcgcgacgacgggcagtagccgccgtcccagcc

SEQ ID NO: 30430 - protein, 90 aa, Panicum virgatum
  misc_feature: Ceres CLONE 1900110
  misc_feature: SWISSPROT Homolog: EC 3.1.1.4 Phospholipase A(2)
MYSGCPGEKPCDALDACCMVHDHCVDTHNNDYLNTRCNENLLSCLDRVSPAGPTFPGNECDVGQTASVIRGVIETAVLAGKILHKRDDGQ

SEQ ID NO: 30431 - DNA, 625 bp, Panicum virgatum
  misc_feature: Ceres CLONE 1900115-R
  misc_feature: Encodes the peptide sequence at SEQ ID NO. 30432
tccggcagctcttcaccgacgaacagctggcggcgctgagcagggacatcgacccggccgccacgtccccgctcgactactacccgctgccgaggaaaggcgagaggttcccggtcgccgaccccgacatggcgccgaggttgcagccgcgccccgacagcgacgccgagtacctgcacggcattctggaatcgatcgcgcgaattgaggccaaggggtacaatctgctgagggagctcggcgcgacggcggtggaggaggtgttcacggcggggggaggagcgcagaacgacaagtggacggcgattcgggggagggtgctcggcgtgccggtgcggaaggcggagcagaccgaggcggcgtacggagcggcgttgctggcgctcaagggcgccgatcgccgagaaggagcaatggctagctagagcagatgctaaagaaatttgggcaagcacggcgctaagatctggacaagctacgatgaattgtgtacgtgacgcatgcttgaacattcttccggacagatttctggtgccaagaggagaagggcacatgatatcttcagtaaggccagctttagcctcgaaccttttgtcaagctgcagattagagttcatttggatcc

SEQ ID NO: 30432 - protein, 140 aa, Panicum virgatum
  misc_feature: Ceres CLONE 1900115-R
  misc_feature: SWISSPROT Homolog: EC 2.7.1.17 Xylulokinase
RQLFTDEQLAALSRDIDPAATSPLDYYPLPRKGERFPVADPDMAPRLQPRPDSDAEYLHGILESIARIEAKGYNLLRELGATAVEEVFTAGGGAQNDKWTAIRGRVLGVPVRKAEQTEAAYGAALLALKGADRREGAMAS

SEQ ID NO: 30433 - DNA, 685 bp, Panicum virgatum
  misc_feature: Ceres CLONE 1900115
aaaaaaaaaaaagaatcacctcctcctgcatcgcatcacaccccatggtgccagctctcactctctccgtggagccgttggctcaccgtcaccaccaccctgcaagacgagggttccggagagttcagggccgcgcggtaacaccgagggcaaggatcacgatgctcagccggcaggatccgcgaggaggtggtggtgccgccaccggcgcgcctctgttcctcgggatagacttcggaacatccggggcaagatacgctctgattgacaggcaaggcgccatccattccgaagggaaacgagcttacgcaccacctgtcggcggcggcgccgcgggctgggcgagctcctggcgggaggcgctgttccagctcctcggcgacatcccgcgggcgcaccgcccgtccatctcctccatctccattgacgggacctcggcgaccacgctcatcgtcgacagcgagaccggagagctcctcgccggcccgttcctctacaacgagagcttcccggacgcgctgcctgccgtggagtcgatcgcgccggcgaaccacacggtctgctccgcctcctccaccctctgcaagctcgtctcgtggtggaacacgaccggcggcggcgccggctcggccgtgctgatgcaccagtccgactggctcctctggctcctgcacggccggtacgg

SEQ ID NO: 30434 - DNA, 1947 bp, Panicum virgatum
  misc_feature: Ceres CLONE 1900121
  misc_feature: Encodes the peptide sequence at SEQ ID NO. 30435
gcacacacacacacaagtacacaactcgtaggcagcgagcgtctcccctctgccccccgcaggaagagagagcgagatcgccgtctctcttcgtcggtggtgcgggtgcccgccctccccgagcgagatctccctgcagttcctcgagatctggttacagatctagctgtcaagatggtgaagatctgctgcatcggtgctggctatgtcggtggcccgaccatggccgtcattgccctcaagtgcccagacattgaggtcgtcgtcgttgacatctccaagccccgcattgaggcctggaacagtgacaccctccccatctacgagcctggtctcgatgatgttgtgaagcagtgcaggggcaagaacctcttcttcagcactgatgttgagaagcacgtcgctgaggctgacatcatctttgtctcggtgaacacccccaccaagacccgtggtcttggagctggcaaggctgccgacctcacctactgggagagtgctgctcgcatgatcgctgatgtctccaagtctgacaagatcgttgttgagaagtccactgtccctgtcaagactgctgaggctattgagaagatcttgacccacaacagcaagggcatcaactaccagatcctctccaacccggagttccttgcagagggcactgctattgaggacctgttcaagcctgacagagtgctcattggtggccgggagacccctgagggcaggaaggctgtccaggccctcaaggatgtgtacgctcactgggttcctgaggacaggatcctcaccaccaacctgtggtctgctgagctctccaagcttgctgccaatgcattcttggcgcagaggatctcctctgtgaatgccatctccgcgctctgcgaggccactggtgccaatgtgtccgaggtggcgtatgccgtgggcaaggacaccaggatcggccccaagttcttgaatgccagtgttgggttcggtggatcctgcttccagaaggacatcctgaacttggtgtacatctgcgagtgcaatggcctgcccgaggtggcgaactactggaagcaggtgatcaagatcaacgactaccagaagagccggttcgtgaaccgcgtggtgtcgtccatgttcaacaccgtcgcaggcaagaagatcgcagtcctcggctttgccttcaagaaggacaccggtgacaccagggagacccccgccatcgatgtctgcaagggcctgctgggtgacaaggcccagatcagcatctacgacccccaggtgacggaggaccagatccagcgggacctggccatgaacaagttcgactgggaccacccgatgcacctgcagccgacgagccccacggccgtgaagcaggtgagctgcgtctgggacgcgtacgaggccaccaagggcgcccacggtctgtgcatcctgaccgagtgggacgagttcaagaccctggactaccagaagatcttcgacaacatgcagaagccggccttcgtgttcgacgggcgcaacatcatcgaccccgagaagctgagggagatcggcttcatcgtctactccatcggcaagccgctcgacgcctggctcaaggacatgcccgccgtcgcttaagtccccggagagagctgcagcctgcaggagttggattcgaggaaggaagaggaactggttgaccattctttattatagtttgtttttgcaggagacgccacgattttctattcggtcaggcataaaagttggacggtgctgctagtaatctgtgtttcgtgttttcaatgttggaggacgtctgtagatgtaagatcctcgggcgcttgtgctctctgctttgaggaaatttccttgtaccccccatggacctgctatagtcggttgattcatcaattgtattcctataaaagttactacagaatcaatgttctcttcttattttcgcag

SEQ ID NO: 30435 - protein, 480 aa, Panicum virgatum
  misc_feature: Ceres CLONE 1900121
  misc_feature (2)..(200): Pfam Name: UDPG_MGDP_dh_N Pfam Description: UDP-glucose/GDP-mannose dehydrogenase family, NAD binding domain
  misc_feature (209)..(306): Pfam Name: UDPG_MGDP_dh Pfam Description: UDP-glucose/GDP-mannose dehydrogenase family, central domain
  misc_feature (328)..(452): Pfam Name: UDPG_MGDP_dh_C Pfam Description: UDP-glucose/GDP-mannose dehydrogenase family, UDP binding domain
  misc_feature: SWISSPROT Homolog: EC 1.1.1.22 UDP-glucose 6-dehydrogenase
  misc_feature: Useful for making plants with altered carbohydrate content
  misc_feature: Useful for making plants with altered cell wall content and/or composition
MVKICCIGAGYVGGPTMAVIALKCPDIEVVVVDISKPRIEAWNSDTLPIYEPGLDDVVKQCRGKNLFFSTDVEKHVAEADIIFVSVNTPTKTRGLGAGKAADLTYWESAARMIADVSKSDKIVVEKSTVPVKTAEAIEKILTHNSKGINYQILSNPEFLAEGTAIEDLFKPDRVLIGGRETPEGRKAVQALKDVYAHWVPEDRILTTNLWSAELSKLAANAFLAQRISSVNAISALCEATGANVSEVAYAVGKDTRIGPKFLNASVGFGGSCFQKDILNLVYICECNGLPEVANYWKQVIKINDYQKSRFVNRVVSSMFNTVAGKKIAVLGFAFKKDTGDTRETPAIDVCKGLLGDKAQISIYDPQVTEDQIQRDLAMNKFDWDHPMHLQPTSPTAVKQVSCVWDAYEATKGAHGLCILTEWDEFKTLDYQKIFDNMQKPAFVFDGRNIIDPEKLREIGFIVYSIGKPLDAWLKDMPAVA

SEQ ID NO: 30436 - DNA, 738 bp, Panicum virgatum
  misc_feature: Ceres CLONE 1900129
  misc_feature: Encodes the peptide sequence at SEQ ID NO. 30437
agaactgcagcctgcagtcggccggttctcgccacctctcgcacctccactgagcgcaccagccgcccccatcctcctctccctcccccggcgcaggctgagcacgcggatctctcgggcagcggaggcaaggcgcggcggcggcggcggccctcgaagcggcgcccccgggtggggcctcgcaggcggcggggagggaggcggaggcggagatgagccgggggcggtcgccggagccattggatttcttcatctggactgtgcaggatgtgggtttatggttggaggaaataaatctcggaagctatcgccagtcatttgaagaaaatggtgtgaatggagagtatctagaaagcctgtcgatgttcaccacagagcagattcttcgattcataagacggtgtcatatgaaatggggagattttattacgctctgtaaagagttgaggcgcatcaaaggttcaaatttctgctgcctactgctattcttgcactttagaaagagttcacataggcatatttctattccatgactcccatcacagttcaaggtttctccagtttcctttttagttagcatataatgcgacacgcgtcaagcagctaaaaaagtaatttcccccaatgcatacttctttatcttcgtcaatttaaatacctaagtagtgaaaatgcccctgtaaatgtctaagcagcccaattaccagccatatatttcttgagtgagaacacctctgt

SEQ ID NO: 30437 - protein, 106 aa, Panicum virgatum
  misc_feature: Ceres CLONE 1900129
  misc_feature: SWISSPROT Homolog: EC 2.7.10.2 Non-specific protein-tyrosine kinase
MSRGRSPEPLDFFIWTVQDVGLWLEEINLGSYRQSFEENGVNGEYLESLSMFTTEQILRFIRRCHMKWGDFITLCKELRRIKGSNFCCLLLFLHFRKSSHRHISIP

SEQ ID NO: 30438 - DNA, 1417 bp, Panicum virgatum
  misc_feature: Ceres CLONE 1900133
  misc_feature: Encodes the peptide sequence at SEQ ID NO. 30439
gaggctcctctgccctccgcaccccacacacgcctccctcgcgtcgcgtcgaggctccgcgcggccaggaacagctgctgctccttcggaagacgtcgaggacagcggcggccggcgcttcttctcatagtttgaaggcaacaccttcaccggtaaggcaatagcataatactggccggccttcttcctggtgtgatctatctttgcagaaaccaataattaagtttcattaatgggctcctcaagtcatcaaaaaggcagaatgtgtaccaaaaagcccttgggaattcaactttttgagtgtgtccagggaagtcctatctccttcagatcatgccaggctcttgtattagtattgacgttcttatcatatgccagctaccatgccactagaaaaactacaagcattgttaagagtgttcttgatcctaagacaaacctaggtatattgcactggcccagtcatctctatcttcaaaatttgaaaggctctgagaacaatacactctctagtggctgggctccattcaacgccaaagatggtactgcattgcttggcgagattgacttggcttttcttggtgtatatgcaattggcatgttctttgctgggcatttgggcgaccgggtggatctgaggatccttctcactattggaatgataggaactggattgttcactgctgcttttggagccggctactggttcaatatacacagcttctactactttctgggcatgcagatgatggctggcctgtttcagtcatctggatggccttcagtagttgcagtggttggcaattggtttgggaagagcaagagggggctgataatgggaatttggaatgctcacacatctgtaggaaacatatctggctctctgattgctgctgcaatgttgaagtatggatggtcctggtcctttgctgtgcccggtatcatgatcgcactagtcgggctcacggtgttcctgttgttgcctgttaatcctgatgtgattggaattcaggaggatctccatttgaaggactctgaaaagactgacatggacacccctttgttggagcggcgctcagaagcaaaagagaaggcagttggatttattgaggcctggagaattcctggtgtagctcctttcgctctctgccttttcttctgcaagcttgtggcctatacgttcctgtattggcttcccttttatatcagccacacagccattggcggtcaatacttgtcagactcctcggccggcgtgttgtcaacgctgttcgatgtgggtggcgttgtaggcggcatcctcgccggccatatctccgaccacctcgacgcccgggcgctgacggccgcgagcttcaccttctccgcgatcccggcgctcttcttctaccgcatctacgggagcgtctcgctgacg

SEQ ID NO: 30439 - protein, 394 aa, Panicum virgatum
  misc_feature: Ceres CLONE 1900133
  misc_feature (39)..(394): Pfam Name: MFS_1 Pfam Description: Major Facilitator Superfamily
MGSSSHQKGRMCTKKPLGIQLFECVQGSPISFRSCQALVLVLTFLSYASYHATRKTTSIVKSVLDPKTNLGILHWPSHLYLQNLKGSENNTLSSGWAPFNAKDGTALLGEIDLAFLGVYAIGMFFAGHLGDRVDLRILLTIGMIGTGLFTAAFGAGYWFNIHSFYYFLGMQMMAGLFQSSGWPSVVAVVGNWFGKSKRGLIMGIWNAHTSVGNISGSLIAAAMLKYGWSWSFAVPGIMIALVGLTVFLLLPVNPDVIGIQEDLHLKDSEKTDMDTPLLERRSEAKEKAVGFIEAWRIPGVAPFALCLFFCKLVAYTFLYWLPFYISHTAIGGQYLSDSSAGVLSTLFDVGGVVGGILAGHISDHLDARALTAASFTFSAIPALFFYRIYGSVSL

SEQ ID NO: 30440 - DNA, 555 bp, Panicum virgatum
  misc_feature: Ceres CLONE 1900133-R
tgctcatgttcatcacggggatgctggtgaacggcccctacgcgctgatcacgacggccgtgtccgcggacctcggcacgcacagctccctgaacggcaactcccgggcgctggccaccgtgacggccatcatcgacggcacgggctccatcggcgcggcggtgggcccgctgctgacgaggtacatctccgccaggagctggagcgccgtgttcacgatgctgatggcgtcggcgctcgtcgcggggctgctgctgacgaggctggtggtggcggaggtggtcgccaagatggagtcccggagggcgcccgcccacactgccggcgacctgcccgtgtccaccaccatcatggatgaaccttaggctgtcgtggagactgggagagcagaccacctctggtttgacaagaactgtgggatcttgctcatggtcggtgtgtcgtggttgttgtgcgtcatggtatatgtatatggaatgactggctgtggtcggcgatgaggatgaaatgtggtcgggctgcagcgcggggagtttgcatctcttctgctccccc

SEQ ID NO: 30441 - DNA, 712 bp, Panicum virgatum
  misc_feature: Ceres CLONE 1900135
  misc_feature: Encodes the peptide sequence at SEQ ID NO. 30442
gcgatacagagaggctgaggagaggcaccctctcaagcctcaaggcttcacgagacctcccctctgctgccatctcctctcctctgctgctgtgtgtgtgtgcaagaaaccccaagggagaggtgagagcaagaggctaggcttcctcgacggagatgggggcgcagaggtacaggttcttcttctgcgggtgcggcgccaatgcggcggccggcgaccgtgagggcgacgacgacggggatttcggcgcgttcggggagaaggccgagaagggggcggaagccggcccgcgggggctgtcgtgggcgcaggtggaggcgatgaccggcgggttcacctccgccgtggtcggcgagggcgggttcagcaccgtgtacctggcgcgcctctccggcgcgctcgccgccgtcaaggtccaccgcagcagcgagcgcctccaccgcgtgttccgccaggagctcgacgcgctccagcgcgtccggcacccgcacatcgtccgcctcctcgccttctgcgagcagcaagaggaaggcgtgctggtgctcgaattcgcggcgaacgggaacctgcacgagcggctccacggcgggggcaaggcggcgggggctatgccgtgggcgcggcggatgtcggtggcgctgcaggtggcgcgggcgctcgagtacctgcacgaccagtgcgagccgcaggtggtgcacggcgacgtcaaagc

SEQ ID NO: 30442 - protein, 185 aa, Panicum virgatum
  misc_feature: Ceres CLONE 1900135
  misc_feature (61)..(184): Pfam Name: Pkinase_Tyr Pfam Description: Protein tyrosine kinase
  misc_feature: SWISSPROT Homolog: EC 2.7.11.1 Non-specific serine/threonine protein kinase
MGAQRYRFFFCGCGANAAAGDREGDDDGDFGAFGEKAEKGAEAGPRGLSWAQVEAMTGGFTSAVVGEGGFSTVYLARLSGALAAVKVHRSSERLHRVFRQELDALQRVRHPHIVRLLAFCEQQEEGVLVLEFAANGNLHERLHGGGKAAGAMPWARRMSVALQVARALEYLHDQCEPQVVHGDVK

SEQ ID NO: 30443 - DNA, 745 bp, Panicum virgatum
  misc_feature: Ceres CLONE 1900147
  misc_feature: Encodes the peptide sequence at SEQ ID NO. 30444
aacccaaaccacttgcccgccgatccgtgctctccgcatcagcacgccagcgccaagaccgtgcagcggctgacgcgactccacacacacacacgatggccacctcaggccacgccgtggtcgacatcgacgagaccggcggcggccaggccatgcggccggcgctcccgccggtcccgtacgtcctcaacttcgccgacctgtcttacagcgtcaagaaggacggcggcctgggctgcctcccgtcgcggcccagcaaccgcctcgcgtccgcggacgcgccgccggccggctcgtccggcaacacaaagacgctgctcgacggcatctccggggaggcgcgggagggcgagctgttcgccgtcatgggcgccagcggctccggcaagtccacgctggtggacgcgctggcggggcggatcgcgcgggagagcctccgggggaccgtcacgctcaacggggagccgctccacggccgccggctccgcgccatctccgcctacgtcatgcaggacgacctgctgtacccgatgctgacggtccgcgagacgctgctcttcgccgccgagttccgcctcccgcgcgcgctgccccaggacaggaagcgcgcgcgcgtcgacgcgctcatcgaccagctcgggctgtcccgggccgcggacaccatcatcggcgacgagggccaccgcggggtgtccggcggcgagcgccgccgcgtgtccatcgggacggacatcatccacgaccc

SEQ ID NO: 30444 - protein, 216 aa, Panicum virgatum
  misc_feature: Ceres CLONE 1900147
  misc_feature (85)..(216): Pfam Name: ABC_tran Pfam Description: ABC transporter
  misc_feature: SWISSPROT Homolog: EC 3.6.3.25 Sulfate-transporting ATPase
MATSGHAVVDIDETGGGQAMRPALPPVPYVLNFADLSYSVKKDGGLGCLPSRPSNRLASADAPPAGSSGNTKTLLDGISGEAREGELFAVMGASGSGKSTLVDALAGRIARESLRGTVTLNGEPLHGRRLRAISAYVMQDDLLYPMLTVRETLLFAAEFRLPRALPQDRKRARVDALIDQLGLSRAADTIIGDEGHRGVSGGERRRVSIGTDIIHD

SEQ ID NO: 30445 - DNA, 2288 bp, Panicum virgatum
  misc_feature: Ceres CLONE 1900157
  misc_feature: Encodes the peptide sequence at SEQ ID NO. 30446
aaaacaccaaccacccgcccgccaagaacagcagaacgcaacagaacacagtaacgaacagggcagcaagcagagcaaggggaatggggatcctcctctccccctgctatttttcgcccctcgtgagatggcgccgcccggggggtgaaatgacctgatcgagcgcgccgggcctgaccccgctgctgctgctcggcgtcgtgcgtgacgggagcgggaggggggcggagccgcgacgccgttgcggctgcggttgcggcttcctccttctctcatccccccgcccggagccgcggcagcggaggacccgcacccgcacggcctcgagagtttgatcgtctcgtggcgcgccatgtcgtctaattctccgaccagcccgccggcggctccgtcgccgacgaagagcagacttgctccttcggacgccccgccgccgtcagcggactcgccgtccccaccgtcgccgccggtggcttcgtcctcgccgacgccaccagagcgcagcggctcctcgccgccgccgaggtcccggggctctgcgatctcgccggccaagacccactctccatctcctccaccaccaccaccagagcaatcgtctagaggctcacatggcggtggcagtccgccgccgccaccggtttccacgcaccgtggcggtcccaccatggtggaagtcgttttcgccgctgccggcgccgcggcgctcctcgtcatcctcatcgccgcctgcgtctgctgctcgaggaggacggcgccgaggaggaggaagagaccccacaatcccatgcattactacgccgacacgtcatcagcgtataaagggagcagcacgtacgacacaacgagtgggccgcagcagcaatggcagagcgacgctggccaggcgacgccgatgagcagcttcggcccgccggggggtggctggcacgcgccgccgcccgacatgacctccggtgtgtactccagctcgccgcggccgccgccttcaccacacgaggcgctggggctcagcaagggcaccttcacctacgagcagctggcggcggccacagccaacttctcgccggcgaacctgctcgggcagggcgggttcgggtacgtgcacaagggcgtgctccccggcggcagggcggtggccgtgaagcagctcaagtccgggagcgggcaaggggagcgcgagttccaggccgaggtggacatcatcagccgggtgcaccaccggcacctcgtgtccctcgtcggctactgcatcgccggcgcgcggcgcatgctcgtctacgagttcgtgcccaacaggaccctcgagttccacctccacgggaaagggcagccggtgatggagtggccgacgagactccgcatcgcgctgggggcggcgaatggactcgcctacctgcacgaagactgccatcctcggatcattcaccgcgacatcaagtccgccaacattcttctcgacaacaacttcgaagcaatggtcgcggacttcgggctggccaagctgacctccgacagcagcacgcacgtctcgacccgcgtcatgggcacgttcgggtacctggcgccggagtacgcgtcgagcgggaagctgacggagaagtcggacgtcttctcctacggcgtgatgctgctggagctcctcacggggcggcggcccgtcgacggcggcaccgccgtcagctcgttcctcgaggacagcctcgtcgactgggcgaggccggccctgtcgcgcgcgctggccgacggcgactacgacggcgtcgcggacccgaggctgcacggcagctacgaccccgtggagatggcgcggctggtcgccagcgccgcggccgccgtgcgccactcggccaagaagcgccccaagatgagccagatcgtgagggcgctggagggggacatgtcgctggaggacctgaacgagggggtgcggcccgggcagagcatggcgttcggcacggcggcgtcagcgccctcgtacaaggccaacagggctcccgggcagtacacgtcggacatggagcggatcaggcaggcgccgatggcgatcggagagtccagtggcggcgcggtcaccgggttcggccgtccctcgccgatcgggatcgaggggcccttcgacgacgacgatttgagtccggtgaagggtccgccgcgccggtagcaggctagcagccgtgaacgccagtgctgtcggaccgttgcgattcatgctcgccgcgcctgttgttgattgcgcgatcgtcctgctctggcgtctgtgaatagcttgcctcttctttgccacc

SEQ ID NO: 30446 - protein, 603 aa, Panicum virgatum
  misc_feature: Ceres CLONE 1900157
  misc_feature (237)..(513): Pfam Name: Pkinase_Tyr Pfam Description: Protein tyrosine kinase
  misc_feature: SWISSPROT Homolog: EC 2.7.11.1 Non-specific serine/threonine protein kinase
MSSNSPTSPPAAPSPTKSRLAPSDAPPPSADSPSPPSPPVASSSPTPPERSGSSPPPRSRGSAISPAKTHSPSPPPPPPEQSSRGSHGGGSPPPPPVSTHRGGPTMVEVVFAAAGAAALLVILIAACVCCSRRTAPRRRKRPHNPMHYYADTSSAYKGSSTYDTTSGPQQQWQSDAGQATPMSSFGPPGGGWHAPPPDMTSGVYSSSPRPPPSPHEALGLSKGTFTYEQLAAATANFSPANLLGQGGFGYVHKGVLPGGRAVAVKQLKSGSGQGEREFQAEVDIISRVHHRHLVSLVGYCIAGARRMLVYEFVPNRTLEFHLHGKGQPVMEWPTRLRIALGAANGLAYLHEDCHPRIIHRDIKSANILLDNNFEAMVADFGLAKLTSDSSTHVSTRVMGTFGYLAPEYASSGKLTEKSDVFSYGVMLLELLTGRRPVDGGTAVSSFLEDSLVDWARPALSRALADGDYDGVADPRLHGSYDPVEMARLVASAAAAVRHSAKKRPKMSQIVRALEGDMSLEDLNEGVRPGQSMAFGTAASAPSYKANRAPGQYTSDMERIRQAPMAIGESSGGAVTGFGRPSPIGIEGPFDDDDLSPVKGPPRR

SEQ ID NO: 30447 - DNA, 701 bp, Panicum virgatum
  misc_feature: Ceres CLONE 1900161
  misc_feature: Encodes the peptide sequence at SEQ ID NO. 30448
aaaaaaccccaccccacagaagccgccgccgccgcagaccgatccgaggcgagcacgcaagcggcgagtcgccgacgctccttgagatcttcggcgagccgtgactgagacatctgctgccgtccgccgagcagtttaatcttcacctgcagccatgggtaaggagaagtcccacatcaacatcgtggtcattggccacgtcgactccggcaagtcgaccaccaccggccacctgatctacaagcttggaggcatcgacaagcgtgtgatcgagaggttcgagaaggaggctgcggagatgaacaagaggtccttcaagtacgcgtgggtgcttgacaagctcaaggccgagcgtgagagaggtatcaccattgatatcgccctgtggaagttcgagaccaccaagtactactgcacggtcattgatgcccctggacaccgtgacttcatcaagaacatgatcacgggtacctcccaggctgattgcgctgtccttattattgactccaccactggtggttttgaggctggtatctccaaggatggccagacccgtgagcatgctctccttgctttcactcttggagtcaagcagatgatctgctgctgcaacaagatggatgccaccactcccaagtactccaaggcccgttatgatgagattgttaaggaagtctcctcctacctgaagaaggttggct

SEQ ID NO: 30448 - protein, 182 aa, Panicum virgatum
  misc_feature: Ceres CLONE 1900161
  misc_feature (5)..(182): Pfam Name: GTP_EFTU Pfam Description: Elongation factor Tu GTP binding domain
  misc_feature: SWISSPROT Homolog: EC 2.7.7.4 Sulfate adenylyltransferase
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVG

SEQ ID NO: 30449 - DNA, 1399 bp, Panicum virgatum
  misc_feature: Ceres CLONE 1900176
  misc_feature: Encodes the peptide sequence at SEQ ID NO. 30450
cgccccgagacagccgctcctccgccggcgtcctccacccacctcctcgcggctcgcggtgccggccatcccacccggaactcccccgaccactggcacctcgcgcgccacggccccccgaccactgccaccgccgcctttgactcgttgaccgacaagtgtgagcgccgcccgccatggacgcgcgccgcaaggtggggcagcagggggcggccggccgcgccgcggcggcccggctgccgagggtgcaggccggggacgcgctgcctctgccgatccggcacaccaacctcatcttctcggccctgttcgcggtgtcgctcgcctacctgatgcgccggtggcgcgagaagatccgcagctccacgccgctccacgccgtggggctcgccgagatgctcgccatcttcggcctcatcgcctcgctcatctacctcctcagcttcttcggcatcgccttcgtgcagtctatcgtctcctccagcgacgaggacgaggacttcctgggcgtcggggccggggctccgcctcccaccgcggcgccgcccgcccgccagttgccggccccgtgcgcgctgctggggagccccgccgccgcgcccgagaaaatgccggaggaggacgaggagatcgtcgccgaggtcgtcgccgggaagatcccgtcctacgtgctcgagaccaggctcggggactgccgccgcgccgccgggatccggcgcgaggcgctgcgcaggatcacggggagggagatcgaggggctcccgctcgacggcttcgactacgcctccatcctcggccagtgctgcgagctgccggtcgggtacgtgcagctgcccgtgggcatcgccgggccgctcctgctcgacggccagaggtactacgtgcccatggccaccaccgaggggtgcctcgtcgccagcaccaaccgcggatgcaaggccatcgcggagtctggcggcgccaccagcgtcgtgctccgcgacgggatgacccgcgctcccgtcgcccgcctccccaccgcgcgccgcgccgccgaggtcagggcattccttgaggatcctgacaattttgaaacgctctccatgattttcaacaggtcaagcaggttcgctaggctgcagggggtgcagtgcgcgatggcaggcaggaacctgtacatgagattcacctgcagcacaggggacgccatgggtatgaacatgatctcaaagggcgtgcaaaatgtgctggatttccttcaggatgacttccctgacatggatgtcattagcatctcaggtaacttttgctctgacaagaagcccgctgctgtgaattggatcgaagggcgtgggaagtctgtggtttgtgaggcggttatcaaggaggaagtggtgaaaaaggttctaaaaaccgatgt

SEQ ID NO: 30450 - protein, 407 aa, Panicum virgatum
  misc_feature: Ceres CLONE 1900176
  misc_feature (160)..(407): Pfam Name: HMG-CoA_red Pfam Description: Hydroxymethylglutaryl-coenzyme A reductase
  misc_feature: SWISSPROT Homolog: EC 1.1.1.34 Hydroxymethylglutaryl-CoA reductase (NADPH)
MDARRKVGQQGAAGRAAAARLPRVQAGDALPLPIRHTNLIFSALFAVSLAYLMRRWREKIRSSTPLHAVGLAEMLAIFGLIASLIYLLSFFGIAFVQSIVSSSDEDEDFLGVGAGAPPPTAAPPARQLPAPCALLGSPAAAPEKMPEEDEEIVAEVVAGKIPSYVLETRLGDCRRAAGIRREALRRITGREIEGLPLDGFDYASILGQCCELPVGYVQLPVGIAGPLLLDGQRYYVPMATTEGCLVASTNRGCKAIAESGGATSVVLRDGMTRAPVARLPTARRAAEVRAFLEDPDNFETLSMIFNRSSRFARLQGVQCAMAGRNLYMRFTCSTGDAMGMNMISKGVQNVLDFLQDDFPDMDVISISGNFCSDKKPAAVNWIEGRGKSVVCEAVIKEEVVKKVLKTD

SEQ ID NO: 30451 - DNA, 691 bp, Panicum virgatum
  misc_feature: Ceres CLONE 1900176-R
gatcaaacgcgaggctgctggccaccgtggtggccggcggggttctcgccggggagctatccctcctgtccgcgctcgccgccggccagctcgtgaagagccacatgaagtacaacagatccagcaaggacatgtccaagatcgtgccttgatcctggatttggatcgtcgcaggggaaaaatgaacggacccggatagtgaaaatgccgtggaataagtttttcatgtccggtggaagcgcagaggtggggttggattggagggactgggcatggacaggactgaggttgtttaacacctggtcactttaccaagagccaaaagaagaattcatcatcgacatcaagtgagctgcgaacagtgtgcatcagcgaaaccgtcaagattgtgaattggccaggtccttgttcaggagctgacccattgcttttttttttatgccggccgtggccggcccctccaactcggtcatgaaaccctgccgccgccgtcccctgcgcgctgaccaccggagaagcgagctaaccaacctcctctgtgtttcgtgttcataaaaggtttttttccccctcttctcgttgtttgatccgttttcgcaaccgaatgctgtcgagaatccggtgatgtggctgtaaaataaaataaaaataataataaaaaacgtggccactgggcactggcctacccctc

SEQ ID NO: 30452 - DNA, 1004 bp, Panicum virgatum
  misc_feature: Ceres CLONE 1900209
  misc_feature: Encodes the peptide sequence at SEQ ID NO. 30453
ccttttgctcctttgttcccttcccatcttcctctcctcggttctcggcactcggcgtcactcgccgcggttcccgccggcggctctccgggtccgggccaatccattccaggaccttctccagaacgaggcggcgcgtgtgcgcgagcgagggggcgttccgcctgccgtgccatggcgccgccgtgcgggctgctgctggccctggcggcggcggcggccgtgctcgcggccgcgggcgcgcgggcgcaggagacgtgcgcgggggcggcgccgccgcggcgcggggcgcgggtgtccgtggccagcttcggcggcgcgggggacggccggacgctcaacacgggcgcgttcgcgcgcgccgtcgccaccgtcgagaggctgcgcgcgcccggcggggcggagctctacgtgccgcccggggtgtggctcacggggccattcaacctcacctcgcggatgacgctcttcctcgcgcgcggcgccgtcatccgcgccacgcaggacacaccaagctggcctctgatcgagccgctgccctcatacgggagaggacgagagctgcccgggggaagatacataagtttaatccatggcagtggactccaggatgttgttatcacaggtgaaaatggaactattgatggtcaaggcagtgtgtggtgggatatgtggaagaaaggtacactgccctacacaaggcctcacctacttgagctgatgacctcttctgatatcatcgtctccaacgtcgtcttccaggattcccccttctggaacattcatcctgtttattgcagcaatgttgtgatcagaaatgtgactgtactagctccacatgactcccccaacacggatggaattgatccagattccagcagcaacgtctgcattgaggattgctacatttccacgggtgacgattcaattgccatcaagagtggctgggacgagtatggaatctcctatggccacccgagctccgacataactgttcggcggat

SEQ ID NO: 30453 - protein, 276 aa, Panicum virgatum
  misc_feature: Ceres CLONE 1900209
  misc_feature: SWISSPROT Homolog: EC 3.2.1.15 Polygalacturonase
  misc_feature: Useful for making plants with altered carbohydrate content
  misc_feature: Useful for making plants with altered cell wall content and/or composition
MAPPCGLLLALAAAAAVLAAAGARAQETCAGAAPPRRGARVSVASFGGAGDGRTLNTGAFARAVATVERLRAPGGAELYVPPGVWLTGPFNLTSRMTLFLARGAVIRATQDTPSWPLIEPLPSYGRGRELPGGRYISLIHGSGLQDVVITGENGTIDGQGSVWWDMWKKGTLPYTRPHLLELMTSSDIIVSNVVFQDSPFWNIHPVYCSNVVIRNVTVLAPHDSPNTDGIDPDSSSNVCIEDCYISTGDDSIAIKSGWDEYGISYGHPSSDITVRR

SEQ ID NO: 30454 - DNA, 631 bp, Panicum virgatum
  misc_feature: Ceres CLONE 1900211
  misc_feature: Encodes the peptide sequence at SEQ ID NO. 30455
agagaggcggaaaagcagaaccgtgttctatgcttccaaggtccttgggaccagcggcgcggcgcctgggcctggtcgcagcggcggctccctccaccgcgcgcgcgtcctcggcttccgcggcgcggcggccgtgcccgccgtccgacggcgacgaggccggggaggatgatgagcctctacctcttcggacgccccacgggccgccggcgccggaggagcggcggtggcctcgccgcggagagcagcgtcggagagaattctcatttatcacaacagccgccaaagatcattctgtcttgacccggcaacttctagattcgcgacatgatacagtagatgaggttggtacagaacatgatccgttcattgagttgaaagcaaggttcatggacttcaaacagcgaaactatgtggaaaatttttcaaattaccaaagtttggcgcaacagcaaacaccaaagttcatggtgattgcttgtgctgactccagggtctgccctaccagtattttggggtttcagcctggggaagcatttacagttcgtaatgtggcaaatttggtaccaccatatgagcatgggggttcagagactagtgcagcactagagtttgctgtcaatacactcca

SEQ ID NO: 30455 - protein, 200 aa, Panicum virgatum
  misc_feature: Ceres CLONE 1900211
  misc_feature: SWISSPROT Homolog: EC 4.2.1.1 Carbonate dehydratase
MLPRSLGPAARRLGLVAAAAPSTARASSASAARRPCPPSDGDEAGEDDEPLPLRTPHGPPAPEERRWPRRGEQRRREFSFITTAAKDHSVLTRQLLDSRHDTVDEVGTEHDPFIELKARFMDFKQRNYVENFSNYQSLAQQQTPKFMVIACADSRVCPTSILGFQPGEAFTVRNVANLVPPYEHGGSETSAALEFAVNTL

SEQ ID NO: 30456 - DNA, 1713 bp, Panicum virgatum
  misc_feature: Ceres CLONE 1900215
  misc_feature: Encodes the peptide sequence at SEQ ID NO. 30457
gtcattccgcacctctccgtcccgttccctctcctctcctcccgcccgccccctgccctcgagctccctcccccgcgcgcgctctcgtcggcgacgatctccagccagagtgaggtagatcaggggctctgtcccggctgcgggagaaaaggatggaggactccgcgggcttgcgtggcggcgggggatgcggcggcctggacgcgcagatcgagcagctcatggagtgccgcccgctcccggagacggaggttaaaacattgtgtgagaaggccaaggagatattgatggaggaaagcaatgttcagccagttaaaagcccggtgacaatttgtggtgacattcatggacaattccatgatcttgtagaacttttccggattggcgggaagtgtccagacacaaactatttgtttatgggagattatgtggatcgtggctattactctgttgagcatagtcacaagattcggggtcgatgcctcgtccctcgacccgggaacgtcgttccgattcgagggtcggggtcgaagagggtcagcgtcccattcaagcttttggttgcactgaaggtgcggtacccacaacgtattactattcttcgtggaaaccatgagagtagacagatcacacaggtgtatggcttctatgatgaatgcctacgaaaatatggcagtgccaatgtctggaagatcttcaccgatctttttgactattttcctttgacagcattggtggaatcagaaattttttgcctccatggtggtttatctccttccattgagaatctcgatagtgttagaagcttagatcgtgttcaagaggtccctcatgagggacctatgtgtgaccttctatggtctgatccagatgatcgatgtggctggggcatatctcctcgaggtgctggatacacttttggccaggacatatcggaacagtttaatcacaccaacaatcttaaacttgtagcccgggctcatcagttggttatggagggttataactgggcacatgaacaaaaggtagtgaccatattcagtgcacctaattactgttaccggtgtggcaacatggcatccatccttgaggttgatgactgcaggaatcactcatttattcagtttgagccagctccgaggagaggtgaaccagatgtgacacggagaacaccagattatttcctctgagttatttgctgtaccattttgattattgggcaagattgcaatagtggttgctggtcagtaacatttttgttggatccgtatgataaagtaacctgaccagcaatagcaagaaaatgccgctgccttaatagtgtgacaattgatctccattcgtggcttcaagaggtgctatcaacctaccacccaaaccgacgtaagaatctggtggtgaattggcgcctgtgttggctctgttgaccactggctcgacagagatagagcttttgttttagcataagttgcttgggttcttccttgttttgttttgcgttgatgtgcctacaacctcggtgattaattgactacacatgctgatcccctcgttgcaagtattgtgaaggacacgcagctagttcttccgttctttactgctcattatccgatgttacccgttgtacccacacttttttatgtagcaaccaacgtgttatggtccgtttgtttggttcgaagtctttgcttcccatattgcttgtatcatcgt

SEQ ID NO: 30457 - protein, 345 aa, Panicum virgatum
  misc_feature: Ceres CLONE 1900215
  misc_feature (56)..(281): Pfam Name: Metallophos Pfam Description: Calcineurin-like phosphoesterase
  misc_feature: SWISSPROT Homolog: EC 3.1.3.16 Phosphoprotein phosphatase
  misc_feature: The sequence is a functional homolog of SEQ ID NO 13 in US patent 7271316
MEDSAGLRGGGGCGGLDAQIEQLMECRPLPETEVKTLCEKAKEILMEESNVQPVKSPVTICGDIHGQFHDLVELFRIGGKCPDTNYLFMGDYVDRGYYSVEHSHKIRGRCLVPRPGNVVPIRGSGSKRVSVPFKLLVALKVRYPQRITILRGNHESRQITQVYGFYDECLRKYGSANVWKIFTDLFDYFPLTALVESEIFCLHGGLSPSIENLDSVRSLDRVQEVPHEGPMCDLLWSDPDDRCGWGISPRGAGYTFGQDISEQFNHTNNLKLVARAHQLVMEGYNWAHEQKVVTIFSAPNYCYRCGNMASILEVDDCRNHSFIQFEPAPRRGEPDVTRRTPDYFL

SEQ ID NO: 30458 - DNA, 444 bp, Panicum virgatum
  misc_feature: Ceres CLONE 1900219
  misc_feature: Encodes the peptide sequence at SEQ ID NO. 30459
gtcacttcaatgtgtacagaaaagttaatgggagatgactccctacacctgcgattgctctcgtggttgcattgaccctgggacagtatgccttcctcgccgcgggcgccggccctaggggcatcataggaagcccctgattgtcaggaatctcgagaggaaagaggcgtgtccgatgccgagataacccacctgctgattgcggaggcaactgaccgcgaccggcgtagaatgcatagcatagattcgccccgctcaacgtccaggtactcgcgccaactgggcggagggcgtctcctcttcgccagatgaaccccatatggcccatcctctactccaccctcaagctcacgaacttccgctccgacttcgactacctagcagaaaactgctactgtgaggatggtggcctttatgatgaatattacgttcagaagagaattg

SEQ ID NO: 30459 - protein, 45 aa, Panicum virgatum
  misc_feature: Ceres CLONE 1900219
  misc_feature: SWISSPROT Homolog: EC 1.5.3.11 Polyamine oxidase
MNPIWPILYSTLKLTNFRSDFDYLAENCYCEDGGLYDEYYVQKRI

SEQ ID NO: 30460 - DNA, 1462 bp, Panicum virgatum
  misc_feature: Ceres CLONE 1900226
  misc_feature: Encodes the peptide sequence at SEQ ID NO. 30461
agccagccaccaaacagcagcatcgatcgagcagcagcggcggcaacaacgacagcacgaggcagcaagcgtcgcaagcccaggaatcccgggcccaccgcgcaccccgtcgccccccgcttccccgcgccacccccgattcttctcccccagcccttgaccagaccgcgcccgccgcccggcgttgaggacggcgatggagctgggcctgagcctcgcctcggcctcgccgccggcgggcgggctggcgccgccgccgcccctagcgccgccggggaaggagcagcaggtggccggcgtggggatcctgctgcagatctccatgctcgtgctctccttcgtgctcggccacgtcctgcgccgccaccgcttctactacctacccgaggccagcgcctcgctcctcatcggtctagttgttggtggccttgctaacgtttcaaatacagagaccaacactaggacgtggttcaacttccatgaagaattcttcttcttgttcttattacccccgataatatttcaatcaggattcagcttatctccgaaaccattctttgcaaactttggggctattgtaactttcgccattcttgggacgttcattgcttcagttgtaacaggggttcttgtctatcttggcggactgacatttctaatgtataaacttccacttgttgagtgccttatgtttggtgcccttatatctgcaactgatcctatcacagtgctatcgatattccaggaactgggctctgatgttaacttgtatgctttggtgtttggagaatcagttttgaatgatgcgatggcaatttctctttacaggacaatgtcatctgttagaagtcatgcagcagcaggcgagaacttttttatgatgattctccagttccttgagacctttgttggttcaatgtcatcaggtgtgggagttggatttatctctgctcttctgttcaaatatgctggattggatgttgacaatctgcaaaacttggagtgctgcctttttgttctctttccatatttctcgtatatgttagccgaaggacttggattgtcagggattgtttctatattattcacgggaatggttatgaagcattacacatactccaatctttcagacaattcacagcgctttgtttctgcctttttccacttactatcatctttggctgaaacatttgtgttcatttatatgggcttcgatattgccatggaagagcatagctggtcacatgttggcttcattttcttctcaattatattcatagttgttgcaagggctgtaaatgtcttttcttgtgcatacttggttaacatgtctaggccagaacatcgccgaatacctctaaagcatcagaaagcactttggtttagcgggcttagaggggccatggcttttgcacttgctctccaatctgtgcatgaactttctgaaagacatggggaaacg

SEQ ID NO: 30461 - protein, 421 aa, Panicum virgatum
  misc_feature: Ceres CLONE 1900226
  misc_feature (41)..(418): Pfam Name: Na_H_Exchanger Pfam Description: Sodium/hydrogen exchanger family
MELGLSLASASPPAGGLAPPPPLAPPGKEQQVAGVGILLQISMLVLSFVLGHVLRRHRFYYLPEASASLLIGLVVGGLANVSNTETNTRTWFNFHEEFFFLFLLPPIIFQSGFSLSPKPFFANFGAIVTFAILGTFIASVVTGVLVYLGGLTFLMYKLPLVECLMFGALISATDPITVLSIFQELGSDVNLYALVFGESVLNDAMAISLYRTMSSVRSHAAAGENFFMMILQFLETFVGSMSSGVGVGFISALLFKYAGLDVDNLQNLECCLFVLFPYFSYMLAEGLGLSGIVSILFTGMVMKHYTYSNLSDNSQRFVSAFFHLLSSLAETFVFIYMGFDIAMEEHSWSHVGFIFFSIIFIVVARAVNVFSCAYLVNMSRPEHRRIPLKHQKALWFSGLRGAMAFALALQSVHELSERHGE

SEQ ID NO: 30462 - DNA, 598 bp, Panicum virgatum
  misc_feature: Ceres CLONE 1900226-R
ggagatgaaaacccatcattagagcattctcagaattatgaggacaacaacggttacatgcctccaacttatgaagaaggtacatcatctgggggaggattaagaatgaaacttaaacagtttcacaaaagcacaacgtcattcactgcccttgacaaaaactacctgactccatttttcaccagccagactgacgacgacgacgacgaagacttcagtgggcaaccccaaaaccgaagagtaagattctatgatcaatagcagtatttggggttccacttatcaagctaaatacacggagcagaactgaaagcatgattgtgtgtacgattggattgaacctagtatagggcatacttagttgagtagcatatggcaggcagaggatatctgctgtataccgtaggacagaaatcataaggctcaaatcaactcttatggggatgaggatagccgggctgcatgtatatgtgtttgtaggcctccttgagaacttggtggagctccagatgaaaagcaggttattgctgaaattgtctggttgttagcctttaccgttatgctaattttaataccccagacattatgattgtttacc

SEQ ID NO: 30463 - DNA, 1333 bp, Panicum virgatum
  misc_feature: Ceres CLONE 1900228
  misc_feature: Encodes the peptide sequence at SEQ ID NO. 30464
agcctgcgtgtgtattttcaaacttgtgagccgcagcggcgtccgtcaaggccaccaacagcagcggaacgtctcgccctctctgaaagccatttcagaaccaccttggaactccaccccctccgcttccgcgaacccaatccctaatccctctcgccctctcgcccgcccccaattcgatccggcccgggccccgatccccctcgatccccgctccaaccaggcgccggcccgatcggcattgcgcgccggccgcctcggccagatctgggcgccagatcccgccgcccccgcgcctagcgattccggcgccggacgccaacttggcgccccagaagcggtcccagcgcggcggcggcggcggaggtggcgcctccgccgccgccgcggcctcgtccgccgccgcgggggactccggggatgcggtcatggcgcggtggctgcagtccgcggggctgcagcacctcgcggcgtcctcggccgcgggcggggtcggcgcaggggacctccacggcggcagccttgccggcggtggcgccggcggccttctcccgagccttctcatgcagggatatgggccacaatcgattgaagaaaaacagaagctttacacattattgaggagtctgaatttcaatggggaattggcatctgcatccttgtccgagccctatactcaaacagcacagagctttggcggtggggcttctgtagatggattttattcacccgaacttagaggtgaattcggggctggccttttagatctccatgcagtggatgacagcgaacttctttctgagaatgttgcgtcagaaccatttgaggcttcaccttttatgccaaaggaaatggatgatgatgaggatgatgtaataccaataaaccagcaaggtctggttgataaccgaagtagtgcattcatcagtgaaaaagagaacactgtggtcagtgttagagaaagtaatgtagcgaagatcaaagttgtggtaaggaaaagacccctaaacaaaaaggaggtatctcgaaaagaggaagacatcatagacgtacacaattctcagttcttgactgtccatgaacctaagctcaaggtggatttgacggcgtatgtggaaaagcatgaattctgctttgatgctgtattggatgagcatgtaactaatgatgaggtgtatcgtgagactgtggagcctattattccaataattttccaaaggacaaaagccacatgcttcgcatatggccagacaggcagtggcaagacctatacaatgcaacccctacctctaagagctgtgcatgatatggtttgtcttttaaatcatcctat

SEQ ID NO: 30464 - protein, 301 aa, Panicum virgatum
  misc_feature: Ceres CLONE 1900228
  misc_feature (189)..(301): Pfam Name: Kinesin Pfam Description: Kinesin motor domain
MARWLQSAGLQHLAASSAAGGVGAGDLHGGSLAGGGAGGLLPSLLMQGYGPQSIEEKQKLYTLLRSLNFNGELASASLSEPYTQTAQSFGGGASVDGFYSPELRGEFGAGLLDLHAVDDSELLSENVASEPFEASPFMPKEMDDDEDDVIPINQQGLVDNRSSAFISEKENTVVSVRESNVAKIKVVVRKRPLNKKEVSRKEEDIIDVHNSQFLTVHEPKLKVDLTAYVEKHEFCFDAVLDEHVTNDEVYRETVEPIIPIIFQRTKATCFAYGQTGSGKTYTMQPLPLRAVHDMVCLLNHP

SEQ ID NO: 30465 - DNA, 767 bp, Panicum virgatum
  misc_feature: Ceres CLONE 1900228-R
acctcagcaccacaggtttcatccaagcaatctgaaaaagaagatatggaaataaatgcaatacttgaggaagaagaggcattgatagcagctcacagaaaggaaatcgaaaacaccatggagatagttcgggaagagatgaacctattagcagaggttgaccagccaggtagccttattgacaactacgtggcacagctgagctttctgttgtcacggaaggcttctggcttggtgagcctccaggcgcgcttggcgcggtttcagcagcgcctcaaggaacaggagattcttagccgtcaaaaaacatcaagatagttgaactccagaaattgaaatactctgtttttcaattgtcatggactgcgagaagcactgtatcgtggcctttgacatcatcttcaaacgggtgatttgagatggcagatagtgatccgatatccatggtgatgtgggttgttgatgcagagctggcttttggttggggttgtctgagtcactttgctaatttttctttttgtgaaacgggtgcttgtggcggcataggtttgtcagtgtttgctgttctgttgtaccaatatagtcgttactgttgtttgaaaatatcggtagtgaagtgctgcggtgaggaccattgtacctcgccttccattatagtgttgtatactttgttgataaaagatggcatgcggctaaatatctacaggatttgactcatacatgtagttactctgatggtaaaagatggcatgcggcaaaatatcatc

SEQ ID NO: 30466 - DNA, 1818 bp, Panicum virgatum
  misc_feature: Ceres CLONE 1900235
  misc_feature: Encodes the peptide sequence at SEQ ID NO. 30467
cccctcctcgagtccctcgctccccatcccccggtctcgcaccacccaccttccccccgatccagcaccgcacgcctccgcactcccccatgacacgcaagaggcgcaagcacgccgccgccgccgccgcctagggttttccgatccccctccagcagcatggattcgctgccgcggaagcgcaagggcgcgcgcgccgcgtgctcgctggccggatccccccacgacgcgcccgccgccgcccgcaagcgcacctgccacgagcccaagccgcgccccgagaagaagaagcccccgccctccggggacgcctccgcctcggcccggggcggcgtggtcatgacggcgccgcccgccagcggccgggcgccgcccgacagccccggccgcgggctcaagcggaagctcggctgcatcgagtctgccacgcggatgggccggaagaagcgcctcgacagcgagtacgagctcggcgccgagatcgggcacggcaagttcggctccgtccggatctgccgcgccaaggccggcggcgaggagttcgcctgcaaggccctgcccaagagcggcgaggaaacggtacaccgcgaggtcgagatcatgcagcacctctcgggccacccgggcgtcgtcacgctcagggccgtcttcaaggacgccgataagttctacctcgtcatggagctctgcggcgggggcaggctgctcgacgagatcgccagggagggcaagttctccgagcagcgtgctgccgtcctgatcaaagatctcatggccgtgctcaagtactgccacgacatgggtgtcgtgcacagggacattaagccggagaatattttgctcaccaaggcagggaagatgaagctcgccgatttcggacttgctgcacgggtcaccaatggtcagaaattgtctggcatagctgggagcccagcatatgtggcacctgaagttctttctggaagttattctgagaaagttgatatatggggtgctggtgtgctactacatgtactactacttggttcacttccatttcaaggagactctctggatgccgtctttgagtctataaagacggttgaacttgatttcagcagtggtccatgggaatcgatatcaggtcttgggaaggatcttattaggcaaatgttgaatagagatgtctcttctagaatgactgctgatgaaattcttagtcacccatgggtattgttttacacggaatgcccctcgaaggtggtaactgctaatttatgcgtcactgacaagattttaacacccaggattccgtgggacagacttaggtcagaatgtgagtcattgtcagactcaagtgaaaggtcagatgatcaggatgaatgtggcatagttgacgcactgacagcagcaataacccatgttagaatatcagagccgaagagaagtcggctctgtagccctgccattaccattcagcaagaatgctcttcaaacttgaagagtaatctgtgcacggctttctgacctgacccagtatatagctccagatcggaatggtgtccatttttctggctgagaaggttggtctgatttacaatggctccactggccggtgtagagctgaggataataaactgggtttttttcagcaaggcaacgagcggttgttatgtaggttttctccagtaattgctgatgaacccgacggtagtaattgctgtaaattttgtaaatagcatgatccctccccctatctgtgcctgggttgctaatttatgttgtcgtaactgtaccatctttcaagcaatgttcataattcataagctgttgttttcc

SEQ ID NO: 30467 - protein, 448 aa, Panicum virgatum
  misc_feature: Ceres CLONE 1900235
  misc_feature (102)..(351): Pfam Name: Pkinase Pfam Description: Protein kinase domain
  misc_feature: SWISSPROT Homolog: EC 2.7.11.1 Non-specific serine/threonine protein kinase
MDSLPRKRKGARAACSLAGSPHDAPAAARKRTCHEPKPRPEKKKPPPSGDASASARGGVVMTAPPASGRAPPDSPGRGLKRKLGCIESATRMGRKKRLDSEYELGAEIGHGKFGSVRICRAKAGGEEFACKALPKSGEETVHREVEIMQHLSGHPGVVTLRAVFKDADKFYLVMELCGGGRLLDEIAREGKFSEQRAAVLIKDLMAVLKYCHDMGVVHRDIKPENILLTKAGKMKLADFGLAARVTNGQKLSGIAGSPAYVAPEVLSGSYSEKVDIWGAGVLLHVLLLGSLPFQGDSLDAVFESIKTVELDFSSGPWESISGLGKDLIRQMLNRDVSSRMTADEILSHPWVLFYTECPSKVVTANLCVTDKILTPRIPWDRLRSECESLSDSSERSDDQDECGIVDALTAAITHVRISEPKRSRLCSPAITIQQECSSNLKSNLCTAF

SEQ ID NO: 30468 - DNA, 677 bp, Panicum virgatum
  misc_feature: Ceres CLONE 1900236
  misc_feature: Encodes the peptide sequence at SEQ ID NO. 30469
aaactcgccgttccgccagcgactcctgaccaccaccaccagccagtccccggatccggcgagggagcggagcagctagcgacgaggtgaactgatcgatcgatcggcatggggctgaggaagcgcctgttgcggtgcttcgggtgcggcggcaagcaggcgccggaggagaagcgggaggagcagggggcgggcaataagcgccgccccacccttccgacgacaccatgagggagtgcatctcgatccacatcggacaggccggtatccaggtcggaaacgcgtgctgggagctctactgcctcgagcatggcattcaggctgatggccagatgcccggtgacaagaccattggaggaggcgatgatgctttcaacaccttcttcagtgagactggggctgggaagcatgtcccccgtgctgtgtttgttgaccttgagcccactgtgattgatgaggtgaggactggcacttaccgccagctcttccaccctgagcagctcatcagcggcaaggaggatgctgccaacaactttgcccgtggtcactacaccattggcaaggagattgttgacctgtgccttgaccgcatcaggaagcttgccgacaactgtactggtctccaaggcttccttgtcttcaacgctgttggtggaggaacggggtctggccttggt

SEQ ID NO: 30469 - protein, 149 aa, Panicum virgatum
  misc_feature: Ceres CLONE 1900236
  misc_feature (49)..(149): Pfam Name: Tubulin Pfam Description: Tubulin/FtsZ family, GTPase domain
  misc_feature: Useful for making plants with altered cell wall content and/or composition
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGKEIVDLCLDRIRKLADNCTGLQGFLVFNAVGGGTGSGL

SEQ ID NO: 30470 - DNA, 1643 bp, Panicum virgatum
  misc_feature: Ceres CLONE 1900240
  misc_feature: Encodes the peptide sequence at SEQ ID NO. 30471
agtagtaaccccggaccggcccaacaaatccgtatcccgacgccggcgacggccagaccagacgccggtatcgagtccacactgccaccccatccatcacacacctgtcctcccatccgcttcgccgcgccgcgccgcctcggcaccccaatctcaatcacacgcgcgccacccgcgatgacgccggcggcgatctccggctccagcggccacctcgtcctctcctccccccgcctccggcagccgctcaccctccctccgcgcgccgcgcgcccaatcgcagcctcttcgcccgtggcccgctgcggggtcgcggccgccgccgtgtccactcccgccgcgtccgccgccgcggggaaagatgccaaacaggctcctaaggatttccttcatatcaatgattttggcaaggatacgatcatgaatatccttaatcgggcgattgaggttaagacactgataaaatctggagacaggagcttccaaccgttcaaagggaaatcaatggcgatgatttttgccaagccgtcaatgaggacccgtgtttcatttgagacaggattcttcttacttggtgggcatgctatctatttgggtcctgatgatatccaaatgggcaagcgtgaggagactcgtgatgttgctcgagtactctctggctataatgacatcattatggctagggtttttggtcaccaggatattctggacttggcgaaatatgcatctgtacctgtcataaatggtctcactgactataaccatccatgccagataatggctgatgcacttactatgcttgagcacattggtcgtattgaaaacaccaaggttgtctatgttggagatgggaacaatattgtgcactcatggcttctattggctgctgtgcttcctttccactttgtatgcgcttgtcctaagggatttgagccagatgcgaagacagtggagatcgctaggagtgctggaatcagtaagattgaaataacaaatgatcccagggaagcagttaagggagcagatgttgtttacacagatgtctgggccagcatgggccaaaaggaagaagctgattatagaaaacagaagttccaaggattcacggtggatgaagccatgatggagattgctggtccacaggcctacctcatgcattgtttacccgcagagagaggggtggaggtgacagacggtgccattgaggctcccaactcaatcgtattccctcaggctgaaaatcggatgcacgctcagaatgccatcatgcttcatgtccttggcgcttaataccccttccgcaccattactgagggataaaggctgtttcagctttagcgctgaagctctagagtttctttggaggcacgatggtagcgttttttaaacatgtcactgtattacgatgaattggactgtccgacaacgtgatattttgcttgtccgtccgggtggtagcttgttgtgatgtaaaagggtggcaatcttgaataaaaacacaaacttctatggtgccaaattttcaaatcttgtaaagattggcgttttgtaagaggtgcacaagccttaaacatgatctgaaatagcagatcgcttatagtttcagtgctgaaatactcaagtcttgtagggtacttggaagc

SEQ ID NO: 30471 - protein, 370 aa, Panicum virgatum
  misc_feature: Ceres CLONE 1900240
  misc_feature (214)..(367): Pfam Name: OTCace Pfam Description: Aspartate/ornithine carbamoyltransferase, Asp/Orn binding domain
  misc_feature (68)..(210): Pfam Name: OTCace_N Pfam Description: Aspartate/ornithine carbamoyltransferase, carbamoyl-P binding domain
  misc_feature: SWISSPROT Homolog: EC 2.1.3.3 Ornithine carbamoyltransferase
  misc_feature: Useful for making plants with modulated nitrogen use efficiency
MTPAAISGSSGHLVLSSPRLRQPLTLPPRAARPIAASSPVARCGVAAAAVSTPAASAAAGKDAKQAPKDFLHINDFGKDTIMNILNRAIEVKTLIKSGDRSFQPFKGKSMAMIFAKPSMRTRVSFETGFFLLGGHAIYLGPDDIQMGKREETRDVARVLSGYNDIIMARVFGHQDILDLAKYASVPVINGLTDYNHPCQIMADALTMLEHIGRIENTKVVYVGDGNNIVHSWLLLAAVLPFHFVCACPKGFEPDAKTVEIARSAGISKIEITNDPREAVKGADVVYTDVWASMGQKEEADYRKQKFQGFTVDEAMMEIAGPQAYLMHCLPAERGVEVTDGAIEAPNSIVFPQAENRMHAQNAIMLHVLGA

SEQ ID NO: 30472 - DNA, 746 bp, Panicum virgatum
  misc_feature: Ceres CLONE 1900271
  misc_feature: Encodes the peptide sequence at SEQ ID NO. 30473
atcctctctccctccgatcagcagcagcacagccagagccagcaccagcgcagcggcgagcggtccaccatccacagcttcaattcaaatcgcactgccatggcgtcgcagcagcagcagcagcggcaggcggcggcggcggcgcccgtggggttcgaggactacctgccggtgatggcggagcggctgggcgaggaggggctgatgcgggagctggcgagcgggttccggctgctcatggacccggcccgcgggctcatcaccttcgacagcctccgccgcagcgcgccgctgctgggcctgggcgccatgtccgacgacgacctccgcgggatgctcgcggagggcgacttcgacggcgacggcgcgctcagcgagatggagttctgcgtgctcatgctccgcctcagccccgagctcatggacgggccccgcaggtggctcgacgacgccgtctcgcaggcctcgcacttcctctacaccagctaggcgggcctaggactgggctgccggagacggccgcgcgcgtagcgtaggaattgttggttgagcttctctttcttttcgttgttcatagctggattaggaattcgttcaaaaaaaaatagctggattaggaagggactggtgcctgattggtcgatagatggattccatgccttgtgtactcgatcgcctgttcctccccaactgggatctgaattgagattccagacgcaaccagagagagcgggctgagcagcggc

SEQ ID NO: 30473 - protein, 129 aa, Panicum virgatum
  misc_feature: Ceres CLONE 1900271
  misc_feature: Useful for making plants with altered glycerol content
MASQQQQQRQAAAAAPVGFEDYLPVMAERLGEEGLMRELASGFRLLMDPARGLITFDSLRRSAPLLGLGAMSDDDLRGMLAEGDFDGDGALSEMEFCVLMLRLSPELMDGPRRWLDDAVSQASHFLYTS

SEQ ID NO: 30474 - DNA, 1563 bp, Panicum virgatum
  misc_feature: Ceres CLONE 1900272
  misc_feature: Encodes the peptide sequence at SEQ ID NO. 30475
acccccaaggccaagggcccccaaccctaccttcctttctctctgtctcgccgtgctcgtcgtcgttgtcgccaccaccactcgcctcccccgccgaccaccaccaccgtccaccggcgacaaggacagcgacgatgcagtcggcggcgtggaggcgtcacctcctcgaccaccacctctccccttccacctcggccgccatcgctgccttcagatccgcctcacagcccgggctcactccccaagggttgtgtggagcggatggcgcgaggtacatgtcgtccgcgagggcgccggcggtcaagggatcggggcatctcgtccgcaagggcaccggagggaggtcttctgtcagtgggattgtagctacggtgttcggagctactgggtttcttgggcgttatcttgtgcaccagcttgccaagatgggttctcaagtgcttgtcccattcagaggttctgaggattgtcaccggcacctgaagattatgggtgacttgggtcagattgtgccgatgaaataccatccaagagatgttgattctattaaggctgttatggccaagtcaaatgtggttgttaacctcataggacgagagtatgaaacaagaaactacagcttcgaagaagtaaaccatcatatggctgaacagcttgctatgattgctaaggagcatgggggtatcatgagatttatccaggtttcatgcctaggggcatcaccctcttcggaatctagaatgttgaggacaaaagctgcaggagaggaatcaatcttgaatgaatttcctgaggctacaatcatgaggcctgcaaccatgattggcacagaagatcgaattttgaacagatgggcacaattcgcgaagaattggggtttcctcccgcttgttggcggaggaactgcaaagattcagcctgtttatgtgattgatgttgctgctgctattgtcaactccctcaaggatgatggtactagcatggggaagatatatgagcttgggggacctgagatatacactgtccatgagctggctgagctgatgtatgagacaatccgtgaatggccgcgatatgtcaatgttccgcttcctgttgcaagggctattgcttctccaagggaaatgttgctaaacaaagtaccatttcccctgccaaccccttctattttcaacctagatcagatcaatgcattctctgtggataacctcgtgtctgaagatgctctcactttcgaggacctgggcatcatgcctcagaagctgaaggggtaccctgtggagtacctcatgtcttaccggaagggcgggccttctttcggttcaactgtgagcgagaagatgaggagctctgagatgtagcctccttccgtccctgaaggcactgtagattcataatcatttagttgcagatgcattgttgtgtttgttgtctggcgatctgtcgccgctgcagctgctcccgccggctgcctcacccgtgggcaggacccaaattccatgcatggctcctgctccttgtttgtttttacatcaataagaacgctcggatgcttcttttgtc

SEQ ID NO: 30475 - protein, 408 aa, Panicum virgatum
  misc_feature: Ceres CLONE 1900272
  misc_feature (78)..(290): Pfam Name: Epimerase Pfam Description: NAD dependent epimerase/dehydratase family
MQSAAWRRHLLDHHLSPSTSAAIAAFRSASQPGLTPQGLCGADGARYMSSARAPAVKGSGHLVRKGTGGRSSVSGIVATVFGATGFLGRYLVHQLAKMGSQVLVPFRGSEDCHRHLKIMGDLGQIVPMKYHPRDVDSIKAVMAKSNVVVNLIGREYETRNYSFEEVNHHMAEQLAMIAKEHGGIMRFIQVSCLGASPSSESRMLRTKAAGEESILNEFPEATIMRPATMIGTEDRILNRWAQFAKNWGFLPLVGGGTAKIQPVYVIDVAAAIVNSLKDDGTSMGKIYELGGPEIYTVHELAELMYETIREWPRYVNVPLPVARAIASPREMLLNKVPFPLPTPSIFNLDQINAFSVDNLVSEDALTFEDLGIMPQKLKGYPVEYLMSYRKGGPSFGSTVSEKMRSSEM

SEQ ID NO: 30476 - DNA, 1773 bp, Panicum virgatum
  misc_feature: Ceres CLONE 1900292
  misc_feature: Encodes the peptide sequence at SEQ ID NO. 30477
gggaagtaaatttttttcctcctcccctgcgtctggtcttcctcgtccccttcttcgccttcacacctccctccctccattaccatcccgtgggcgacgactggcgcccaccgaccgccaggtcacggccctggattcgctccccggcgtctccggatcgtctccgagatctgctgctgagggagttgcatatatttcgaggtgcttgtgaagtgttcaagggaggattctgtttgtttttcgtgcgtgtgtaatggaggaagtggaggaggcaaacagagcagccgtggagagctgccacagggtgctcgctttgctctccaagccgcatgaccccgcgcaagccaggagcatagctctggggacggacgaggcgtgcgccaagtttaggaaggtggtctccctactcagcaacggaggagcgggagtaggaggagaagcaggaccgtcaggaacaagcggaagccatcctagggctaaggttgtcagcagaagacagaatccagggttcttaactcagaaaggcttcctggatagtaacaccccagtggtggtgttgaacagcgcgcatccttctcctagctccgcacaggtctatcctaggactggggcgttggatgcacagagcatacatcctcttggaggacctcccaagttggttcagcctttgtctgcacattttcagttcggcaatgtgtcttcacggtatcagttcccacatcagcagcagcagaagttgcaggctgagatgttcaagagaagcaatagcgggattaacttgaagtttgatagcaccagtggcacggggacaatgtcatcagcgaggtccttcttgtcgtctttgagcatggatggtagtgtggcgagcctggatggcaagtcatcgtcgttccatttgatcggcggccctgcgatgagcgacccagtgaatgcacagcaggccccaaggcggcgatgcacgggtcgtggggaggacgggacaggcaagtgcgctgtgacaggcaggtgccattgttcaaagagaaggaagttgcgggtgaagagatcaattaaggttcccgccatcagtaataagattgctgatataccgcctgatgaatactcgtggaggaagtatgggcagaagccaattaaaggttcccctcatcctaggggttactacaaatgcagcagcgtgaggggctgcccggcaaggaagcatgtcgagcggtgtgtagatgattcatcgatgctcatagtgacatatgagggcgagcacaaccatactcggatgccaactcagtctgcgcaggcgtagggaactccttgatcaccagaccctcttcaggaagtgccaacaacccagtccttgtcggaggacagctgcgttggtcttcttaacaaggattgcaaattgacaaatatgaagccgtttcgagctgctgttttgttgtttggcctcctcacctacatgatttgtagcaatagtccagttgagaacacaatattttcttctccgtggagttgtcacaatgatgacaaagaagaacgagccgttagatctgtgctgttgctcatggttagtgtgaggtgttggaagggaagataaaaagttggcgggaaagggacagttatcttaactttgtactaaaagggtagggaaagggcagaacaattttttcttgagttaccctgatttttggtccctcaccgaccgtgtaccaggatagtgtcagaactcaaaagaagtgcacaaaagctgctttgctattatagcatttcattcattcattc

SEQ ID NO: 30477 - protein, 347 aa, Panicum virgatum
  misc_feature: Ceres CLONE 1900292
  misc_feature (279)..(339): Pfam Name: WRKY Pfam Description: WRKY DNA -binding domain
  misc_feature: The sequence is a functional homolog of SEQ ID NO 1277 in the 11/479,226 US patent application
  misc_feature: The sequence is a functional homolog of SEQ ID NO 2442 in the 10/374,780 US patent application
  misc_feature: The sequence is a functional homolog of SEQ ID NO 48 in the 11/375,241 US patent application
  misc_feature: The sequence is a functional homolog of SEQ ID NO 590 in the 10/412,699 US patent application
  misc_feature: The sequence is a functional homolog of SEQ ID NO 632 in the 11/435,388 US patent application
  misc_feature: The sequence is a functional homolog of SEQ ID NO 528 in the 10/374,780 US patent application
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
MEEVEEANRAAVESCHRVLALLSKPHDPAQARSIALGTDEACAKFRKVVSLLSNGGAGVGGEAGPSGTSGSHPRAKVVSRRQNPGFLTQKGFLDSNTPVVVLNSAHPSPSSAQVYPRTGALDAQSIHPLGGPPKLVQPLSAHFQFGNVSSRYQFPHQQQQKLQAEMFKRSNSGINLKFDSTSGTGTMSSARSFLSSLSMDGSVASLDGKSSSFHLIGGPAMSDPVNAQQAPRRRCTGRGEDGTGKCAVTGRCHCSKRRKLRVKRSIKVPAISNKIADIPPDEYSWRKYGQKPIKGSPHPRGYYKCSSVRGCPARKHVERCVDDSSMLIVTYEGEHNHTRMPTQSAQA

SEQ ID NO: 30478 - DNA, 728 bp, Panicum virgatum
  misc_feature: Ceres CLONE 1900300
  misc_feature: Encodes the peptide sequence at SEQ ID NO. 30479
agccatcagcagcagcagcagaagaagaagaagaagaagaagaagagggtcggagggccgcaccaacagacgaccggagccgcgataatggagcaggccggcgccggtgtatggctgcgcgcgcgagggatcgccctgctggttctcgccgtcgtgtcgctgagggcgctccccgccggggccgcggcgatcacgcggtcggatttccccgaggggttcgtcttcggcgccgggacgtcggcctaccaggtggaaggcgcgtgggatgaggacggaaagaagccgagcatttgggtcacatttgcgcatggtggctatgcttttgaccatgcgactggagacgtagctgctgatcagtatcacaagtacaaggaggatgtgaagctaatgcatgagatgggcttggatgcatacagattttcttttgcctggacaaggcttattcctgacggtcgaggtgctgtgaacccaaaggggctggagtactacaataacctaatcgatgaactcatgacctacgggatacagcctcatgcaacaatataccattttgaccttccccaggctcttcaagatgaatacaatggcctgctcagtcctagattcattgaagatttcacggcgtatgcggatctgtgcttcaggagcttcggtgacagagtgaagcactggaccacccttaatgagccgaacatcgagccgcttggtgggtatgacatgggcagtct

SEQ ID NO: 30479 - protein, 213 aa, Panicum virgatum
  misc_feature: Ceres CLONE 1900300
  misc_feature (36)..(213): Pfam Name: Glyco_hydro_1 Pfam Description: Glycosyl hydrolase family 1
  misc_feature: SWISSPROT Homolog: EC 3.2.1.21 Beta-glucosidase
  misc_feature: Useful for making plants with altered cell wall content and/or composition
  misc_feature: Useful for making plants with altered carbohydrate content
MEQAGAGVWLRARGIALLVLAVVSLRALPAGAAAITRSDFPEGFVFGAGTSAYQVEGAWDEDGKKPSIWVTFAHGGYAFDHATGDVAADQYHKYKEDVKLMHEMGLDAYRFSFAWTRLIPDGRGAVNPKGLEYYNNLIDELMTYGIQPHATIYHFDLPQALQDEYNGLLSPRFIEDFTAYADLCFRSFGDRVKHWTTLNEPNIEPLGGYDMGS

SEQ ID NO: 30480 - DNA, 2872 bp, Panicum virgatum
  misc_feature: Ceres CLONE 1900310
  misc_feature: Encodes the peptide sequence at SEQ ID NO. 30481
actcctaatccgccatcaccgccaccgcttccgcctcagccgcttccaccgcctcccccgaaacttcaaacgcgccagcacgcgggaggccagcgctgggccggagctagctagggttccgttcctccggcgccgggatgggttacctcctcttctcctcgccgtcgccgccgctcgccttccaatacccctgctcctcctcctcctcctccggcgtcgcggcctcccgccgcagccgctctcggcggggcgcggcctccgtcgtcgcgtcgtccgcctcgacgcccgatggcggcccttccccttcgtcgtccgcggcggcgtcggcggacgcgtacgtgctggcgcggcgggtggtgctgctcggcgcctccgccgtacctctcctccgcctccgcgaagccgtggccgcgcccacgactgtttatggcatgtcattatcccaagggtttattagaagaaaggggattgatgccccaagggtagatcgtgaagctgagaattgctacaaaacgctcaagatcggacgaaattccatcatctgtagacctaaggaggataagtttgatgagacaaaggatgtctcaaagcttgatgaccccccatctgaagggaaaacgggtattccagagcctgacacaactcaatttgaaggatctcagagtgaaactactactactgaagctcgtcagcctgaatcatccttacaatctgtggaagaacagcatccagggaatccactgcttggctttttgggtacagttggagtcactgcctctggtgttcttggtgggctgtatggcacttctctacaagaaaaaaaggccctgcaatcgatcatctcatctacggagagcaaattggctgaaaatgaggcagcactttctttgatgagggaaaactatgagaaaagattactggaggagcaagcagcacaaaagaagcaatctttgaagttccaggagcaggaagcttctctttcagaccagttggcttcagcaaaaaagtctttgacatccctgagtgaagaattcagaaaggagaagaaactagctgaggaacttagggatgaaatacagggattagagagtattatcagacaagctggggatgataaagatgcgcttgaaagtaaattggaagaaaagctgggagagattaattctttgcaggaaaaaataagtttgctgagccaagaaattgatgataaagagaagcacatcagggaacttagtgcatcactttcctcgaaggaagtagactaccaaaagctgtctgctttgactaatcaaactaaaatgagccttgagcatgcaaattctaaaatacagcaacttgaggaagagctcgatagaagtaagaatgcgcttgcttcaaagatatctttgattgattcactcgatgctaaacttgaaacattgaattctgaaaaagaagaagctgacaaaaaaattaacgagttaatacaagagtatacagacctgaaggctgcttcagagacaaaagcaagtcatgcttccaaggtactatcagagagagatgatcagataaaacagcttgaagaaaaactctctgttgcattaactgagtctagcaaaaatcatgaaacaattcttgagttgaacaaagagttggatgccaccaaagcaatgctagagagtgaacttgtggccacagaaactttaaaagaatcgatccaatcatctgaagaggctctaaaggattccagaaatgaggcttccaagctttccaaggaacttgaggaggcaaataaattgaatcaggacctggtgtcacagatttctgaactccaagatgagttgagtgcaactcaagaaggactgacgattaaactaggagaggcagaatcagtaaccaaaactctctcagaggaactggcctcagtgaagaaaatggttcaaaaaggacaagaagaacttgaaaccacctctaatgagctggcatctgttgttgaagctcgtgacaacttgaaaaaagaattgctggatgtgtacaagaatttggaatccaccacacatgagcttgtcgaggaaaggaaaatggtgacaaccttgaatagggagcttgaagcgttggcgaaacaattgcaggtagattctgaagcccgaaaagctcttgaagcagatctggatgaggcaacgaagtcactagatgagatgaacaatagtgcattgtcactgtctagagaactagagagcactcattctaggaatgacactcttgaagctgagaaagaaatgctatccaaggctctcgctgaacaaacgaaaatcacagcagaagctcaggaaaacactgaggatgctcagaatctgatcacaaggcttcaggcggagaaggagagctttgaattgagatctagacatcttgaagaggaattggcattagcgaagggtgagatactgcgcctaaggaggcagattagtacaaacaggtctctgtcaccaagaacatctgccagaccaagagcaccaccagaggctaatgagatccagaaggagcaagctgtgaacaatcataatcagaataccagtggagtagttgctggaactccaccatctgtgaaaagggctgtaaggagaagaaaaggtggtgcatcaacatgagtattggaagcccaagcaaaggccttctttttttccatgctttcctctttagtagtctgttattacttcattttttaaatcataatcctttgcaaaatagcatcaatagttattccagtgttattacatttgccttttgtagcatttcaattacttgatgtgttttgttcaagcttctgtgaaactgagggcctgtatatgtatagatgagttactgaagagccaacataatgaattccagtatc

SEQ ID NO: 30481 - protein, 829 aa, Panicum virgatum
  misc_feature: Ceres CLONE 1900310
  misc_feature: SWISSPROT Homolog: EC 2.7.11.1 Non-specific serine/threonine protein kinase
MGYLLFSSPSPPLAFQYPCSSSSSSGVAASRRSRSRRGAASVVASSASTPDGGPSPSSSAAASADAYVLARRVVLLGASAVPLLRLREAVAAPTTVYGMSLSQGFIRRKGIDAPRVDREAENCYKTLKIGRNSIICRPKEDKFDETKDVSKLDDPPSEGKTGIPEPDTTQFEGSQSETTTTEARQPESSLQSVEEQHPGNPLLGFLGTVGVTASGVLGGLYGTSLQEKKALQSIISSTESKLAENEAALSLMRENYEKRLLEEQAAQKKQSLKFQEQEASLSDQLASAKKSLTSLSEEFRKEKKLAEELRDEIQGLESIIRQAGDDKDALESKLEEKLGEINSLQEKISLLSQEIDDKEKHIRELSASLSSKEVDYQKLSALTNQTKMSLEHANSKIQQLEEELDRSKNALASKISLIDSLDAKLETLNSEKEEADKKINELIQEYTDLKAASETKASHASKVLSERDDQIKQLEEKLSVALTESSKNHETILELNKELDATKAMLESELVATETLKESIQSSEEALKDSRNEASKLSKELEEANKLNQDLVSQISELQDELSATQEGLTIKLGEAESVTKTLSEELASVKKMVQKGQEELETTSNELASVVEARDNLKKELLDVYKNLESTTHELVEERKMVTTLNRELEALAKQLQVDSEARKALEADLDEATKSLDEMNNSALSLSRELESTHSRNDTLEAEKEMLSKALAEQTKITAEAQENTEDAQNLITRLQAEKESFELRSRHLEEELALAKGEILRLRRQISTNRSLSPRTSARPRAPPEANEIQKEQAVNNHNQNTSGVVAGTPPSVKRAVRRRKGGAST

SEQ ID NO: 30482 - DNA, 1601 bp, Panicum virgatum
  misc_feature: Ceres CLONE 1900311
  misc_feature: Encodes the peptide sequence at SEQ ID NO. 30483
gtcgtctgcgtctcacactccgcccactccgcctcccgttcccctcccctccgtctcctgcatatttatcgccggctcgccgtcgttcgtcgcctcatcctcctccttcgcctgcccgatgcgcccgtagcgtgctgaccgccgtagggtttgctggagtgacgccgcacgtcgcccgtggtgggactggtttcggcgtccatttcgggttggagcagcctcggcttccgcgccggtaagccgccgaaggctggaggcgagtctggcggagtgaagatccacctgaaattcgatcggttcctcggataagttggaggtgagatggcgaacctgcagccttccctcgccattcccccctcgttcgccggggcctcgccgccatctccctcgccggtggctgggagcagcagcggccccgccctgggccaggcggccaaggataagaagatggcgtcggcggagcagctggtgctggaactctgcgaccctgaactgcgcgagaacgcgctgcttgagctctccaagaaaagagagatatttcaagatcttgccccgctgctgtggcactcatttggcacaattgctgcgctactccaggagatcgtgtctatctacccttcactttcacctccaacactatcacctggtgcatcaaaccgagtttgcaatgctcttgcacttctgcagtgtgtcgcatcgcatcctgagaccaggatccttttcttaaatgctcatattccgctgtacctgtacccgtttctgaatactaccagcaaaacaagaccttttgagtacttgaggcttactagcctgggtgtcattggtgctcttgtcaaggttgatgatactgaagtcaacagttttttgctgcaaactgaaataattcctctgtgcttacgaaccatggagatgagcagtgagctgtcaaaaactgtggcaaccttcatcgtccaaaagattctcctagatgatgttgggttgcgctacatctgtgccactgctaagcgtttctttgctgtaggcagtgttttggcaaacatggttgtttcacttgctgatcagccctccacaaggctgctgaagcacatcattcgttgttacctcaggctgtcagataatcccagggcctgtgctgcattgcaaagctgccttcctgatatgctcaaagatgggacatttaataactgtcttagggatgacccagctacaaggcgttggctccaacagctgctgcacaatgtgacaggcgggggaggcatgggaggagctcctcagccaggcctggatcatatgatgggcatatgaaggtgaagcagtctagtcgttgcaattcactacaataatacatcatcccgcagtgaattgcaactagagaaccagaagaaaagtagaatggtctagtctaactttttctggggctaaacaaagaagaaaaggattgttgtgtgggattaccgtaagcggttaagctgatgtgcattcatcatgtaatgctgtggaaaacaagcacagcacgctgctccatttctgtgcttgcaccggaactcttttgctttgacagttcagaacctgagaacaaagaggaagaaccccgttccgtg

SEQ ID NO: 30483 - protein, 327 aa, Panicum virgatum
  misc_feature: Ceres CLONE 1900311
  misc_feature (48)..(310): Pfam Name: Rcd1 Pfam Description: Cell differentiation family, Rcd1-like
MANLQPSLAIPPSFAGASPPSPSPVAGSSSGPALGQAAKDKKMASAEQLVLELCDPELRENALLELSKKREIFQDLAPLLWHSFGTIAALLQEIVSIYPSLSPPTLSPGASNRVCNALALLQCVASHPETRILFLNAHIPLYLYPFLNTTSKTRPFEYLRLTSLGVIGALVKVDDTEVNSFLLQTEIIPLCLRTMEMSSELSKTVATFIVQKILLDDVGLRYICATAKRFFAVGSVLANMVVSLADQPSTRLLKHIIRCYLRLSDNPRACAALQSCLPDMLKDGTFNNCLRDDPATRRWLQQLLHNVTGGGGMGGAPQPGLDHMMGI

SEQ ID NO: 30484 - DNA, 636 bp, Panicum virgatum
  misc_feature: Ceres CLONE 1900352-R
  misc_feature: Encodes the peptide sequence at SEQ ID NO. 30485
cccgaaggggttacaatattcagagtcttgctgttggcccagctgaaaaagaaggaacttctcgcatcactactgttgttcctggaactgatgaatccattaccaaactagtacatcaactgtacaagctcattgatgtttatgaggtccaggattttactcatttaccatttgctgctagagagttgatgatcataaagatcgctgcaaatgctgcagctcgaagggatgtcctagatattgctcagatttttgaggctcagaaagttgacatatcagaccacacaattacacttcagcttaccggagacattgacaaaatggttagattgcataccatgctagagcaatatggcatctgtgaggttgcacgaactggccgggttgctctgctccgtgagtctggagtcgactccaagtacctccgtgggttttccctcccactgtagttcaccacttgctgacataccacactccccggcttcaggttgcacattccgttgtcttcagagcatgtcttttccttttggagcaacaatagtagaagaaccattaaaaaaaccacagggtgagaacagtaggaagaatatagtgcacaaaaccttacgtctctggaatgctatgtgcttatgctgc

SEQ ID NO: 30485 - protein, 148 aa, Panicum virgatum
  misc_feature: Ceres CLONE 1900352-R
  misc_feature: SWISSPROT Homolog: EC 2.2.1.6 Acetolactate synthase
RRGYNIQSLAVGPAEKEGTSRITTVVPGTDESITKLVHQLYKLIDVYEVQDFTHLPFAARELMIIKIAANAAARRDVLDIAQIFEAQKVDISDHTITLQLTGDIDKMVRLHTMLEQYGICEVARTGRVALLRESGVDSKYLRGFSLPL

SEQ ID NO: 30486 - DNA, 342 bp, Panicum virgatum
  misc_feature: Ceres CLONE 1900352
acgatttttttttcctccgcctctcgcgatccccaaagccctcgcccaaaaacccccgccgctccccatttcggcctctccacccgccatggccgccgccgccgccgccgcccccgcggtggtcccccagctccgccccgccgcaactggggccgggtcccgcagccaccgccggccgccggcgccgaagctgggcctcgcggcggggactcgggcgcgctccctgaccgtctccgtccccaccgcccagtctaccacgacggggagggggacgccggagccacccagctccaccagcgcggtcatacagcgccacaccatcagcagtttaagctgggaatg

SEQ ID NO: 30487 - DNA, 1820 bp, Panicum virgatum
  misc_feature: Ceres CLONE 1900357
  misc_feature: Encodes the peptide sequence at SEQ ID NO. 30488
gcctgctcacttcgtttcgaggctgcatttgcgacctcacctcgccttgctcgcctccactcccccctccactagccattccgttcatctccaaggccaagaagaccggcccacgagacaagacgcccgccacaccacccaacccgcttgtcctcttccttccgcgtcggacgaggccacgcacatggcgctgctgcctctgccacccctcttcctcctcctgctcctgctgggaatgctcgcctcccgggcgccggcgcagccagccacgctgcacgagcgcgacgcggcggcgctgcgagacctccgcgccagcctgcgcgacctcccgggctcccgcttcttcgacacctgggacgacgcccggagcccctgcgcgtacgccggcgtcgtctgcgcgcccgacggcgattcctcctccacgccggccgtcctccgcgtgtccgtgctcaccctcggcacggggctcgccgactccccgggtctagccggcgcactcccggactccctttccacgctcgccgcgctcacggacctggtcctgtacccaggccgcgtgacgggccccatcccgtcggccctcggcgcgggtctccgccgcctgcgtctcctctcgctggcgggcaaccagctgacgggctccgtgccggcctccctcgcggggctacccgacctccacacgctcgacctcggcgggaaccgcctcgacggcgccgtcccgccggggctgctcctgccggactcgcctagcctcaaggtgctcatcctcgccaacaacggcgggatctccggggagattcccgccgggttcgcgagctccgggctgttccacgtcgacctcgccaggaacgcgctcgctgggggattaccgccgctgccggccacgttgcggtacttctccgtcgctggcaacgcaatgcagggcacactcgacgaggcctttggtggtggtggtggcgacggctctgccactgccagtccaccaccacttctggccgacctggcgttcctggacctgtccatgaacaacttgtcgggcagcatcccggcgtcggtgttcggtctcccgagcctgtcgtcgctgctcctgtcgaggaacaacttcacgggcgcgctgtccgtgccgccgccgtccccggagcagcagtgggcggtggtggacgtgagccacaacggcatctcgggcgaggtcccggaggcgctggcggcggcggggagcctgtacgtgaacaacaaccggctgtccggggaggtgcccgcggcggtggcgcgcagcgtgctggcggggcggatgaccacgctgtacgcgcagcacaacttcctgacggggttctcggtcccgcctgccgcgccgctgccggactccgccgcgctctgcctgtcctacaactgcatggagctgccgtcggcgtcggcagccgacgggtgtcccaccattggtgggcctctcgaggccaggcccgccgagcagtgcaacggaggcggcggcgacggctgacgggctgagtccccggacggacgggggtgacaggacaggtgggggcgcgcccgctcgcgccacggcacggcaccccggcaagtccacgggcggcggtggttggcgccctctcgtctggtcttggggacggacacggacaccaggctgggtggggggctggagccgtgacctcgctcgcgcagtcgcgtctctgctttgtccgcttgtttagcttgtaataatgtaacctgtagggttgtgtagaagaccagatcttggttctcaccatcggctcctgattgtaatccttcgatgtaagattatttgttactgatttcttttt

SEQ ID NO: 30488 - protein, 437 aa, Panicum virgatum
  misc_feature: Ceres CLONE 1900357
  misc_feature (31)..(72): Pfam Name: LRRNT_2 Pfam Description: Leucine rich repeat N-terminal domain
  misc_feature: SWISSPROT Homolog: EC 2.7.11.1 Non-specific serine/threonine protein kinase
MALLPLPPLFLLLLLLGMLASRAPAQPATLHERDAAALRDLRASLRDLPGSRFFDTWDDARSPCAYAGVVCAPDGDSSSTPAVLRVSVLTLGTGLADSPGLAGALPDSLSTLAALTDLVLYPGRVTGPIPSALGAGLRRLRLLSLAGNQLTGSVPASLAGLPDLHTLDLGGNRLDGAVPPGLLLPDSPSLKVLILANNGGISGEIPAGFASSGLFHVDLARNALAGGLPPLPATLRYFSVAGNAMQGTLDEAFGGGGGDGSATASPPPLLADLAFLDLSMNNLSGSIPASVFGLPSLSSLLLSRNNFTGALSVPPPSPEQQWAVVDVSHNGISGEVPEALAAAGSLYVNNNRLSGEVPAAVARSVLAGRMTTLYAQHNFLTGFSVPPAAPLPDSAALCLSYNCMELPSASAADGCPTIGGPLEARPAEQCNGGGGDG

SEQ ID NO: 30489 - DNA, 2838 bp, Panicum virgatum
  misc_feature: Ceres CLONE 1900361
  misc_feature: Encodes the peptide sequence at SEQ ID NO. 30490
gttcctcgctccacaggctctggctctccctccgctctctttcttctagtgcgataggttgttgcacgttttgcagctccccctcctcctcttcagtttttcctcatcaccgtggtggccacttgtcctctctcctatcagcagagccagggccagagccagatagtttagtcctcgcctccatcttcgtcttcttcgttgtcatcgtcgtcgtcgtcgtcgtcatcctccacgctctcttctcgggattagggaggaaccaccgagggctgaagctgctgcctgttcaacggctgaaggataccgaggctactgccttctgagtttctgaagaataaggcgcatctcttctgtgctacaaaatccagtggcggaccatgatgagcaacgttaagcttggtgttgaggttgtcagtgctcacgatctcctcccgaaagaacagggcacagccaatgcctttgttgaagtcgagtttgatgaccagaagttccgcacagccatcaaagacagggacctcaaccctgtgtggaatgagcagttctacttcaacgtatctgatccatcccgcctccccgagctacaccttgaggcctatgtgtaccatgcaaaccgtaccaacaattccaaggcctgccttggcaaggttcgcatatcgggtacatcctttgtcagccaaccagatgcttcacccctgcactaccccctggagaagcgcaacatcttatcgcgcgcacgtggtgagcttggactaagggtcttccttacaaatgatccatcagtaagggtgtctgcaccaggtccggaattcgatatgttaagcacatctagcactgcgcaagagcaggaagcggccaactccattccaaatcctttccaagagaccagaccaaatccagtgagacaattacagcacttgccaagagaacagcagcgtccggcaccaatgggacaagcatactacaatgaaggttcatacggagacccgcaacaaagaagcttttctgcaattgcaaataaagctggagcccctccgcctcaggtatcaaggatgtatgctccaggttcacagcaacctatcgacttccagctgaaggagacaagcccaacgcttggtggtggccgtgttattggcggtcgggtgtatcctggtgagaaggccggggcttacgaccttgttgagaagatgcagtacctctttgtgcgagtggtcaaggcccgcgacttgcccaacatggacatcactgggagtcttgacccttttgtcgaggtgcatcttggaaactacaaaatgaaaacaaagtattttgagaagaatcagaagcccgaatgggatgaggtgtttgcattccccaaagaagtcatgcagtcaacaacacttgaagttgttgtgaaggacaaggatgtcattcgggatgactatgtcggtcgagtgagtcttgacctgaatgaggtccctgtaagggtccctcctgacagcccattggcgccagagtggtatcgtcttgtgggaaaggatggcataagggacagaggagagctgatgcttgcagtctggtatggtactcaagcagatgaatgcttcccaagcgccatccatgcaggatcaacaccagttgattcccatcttcacaactatatccgtgggaaggtctaccctgcaccaagaatgtggtacgtgagggtcaatgtaattgaggcacaggatatattcccaatggagaaccacatacctgatgtatttgtaaaagtgaggctgggccaccaattgttgaagacaaggcaagttcggtcaccaaccaaaaacttcatgtggaatgaagagatgatgtttgtcgcagcagagccttttgaggaagacttgatcataacaatagaagaccgtgtagcacaaaacaaagatgaggtgattggtgaagttatgataccactaacaaggattccaaagcgggctgatcacaagccagtacggccagcatggtttgatctgagaagaccaggattgattgatgcgaaccagctaaaggaagacaaattctatgcaaaggtaaacctccgtatttgccttgaaggtggttatcatgtgcttgataagtccacacaatattgcagtgatctccggccaacaatgaaacagttgtggaagccaccaattggcatgcttgaagttggcattttaagtgcacatggtctcaatccaacaaaaaccagaaatgaccgagggtcatgtgatgcatattgtgttgccaagtatggttcaaaatgggtgcggacacgcacaatcgttgacaacttgagccctcgattcaatgagcagtacacatgggaagtttatgatcatggaactgtactcacaattggtctgtttgacaactgccacataagtggagacagtaaccatggctcccaaggccatatggataaacccattgggaaagtacgaattcggctttcaacacttgagactgggcgggtgtacacacatacatacccattgcttgtcctgcacccatcaggagttaaaaagatgggcgaactccaccttgccatccggttctcagccacatccctgatcaatgtgctctttacatactctaggcccctcttgcccaagatgcattacacacagcctctgtcaatagtccagcaggaaatgcttcgccaccaggctgtgcagcttgttgcgcagcgcctggggcgcatggagccaccagttcgcagggaagttgttgagttcatgtcagatgctagctctcacctgtggagcatgcgacggagcaaagctaatttcttccgtcttatgcaagttttctctggagtcattgctgcaggaaagtggt

SEQ ID NO: 30490 - protein, 820 aa, Panicum virgatum
  misc_feature: Ceres CLONE 1900361
  misc_feature (273)..(353): Pfam Name: C2 Pfam Description: C2 domain
  misc_feature (7)..(91): Pfam Name: C2 Pfam Description: C2 domain
  misc_feature (595)..(688): Pfam Name: C2 Pfam Description: C2 domain
  misc_feature (434)..(515): Pfam Name: C2 Pfam Description: C2 domain
MMSNVKLGVEVVSAHDLLPKEQGTANAFVEVEFDDQKFRTAIKDRDLNPVWNEQFYFNVSDPSRLPELHLEAYVYHANRTNNSKACLGKVRISGTSFVSQPDASPLHYPLEKRNILSRARGELGLRVFLTNDPSVRVSAPGPEFDMLSTSSTAQEQEAANSIPNPFQETRPNPVRQLQHLPREQQRPAPMGQAYYNEGSYGDPQQRSFSAIANKAGAPPPQVSRMYAPGSQQPIDFQLKETSPTLGGGRVIGGRVYPGEKAGAYDLVEKMQYLFVRVVKARDLPNMDITGSLDPFVEVHLGNYKMKTKYFEKNQKPEWDEVFAFPKEVMQSTTLEVVVKDKDVIRDDYVGRVSLDLNEVPVRVPPDSPLAPEWYRLVGKDGIRDRGELMLAVWYGTQADECFPSAIHAGSTPVDSHLHNYIRGKVYPAPRMWYVRVNVIEAQDIFPMENHIPDVFVKVRLGHQLLKTRQVRSPTKNFMWNEEMMFVAAEPFEEDLIITIEDRVAQNKDEVIGEVMIPLTRIPKRADHKPVRPAWFDLRRPGLIDANQLKEDKFYAKVNLRICLEGGYHVLDKSTQYCSDLRPTMKQLWKPPIGMLEVGILSAHGLNPTKTRNDRGSCDAYCVAKYGSKWVRTRTIVDNLSPRFNEQYTWEVYDHGTVLTIGLFDNCHISGDSNHGSQGHMDKPIGKVRIRLSTLETGRVYTHTYPLLVLHPSGVKKMGELHLAIRFSATSLINVLFTYSRPLLPKMHYTQPLSIVQQEMLRHQAVQLVAQRLGRMEPPVRREVVEFMSDASSHLWSMRRSKANFFRLMQVFSGVIAAGKW

SEQ ID NO: 30491 - DNA, 505 bp, Panicum virgatum
  misc_feature: Ceres CLONE 1900361-R
  misc_feature: Encodes the peptide sequence at SEQ ID NO. 30492
agatctaattaggatgaggtatgataggttacgacatgttgctgggagaattcagacagttgttggagacatagccactcagggagagaggttacagtcactgctgagctggagggacccaagggcaacagctatgttcctaatattttgcctgatcacagccattatactatatgtgacaccattccaagtgattgcactctgccttgggttcttctggatgaggcatcctcgatttcgccacaaggtgccgtctgcaccagtaaacttcttcaggaggctacctgcaaagacagattcattgctgtaaagttccatggagaacagctattgatggtatctaatgtaccactctgtatgtgtttcttgtgtcctatttattgttgtataatagtattaagtgagataaaatgcaatttgctgcttcatgtgacagaacaaactaagtcaatttcgtcaggtaacttccaagccttagaaattaagaatatatttaaacttttgt

SEQ ID NO: 30492 - protein, 102 aa, Panicum virgatum
  misc_feature: Ceres CLONE 1900361-R
  misc_feature (1)..(102): Pfam Name: PRT_C Pfam Description: Plant phosphoribosyltransferase C-terminal
DLIRMRYDRLRHVAGRIQTVVGDIATQGERLQSLLSWRDPRATAMFLIFCLITAIILYVTPFQVIALCLGFFWMRHPRFRHKVPSAPVNFFRRLPAKTDSLL

SEQ ID NO: 30493 - DNA, 629 bp, Panicum virgatum
  misc_feature: Ceres CLONE 1900367
  misc_feature: Encodes the peptide sequence at SEQ ID NO. 30494
ccgtgcgcggaggcggcggcggaggaggacgacgaagcggttgggctcgaggttcttaagagcttggggggagatggagtggctcgacgagtacgagaagctggtgatccggatgaacacgccgcgggtggtcatcgacaatgctgtctgccccacggccacgctcgtgcaggtcgacagcgccaggaagcgaggcgtcctgctcaaggccgtgcaggtgctggccgacctcgacctctccatcaacaaggcctacatctcatccgacggacgctggttcatggacgtcttccacgtcaccgaccgcctcggccgcaaactcaccgacgacagcgtcatcacctacatcaagcagtcgctggggacgtggaacgggccggcgcggccggcggcgctcgagggcttgacggcgctggagctcacgggcgccgaccgcacggggctgctctccgaggtcttcgccgtgctcgccgacatggagtgcagcgtggtggaggcccgcgcgtggacgcaccggggccgcctcgcctgcgtggcgttcctccgcggcgaggacgccgacgccggccgcgtgccgcgcatcctcgcccgcctcggccacctcctccgcggggaccccgcggaggcgc

SEQ ID NO: 30494 - protein, 185 aa, Panicum virgatum
  misc_feature: Ceres CLONE 1900367
  misc_feature (112)..(176): Pfam Name: ACT Pfam Description: ACT domain
  misc_feature: SWISSPROT Homolog: EC 2.7.7.59 [Protein-PII] uridylyltransferase
MEWLDEYEKLVIRMNTPRVVIDNAVCPTATLVQVDSARKRGVLLKAVQVLADLDLSINKAYISSDGRWFMDVFHVTDRLGRKLTDDSVITYIKQSLGTWNGPARPAALEGLTALELTGADRTGLLSEVFAVLADMECSVVEARAWTHRGRLACVAFLRGEDADAGRVPRILARLGHLLRGDPAEA

SEQ ID NO: 30495 - DNA, 754 bp, Panicum virgatum
  misc_feature: Ceres CLONE 1900372
  misc_feature: Encodes the peptide sequence at SEQ ID NO. 30496
acgggcggtgactcctctcctctcctctgctctgcggttcggaacacgggaacagcctgctcctccctgactactccatcttccttcgcgcgaggcctggtcgaccggttggctggttccatatccggcggggcttggtgctcgaggcgatcgcatcgtcatccgccgctcgcgccgttcgattgggccatggacaacccagcgccgccaacgaatgccgcggccggcgcgccagagccatcgccgtcgccgtcgccgtcgcggcggctgccggacttccagcagtcggtgcggctcaagtacgtgaagctggggtaccactacctcatctcccacggcatgtacctgctgctcaccccgctgatggtgctcgtggccgtgcacctctccacgctctccccgcgcgacgtcgccgacctgtgggcgcacctccgcctcaacctcgtctccgtgctcgcctgctccgcgctcctcgtcttcctcgccaccgcctacttcctcacgcggccgcggcccgtgtacctggtcgacttcgcctgctacaagccggggcccgagcgccggtgctcgcgcgacaccttcatgcgatgctcgcgcctcacgggctccttcaccgacgccagcctcgagttccagcgcaagatcctggagcgctcggggctcggcgaggacacgtacctgcctcccgccgtgacgcgggtgccgcccaacccgtccatggacgcggcgcgcgccgaggcgcgggaggtcatgt

SEQ ID NO: 30496 - protein, 188 aa, Panicum virgatum
  misc_feature: Ceres CLONE 1900372
  misc_feature (102)..(188): Pfam Name: FAE1_CUT1_RppA Pfam Description: FAE1/Type III polyketide synthase-like protein
  misc_feature: SWISSPROT Homolog: EC 2.3.1.119 Icosanoyl-CoA synthase
MDNPAPPTNAAAGAPEPSPSPSPSRRLPDFQQSVRLKYVKLGYHYLISHGMYLLLTPLMVLVAVHLSTLSPRDVADLWAHLRLNLVSVLACSALLVFLATAYFLTRPRPVYLVDFACYKPGPERRCSRDTFMRCSRLTGSFTDASLEFQRKILERSGLGEDTYLPPAVTRVPPNPSMDAARAEAREVM

SEQ ID NO: 30497 - DNA, 731 bp, Panicum virgatum
  misc_feature: Ceres CLONE 1900375
  misc_feature: Encodes the peptide sequence at SEQ ID NO. 30498
actcgctgctccgtctcctcacgaacgcgcgacccaaaacccctccccccatccatctcctcttctggtggcgaccgccatggccgccgggcgggccttcctcggcgccccctgctcctccctcgccactggtgcccgccgcctcgcctttgcttcgcctccgccccgggcgctcgcccctgcgctccgccgccgcgtaccctgccgctgcgtggcctccgtctcctcgacccccgacgcggcctccgcttcggagccctacgtgctcaccacgccactctactacgtcaatgccccaccgcacatgggaagcgcctacaccaccatcgccgccgacgccatcgcccggttccagaggttgctagagaagaaggttatatttattactggaacagatgaacatggtgagaaaatcgccacttcagcggaggctagtggtagaaacccaaaggagcattgtgatgctatttcaagttcatataagatgctctgggctgatttagacatagaatacgacaagtttatccgcacaactgatcataagcatgagggtgttgtcaatgaattctattctagagtattaagcagtggtgacatatatagagctgattacgaaggactttattgtgttaactgtgaggagtacaaggatgaaaaagagctggccgaaaacaaaatctgccctgtgcatttgaagccttgtgtagcagaaaagagacaactatttcttt

SEQ ID NO: 30498 - protein, 217 aa, Panicum virgatum
  misc_feature: Ceres CLONE 1900375
  misc_feature (61)..(215): Pfam Name: tRNA-synt_1g Pfam Description: tRNA synthetases class I (M)
  misc_feature: SWISSPROT Homolog: EC 6.1.1.10 Methionine--tRNA ligase
MAAGRAFLGAPCSSLATGARRLAFASPPPRALAPALRRRVPCRCVASVSSTPDAASASEPYVLTTPLYYVNAPPHMGSAYTTIAADAIARFQRLLEKKVIFITGTDEHGEKIATSAEASGRNPKEHCDAISSSYKMLWADLDIEYDKFIRTTDHKHEGVVNEFYSRVLSSGDIYRADYEGLYCVNCEEYKDEKELAENKICPVHLKPCVAEKRQLFL

SEQ ID NO: 30499 - DNA, 2817 bp, Panicum virgatum
  misc_feature: Ceres CLONE 1900387
  misc_feature: Encodes the peptide sequence at SEQ ID NO. 30500
accccaattcgtccagtactccagttccagacttccagtccccaactccaatccaccccgccgcctctccaatttctaatcccccaaggcgaagcagcaatcgaaacatccagaggcctccatcctcacccatttccgctgattcactttgggaggcgaggcgatgccctcgaggagcaagcgcaaccgactcggcctcgacggcgaggacgaggaggaagaggagatcgccgctacctcatctgaccccgacgactcggagtcggaggcggagcgcggggccgaggcggatgacggcgacgacgaatacgtgggggaaaggagtgacgcgggcggcggcgacgaagcggaggaacgaggcagcagcgacagcggcgatgggggcggccccggcgacggcgggaagccacttcggagcgggaggcgtggggtgatggctcccgatagggagaggaaatcacagaatgtcgatgctctggtcaggggtaacctggttgtaaggaggcagccactcattccacgtatcctttcagtttctgatgcggcagcaatagctcgaaagccattcaaacctccatgccaaaatggatatagtaagaataatgagcatcttgctcgtcgcctttcagctcgtaaaagatttgtcccgtggggttcgacacaggcatttgcagttacacataatcttccacaaccacatgctgttactagtgttagttcatcagaaaaggaggaacctcttccacctggcatagagccattggttttgtggcaacgtgaggaatgtgacaaggaaaactgcaatgcttctgtgatcgaagttgatcacttgcttgtacgttacctccgaccgcatcaaagggaaggagttcagtttatgtttgattgtgtctctgggtcgttgagtgatgatggtatttctggttgcattttagctgatgatatgggattggggaagactctacagtcaataactttactatatacccttctttatcaaggctttgatgataagccaatggttaaaagggctgtgattgtaacccccacaagcttagttagcaattgggaatctgagataattaagtggttaaaaggcagagtgcagctgcttgccctctgtgaaagcacacgtgctgatgttctttccggcatagaaagtttcttaaaacccttgagccgtcttcaggtacttatcatatcttatgagacgttccgcatgcattcttcaaaatttgaaagaccgggcagctgtgaccttctgatatgcgatgaggcccacaggctgaaaaatgatcagacactgacaaataaggcattggcttcccttccttgtacacggcgcatcctcttgtcaggtaccccaatgcagaatgatttggaagaattcttttcaatggtgaatttcacaaatccaggggttttgggggacgcttcatattttcgtcgatattacgaagcaccgatcatatgtggaagagaacccaacgcaagtgcagaagaaaagaagttgggatctgagagatctgcagagcttagtgcaaaagtaaatcagtttatactgagacgaacaaatgccctgttatccaatcacttgcctccaaagattgttgaagttgtgtgctgcaagctgactcctttgcagacaacactgtacaaccacttcatccattccaaaaatgttaaacgcctgatatccgaagaaacaaagcaatccaaaattctggcatatattactgcacttaagaaattatgcaaccatccaaagctgatctacgacaccataaaaagtaacaattcaagtggctctggttttgaagattgtctgcgcttttttccaccggaactgttttcaggaagatctggatcatggactggtggaggaggaatgtgggtagaactatctggaaaaatgcatgtattggcaagattactgggccacctgcgtcacaaaactgatgatcgtattgtccttgtatcaaattatactcagacattagatctatttgttcaattatgtcgggaaagaaggtacccatatgttagacttgatggagcaacatccatcagtaaaaggcaaaagctggtgaaccaattcaatgatctatctagggatgagtttgtctttctacttagtagcaaggcaggtggttgtgggcttaatttggtaggaggaaatcgcttggttctctttgaccctgattggaaccctgccaatgataagcaggctgctgctcgagtatggagggatggacaaaaaaagagagtctacatttataggttcttaagcacaggaaccattgaagagaaggtatatcaacgtcaaatgtcaaaggaaggcctacaaaaagttattcagcaggagcaaacagacaacaaaatgcagggaagttctctttcaacagaagacctgcgtgatctttttacttttcatgaacaagtcaggtctgaaatacatgaaaatttgaagtgtagccgctgtaacaaggatggaaattcgcttttgggtggtaatgattttgatttagcagccactgagcataagccttcaatgccaggagtgcaagattatattgatattggtgggtttggagagatatctggatgtttgcagataatggatagctcacatcatcagattggaagaccgtctgaagaagatttaggaagttggggacatcactgtgatccatcaactgtacctgatactatactgcagtgttctgctggtagtgaggtttctttcgttttcaccaatcaggttgatggaaaacttgttccggttgaatcagtggcacgatcagcacctcatcaact

SEQ ID NO: 30500 - protein, 884 aa, Panicum virgatum
  misc_feature: Ceres CLONE 1900387
  misc_feature (231)..(537): Pfam Name: SNF2_N Pfam Description: SNF2 family N-terminal domain
  misc_feature (618)..(697): Pfam Name: Helicase_C Pfam Description: Helicase conserved C-terminal domain
MPSRSKRNRLGLDGEDEEEEEIAATSSDPDDSESEAERGAEADDGDDEYVGERSDAGGGDEAEERGSSDSGDGGGPGDGGKPLRSGRRGVMAPDRERKSQNVDALVRGNLVVRRQPLIPRILSVSDAAAIARKPFKPPCQNGYSKNNEHLARRLSARKRFVPWGSTQAFAVTHNLPQPHAVTSVSSSEKEEPLPPGIEPLVLWQREECDKENCNASVIEVDHLLVRYLRPHQREGVQFMFDCVSGSLSDDGISGCILADDMGLGKTLQSITLLYTLLYQGFDDKPMVKRAVIVTPTSLVSNWESEIIKWLKGRVQLLALCESTRADVLSGIESFLKPLSRLQVLIISYETFRMHSSKFERPGSCDLLICDEAHRLKNDQTLTNKALASLPCTRRILLSGTPMQNDLEEFFSMVNFTNPGVLGDASYFRRYYEAPIICGREPNASAEEKKLGSERSAELSAKVNQFILRRTNALLSNHLPPKIVEVVCCKLTPLQTTLYNHFIHSKNVKRLISEETKQSKILAYITALKKLCNHPKLIYDTIKSNNSSGSGFEDCLRFFPPELFSGRSGSWTGGGGMWVELSGKMHVLARLLGHLRHKTDDRIVLVSNYTQTLDLFVQLCRERRYPYVRLDGATSISKRQKLVNQFNDLSRDEFVFLLSSKAGGCGLNLVGGNRLVLFDPDWNPANDKQAAARVWRDGQKKRVYIYRFLSTGTIEEKVYQRQMSKEGLQKVIQQEQTDNKMQGSSLSTEDLRDLFTFHEQVRSEIHENLKCSRCNKDGNSLLGGNDFDLAATEHKPSMPGVQDYIDIGGFGEISGCLQIMDSSHHQIGRPSEEDLGSWGHHCDPSTVPDTILQCSAGSEVSFVFTNQVDGKLVPVESVARSAPHQ

SEQ ID NO: 30501 - DNA, 502 bp, Panicum virgatum
  misc_feature: Ceres CLONE 1900387-R
agggccagaagcccaatccttgtaccatatttccgtaaaaaggattaaagtagggagtcaggatcacaatgaggccggtcttcattcccatccctcacatgtgcagtcacaatggttaaatacatactggaagaaaagaattggtgttgttcatgtgctcacatgggttctctagatcttaagagctttgcctaagctctgtcggtttgaccattatgagggtttaatttcacttgagatgatccaggacttctgagagaagaatgctcttttttccccttttttttttggccttcttgtagggactgggtgcagaatctcattccagattatgctgaaaaatatggacatgtgttctccccattccactattacctcgtgatttggggttagacactaaggggtatagttttattaagctttgcacatgttctgttccaaaattactgcatcagaacagtactaatgtcctagctcctaatggaaattgaatttgttatgg

SEQ ID NO: 30502 - DNA, 2054 bp, Panicum virgatum
  misc_feature: Ceres CLONE 1900392
  misc_feature: Encodes the peptide sequence at SEQ ID NO. 30503
agaggagagcgccgcggtgacatcacagacagacacaggcagagcgcccgagagccagcagcatgtcgttgtagctgagctagttagctgcctcagcatcagctcggctgcacctgcacgggggggtttgggtggggacagcacacagcagcagcagccgcaaggccacgctccctcgcgcaagctaggcaggatgatgctcgcgtacatggaccgcgcggcggcggcggccgagccggaggacgccggggagccggcggccgaggcggccgggtgcgcggcggcgacggacttcggcgggctggtgagcgccatgccggcggcggtggtccggcccgcgagcgcggaggacgtggccagcgccatccgcgcggcggcgcggacggcgggcctcacggtggccgcccgcgggaacgggcactcggtggccgggcaggcgacggcggagggcgggctggtcctggacatgcgcgcgctggcgctgtcccggcgcccgcagatgcagctggtggggtgccccgtcgcgggcgggccctgcttcgccgacgtccccggcggcgcgctctgggaggaggtgctccactggggcgtcaagagccacggcctcgccccggcgtcctggaccgactacctccgcctcaccgtgggcggcacgctctccaacggcggcgtgagcgggcagtccttccgctacgggccgcaggtgtccaacgtggccgagctcgaggtggtcaccggcgacggcgagtgccgcgtctgctcgccctcctcccacccggacctcttcttcgccgtgctcggcgggctcgggcagttcggcgtcatcacccgcgcccgcatcccgctccgccgggcgccggcgcaggtgcggtgggcgcgcgccgtgtacgcgagcttcgccgagtacgcggccgacgccgagtggctggtgacgcgggcccccgacgccgccttcgactacgtcgagggcttcgccttcgtcaacagcgacgaccccgtcaacgggtggccgtccgtgcccatccccggcggcgcccgcttcgacccggccctcctccccgccggcgccggccccgtcctctactgcctggaggtggccctgtaccggtaccccgacgacgaggacaaggcggcggccgtgagccggatgatggcgccgctgaagcacgtgcgggggctggagttcgcggcggacgtcgggtacgtggacttcctgtcccgcgtgaaccgggtggaggaggaggcccggcgcaacggcagctgggacgcgccgcacccctggctcaacctcttcgtctccgtccgcgacatcgccgacttcgaccgcgccgtcatcaagggcatgctcgccgacggcatcgacgggcccatgctcgtctaccccatgctcaagagcaagtgggacccgaacacgtcggtggcgctgccggagggcgagatcttctacctggtggcgctgctgcgcttctgccgcggcggcgggccggcggtgggcgagctggtggcgcagaacggcgagatcctccgcgagtgccgcgccaacgggtacgaccacaaggcctacttcccgagctaccgcggcgaggccgagtgggcgcgccacttcggcgccgccaggtggcggcgcttcgtggagcgcaaggcccgctacgacccgctggcgatcctcgcgccgggccagaagatcttcccccgggccccggcctccgtcgccgtgcagctgtagcagcaggggtgggcgacggtgaggaccagcgagcgccgggaggaagggaaggatgatggccccggccgggtaatgatgctgattacgccgctgatcctggtgatgatgggcgatcgaggagggagggggctaccgcggccgtggcgatcgagcagggtaatgatggcgatcgggccaccgttaggtgcgtccggccgatcttgcggggcggctgcttgctgcccaaagggattggcgtgcgtgtgtgcgtggagatctccatgaattttccatggagaaagggaaaaaagtacgaaggcgcagaggaaaacgaaagctgtggccttcc

SEQ ID NO: 30503 - protein, 510 aa, Panicum virgatum
  misc_feature: Ceres CLONE 1900392
  misc_feature (222)..(499): Pfam Name: Cytokin-bind Pfam Description: Cytokinin dehydrogenase 1, FAD and cytokinin binding
  misc_feature (42)..(190): Pfam Name: FAD_binding_4 Pfam Description: FAD binding domain
  misc_feature: SWISSPROT Homolog: EC 1.5.99.12 Cytokinin dehydrogenase
MMLAYMDRAAAAAEPEDAGEPAAEAAGCAAATDFGGLVSAMPAAVVRPASAEDVASAIRAAARTAGLTVAARGNGHSVAGQATAEGGLVLDMRALALSRRPQMQLVGCPVAGGPCFADVPGGALWEEVLHWGVKSHGLAPASWTDYLRLTVGGTLSNGGVSGQSFRYGPQVSNVAELEVVTGDGECRVCSPSSHPDLFFAVLGGLGQFGVITRARIPLRRAPAQVRWARAVYASFAEYAADAEWLVTRAPDAAFDYVEGFAFVNSDDPVNGWPSVPIPGGARFDPALLPAGAGPVLYCLEVALYRYPDDEDKAAAVSRMMAPLKHVRGLEFAADVGYVDFLSRVNRVEEEARRNGSWDAPHPWLNLFVSVRDIADFDRAVIKGMLADGIDGPMLVYPMLKSKWDPNTSVALPEGEIFYLVALLRFCRGGGPAVGELVAQNGEILRECRANGYDHKAYFPSYRGEAEWARHFGAARWRRFVERKARYDPLAILAPGQKIFPRAPASVAVQL

SEQ ID NO: 30504 - DNA, 1650 bp, Panicum virgatum
  misc_feature: Ceres CLONE 1900395
  misc_feature: Encodes the peptide sequence at SEQ ID NO. 30505
gaaatgaatcgattgtccatctccttcggaggacaacaattgcgtaggcatggccatccaccttaaattgcctttcacccaacaccttctcctgctcctttcttacgttgcggccgtagtgtctgatcctgtgtctcttcgagaactctctgatgtggcgttccaacatcctatactaggtgatgacctgaagccagagcacttccccaacgagcggctctacgaagcctaccttgccattcagcatttcaagagcactatcactagtgaccccaagaacatcacagcaacctggactggccatgacatctgcggcgagaagacctacctcggcttctactgcgcaacaccgccagggttagctgagaagctaacaattactcaggttctcttaaatggatttgacctgtgtgcgccccatttgcaaggcttcatcgatcagctcccggatatcgcgcttttccatgcagcctccaacaactttggtggtgatatccctcaactcagcagcctgccttacctctacgagctcaatatcgctaactacgatatgcagcctctgcagccttctggtacttacctcgacggtgctgggggaggtggtggagggactggggggggatatggcccaccaccatgtgttaataaagtatattttaatttcacatttcacatccgcgctggcaacgtgacttcaggaggcctcattccgggcattccaaatccaaggattccaggccttccagagcatccaaagtttccgggcataccaggcgccacggattctaaggcgctcctcctcaactacaaccacctgtccgggcaacttccggcgaacctcggcctctccaagttgagctacctcgccctcgccaacaacaagctcacgggtccaatcccaccgtcgatcgagcacctgcaagactccctcttcgagctgctcctcctcaacaaccagctctccggctgcctaccccacgagctcggcatgctccacaaggcggccgtcatcgacgccggcatgaaccggctcaccggcccgatcccgtcatccttctcctgcctcagcagcgtcgagcagctcaatctcgccgggaaccgcctctacggcccggtgcccgacgctctctgcaagctcgccgggcccgccggccgcctcgacaacctcacgctgtccggcaactacttcacctccgtcgggccggcgtgcgcggcgctgatcaaggacggcgtgctggacgtgaagagcaactgcatcccgggcctcgccgaccagaggcgcccggcggagtgcgccgcgttccagagccagcccaagacgtgcccggcggcgagcactccggtggcctgccccgccgcagctgcggccaagggcgaggtggcaccgggggagaggaaggctagggactactccagctacgtgacctacgctactctgcatgagtgagcggcctcaggtcggcatgcagtaggagacagatcgtctcggtggcgttttggctatttgtttttgtattcttatgtactagtaccgtgtggttggagtgtttgctgtctattttctacgcacgtgttgctgtccaggttgctgtccaacctagatctatttgtatccgttatatttgagtgaaaatttgttgccgttgttgg

SEQ ID NO: 30505 - protein, 465 aa, Panicum virgatum
  misc_feature: Ceres CLONE 1900395
  misc_feature: SWISSPROT Homolog: EC 2.7.11.1 Non-specific serine/threonine protein kinase
MAIHLKLPFTQHLLLLLSYVAAVVSDPVSLRELSDVAFQHPILGDDLKPEHFPNERLYEAYLAIQHFKSTITSDPKNITATWTGHDICGEKTYLGFYCATPPGLAEKLTITQVLLNGFDLCAPHLQGFIDQLPDIALFHAASNNFGGDIPQLSSLPYLYELNIANYDMQPLQPSGTYLDGAGGGGGGTGGGYGPPPCVNKVYFNFTFHIRAGNVTSGGLIPGIPNPRIPGLPEHPKFPGIPGATDSKALLLNYNHLSGQLPANLGLSKLSYLALANNKLTGPIPPSIEHLQDSLFELLLLNNQLSGCLPHELGMLHKAAVIDAGMNRLTGPIPSSFSCLSSVEQLNLAGNRLYGPVPDALCKLAGPAGRLDNLTLSGNYFTSVGPACAALIKDGVLDVKSNCIPGLADQRRPAECAAFQSQPKTCPAASTPVACPAAAAAKGEVAPGERKARDYSSYVTYATLHE

SEQ ID NO: 30506 - DNA, 667 bp, Panicum virgatum
  misc_feature: Ceres CLONE 1900396
  misc_feature: Encodes the peptide sequence at SEQ ID NO. 30507
aacactagctagcaccggtcacagcaccaaccgtaccgccatggcctccctcgccgccgtctccgtgcagccggtcgccgtaaagggcctcgccggcagctccatctccggcaggaggctcgccgccgctaggccgtcgcgcgccggcgcctgccgctccgcccgcaggccccgcggcgccgccgtggtggccaagtacggcgacaagagcgtctacttcgacctcgacgacatcggcaacaccaccgggcagtgggacctctacggctccgacgcgccctcgccctacaacccgctccagagcaagttcttcgagacgttcgcggggccgttcaccaagaggggcctgctgctcaagttcctgctgctgggcggcgggtcgctgctggcctacgtcagcgcgtcggcgtcgccggacctgctgccgatcaagatggggccgcagcagccgccgcagccggggccgcgtggcaagatctaagctcagttgttccttctcctccatctgtctctactagctgcttgcttgtaccaccactggctccggacgccatggttcgtcgtccctgctgcctgttgtgctgctgatatttgatcgcgctgcctgtttatcgatgttgatactgttgtattaaaaagaccgctccactgctctcggctccggcgc

SEQ ID NO: 30507 - protein, 146 aa, Panicum virgatum
  misc_feature: Ceres CLONE 1900396
  misc_feature (5)..(146): Pfam Name: PSI_PsaH Pfam Description: Photosystem I reaction centre subunit VI
MASLAAVSVQPVAVKGLAGSSISGRRLAAARPSRAGACRSARRPRGAAVVAKYGDKSVYFDLDDIGNTTGQWDLYGSDAPSPYNPLQSKFFETFAGPFTKRGLLLKFLLLGGGSLLAYVSASASPDLLPIKMGPQQPPQPGPRGKI

SEQ ID NO: 30508 - DNA, 1473 bp, Panicum virgatum
  misc_feature: Ceres CLONE 1900400
  misc_feature: Encodes the peptide sequence at SEQ ID NO. 30509
gtcccctttctctgaccaagaccgaccggaacggcgcccgccgcgcagacgcgaagaagaggaaggtactcgccgcctagggtttcctccgccgccgccgccacggccaccgccaatcaggtgggagtggggggaacctcgccgcgatgccacagtcggtgctggtggagcgcgcgacgagcgagtcgctaatcgggcctgattggtcgctcaacctcgagatctgcgacatcctcaaccacgacccctcgcaagccaaagatgtagtgaagactatcaagaaacggattgggcacaagaactcaaaggtccagcttcttgcattaacgttgctcgagaccttgattaaaaattgtggagattttgttcatatgcaagttgctgagaaggatatacttcatgaaatggtgaagatagctaagaagaagccggactatcatgttaaagagaagatactgattctgattgacacttggcaagaagcttttggtggttcccgtgcaagatatccacagtattatgcagcatatcaagagatgctgcgtgctggagctgtatttcctcaaaggccagagagttctgtgccaatttatactccgccacagacgcaacctctaaggaactatccacctcctgctttgcgcaacactgattatcgtcaagatgcgcctgaatcatcttcagcaccagaagtgcctacgttaagcctgacagaaattcagaatgcacgcggggtcatggatgttctttcagagatgttgaatgctattgatcctaataacagagagggtttaaagcaggaggtaattgtggaccttgtggaccaatgtcgttcgtacaagcaaagagtggtgcaacttgtcaactcaacatcggatgaggacctgttaagtcagggcctttcactgaatgatgatttgcagcgtgttttagcaaaacacgatgcaattgctgctggcatagctgttcggatagaaaaaccaaaagcactcccggcccgtgcaggcaattctccaacaaaaccagaggggacaaaagagacagatcaaaggtcttctaaagatgccagtagcgtgacaccgtttgagcagttagcacttcctgcaccaccatcatcaagtgcttcaaagtctcatgtaaaaccagctaataaccctaatattgacctacttagtggagatgactttttcaaaccagaacctgttcattcccaagcccttgttcctgtaagcaatcagcctgcagcttcagcttcttcaagccactctttagaccttttagacatgttttcagataccaatgctatcaataactccagccaaaaccctgccacacctcctataccaaacacaaatcctaacccctcagcaccagaagcctatcctgctccacagcaacctgttccaccacaacatccttctccatattctaatggcttaaattcgaatacattggcaccttatgatcaaggct

SEQ ID NO: 30509 - protein, 442 aa, Panicum virgatum
  misc_feature: Ceres CLONE 1900400
  misc_feature (1)..(135): Pfam Name: VHS Pfam Description: VHS domain
  misc_feature (181)..(279): Pfam Name: GAT Pfam Description: GAT domain
MPQSVLVERATSESLIGPDWSLNLEICDILNHDPSQAKDVVKTIKKRIGHKNSKVQLLALTLLETLIKNCGDFVHMQVAEKDILHEMVKIAKKKPDYHVKEKILILIDTWQEAFGGSRARYPQYYAAYQEMLRAGAVFPQRPESSVPIYTPPQTQPLRNYPPPALRNTDYRQDAPESSSAPEVPTLSLTEIQNARGVMDVLSEMLNAIDPNNREGLKQEVIVDLVDQCRSYKQRVVQLVNSTSDEDLLSQGLSLNDDLQRVLAKHDAIAAGIAVRIEKPKALPARAGNSPTKPEGTKETDQRSSKDASSVTPFEQLALPAPPSSSASKSHVKPANNPNIDLLSGDDFFKPEPVHSQALVPVSNQPAASASSSHSLDLLDMFSDTNAINNSSQNPATPPIPNTNPNPSAPEAYPAPQQPVPPQHPSPYSNGLNSNTLAPYDQG

SEQ ID NO: 30510 - DNA, 684 bp, Panicum virgatum
  misc_feature: Ceres CLONE 1900400-R
  misc_feature (89)..(89): n is a, c, t, g, unknown, or other
aacgccggatacgcatacgccagtgcaaacgagctgtctcagaggatgaatgggctctcgatgcaagatggcagtctgtatggcccacntgggtcttcccttgggcagcgcaacaggccaagccgaccagaagattcactctttagtgatcttgttagcattgcgaaaacaaagcctagcaaaactgcgtctaataagcctggtggcttgtaaagaggagccattgcttgctaccagccatggccatggtgatagcttttgctcagagtatataagttcttttggaattttttcccctcctattggaaagtagcaggcgagggttatagattctgaggattcataccggagtgttcggcataatttcattttgtttgattattgcaagatgttattttttttcttttactagttttctggatttctatgtatgtacataaaatatccagctgagggaagaaaaaaaattctggttacggtgcgcggtacaggtacccattggacctctgtctcttgtaagaagttcgggttaagttgggggcgttactatgctcgtaaacttccttgacttgacttgactcgagtcatttaggagcagttgctccacctgttcagcaaatttatgaaactagtgtaactagatatggatgtgttctgttcaaattgatgaatgaaaaatctgtg

SEQ ID NO: 30511 - DNA, 1104 bp, Panicum virgatum
  misc_feature: Ceres CLONE 1900402
  misc_feature: Encodes the peptide sequence at SEQ ID NO. 30512
acagcaggcacccaccgacgccagcctattgctttcaaccgcccgccatggcgcccgacgcgtcctccccgacgccgcacgttgccgtggtagcgttccctttcagctcccacgcggcggtgctgctcgccttcgcgcgcgcgctggccgccgccgcggcgcccgcggggggcacgctctcgttcctctccaccgcgggctccatcgcgcagctccgccgggcggtcggcgccgagctcccgggaaacctgcgcttcgtggaggtcccggacggcgccgggccgcccgcggcgaagggcgccgtgccggtgccggtgccggtgccgatgccgcggcagatggagctgttcatggccgccgcggaggccggcggggtgaaggccgggctgcaggcggcccgcgccgcggcgggcggcgccaaggtgagctgcgtggtcggggacgcgttcgtgtggcccgcggcggaggcggcggccgcggcgggggcgccgtgggtgccggtgtggacggccgcgtcgtgcgcgctcctggcgcacctccgcaccgacgcgctgcgggcggacgtcggcgaccaggccgcgagcagggcggatgagctgctggtctcgcacccgggcctcggcagctaccgcgtcggcgacctccccgacggcgtcatctccggcgacttcaactacgtcatcagccgccttgtccaccgcatggggcagctactcccgcgtgccgccgccgccgtggcactcgatactttcccgggcctggacccgcccgacgtcaccgcagctctcgacgagacgctcccgaactgcctcccgctcggcccctaccacctcctcctccccaaggacaccaccgacgccgcgtcgcaagcagccggcgacccgcacggctgcctcgcctggctcgacgcccacccggcgcgctccgtggcgtacgtcagcttcggcacggtggcgtcgccgcgccccgacgagctccgagagctggcggccgggctggagtcctctggcgcgccgttcctgtggtccctgcgcgaggactcgtggccgctcctgcccgcggggttcctggcccgcgccgccgccgccggcgccgggctcgtgg

SEQ ID NO: 30512 - protein, 352 aa, Panicum virgatum
  misc_feature: Ceres CLONE 1900402
  misc_feature (24)..(352): Pfam Name: UDPGT Pfam Description: UDP-glucoronosyl and UDP-glucosyl transferase
  misc_feature: SWISSPROT Homolog: EC 2.4.1.115 Anthocyanidin 3-O-glucosyltransferase
  misc_feature: Useful for making plants with modulated flowering time
  misc_feature: Useful for making plants with altered carbohydrate content
MAPDASSPTPHVAVVAFPFSSHAAVLLAFARALAAAAAPAGGTLSFLSTAGSIAQLRRAVGAELPGNLRFVEVPDGAGPPAAKGAVPVPVPVPMPRQMELFMAAAEAGGVKAGLQAARAAAGGAKVSCVVGDAFVWPAAEAAAAAGAPWVPVWTAASCALLAHLRTDALRADVGDQAASRADELLVSHPGLGSYRVGDLPDGVISGDFNYVISRLVHRMGQLLPRAAAAVALDTFPGLDPPDVTAALDETLPNCLPLGPYHLLLPKDTTDAASQAAGDPHGCLAWLDAHPARSVAYVSFGTVASPRPDELRELAAGLESSGAPFLWSLREDSWPLLPAGFLARAAAAGAGLV

SEQ ID NO: 30513 - DNA, 360 bp, Panicum virgatum
  misc_feature: Ceres CLONE 1900402-R
  misc_feature: Encodes the peptide sequence at SEQ ID NO. 30514
gatgaacgcgcggtccgtggcgagcgtgtgggggttcggattggcgttcgagggcgccacgatgacgcgcgccggtgtggccgccgccgtgggggagctgctacgcggggaggaaggggcgaggatgagggccagggcgcaggagttgcaggccgcggtggccgcagcgttcgtgccgggcggcgcgtgcaggaggaacttcgacgagttcgtgcagatagtctgtcgcgtgtaaattgcccgattcatcattcatacttgttgtcttttttttttgcgactttattcaacctgttgtcgggcgatcgaactgtgaccggttttatgtactagagatgcacgtgccacatgtacgtgttt

SEQ ID NO: 30514 - protein, 77 aa, Panicum virgatum
  misc_feature: Ceres CLONE 1900402-R
  misc_feature: SWISSPROT Homolog: EC 2.4.1.115 Anthocyanidin 3-O-glucosyltransferase
  misc_feature: Useful for making plants with modulated flowering time
  misc_feature: Useful for making plants with altered carbohydrate content
MNARSVASVWGFGLAFEGATMTRAGVAAAVGELLRGEEGARMRARAQELQAAVAAAFVPGGACRRNFDEFVQIVCRV

SEQ ID NO: 30515 - DNA, 1466 bp, Panicum virgatum
  misc_feature: Ceres CLONE 1900406
  misc_feature: Encodes the peptide sequence at SEQ ID NO. 30516
cacacggtcacgggcgcggcataaacaggagagcggcgccgaatagactctgcggcctcgcctccttccccacttcgtcatcggcagctccgccgcgtgccggccggccgataccttcgctactatactcgctacccgatcgcctgctcccgcggtcccgcctgcgcctctgcatccctttccggctctcgcgccttctaccccgcgacgcctcggcatcagcccctcgccgcgcagcgcagagcgcaccccccaccacgcccccggcgccggcgagatggagctcaagcccggcatgtcggcgctcgtcaccggcggcgcctccggcatcgggaaagcactgtgcattgcttttgcacagaagggtttatttgtgaccgtcgtcgatttctctgaagaaaatggaagagaagttgcggtgttagttcagaaggaaaatagcaaatttcatagagatcttagagttccatcttctatatttgtcaaatgtgatgttagtaatgcagatagtcttgcttctgcttttgagaagcatgttcaaacatatggtagactagatatctgcatcaattgtgccggaattgccaataaaacactagtttatgatgatacatctgatggagctagaacatggaggcatgctgtaaatgtgaaccttgttgctgttattgatggtactcgcattgcaagtcaaataatgcggtcccaaaagaagcctggtgtcataataaatatcggttcagcagcaggcctttatcctatggtttttgatcccgtatatagtgcgacaaaagggggtgtggttatgtttacaagatcacttattcgattgaaacgtcaaggtgttcgtgtcaatgtgctctgcccagagtttgttcaaactaatatgggggaacaaatgagccgcagaattgtagatgctactggtggatatttgaagatggaggatattgtcaatggtgcgtttgagcttatacaggatgagagcaaggctggtgcttgcctttggataacgaaacgacgagggatggaatactggccaacaccagatgaacaaagaaagtatatagtgaaccccagcaagtcgaaaaggatgctgacaaataacatatatccgagcatccaaatgcctgaatcttttgagaagatagttgttcacacactcagccataatttccgcaatgctacaagacttgagcgtgttcgactgagattgcctgttgaaccacacagtgctctggttaaaataatatatgctggtgtaaatgctagtgatgtaaacttcagctcaggacgctattttagcagtaatcctaaagatgcctcttcacgccttccatttgatgctggttttgagggtgtgggaattgttgccgcagtcggagattcagtgaatcatatcatagtaggcactcctgtggcccttatgacttttggaagctatgctgaattcacgcaggttgcag

SEQ ID NO: 30516 - protein, 396 aa, Panicum virgatum
  misc_feature: Ceres CLONE 1900406
  misc_feature (7)..(187): Pfam Name: adh_short Pfam Description: short chain dehydrogenase
  misc_feature (317)..(396): Pfam Name: ADH_N Pfam Description: Alcohol dehydrogenase GroES-like domain
  misc_feature: SWISSPROT Homolog: EC 1.1.1.141 15-hydroxyprostaglandin dehydrogenase (NAD(+))
MELKPGMSALVTGGASGIGKALCIAFAQKGLFVTVVDFSEENGREVAVLVQKENSKFHRDLRVPSSIFVKCDVSNADSLASAFEKHVQTYGRLDICINCAGIANKTLVYDDTSDGARTWRHAVNVNLVAVIDGTRIASQIMRSQKKPGVIINIGSAAGLYPMVFDPVYSATKGGVVMFTRSLIRLKRQGVRVNVLCPEFVQTNMGEQMSRRIVDATGGYLKMEDIVNGAFELIQDESKAGACLWITKRRGMEYWPTPDEQRKYIVNPSKSKRMLTNNIYPSIQMPESFEKIVVHTLSHNFRNATRLERVRLRLPVEPHSALVKIIYAGVNASDVNFSSGRYFSSNPKDASSRLPFDAGFEGVGIVAAVGDSVNHIIVGTPVALMTFGSYAEFTQVA

SEQ ID NO: 30517 - DNA, 698 bp, Panicum virgatum
  misc_feature: Ceres CLONE 1900406-R
taggtggggaaatgtttgacttgtgcttgaatgcacttgcagtccacgggcatctcattgtaattggtatgatctcccagtatcaaggagagggtggatggaagcctaagaattacactggactatgtgagaagatactagctaaaagtcaaactgtggctggatttttccttgttcagtatgctcatctgtggcaagatcatcttgacaaactttttgacctgtatgcctctggaaagctaaaggtttccctagatcccaagaagttcctgggtgttgtttccgtgccagatgcagtagaataccttcattctggcaggagtgttggcaaggttgttgtgtgcattgatccatcatacaggcagatcgttgctaagctttaacttaaggacaatggcacgcactatggttcacagttgcaatataggttaggctgttataggacgcagaggccctgaggccatttttctttggttctctgtttcctgcctaggtggctcaacacaagacagcattttccaggttcgtttcagaaaagatagcatttcccaagggggtaagaaccgaataatatgcatgtgttggtgtatggctcagttttgtgcatagtttataagatgcacgactatactaaagggcaaacatggacatggaattcaattaagtttataatcccagagattatgatcatattgggc

SEQ ID NO: 30518 - DNA, 727 bp, Panicum virgatum
  misc_feature: Ceres CLONE 1900414
  misc_feature: Encodes the peptide sequence at SEQ ID NO. 30519
gtgtcactcgccacaaccgaactctgaccccccccccccccccactcgcctcctctccaaccaattcgcacgccacgccacggagagctgagctgagctgcgcatggcgaggtccatggagagcggcgacggcggcggcggcgggctggtggtgacggagctgagccacatcaaggagctggtgcggcagctggaggcgcacctcggcggctccgacgagctctgcaggcacctcgccacggagatcttctccctcaccgagcgctccatcggcatcatcaccgccgcctcctcctcctccggcctcgacgcccggaagcgggagtacgccgggctcgcctcgcccctcccggccacgcccaccagcgacgtcgccgacgggcctttcaggagcaccaagaagaggaaggtgatggagaagaggaagcagcaggtgcgcgtgagctcgccccgcggcggcgccggcgagaacccggtggacgacggccacagctggcggaagtacggccagaaggagattcttggagccaagcacccaaggggctactaccgctgcacgcaccgccactcccagggatgcttggcgacgaagcaggtgcagcgcaccgacgaggacccggcgctcttcgacgtcatctaccacggcgaccacacctgcgttcagaggccggcggtggcggcggcgccggagcacaatccggacgcgaacagcttcctgcagagcctg

SEQ ID NO: 30519 - protein, 207 aa, Panicum virgatum
  misc_feature: Ceres CLONE 1900414
  misc_feature (125)..(187): Pfam Name: WRKY Pfam Description: WRKY DNA -binding domain
MARSMESGDGGGGGLVVTELSHIKELVRQLEAHLGGSDELCRHLATEIFSLTERSIGIITAASSSSGLDARKREYAGLASPLPATPTSDVADGPFRSTKKRKVMEKRKQQVRVSSPRGGAGENPVDDGHSWRKYGQKEILGAKHPRGYYRCTHRHSQGCLATKQVQRTDEDPALFDVIYHGDHTCVQRPAVAAAPEHNPDANSFLQS

SEQ ID NO: 30520 - DNA, 2220 bp, Panicum virgatum
  misc_feature: Ceres CLONE 1900424
  misc_feature: Encodes the peptide sequence at SEQ ID NO. 30521
attgccgcctcctcctcaccagcctcaaggaaagggcaggcaaggcgaggcgaggccgaggccaagccgtcccctccctcctcctcccccgttgcttcagttcgtccgttgcgtcccatttccttcaccccatatctaatcctggaccgacctgcaagcagcagcgagaggagaggaggaggagacgtagatatatagatacatagccagagagactcgtcggagctcctccgggaaaggaacttctccgtgggtcagatctttcttcgagacgacctgcaggaggaggaggatgccttccagagcgatgaaccggctgctcttcgtcgagtcgtcgtcctcgtccggcggcggcggcggcagggaggccgagccggccgcggcggtgctctgcgccccgaggccgcgcagggcccttgtccacccctgcagcgccgacctcatcctcggcccgccgcccttcctgctcggcaacaacaagacagcagccgccgccgccgcagaccgatccgaggcgagcacgcaagcggcgagtcgccgacgctccttgagatcttcggcgagccgtgactgagacatctgctgccgtccgccgagcagtttaatcttcacctgcagccatgggtaaggagaagtcccacatcaacatcgtggtcattggccacgtcgactccggcaagtcgaccaccaccggccacctgatctacaagcttggaggcatcgacaagcgtgtgatcgagaggttcgagaaggaggctgcggagatgaacaagaggtccttcaagtacgcgtgggtgcttgacaagctcaaggccgagcgcgagagaggtatcactattgatatcgccctgtggaagttcgagaccaccaagtactactgcacggtcattgatgcccctggacaccgtgacttcatcaagaacatgatcacgggtacctcccaggctgattgtgctgtccttatcattgactccaccactggtggttttgaggctggtatctccaaggatggccagacccgcgagcatgctctccttgctttcactcttggagtcaagcagatgatctgctgctgcaacaagatggatgccaccactcccaagtactccaaggcccgttatgatgagattgttaaggaagtctcctcctacctgaagaaggtgggctacaaccctgacaagattgccttcgttcccatctctggttttgagggtgacaacatgatagagaggtccaccaaccttgactggtacaagggcccaaccctgcttgaggctcttgaccagatcaacgagcccaagaggccttcggacaagcccctgcgtctcccccttcaggatgtgtacaagattggtggtattggaactgtccctgttggccgtgttgagacaggtatcatcaagcctggtatggttgttacctttggccccagtggcctgactactgaggtgaagtcagttgagatgcaccacgaggctctccaggaggcccttcctggtgacaatgttggcttcaacgtgaagaacgttgctgtgaaggatctgaagcgtgggtatgtggcctccaactccaaggatgaccctgccaaggaggctgccagcttcacctcccaggtcatcatcatgaaccaccctggacagatcggcaacggctatgccccagtgctggactgccacacctcccacattgctgtcaagtttgctgagctcattaccaagatcgacaggcaatctggtaaggagcttgagaaggagcccaagttcctcaagaatggtgatgctggtatggtcaagatggttcccacgaagcccatggttgtggagacattctctgagtaccctcctcttggtcgctttgccgtccgtgacatgaggcaaacagttgctgttggagtcatcaagagtgtggagaagaaggacccaaccggtgccaaggtgaccaaggctgcagccaagaagaaatgatgcgtctggtggttgattctgcttctgcatttggcatacctagatgctttactatcatgccttattttctgtccatggccatttttgttatcaggtgaaccgttagtttgctggcaaaatgagccattggtcaatcgtcctagtactattttgttatttggcttaggcaaacctggaatgcttggactgatctgtgctggtatggtacatgatgaatctaaatctttaacacaagtgaagctttttttttccttac

SEQ ID NO: 30521 - protein, 447 aa, Panicum virgatum
  misc_feature: Ceres CLONE 1900424
  misc_feature (5)..(225): Pfam Name: GTP_EFTU Pfam Description: Elongation factor Tu GTP binding domain
  misc_feature (322)..(430): Pfam Name: GTP_EFTU_D3 Pfam Description: Elongation factor Tu C-terminal domain
  misc_feature (248)..(315): Pfam Name: GTP_EFTU_D2 Pfam Description: Elongation factor Tu domain 2
  misc_feature: SWISSPROT Homolog: EC 2.7.7.4 Sulfate adenylyltransferase
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTNLDWYKGPTLLEALDQINEPKRPSDKPLRLPLQDVYKIGGIGTVPVGRVETGIIKPGMVVTFGPSGLTTEVKSVEMHHEALQEALPGDNVGFNVKNVAVKDLKRGYVASNSKDDPAKEAASFTSQVIIMNHPGQIGNGYAPVLDCHTSHIAVKFAELITKIDRQSGKELEKEPKFLKNGDAGMVKMVPTKPMVVETFSEYPPLGRFAVRDMRQTVAVGVIKSVEKKDPTGAKVTKAAAKKK

SEQ ID NO: 30522 - DNA, 1865 bp, Panicum virgatum
  misc_feature: Ceres CLONE 1900438
  misc_feature: Encodes the peptide sequence at SEQ ID NO. 30523
aaaagctaataagcatatatagtagtatagtgtgtgcgcgtctctcctggtgctcgcgctcgcgcgtaagtcgtccatggccgtccaccaccatcctcacctcctcgacttctcatcggctcctccgaacgcggtggcggaggctcccccgccgccctccttcgaagaccacgggcagcagctcctcgcgctccacggcaccgacatgctgatgacgaccgtacctcaccgtgtcctcgtcgacgacgacacagcggcagcatggccgccgccggtctccctctccctgtacaacaactacaacacggcagcagcggcggcgtcgcttttcgtcggccatcaccagcagcagacgtcgttggcgcctaatcatcatcaccagctgcatcatcagccgttgcagcagcaggtacggaggatgagctcaacaaggtacctgggccctgtgcaggagctgctcagcgagttctgcagccttgaaggggacctgctgctgcacgccgccgccatgaacgggaacggcaagcagagagatccgaacgcggagccgtcgccgtcgtcctcctcctctgcaggtggtggcctctgcctctgggggcatccctcgtctctgatgagcaccaccatggatctattggagcttgagaggaggaagaccaggctcttatccatggttgaagaggtggaccgtcggtaccgtcggtaccgtgagcagattcggtcggtggaggcgtcgttcgaggcggtggccggaggcggcgcggcgcaggtgtacacgaggctggcgctgcgtgccatgtcgcggcacttccgctgcctgcgggacgccgtgctggcgcagctgcgcgcggtgaggaaggcctgcatggggggagacgatagggacggcggcggcgggccgtcgccggcggcgggcgccaccaagggggacacgccgaggctcaaggtgctggaccagtgcctcaggcagcagcgcgcgttccagcagccccccggcagcaccatcgagagctacccatggcggccgcagcgaggactgccggagcgcgccgtcgccgtcctccgcgcatggctattcgagcacttcctccacccgtatccaaatgatgtggacaagcacattctggcgcgccagacagggttatcaagaagccaggtttccaattggttcatcaacgcgagggtgcggctgtggaagcccatgatagaggacatgtacacggaagaagagaagctgcaatcagcagaggcgagccaaaacaacccaagcggcggcggaggcggtggaacagtcgtcaaacctgagcatcatcacaacacgacgacgacggcactgacagccataggagcaggaggaggagatcaaagtcacttccgatcagctgctgctagcgctgggaacaaccctagcaactccatgctggtctcgtcgtccatcgtgaccgacggcgaccatctgttcagcagctgctatccaccagcaagcatccatcatgggagtcatcgtcacggcgctgcagtgtcgcttactctagggctccagcagcagcagcagcaactgtttatcgcgtcgggggaggcgacgatgatgcaccagagatcgctcatgattcatggcgatggcgaggaagagcccgtgctgccgtatagagacctcatgggctctcagttgctccatgatttgacagggtagctacacaataagcttaagaggtagtactaaggctctgatcattacaggagaggtaaaatccatttcttgagcaaaactgatgtgtgcttcagatcctatatatagtatacatttatttaagagttcaattcagatcttatatagtacaacaactcctattttagagcgagcc

SEQ ID NO: 30523 - protein, 424 aa, Panicum virgatum
  misc_feature: Ceres CLONE 1900438
  misc_feature (3)..(140): Pfam Name: POX Pfam Description: Associated with HOX
  misc_feature: The sequence is a functional homolog of SEQ ID NO 2330 in the 10/374,780 US patent application
  misc_feature: The sequence is a functional homolog of SEQ ID NO 236 in the 10/225,068 US patent application
  misc_feature: The sequence is a functional homolog of SEQ ID NO 268 in the 10/412,699 US patent application
  misc_feature: The sequence is a functional homolog of SEQ ID NO 588 in the 11/479,226 US patent application
  misc_feature: Useful for making plants with modulated biomass
MSSTRYLGPVQELLSEFCSLEGDLLLHAAAMNGNGKQRDPNAEPSPSSSSSAGGGLCLWGHPSSLMSTTMDLLELERRKTRLLSMVEEVDRRYRRYREQIRSVEASFEAVAGGGAAQVYTRLALRAMSRHFRCLRDAVLAQLRAVRKACMGGDDRDGGGGPSPAAGATKGDTPRLKVLDQCLRQQRAFQQPPGSTIESYPWRPQRGLPERAVAVLRAWLFEHFLHPYPNDVDKHILARQTGLSRSQVSNWFINARVRLWKPMIEDMYTEEEKLQSAEASQNNPSGGGGGGTVVKPEHHHNTTTTALTAIGAGGGDQSHFRSAAASAGNNPSNSMLVSSSIVTDGDHLFSSCYPPASIHHGSHRHGAAVSLTLGLQQQQQQLFIASGEATMMHQRSLMIHGDGEEEPVLPYRDLMGSQLLHDLTG

SEQ ID NO: 30524 - DNA, 682 bp, Panicum virgatum
  misc_feature: Ceres CLONE 1900441
  misc_feature: Encodes the peptide sequence at SEQ ID NO. 30525
gttctgcagcagtcgccgtcctcggcctccccttcctcaccttggcgcctagcgaggaccaggagattcatccggacctcgattgcttccttctgctgccggtccgaagtccgatgggaagcagggacggcagcggcgtcagcacaggaggccagggttatgccgctgacatcgattccatcagggaggcgcaggcccgcattgcgccgcacgtgcacaggacgcccgttctgtcctcgacatcaatcgatgccgtagcggggaagcagctgttcttcaagtgcgagtgcttccagaaggctggcgcattcaagatccgtggtgcttcgaattcgatatttgcgcttgatgatgagcaggcatcaaagggtgtggtgacacatagcaggtttcttcacagtgggaaccatgccgctgccgtggctttagctgcaaagctgcgtggcatacccgcacacattgtcataccaaagaatgcaccagcatgtaaggtcgacaacgttaggcggtatggtggtaatattatctggagtgatgtcagcattgagtcgagagaatctgtttgtaaaagagtccaggaggagactggtgctgttctagttcatcccttcaataataagtacactatcagtggtcagggtacagtatctcttgagcttctagagcaagtccctgaaatgac

SEQ ID NO: 30525 - protein, 189 aa, Panicum virgatum
  misc_feature: Ceres CLONE 1900441
  misc_feature (30)..(189): Pfam Name: PALP Pfam Description: Pyridoxal-phosphate dependent enzyme
  misc_feature: SWISSPROT Homolog: EC 5.1.1.18
MGSRDGSGVSTGGQGYAADIDSIREAQARIAPHVHRTPVLSSTSIDAVAGKQLFFKCECFQKAGAFKIRGASNSIFALDDEQASKGVVTHSRFLHSGNHAAAVALAAKLRGIPAHIVIPKNAPACKVDNVRRYGGNIIWSDVSIESRESVCKRVQEETGAVLVHPFNNKYTISGQGTVSLELLEQVPEM

SEQ ID NO: 30526 - DNA, 666 bp, Panicum virgatum
  misc_feature: Ceres CLONE 1900452
  misc_feature: Encodes the peptide sequence at SEQ ID NO. 30527
ccctctggcttcgccgctggacgagagcacgcgttgagacggggccggtcgggcgcggctctatctgcgcctcccccccggccatatttcgcctcctctggccggatctcaccctgcggctcgtcccgtggctgtcctgcgccgttcagagttcgagcacatggttgagctgctcgattcgatcaataaagaagggtgaaaggctacgtgagctcttgctgcagctagaacaacttacaccagaatcatggcgagccttgccgattcttttctagcggatcttgatgaactgtcagacaatgaaggctatcctgaagaagacaatgctgaggcagctggtatggaggatgacggtgatgatgatatgcctgaccttgagtctcttaattacgatgatctggatagtgtctcaaagttgcagaagacgcaacgctataatgacataatgcaaaaagttgaagatgcacttcagaaaggcactgacttctccaatcaaggttccatcctggaggaggatccagagtcccagcttattgtggactgcaatgctttatcagtagatattgagaatgagataaccataatccataatttcataagtgacaagtataggttgaagtttcctgaactggagtcccttgttcatcatccgattgattatgcccg

SEQ ID NO: 30527 - protein, 139 aa, Panicum virgatum
  misc_feature: Ceres CLONE 1900452
  misc_feature (95)..(139): Pfam Name: NOSIC Pfam Description: NOSIC (NUC001) domain
MASLADSFLADLDELSDNEGYPEEDNAEAAGMEDDGDDDMPDLESLNYDDLDSVSKLQKTQRYNDIMQKVEDALQKGTDFSNQGSILEEDPESQLIVDCNALSVDIENEITIIHNFISDKYRLKFPELESLVHHPIDYA

SEQ ID NO: 30528 - DNA, 2112 bp, Panicum virgatum
  misc_feature: Ceres CLONE 1900467
  misc_feature: Encodes the peptide sequence at SEQ ID NO. 30529
aagaaaaaaaggtaaataaaaataaggaaaatccagggggtagcgactggggagagaggaagcaagcgagaaggtcaagccgcgaagagaacagaggcacggcacagatccctctcctcgacccttccgacgcggcaaagcaaaaaaacacagggaggagagggggagagaaagagggagcaggaggagcccggaatcccaaccccaaccccaaccccaaatcctggtccaatctctcaatcaggggagcatcggggtctgatcgggtcggaggattcggggggcgcagccatgaacgagaaggcgtccgtatccaaggagctcaacgccaagcacaagaagatattagaaggtcttcttcggctgcctgagaacagagaatgcgcagactgcaagtcaaagggtcctcgatgggcaagtgtgaatctagggatctttatatgcatgacatgttctggaattcatagaagccttggggtgcacatatctaaggtaagatctgccaccctggatacatggctgccagagcaagttgcatttattcaatcaatgggaaacgaaaaggcaaacagctattgggaagcagagttgcctcctaactatgatagggttggaatagagaatttcatccgtgcaaaatacgaggacaagagatgggtaccaaggaatggaacgtcacgaccttcctctattgctcgagatgagaaaagccaagagtctccggctagtgctaacagaagtggatatggtcacagatcttcatttgagcaaaaccgtacttcaccagctccgagcaaaattgcacctgcagcttcaaggatgccctctcaggcatcacctgcaaaagtagaaccaccagttcctaaggtggtttcacctcctcagccacagaaatctcctgccaaagttgacgcgacaccccctaaagttgagaagccatcggttgcaccacctcctaaagttgattatgccactgatctctttaacatgttatctatggatggaacaacagagaaagagtcagagtcatcttcaaacgatgataatgcctgggatgggttccaatctgcacaaccaccagtacctagctcagagaaaaaggattctgccaaactaacagaaagtaagccccaatctacgtcaggaatagaagatttatttaaagactcaccagctgtgtcagtatcctcagctccagctgtttcccaagcaaatgcgaagaatgatatcatgagtttgtttgagaagtccaatatggtatcaccattcgctctccatcagcagcagctggcattgatgtcccagcagcaagctctttctatggctgctcttaaagctggaaatgcaccacaaatggttccgggggaatgccaatcagctaaatgctaatggttctaatccccctcttggaaactgcctttttcaaactggacaaatcttggttatcaaacacctgggttgactccagcagcagcaccagcagcacagaatggtgccgctaaggttgtgaacagcaaccatgactcttctgggagcttcggttttggtacacctgggctgtacaacattagttcagctgtcccagcaaatggggctgcggttgcaggtgctagcaataatggcactggatccactgcctcatctactcttccctcacaatccggcaaagattacgatttttcctcattaactcaaggatttttctccaaacgatgagcaccttgtgagcttggaaaccgaacagaccagtgtgtaatgttggacgaggcatattgatgtagggagcacaaggggtttgtgcacaattatttgaggcagcttttcttctggtggatacatagttacatgacttcgtagctgtcggacaaataagagggaaaatatgtcgctaaatagctcatgatgtttctacaattgaggagtttgttgtcagttatgcttcctactttcactcgaggattacgccttgccagttatagaagtataatgcagcctttgcattgtcttggtgtgacttagctgcaacgccaatactgattaccgattattttgtattgtacaagacaattggatttttatttgttttacatttgtgtactgttgtgagactgg

SEQ ID NO: 30529 - protein, 365 aa, Panicum virgatum
  misc_feature: Ceres CLONE 1900467
  misc_feature (16)..(130): Pfam Name: ArfGap Pfam Description: Putative GTPase activating protein for Arf
  misc_feature: Useful for making plants with altered terpenoid content
  misc_feature: Useful for making plants with modulated nitrogen use efficiency
MNEKASVSKELNAKHKKILEGLLRLPENRECADCKSKGPRWASVNLGIFICMTCSGIHRSLGVHISKVRSATLDTWLPEQVAFIQSMGNEKANSYWEAELPPNYDRVGIENFIRAKYEDKRWVPRNGTSRPSSIARDEKSQESPASANRSGYGHRSSFEQNRTSPAPSKIAPAASRMPSQASPAKVEPPVPKVVSPPQPQKSPAKVDATPPKVEKPSVAPPPKVDYATDLFNMLSMDGTTEKESESSSNDDNAWDGFQSAQPPVPSSEKKDSAKLTESKPQSTSGIEDLFKDSPAVSVSSAPAVSQANAKNDIMSLFEKSNMVSPFALHQQQLALMSQQQALSMAALKAGNAPQMVPGECQSAKC

SEQ ID NO: 30530 - DNA, 2525 bp, Panicum virgatum
  misc_feature: Ceres CLONE 1900469
  misc_feature: Encodes the peptide sequence at SEQ ID NO. 30531
gatccgcgctaaatgcattgcgagtctgcaatcttgtagcattccttcctgttccatctgccgcaagatgtaagcaggctcacacttgacacaccgagtggccattcagatcttctgtttgagaaaaagcaacgccctttttggtccgagaaatggatgagagcttcgtgcccctgcggggcatcaagaacgacctccatgggaggctcgcctgctacaagcaggactggaccggagggttccgcaccggtatcaggatcctggcgccaaccacctacatattctttgcgtccgcgataccggtgatatcgtttggagagcaattggagaggaatactgatggagttctcacagcagttcagacgttagcatccactgccctgtgtggcataatccactccatcgtgggagggcaacctctgctgatccttggcgtcgccgagccgacagtgctcatgtacacattcatgttcaacttcgccaaggacaggcctgacctcggccgaaatctgttccttgcctggaccggttgggtctgcgtatggactgccattctgctgttcttgctggcgatactaggcgcatgctcaatcatcaaccgattcacccgcatcgcaggcgagctgtttgggcttctgattgctatgctcttcatgcagcaggctatcaaggggcttgtagatgagttccgcattcctgaaagggaaaaccgaaaggcactagagtttgttccatcatggcgctttgcaaatgggatgtttgcaatcgtcttgtcatttggccttttgctcactgccctgaggagcaggaaggcgcgatcatggcgctatagagcaggttggctgcgtggcttcattgccgactatggtgttccactgatggtgctagtatggactggagtttcttacataccttacggaagtgtgccaaaaggaattccacgacgccttttcagccctaatccatggtcccctggtgcttatgacaattggactgttatcaaggatatggcacatgttccgctcctctatatcatcggtgccttcataccaccaacaatgattgctgttctctactacttcgatcatagtgttgcatctcagctcgctcagcagaaagagttcaatttgaggaagcctccatccttccactacgatttgcttctcttaggcttcctgaccttactgtgtggccttattggtatccctccatcaaatggtgtcattccacagtcacccatgcatacaaagagcttggctactctcaagcatcagctgcttcgtaaccggctagtagccactgcacggaagagcatgagtcagaatgctagcttgagccaactgtatagcagcatgcaggatgcttatcagcagatgcagacaccacttgtttatcagcaaccgtctgtcagaagaggcttaaatgagctcaaggactcaacagttcagctagcttcaagcatgggtaacattgacgcaccagttgatgagacagtttttgacatagagaaagaaattgatgatttgttgcccatcgaagtcaaggagcagcgcttgagcaacttgctacaggcagccatggtgggggcttgtgtcgctgcaatgccgctactcaagaagatcccaacatctgtcctctggggctattttgccttcatggccattgagagcttgcctggtaaccagttctgggagaggatcttgctgctcttcactgctcccagcagaagatacaaggtgctagaagagtaccacaccacgttcgtcgagactgtgccattcaagacgatagccatgttcacactgttccagacaacatacctgctggtctgctttggaatcacatggatcccgatagccggtgttcttttccccctcatgatcatgctcctggttccagtcaggcagtacatcctccccaagctcttcaaaggtgcacatctaactgacctggatgcagcagaatatgaggaatcacctgctataccattcagccttgctgcacaagatatcgatgttgcattgggacgcgcccaaagtgcagagatcctagacgacatggtcacaagaagccggggcgagatcaaacgtctgaacagcccgaagatcactagctcaggtggtacacctgtggcagaactgaaaaacatccgcagcccatccatttctgaaaaggcatacagccctcggctcactgagctcaggcatgagcgcagccctctgggagggagaaacagccctaggacgccatccaagttgggcgaaggctcaacaccgaagtgaataaatcaacgatgcattgcttagataagctaagcagctactggaagtcagctatatgagtgatttcagtattaggtgttaaaagaaagagagttttcagtgttagtatccttatatgagatgtcctctgatgaagtatgatatgaatatctctagcttctctcttctctttctcatgttctcctgatttgagtaccatatctgtaatatctgaactagaggaatattagagtaactactcgg

SEQ ID NO: 30531 - protein, 709 aa, Panicum virgatum
  misc_feature: Ceres CLONE 1900469
  misc_feature (7)..(552): Pfam Name: HCO3_cotransp Pfam Description: HCO3- transporter family
MDESFVPLRGIKNDLHGRLACYKQDWTGGFRTGIRILAPTTYIFFASAIPVISFGEQLERNTDGVLTAVQTLASTALCGIIHSIVGGQPLLILGVAEPTVLMYTFMFNFAKDRPDLGRNLFLAWTGWVCVWTAILLFLLAILGACSIINRFTRIAGELFGLLIAMLFMQQAIKGLVDEFRIPERENRKALEFVPSWRFANGMFAIVLSFGLLLTALRSRKARSWRYRAGWLRGFIADYGVPLMVLVWTGVSYIPYGSVPKGIPRRLFSPNPWSPGAYDNWTVIKDMAHVPLLYIIGAFIPPTMIAVLYYFDHSVASQLAQQKEFNLRKPPSFHYDLLLLGFLTLLCGLIGIPPSNGVIPQSPMHTKSLATLKHQLLRNRLVATARKSMSQNASLSQLYSSMQDAYQQMQTPLVYQQPSVRRGLNELKDSTVQLASSMGNIDAPVDETVFDIEKEIDDLLPIEVKEQRLSNLLQAAMVGACVAAMPLLKKIPTSVLWGYFAFMAIESLPGNQFWERILLLFTAPSRRYKVLEEYHTTFVETVPFKTIAMFTLFQTTYLLVCFGITWIPIAGVLFPLMIMLLVPVRQYILPKLFKGAHLTDLDAAEYEESPAIPFSLAAQDIDVALGRAQSAEILDDMVTRSRGEIKRLNSPKITSSGGTPVAELKNIRSPSISEKAYSPRLTELRHERSPLGGRNSPRTPSKLGEGSTPK

SEQ ID NO: 30532 - DNA, 691 bp, Panicum virgatum
  misc_feature: Ceres CLONE 1900470
  misc_feature: Encodes the peptide sequence at SEQ ID NO. 30533
accgagttcttctcgccgcaaaaactagctgtttctctttctccctctcgattcccggccgaataagatggcagcggccgcgcgcctcctcgcgcgaatctcccggcagggcgtcgcctcggccgctgtggcgggggcggtgaggcggcggccagatgcggcggcgctcctgggggcgtccgcgctggcggcggcggatccctgcgcttcgatcaaggtcattcctttgttgaatcaatcagcacgatatacaacatcggcatttcaaaggtctgggttttcaacttcggcacctcagcaagatgataaggaggcaaacaaacatgcagatgatggagttagtaaaagtgctggagtgagtactgaagcttcaggtgaagatgtgcctggaatcaacaaaacccaggaaccagattcagaagacctagacctatcgaaggaggacctcgtgaagctacttcttgagaaagatgagtctttgaaattgaaagatcaggaggttaaagacatgaaggataaggtgctgcgcagctacgccgagatggagaatgtccttgccagaacaaagcgggaatcggagaacaccaagaagtatgccatacagaacttctccaagagtttgttagatgttgcagacaatttgtctcgagcatcatctgttgtcaaggaaagtttctcaaagatagatact

SEQ ID NO: 30533 - protein, 207 aa, Panicum virgatum
  misc_feature: Ceres CLONE 1900470
  misc_feature (111)..(207): Pfam Name: GrpE Pfam Description: GrpE
MAAAARLLARISRQGVASAAVAGAVRRRPDAAALLGASALAAADPCASIKVIPLLNQSARYTTSAFQRSGFSTSAPQQDDKEANKHADDGVSKSAGVSTEASGEDVPGINKTQEPDSEDLDLSKEDLVKLLLEKDESLKLKDQEVKDMKDKVLRSYAEMENVLARTKRESENTKKYAIQNFSKSLLDVADNLSRASSVVKESFSKID

SEQ ID NO: 30534 - DNA, 440 bp, Panicum virgatum
  misc_feature: Ceres CLONE 1900501
  misc_feature: Encodes the peptide sequence at SEQ ID NO. 30535
acacgaatccggaattccggatagagcgccgcccccacctcgacccgctccgtccggcgacgaggaccccgttccggcgccgccacagcgtcgaaccgagagaagggcgaggagggggggcaagcatgacgacgatccggcggttctgctgcgacgacctcctccgcttcgcctccgtcaacctcgaccacctcaccgagacgttcaacatgtcgttctacatgacgtacatggcgcgctggcccgactacttccacgccgccctcagccctggcggccgcgtcatgggttacatcatgggtaaagttgaagggcagggtgagtcttggcatgggcacgtcacggcagtgtctgttgcctcggaatttcggaggcagaaattagccaagaagctcatgaacttgctggaggaaatcagcgataaaatatatctcagaaat

SEQ ID NO: 30535 - protein, 104 aa, Panicum virgatum
  misc_feature: Ceres CLONE 1900501
  misc_feature: SWISSPROT Homolog: EC 2.3.1.88 Peptide alpha-N-acetyltransferase
MTTIRRFCCDDLLRFASVNLDHLTETFNMSFYMTYMARWPDYFHAALSPGGRVMGYIMGKVEGQGESWHGHVTAVSVASEFRRQKLAKKLMNLLEEISDKIYLR

SEQ ID NO: 30536 - DNA, 669 bp, Panicum virgatum
  misc_feature: Ceres CLONE 1900512
  misc_feature: Encodes the peptide sequence at SEQ ID NO. 30537
gacgccgccgcaccaaccacgcgcacgaccagcacaccagagcagaggcggcgccaccacccggtagagcccaagaggcagatcgcgcgcgatccgatccccgccgatcgccatggccccgccggccgtggacccgcgcagcggctactgcgccgccacgcgctccttccgcagcaagcgcgcggacgtcccgctccccgccgaccgcgacctcgacgtcgtcaccttcctcgcctcccgccgccacgcggggaccgtcgcgctcgtcgacgccgccacgggccgccgggtcaccttcgccggcctctggcgcgccgtcgcgggcgcggccaccgcgctcgccgccccgccgctgtccctccgcaagggccaggccgcgctcatcctctccccgaactccgtccacttccccgtcgccgcgctcgccgccatgtccctcggcgccgtgctcaccaccgccaacccgctcaacacgcccgccgagatcgcgaagcaggtcgccgacgcgcgccccgtcctcgccttcgccacccgggacctcctccccaagctccccgccggcctccgcgtcgtgctcctcgagcccgaccgcctcccctccgaccccgccgccgtcgtcgccaccatcggggagatctccgccaccacgcccgaccccgcgcgacgcag

SEQ ID NO: 30537 - protein, 185 aa, Panicum virgatum
  misc_feature: Ceres CLONE 1900512
  misc_feature: SWISSPROT Homolog: EC 6.2.1.12 4-coumarate--CoA ligase
  misc_feature: Useful for making plants with altered carbohydrate content
  misc_feature: Useful for making plants with altered cell wall content and/or composition
MAPPAVDPRSGYCAATRSFRSKRADVPLPADRDLDVVTFLASRRHAGTVALVDAATGRRVTFAGLWRAVAGAATALAAPPLSLRKGQAALILSPNSVHFPVAALAAMSLGAVLTTANPLNTPAEIAKQVADARPVLAFATRDLLPKLPAGLRVVLLEPDRLPSDPAAVVATIGEISATTPDPARR

SEQ ID NO: 30538 - DNA, 683 bp, Panicum virgatum
  misc_feature: Ceres CLONE 1900514
  misc_feature: Encodes the peptide sequence at SEQ ID NO. 30539
cagtcgctccggttgctcgtttcgcctgcctccccacgtctggactcctcgttcgccgcggcgtcaacgcggcttccttcccgcggtctctccgcctccgcctcccagatccggcgcccatggcgaggaacccgggctgcaccgtcttcataggtaacttggatgacagggttcctgagagggttctgtatgagattcttattcaggtaggtcgagttgtagacctacacatacctcgtgacaaggaaactagtcggccaaaaggttatgcttttgctgagtatgaatcagaggagattgcccagtatgctgttaagctattttctggccttgttcgacttcataataaaacacttagatttgcgatgtctgggcaagacaaaccctcatcaaatagcaatatgcctgtaactcctaggttaaaccctctaccaacaccaaagcctcctcatcttatgaggtctagtgatactcctgcatcacagcaaacagtagtgaatggcaggattgcagggtatggtatctcaccaagtcattcatatgacacacattctcaagcatcatcaagtgggttaccaagtagaggactaagcaatggtacgtatgagtatagtagacgtgtattggattctgttctgaatgatgctagccgtcaaggtaccagggaaccagttccctacccc

SEQ ID NO: 30539 - protein, 187 aa, Panicum virgatum
  misc_feature: Ceres CLONE 1900514
  misc_feature (9)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MARNPGCTVFIGNLDDRVPERVLYEILIQVGRVVDLHIPRDKETSRPKGYAFAEYESEEIAQYAVKLFSGLVRLHNKTLRFAMSGQDKPSSNSNMPVTPRLNPLPTPKPPHLMRSSDTPASQQTVVNGRIAGYGISPSHSYDTHSQASSSGLPSRGLSNGTYEYSRRVLDSVLNDASRQGTREPVPY

SEQ ID NO: 30540 - DNA, 695 bp, Panicum virgatum
  misc_feature: Ceres CLONE 1900535
  misc_feature: Encodes the peptide sequence at SEQ ID NO. 30541
aggaagagcagcactaccaaatcctagcgcagcactagctctcctgtgaacagcttctgaaaaactaagctacatccattcccctcacaggaattccttagcttctctgtgtttctagttctctgcgcttgcattccagcaatggcgtgcgagaagagcaatgtcgctaccaatggcgacggcctgtgcatggcgacgccgcgcgccgacccactcaactgggggaaggccgcggaggagctcatgggcagccacctcgacgaggtgaagaggatggtggcggagtaccgccagccgctggtgaaaatcgagggcgccagcctccggatcgcgcaggtcgccgccgtggccaacggcgccggcgaggcccgcgtcgagctcgacgagtcggctcgcgaccgcgtcaaggccagcagcgactgggtcatgaacagcatgatgaacggcaccgacagctacggcgtcaccaccgggttcggggccacctcgcaccgccgcaccaaggagggcggcgcgctccagagggagctcatccggttcctcaacgccggcgccttcggcaccggcaccgacggccacgtcctgccggccgaggcgacgcgggcggccatgctcgtgcgcatcaacaccctgctccaggggtactccggcatccgcttcgagatcctcgaggcgatcgtcaagctgctcaatgc

SEQ ID NO: 30541 - protein, 184 aa, Panicum virgatum
  misc_feature: Ceres CLONE 1900535
  misc_feature: SWISSPROT Homolog: EC 4.3.1.5 Phenylalanine ammonia-lyase
  misc_feature: Useful for making plants with altered cell wall content and/or composition
  misc_feature: Useful for making plants with altered lignin content
MACEKSNVATNGDGLCMATPRADPLNWGKAAEELMGSHLDEVKRMVAEYRQPLVKIEGASLRIAQVAAVANGAGEARVELDESARDRVKASSDWVMNSMMNGTDSYGVTTGFGATSHRRTKEGGALQRELIRFLNAGAFGTGTDGHVLPAEATRAAMLVRINTLLQGYSGIRFEILEAIVKLLN

SEQ ID NO: 30542 - DNA, 556 bp, Panicum virgatum
  misc_feature: Ceres CLONE 1900550
  misc_feature: Encodes the peptide sequence at SEQ ID NO. 30543
gatcgaatcggccggtctcctcctccactctccctccccaccacacccgcggttagcacagcaccatcctctccacccaccaacccaccacgcactccaccacctcttctctcctctcctctctctctctctctctctctctctctctctctctctctctcttcccccaccacgcttaggcttagcttacctccgatccgtctccattctccagcgagagctagctcgctgctcgatcggcccagatccacaaccaacagcgctgcaacaatgccgggtccggggagcgtgcccctggcgctgggcctggacacggcgggcgtgcaagtgccctggtacttccgctgccccatctccctggagctcatggccgaccccgtcaccgtgtccacgggccacacctacgaccgcgccagcatctactcctgggtcgccaccgacaacacctcctgccccgtcacccgcgacccgctcgcagacttcaccctcatccccaaccacaccctctgccgcctcatccagcgagtggcgcgtcgcgctccgctccatgggcgtc

SEQ ID NO: 30543 - protein, 95 aa, Panicum virgatum
  misc_feature: Ceres CLONE 1900550
  misc_feature (19)..(93): Pfam Name: U-box Pfam Description: U-box domain
MPGPGSVPLALGLDTAGVQVPWYFRCPISLELMADPVTVSTGHTYDRASIYSWVATDNTSCPVTRDPLADFTLIPNHTLCRLIQRVARRAPLHGR

SEQ ID NO: 30544 - DNA, 298 bp, Panicum virgatum
  misc_feature: Ceres CLONE 1900553
  misc_feature: Encodes the peptide sequence at SEQ ID NO. 30545
attacacccacatggttacaggaaggaatcaggcatgggtgcaaggaggggtgcttcctccgtcctctctcgctgcctcctcacaaggccgcctcctccttcttgtgacgccggcaaatccgctcttctcggaccatgggctgttctccgctggctcggtactgtaccggcagtcgccgccagcgaggagccgatacggcgcgcatgggaaaacaagcacacacagctcctcatcaatggcaacttcgacgacgaaggttctggtacggcgcccagatctgtctgccgatgttgatct

SEQ ID NO: 30545 - protein, 86 aa, Panicum virgatum
  misc_feature: Ceres CLONE 1900553
  misc_feature: SWISSPROT Homolog: EC 1.2.1.3 Aldehyde dehydrogenase (NAD(+))
MGARRGASSVLSRCLLTRPPPPSCDAGKSALLGPWAVLRWLGTVPAVAASEEPIRRAWENKHTQLLINGNFDDEGSGTAPRSVCRC

SEQ ID NO: 30546 - DNA, 1147 bp, Panicum virgatum
  misc_feature: Ceres CLONE 1900555
  misc_feature: Encodes the peptide sequence at SEQ ID NO. 30547
aagcggcacgcgcagacggcagaccccttcgaaccctagtcacccctcacccgcgccgcccctgcgctccccggccgcctcctgcccccggcggcggctgcggctgcggcatcggcgtcagcgaagatgtcgggcggcttcttccgggggacgtccgctgaccaggacacgcgcttctccaacaagcaggcgaagctgctcaagacacagaagttcgcgcctgagcttgaccacttggtggacatgtctaaggtcaagatggatgtgatgaagccctggatcgccaagagggtcactgagctcctcgggttcgaggacgaagtgctcatcaacttcatctatggcctcctcgaagagaaggaggcggatgggaagaagattcagatccagctgacagggttcatggagaagaacacagtgaaattcatgaaggagctctggaccctcctcctaagtgcgcaacagaatgcaagtggggtacctcaacagtttctagatgcaaaggaggctgaaatacagcagaaaaaggcggaggatgatagaattgcacaggagatccaaaagaagcgggaaaaagagggaagagacttagaattggagaagcagaaaaggatggatggtaatgctggcaactcaagatcctctggcgatccaaatggctctgctataaataatacaactgtcaatgctgaggaagaaatggacttggacttcaaacgcagctcaagaacaaagaaccggggaagtcgcagatccaggagcatttctttgtcgcctcgtggtaggcgaagatctatttctcccagaaagcgttctcgatctccttccaggcgttcccgctcaattgatagacagcgtggatcgtcacggcgttcaacttcacctagacgctctgcttctccccgaaggcattctccaagaaggagatcaccttattcaaggagaggttcaccttcattgccaaggtatccatccccatcttcacgccggagatctcctcttcgcagaaaatcaccatcgtctgggtcacgaaggttttcatcaggtagacatcgatctccatctcctgcaaggcgtaggccaagatccccatctccgggaaggcgcaggccacgctccccatctccaggaaggcgcaggcctcggt

SEQ ID NO: 30547 - protein, 340 aa, Panicum virgatum
  misc_feature: Ceres CLONE 1900555
  misc_feature (45)..(117): Pfam Name: PWI Pfam Description: PWI domain
MSGGFFRGTSADQDTRFSNKQAKLLKTQKFAPELDHLVDMSKVKMDVMKPWIAKRVTELLGFEDEVLINFIYGLLEEKEADGKKIQIQLTGFMEKNTVKFMKELWTLLLSAQQNASGVPQQFLDAKEAEIQQKKAEDDRIAQEIQKKREKEGRDLELEKQKRMDGNAGNSRSSGDPNGSAINNTTVNAEEEMDLDFKRSSRTKNRGSRRSRSISLSPRGRRRSISPRKRSRSPSRRSRSIDRQRGSSRRSTSPRRSASPRRHSPRRRSPYSRRGSPSLPRYPSPSSRRRSPLRRKSPSSGSRRFSSGRHRSPSPARRRPRSPSPGRRRPRSPSPGRRRPR

SEQ ID NO: 30548 - DNA, 344 bp, Panicum virgatum
  misc_feature: Ceres CLONE 1900576
  misc_feature: Encodes the peptide sequence at SEQ ID NO. 30549
agctaactttacaactactcctcccccctccctaccaagcttcctgcccccagccgtctcctcccctcctcctcgattcggcaggctccgtcccctagttacctgtatgaaatggatgactgtgaggatatccatcctcttgtctgtgacaatggaactggaatggtaccggtcgggtctagagatgacgagataccaaagctggtttaccataacctcgtcgcgcggcctcgcctgagtggtatgatgacatggacggggcaatatggtgatctaagaaggggatcatgcaccctccccgagagtccttctaacatcctagcacacaatacaacaaggtatag

SEQ ID NO: 30549 - protein, 77 aa, Panicum virgatum
  misc_feature: Ceres CLONE 1900576
  misc_feature: SWISSPROT Homolog: EC 2.7.10.2 Non-specific protein-tyrosine kinase
  misc_feature: Useful for making plants with modulated biomass
  misc_feature: Useful for making plants with modulated flowering time
MDDCEDIHPLVCDNGTGMVPVGSRDDEIPKLVYHNLVARPRLSGMMTWTGQYGDLRRGSCTLPESPSNILAHNTTRY

SEQ ID NO: 30550 - DNA, 681 bp, Panicum virgatum
  misc_feature: Ceres CLONE 1900586
  misc_feature: Encodes the peptide sequence at SEQ ID NO. 30551
gtattgcaagtggccatctgcccacttcaccgcttcccctttctcgttcacctcctccgctacctcccggatcccgcgcccgccctccgccgccggcgccggggagctcgccgtggaggcggggaccgctcgtgggtagcgcagtgggccgggatccgggaaggcctcggcgactcgctcgccgtgtccctcatcgaggcgcagtttgagccactccttttgctgccactgtaactcggccgggcggagctcagatctgatccaaaataatctgcatccaggtgcagccactcctcgtcggccatggatttcatgaaggttcgatcagactgtgcgtgagatcaagagggaggtcaatttgaaggtgctcaaggtccccgagattgagcagaaggtacttgatgcgacaagtgatgaaccatggggcccccatggaagtgcgctttcggagcttgcacacgctaccaagaagttctctgaatgccagatggtaatgaatgtcttatggactagacttggtgagagaggcgcaaattggcgtcatgtgtataaggccttgacaattatcgagtacttgatagccaacggttctgagagggcagttgatgatattcttgatcattattctaagatctcggttctttcaagcttcgagtatgtgggagctaatggaaaagatgt

SEQ ID NO: 30551 - protein, 64 aa, Panicum virgatum
  misc_feature: Ceres CLONE 1900586
  misc_feature (1)..(63): Pfam Name: ENTH Pfam Description: ENTH domain
MVMNVLWTRLGERGANWRHVYKALTIIEYLIANGSERAVDDILDHYSKISVLSSFEYVGANGKD

SEQ ID NO: 30552 - DNA, 1957 bp, Panicum virgatum
  misc_feature: Ceres CLONE 1900588
  misc_feature: Encodes the peptide sequence at SEQ ID NO. 30553
gtaccgggtggacccctgcctgtttccgtttccatttccctcgcaaacgggccccaaaatctcctgcctagggtttgctcctccggcgctagtagatccggacccccgatggaggagatgcgccgcccgaagcgcgggcgcccgccgaagccgcgggaggtggactatgcggacttcatggaggaggacgacgacgcggccgggctcgcgccgccccacaccaagcggaagcgcgccgcctcggccgccgccgcggcgtctctggaggaccagccactcatcgatattatcaaacacaatggcaggctgatcagccatgctgtcaaaaagttggttgaggattatgaatcaaacaaaaattcggtgatatttcaaatattagccatgctatttgaggcttgtggtgccaagcatgagatttatccagactaccttcatgagtcagatgtggatgacattgtattgtcccttgttgacctagctcgaaaaggtctggtggaagataattatagcacaaaacagaaggaccttaaacacttcaaggagaacctggttatcttttgggatagcttagtccttgaatgtcagaatggcccactgtttgatgataccttattccaaaagatcaaggattatgtgatcgctttatcatgtactcctccaagagtatatcgtcaagtagcttcattggtcggactccagcttgtaacatcattcatatctgttgctaagattcttagtggacaacgcgagactactcagaggcaattgaatgcagagaagaagaagcagagtgatggaccacttgttgaatctctcaacaacagattagctcttactcatgaaaacattacatacttggaggatttgatgcggaagatattcagtgggttattcatgcaccgttatcgtgatgttgatcctgagatccggatgtcatgtatcaaatcccttggtatttgggttgtctcatatccatcactttttttgcaagatatatatctgaagtatcttgggtggacactgaatgacaagaatgctggagttagaaggacttccattcttgccttgcaaagtctgtatgaagtggatgacaacataccttcccttggtctcttcactgagaggttttacagcaggatgatccagcttgctgatgatattgatgtttcagtagctgtgtcagctataggactcatcaagcaattactgaggcatcagctgttgagcgatgatgatttgggcccgctatatgatttgcttattgatgagcctccaatgatcaggcgtgcgataggtgaactagtttatgatcacctaatagcgcaaaacatcaagacatctcagcctggagctagagatggggaaaatgaaccctctgaggttcatattggccgaatgctgcaaatccttagagaattttcagaagacccggtccttagttcatacgtcattgatgatatttgggatgacatgaaggccatgagagactggaggtgtatgatctctgtgctcctcgatgaaaatccaggaattgagcttactgatatggatggaacaaacctagttcgaatgctgcatgcctctgcaaagaaggctgttggggaaagaataattccagcaatggataacagaaagttgtactataataaaggccaaaaggaaacattggaaaatagcaagcgtgaaataacaagtgcctttttgacgaggtatccacatcttttaagaaaatacatgtctgacaaagctaagatatcacccctagttgatatgatggtccttttgaaacttgagatgtattcattcaagagacaagagacgcatttcaaggcagccatagatctcatcactgatgccttcttcaaacatggtgagaaggatgcactgagatcttgcatcaaggcaattactttctgttgcaccgagtgccaggctgatcttaaagactatgctg

SEQ ID NO: 30553 - protein, 616 aa, Panicum virgatum
  misc_feature: Ceres CLONE 1900588
  misc_feature (131)..(246): Pfam Name: STAG Pfam Description: STAG domain
MEEMRRPKRGRPPKPREVDYADFMEEDDDAAGLAPPHTKRKRAASAAAAASLEDQPLIDIIKHNGRLISHAVKKLVEDYESNKNSVIFQILAMLFEACGAKHEIYPDYLHESDVDDIVLSLVDLARKGLVEDNYSTKQKDLKHFKENLVIFWDSLVLECQNGPLFDDTLFQKIKDYVIALSCTPPRVYRQVASLVGLQLVTSFISVAKILSGQRETTQRQLNAEKKKQSDGPLVESLNNRLALTHENITYLEDLMRKIFSGLFMHRYRDVDPEIRMSCIKSLGIWVVSYPSLFLQDIYLKYLGWTLNDKNAGVRRTSILALQSLYEVDDNIPSLGLFTERFYSRMIQLADDIDVSVAVSAIGLIKQLLRHQLLSDDDLGPLYDLLIDEPPMIRRAIGELVYDHLIAQNIKTSQPGARDGENEPSEVHIGRMLQILREFSEDPVLSSYVIDDIWDDMKAMRDWRCMISVLLDENPGIELTDMDGTNLVRMLHASAKKAVGERIIPAMDNRKLYYNKGQKETLENSKREITSAFLTRYPHLLRKYMSDKAKISPLVDMMVLLKLEMYSFKRQETHFKAAIDLITDAFFKHGEKDALRSCIKAITFCCTECQADLKDYA

SEQ ID NO: 30554 - DNA, 1308 bp, Panicum virgatum
  misc_feature: Ceres CLONE 1900589
  misc_feature: Encodes the peptide sequence at SEQ ID NO. 30555
actgcaagccacgctgtggcaagccgccagcacccccaccatggcgcttctcctccatccccgcctcccctcccaccctccccgcgcggccacccagcaccaccacgccatctcggatggctcttgcctcgttcccctccccggccttgcgaggaagcgcacgccactcgcggtgacttgccgggcggcaagggtcaaggaggccgctccgaccacgcgcggcgcgccgcccccgccggcgtcgctggcgaaggaggcgcacaagtacttcgaccacgccgtggtcacggtccgcgcgggcgacggcgggcacggcgccgtgctcgccatgccgcccgcgccatccgccgacgccgccaagccccgcggcaggttcaacaggggcgagaagaagagcaagaaggtgtcgtacaagcggaactacgacgggtcggtggcgctgcccacgggcgggcacggcggcgacgtcgtggtgtacgccgacgaggccgaggagacgctgctgcggttccacgagaaggcgcggttctgcgccaagaggggcgggaacgtgggcgccgccggtggcacgctgagctcgcggatgcacagcgggttcgccggggagacgctcaggatacccgtgcctgtaggaactgttgtgaagcgcaagaaggggactgttcttgctgatttggctcatcccggtgatgaagtgctcgttgctaggggtggacagggcgggatcagcttgatagatgtgcctgagtacaggaggaggaaagctatggctttatcaccaaacatcatgcgtgatgctagtgaccaagtattaactcatggtcaagctggtgaggaagtaagcttggagctaatcttaagggtagttgctgatgttggccttgtgggacttccaaatgctggaaagtcaacactcctatcggctataactcttgcaagaccagacattgccgattatccattcactacattaatgccaaatcttggccggcttggtggagatcctgctttaggggcgctgcagttttcctcggaagcaacattggcagatttaccaggtctgattgagggcgctcatctgggaaagggtcttggtcgcaatttcttgagacatctaaggagaactagagtaattgtccatgtcgtcgatgctgctgcagatgaccctgtgaatgattataagattgtcagagaagtaatttctcccatgtgcagtttagttttcactttgcacttctcagtattataatgttcacaatttgtataatccgtgctgtagactaacatcagtgggaaggtaatatacct

SEQ ID NO: 30555 - protein, 402 aa, Panicum virgatum
  misc_feature: Ceres CLONE 1900589
  misc_feature (277)..(388): Pfam Name: MMR_HSR1 Pfam Description: GTPase of unknown function
  misc_feature (76)..(273): Pfam Name: GTP1_OBG Pfam Description: GTP1/OBG
MALLLHPRLPSHPPRAATQHHHAISDGSCLVPLPGLARKRTPLAVTCRAARVKEAAPTTRGAPPPPASLAKEAHKYFDHAVVTVRAGDGGHGAVLAMPPAPSADAAKPRGRFNRGEKKSKKVSYKRNYDGSVALPTGGHGGDVVVYADEAEETLLRFHEKARFCAKRGGNVGAAGGTLSSRMHSGFAGETLRIPVPVGTVVKRKKGTVLADLAHPGDEVLVARGGQGGISLIDVPEYRRRKAMALSPNIMRDASDQVLTHGQAGEEVSLELILRVVADVGLVGLPNAGKSTLLSAITLARPDIADYPFTTLMPNLGRLGGDPALGALQFSSEATLADLPGLIEGAHLGKGLGRNFLRHLRRTRVIVHVVDAAADDPVNDYKIVREVISPMCSLVFTLHFSVL

SEQ ID NO: 30556 - DNA, 704 bp, Panicum virgatum
  misc_feature: Ceres CLONE 1900589-R
atccccaatacctagagcgaccttacgttgtggtcctgaacaagattgatcttcctaaggcccatgataggctatcgtcactggctttagaaatatcttcaattggctgtgaagaagcccatgtcaaaaacgacagcaaagataacctaaatggaaacataagcgaacatcaggtcccattggacgctaacgttgaaggcagtgaaaaggaacttgaagactatccaagacctcaagctgttgttactgcaagtgtattgaggcacatagggattgatgacacgctgaaggagataagggcagccctgagaaaatgcttcgatcacaaactgccagtgccatgaagcctatgatatgctgacttatcatagtcttactgccatggttcagcatatcataggcttactaccatggtttagtagcagaaagggagtgaagtggatggtcccttggcacatgatgaagagattccaacggcagtaaatggtacggtttgcactttcagcagtaacaacaattttggaaggatgaagccacccaggggcgtccctagcatatgtacacctaaaagttttggccaaaaaattgtaatctcggagtcatagcatatgtacataatgttggttaggtcagaagaaatacaaaaacaatttgtctcactccttcagcttcggcacgatgttatgtagaaatacaatacagat

SEQ ID NO: 30557 - DNA, 1977 bp, Panicum virgatum
  misc_feature: Ceres CLONE 1900601
  misc_feature: Encodes the peptide sequence at SEQ ID NO. 30558
ctcccgtccccgtccgccccgctccgcctcccaaaaatttcccccttttcctcagcctctctccacgcgagcgggcctaaaaccctagccccgatccttcccgcccatggcctccgacgacgccaagcccgcttcccctcccgccgccgcggatccgccggccgccgacgccgaggacgccgccgaccccgaccctgccgccccggcggacggcaaggaggagaccaccccgcagcagccggagaagaagcggggccgcaggaagaagggggaggcgcaggcggaggcggcgaagaagacgccgccgcccaggaagtccggccccgcggcggagcgcccgtccagggagaggaagacggtcgagaggtactcggagctcgccaagcgcgtcgtgcccgtcaagaagtcccccgctattctccagggctctggaaccaagctgaaagacatacccaatgtttccttcaaactatcgaagagaaaggcagatgatattctccaaagccttcatgttctaatgtatgggaagaaatcaaatgtccactttttgaagagaaacatatctcaattttctggttttgtttggacggacaatcaagaaaaacagaggacaaaaataaaggaaaagcttgataaatttaacaaggaaaagttgctcgacttttgtgaaatactggatatttgtgttgcaaaagcaactacaaagaaggaagaagtttctgccaaagtcttggagtttttggagtccccttttgttactagggatgttgttctcactgataacaagaaagggaagaaacgtgggaggagacctaagggaagtggtgagccaacttctgaaggtgcttctgaagacaagaaaaagaaaaggggcaagaaccaagcagctgaagctgggaaagagagtgatgttgaggaagatgctggttctcacgatgcttcaacaggagaggaaggtgatgagggatctgtagcaaacgataatgttgcgagtgatgatgaacctgatgagcctccagcaaagaaaaggtcagcagatgtaaatcaagttaagaaggaaactgggtctaatgcaaaggaaaaagacgcaccacgaaaaagggtttctgcgaaacctgcaaaaggtgcttcaaagccttctcaaggcattaaagatgagcctgatatagaggtcaaaaaggctggcaagagagcaaagagttctaaggaaagtgatgctccacaagattcaaatatggtggacaaggcctctaaatcaaaaacggttgatggaaaagaaagccacaacaataaggttgctaagccatccagtaaaaataaaggtaaaggcaagggtggtgcaaagggtaagcctgccccaactaaggcacagctgcatgctgttgttaccagaattttgaaggaagttgacttcaacacggcaactttggctgatattctcagacaattaggggcccattttgaagtggacctcatggacagaaaagcagaagtgaagtgcatcattgaggatgtaataaataatatgtctgatgatgatggtggtgaggaagaatcagatggtgaagcagaagccaatggtaaggaagagaaggcaaagggtgatcctgatagaggtgaagataattgatgccatggattggatttacatgcatggtcaggtttgtattatgccagcggtttggattgatcttgggaggactattctgttggttctgtacaattggggcaccaccacaaattggtgacctgggtagtacaagattgttaaccatttcacacagccgtatacacctagttgtgcttgactaggtagcgacctgtagcctagttgctggtcatgtataatagctgtgggtttaatagctttgttgcttaggtagctagcctgactgtaatatgcacaataattcttggcttgtttcgtccatttaaacatgtaaaactctatctttctgagtcgttcctgttttgtac

SEQ ID NO: 30558 - protein, 507 aa, Panicum virgatum
  misc_feature: Ceres CLONE 1900601
  misc_feature (419)..(472): Pfam Name: DEK_C Pfam Description: DEK C terminal domain
  misc_feature: SWISSPROT Homolog: EC 5.2.1.8 Peptidylprolyl isomerase
MASDDAKPASPPAAADPPAADAEDAADPDPAAPADGKEETTPQQPEKKRGRRKKGEAQAEAAKKTPPPRKSGPAAERPSRERKTVERYSELAKRVVPVKKSPAILQGSGTKLKDIPNVSFKLSKRKADDILQSLHVLMYGKKSNVHFLKRNISQFSGFVWTDNQEKQRTKIKEKLDKFNKEKLLDFCEILDICVAKATTKKEEVSAKVLEFLESPFVTRDVVLTDNKKGKKRGRRPKGSGEPTSEGASEDKKKKRGKNQAAEAGKESDVEEDAGSHDASTGEEGDEGSVANDNVASDDEPDEPPAKKRSADVNQVKKETGSNAKEKDAPRKRVSAKPAKGASKPSQGIKDEPDIEVKKAGKRAKSSKESDAPQDSNMVDKASKSKTVDGKESHNNKVAKPSSKNKGKGKGGAKGKPAPTKAQLHAVVTRILKEVDFNTATLADILRQLGAHFEVDLMDRKAEVKCIIEDVINNMSDDDGGEEESDGEAEANGKEEKAKGDPDRGEDN

SEQ ID NO: 30559 - DNA, 1428 bp, Panicum virgatum
  misc_feature: Ceres CLONE 1900609
  misc_feature: Encodes the peptide sequence at SEQ ID NO. 30560
aaccatctgcccgcccccgtcgcctcgccctcctcgttgagagagtcgtcccccccgcgtgctctccgcctgcggcctctgtatcccgcaaccaaaaactacaaaaaaatagaaatccccaaatccgcgagatctatcagtatcgagcgagttaccaatccgattgctagggtttagatccgatttttttcgaaaaaactgaaaaaaatttggtcgaggggaggaggaggcgatggcggcgcaagtggcggcggcggtggcgaacgggagcgcgggcgctgtcccagcggtggtgtcgccgggagcggtcggcgtcggggtcggcgtggcgcagccgctcccgaccacgtcgctctacgtcggcgacctggaggggtccgtctcggattcgcagctgtacgagctcttcagccaggcggggcaggtggtgtcggtgcgcgtctgcagggacgtcacctcgcgccgctcgctcggatacgcctacgtcaacttcagcaatcccctggatgctgcaagagcactggaattgttgaactttgctctgcttaacaacaagcctatccgtgtgatgtattcaaaccgtgacccaagcagccgcaggagcggatctgcaaacattttcatcaagaatcttgacaaggcaatagacaataaaactcttcacgagaccttttccacatttggtaccattctctcatgtaaagtagccatggatgaagtgggccaatccaaaggctttggttttgttcagtatgaaaaagaagaggaagctcaggctgctataaaaagtcttaatgggatgctaatcaatgacaagcctgtttatgttggaccttttcttcgcaagcaagagagagatcattcgtttgacaagacaaaatttaacaatgtctttgtgaaaaatttgtctgagtctaccacaaaggaggatctagtcaaaatttttggtgaatatgggaatattaccagtgctgttgtgatgattggtatggatggcaaatcaaggtgctttggtttcatcaattttgagaatccagatgcagctgcccatgctgttcaggaacttaatggaaagaagataaatgacaaagagtggtatgttggaagagctcagaagaagtcagaaagagagatggaactgaaaaggagatttgtgcaaagcttgaaagatgctgctgacaaatatcaaggactgaacttgtacctcaagaacttggatgatagcattggagatgatcaacttcgtgaattgttctctaactttggcaagattacctcgtacaaggtgatgcgtgatcaaaatggtcttagcaaaggctctggttttgttgcgttctcaactcatgaggaagcatctcaggctttgactgaaatgaatggcaaaatgatatctggaaagccactgtatgttgcatttgcacagcgcaa

SEQ ID NO: 30560 - protein, 398 aa, Panicum virgatum
  misc_feature: Ceres CLONE 1900609
  misc_feature (220)..(290): Pfam Name: RRM_1 Pfam Description: RNA recognition motif. (a.k.a. RRM, RBD, or RNP domain)
  misc_feature (129)..(199): Pfam Name: RRM_1 Pfam Description: RNA recognition motif. (a.k.a. RRM, RBD, or RNP domain)
  misc_feature (323)..(393): Pfam Name: RRM_1 Pfam Description: RNA recognition motif. (a.k.a. RRM, RBD, or RNP domain)
  misc_feature (41)..(112): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAAQVAAAVANGSAGAVPAVVSPGAVGVGVGVAQPLPTTSLYVGDLEGSVSDSQLYELFSQAGQVVSVRVCRDVTSRRSLGYAYVNFSNPLDAARALELLNFALLNNKPIRVMYSNRDPSSRRSGSANIFIKNLDKAIDNKTLHETFSTFGTILSCKVAMDEVGQSKGFGFVQYEKEEEAQAAIKSLNGMLINDKPVYVGPFLRKQERDHSFDKTKFNNVFVKNLSESTTKEDLVKIFGEYGNITSAVVMIGMDGKSRCFGFINFENPDAAAHAVQELNGKKINDKEWYVGRAQKKSEREMELKRRFVQSLKDAADKYQGLNLYLKNLDDSIGDDQLRELFSNFGKITSYKVMRDQNGLSKGSGFVAFSTHEEASQALTEMNGKMISGKPLYVAFAQR

SEQ ID NO: 30561 - DNA, 1295 bp, Panicum virgatum
  misc_feature: Ceres CLONE 1900612
  misc_feature: Encodes the peptide sequence at SEQ ID NO. 30562
gcagcccgaaacgcgagcacaatcaaggcctgaccaccaccaccattgccgccgccgccgcaggtgcaggagcagcgctcgcaatggcagctcgtcttgcttaagcgtcgaggagccgaggagctagaagcgcgcattggcgccgccggcgcgggcgcgagctgctgcgccgtgccaccgcgctacgccgatcgccggcgcccattgcctccgtggggtgggttggctggccgccaatctcgctagcgagcggcgccaccgcgaatggcgggacgccgaatgacgctgccgctgctggtgctgctggcggccgcgttcctggccgccaccactagcagcaacagcaaatcctcggcggtgttcgaactgatccaccgggagcaggcgacctggaccgagctggcgcgcaatgaccgggagcgcatggcgttcatctcctcgcgcgggcgccgccgcgccgcggagacgggcacggccgcggccaagcccagcaaggccgcgcccgcgtccgaggccttcgcgatgccgctctcctcgggcgcctacacgggcaccggccagtacttcgtccgcttccgcgtgggcacgcccgcgcagccgttcctgctcgtggccgacaccggcagcgacctgacctgggtcaagtgcctccgccccgccgccgccgacgacgaccccgccttcggcgccggctacggctacagctacggcgccccggcgccgaccgactcctccccgctgccggcgccgtcgtcctcctccccgccgccgcacgggcgcgtcttccggccggacgactcccggacgtgggcgcccatcccgtgctcctccgacacctgcacggcgtccctgcccttctccctcgccgcctgccccacccccggcagcccctgcgcctacgactaccggtacaaggacgggtcggcggcgcgcgggacggtgggctccgactcggcgaccatcgcgctgtcggggcgcggcgcggcggcggcggcggtggccagcaggagcaggagacagcggcgggccaagctgcggggcgtcgtgctgggctgcaccacctcctacagcggcgacagcttcgtggcctccgacggtgtgctcagcctcggctacagcaacatctccttcgcgtcccacgccgcggggcgcttcggcgggcgcttctcctactgcctcgtcgaccatctcgccccgcggaacgccaccagctacctcaccttcgggcgcaacccggccctgtcgccggccgccaggaccgcctgcgcggggacgccggcggcggtgcccggcgc

SEQ ID NO: 30562 - protein, 343 aa, Panicum virgatum
  misc_feature: Ceres CLONE 1900612
  misc_feature: SWISSPROT Homolog: EC 3.4.23.12 Nepenthesin
MAGRRMTLPLLVLLAAAFLAATTSSNSKSSAVFELIHREQATWTELARNDRERMAFISSRGRRRAAETGTAAAKPSKAAPASEAFAMPLSSGAYTGTGQYFVRFRVGTPAQPFLLVADTGSDLTWVKCLRPAAADDDPAFGAGYGYSYGAPAPTDSSPLPAPSSSSPPPHGRVFRPDDSRTWAPIPCSSDTCTASLPFSLAACPTPGSPCAYDYRYKDGSAARGTVGSDSATIALSGRGAAAAAVASRSRRQRRAKLRGVVLGCTTSYSGDSFVASDGVLSLGYSNISFASHAAGRFGGRFSYCLVDHLAPRNATSYLTFGRNPALSPAARTACAGTPAAVPG

SEQ ID NO: 30563 - DNA, 721 bp, Panicum virgatum
  misc_feature: Ceres CLONE 1900612-R
  misc_feature: Encodes the peptide sequence at SEQ ID NO. 30564
ccgttctacgccgtcaccgtcaacggcgtctccgtcgacggggagctcctcaagatcccgcgcctagtctggaatatcgagaggggcggcggcaccatcctcgactcgggcacgagcctcacggtgctagccagcccggcgtaccgggtcgtggtcgcggcgctgagcaagaagctcgcggcgctgccccgggtgatcatggacccgttcgagtactgctacaactggacgtcgccgtcgacgggcgaggacctggccgtgcccgtgccggacttggcctttcacctcgcgggggcggcacgcctgcagccgccggcgaagagctacgtgatcgacgcggcgcccggcgtgaagtgcatcggcgtgcaggagggggagtggcccggggtgtccgtcatcggcaacatcctgcagcaggagcacctgtgggagttcgataccaagaaccgacgactcagatttatgaggtcgcggtgcacgcaatgattgggcccgcggtgatccatcgttcttccccccacttcttcaattttttaccccatgtggtggtgatcttgctgattctttttttttttcttttcccttgttcagatactaatgcaatgagaaatgtaccttcttgcaatgcagaagtgataagctgtaatcagttttcttttctccttttccacaccctgttgttcttctcattccggtgaatatatgttcagagtgcatctcc

SEQ ID NO: 30564 - protein, 161 aa, Panicum virgatum
  misc_feature: Ceres CLONE 1900612-R
  misc_feature: SWISSPROT Homolog: EC 3.4.23.12 Nepenthesin
PFYAVTVNGVSVDGELLKIPRLVWNIERGGGTILDSGTSLTVLASPAYRVVVAALSKKLAALPRVIMDPFEYCYNWTSPSTGEDLAVPVPDLAFHLAGAARLQPPAKSYVIDAAPGVKCIGVQEGEWPGVSVIGNILQQEHLWEFDTKNRRLRFMRSRCTQ

SEQ ID NO: 30565 - DNA, 713 bp, Panicum virgatum
  misc_feature: Ceres CLONE 1900632
  misc_feature: Encodes the peptide sequence at SEQ ID NO. 30566
aattcctgtcacgcacgcggtaggagcgcacctgctggctttctcttgggatcgctgctgcaccgggaggaacgccgccgcgcgtgtcggcgctcggcggcacatgagcggctcgaaggcggcgcccggcgccgccgtgggcggcaaggcggcgcgcgcctgcgacagctgcctgcggcggcgcgcgcggtggtactgcgcggccgacgacgccttcctgtgccagggctgcgacgcgtcggtgcactcggccaacccgctcgccaggcgccacgagcgcctccgcctgcgcccgacgtcgccgccgcgtcacgcggcgtccacttcggcgtcggcgtcgaagacgcgccagcaggtcacgccggggtggtccaagcgcaaggcgcgcaccaggaggccgaacgtcaagagcgtcgggcagctgctgtcgaggaagctcatcgtcgtgccggaggtgaccgtcgagtcgtcgtcggatgagcggaaggccgaggaagaggaggcggaggaggaggagctgctgtaccgcgtgccgaatttcgaccgcgccctcgctgagctatgctcgccgctgccaatcgatgacccggcggccggagccccgtgctccagggaggacgtcgacggcaccgtggagcacacaaagaccccgggtggttgcagaatcacccgtgcagcagctcccggacagctttgcgggcttcggcccgacg

SEQ ID NO: 30566 - protein, 203 aa, Panicum virgatum
  misc_feature: Ceres CLONE 1900632
  misc_feature (15)..(62): Pfam Name: zf-B_box Pfam Description: B-box zinc finger
MSGSKAAPGAAVGGKAARACDSCLRRRARWYCAADDAFLCQGCDASVHSANPLARRHERLRLRPTSPPRHAASTSASASKTRQQVTPGWSKRKARTRRPNVKSVGQLLSRKLIVVPEVTVESSSDERKAEEEEAEEEELLYRVPNFDRALAELCSPLPIDDPAAGAPCSREDVDGTVEHTKTPGGCRITRAAAPGQLCGLRPD

SEQ ID NO: 30567 - DNA, 2039 bp, Panicum virgatum
  misc_feature: Ceres CLONE 1900652
  misc_feature: Encodes the peptide sequence at SEQ ID NO. 30568
gaacaggcagacagaccaacaccgtgaccccccctcccctgtctctctctctctctctctctcctcgtcctcaagctctccctctccctctcccctcccgcggcgtggccgaatgccgcgagccgggcggagctgaccccgcccgccggcgactccgctcggccgccgccgccgccgcagcgacacggattcggctgccgagcgcggaatgcccgcggagggagggcactgaggcgcccagattcgggagcacgggagagcctcgcttggggcaccggggattcgcctcgccggggcggcggaggtggtttgggggcggaggctctccggattccagcgtgtgggacctcaacgcgatggccgccggcggcggcgcctccgccgaagccaagtacaactcgtacaaggcgccgggcctgcgcggggccttccttgaggcggcgcacgtctcgtgcctcgaggaccgctacgcgctcgggccgcagcttgggtggggccagttcggcgtcatccgctcctgctccgacctggtcaccggcgaggctctcgcctgcaagtccatcgccaaggaccgcctcgtgtcccccgacgacgtgaggggcgtcaagctcgagatcgaggtcatggcgcgcctctcgggccaccccaacgtcgttgacctcaaggcggtgtacgaggacgaggactccgtgcacctcgtcatggagctctgcgccggcggggagctcttccaccgcctcgaggagcgcggctgcttctcggagcacgaggctgccgtgctcttccggtacctcatggaggtcgtcgcccattgccatagcaaggggatcgtgcaccgggacctcaagccggagaacatcctcctggtcagcaagtcgccgtcctcgccgatcaaactcgcggactttggcctcgccacctacatcctgcctggtcgaagcttgagtggcatggtaggaagcccgttttacattgcgccggaggtgctttccggtggatacaatgaagctgccgacgtgtggagcgccggggttatactctacatcctcctgagcggcatcccgccgttttgggggaaaaccaagtcgaagatcttcgagtgtataaggtcgacggagctgcggttcccttctgatccatgggatagggtttctgattcagccaaggagctggtcactgggatgctgcggcgcgatcctaggcaacgactaactgccaagcaggttctagagcattcgtggatgcaagagcacgctgaccaatcacaagattcctgcagccattgccacgggatcggcctccggagggaggacctcggctcgtgctccttctccacgccgctggcgacacggagcagggacgtgagcttcaacaccggcggccccatcacctgccagggcatgttggaggaggacgaggcgtggtcgccctccttcgcctgcaggtcgtccttctcggcatttgtcaccgacatggccccatcttgctcgatgtctggcttctcgttcggcgaggcaagcgagctcggtggcggcgtggcgtcccccacgctgccagtggcttccatgccgagcttctcattcttctgcgggcaagagtgcggcgagcccgagccgtcggcatcacagggggtgtcagttgccactgctgctgctgctccttccacttcacggaggatgtcagaggtcatgggggcagcgaggcccgtgacgaaccagtcgcgggtcgctggcgtcaacagcaggcggaaccacacgatcggcgccggcgagcgggagcccctggacgtggcggtggcggagtccgtcatacggtgggcgtcgtgcacgaacctgtcgacgacgcactcgctccgggcttcgctcgtgtgctagctagcatttcgttcgctcgatagtttgtcggccgcctttacctgtaacgctatgcaaagctgagtgttgagattaaagtgtcagtcgaaggtagagaatgtaacctggacccgatatatatgatgttattatagtaaagcagtagattaactagtgatgttcctc

SEQ ID NO: 30568 - protein, 505 aa, Panicum virgatum
  misc_feature: Ceres CLONE 1900652
  misc_feature (38)..(296): Pfam Name: Pkinase Pfam Description: Protein kinase domain
  misc_feature: SWISSPROT Homolog: EC 2.7.11.1 Non-specific serine/threonine protein kinase
  misc_feature: The sequence is a functional homolog of SEQ ID NO 2 in US patent 7084323
MAAGGGASAEAKYNSYKAPGLRGAFLEAAHVSCLEDRYALGPQLGWGQFGVIRSCSDLVTGEALACKSIAKDRLVSPDDVRGVKLEIEVMARLSGHPNVVDLKAVYEDEDSVHLVMELCAGGELFHRLEERGCFSEHEAAVLFRYLMEVVAHCHSKGIVHRDLKPENILLVSKSPSSPIKLADFGLATYILPGRSLSGMVGSPFYIAPEVLSGGYNEAADVWSAGVILYILLSGIPPFWGKTKSKIFECIRSTELRFPSDPWDRVSDSAKELVTGMLRRDPRQRLTAKQVLEHSWMQEHADQSQDSCSHCHGIGLRREDLGSCSFSTPLATRSRDVSFNTGGPITCQGMLEEDEAWSPSFACRSSFSAFVTDMAPSCSMSGFSFGEASELGGGVASPTLPVASMPSFSFFCGQECGEPEPSASQGVSVATAAAAPSTSRRMSEVMGAARPVTNQSRVAGVNSRRNHTIGAGEREPLDVAVAESVIRWASCTNLSTTHSLRASLVC

SEQ ID NO: 30569 - DNA, 716 bp, Panicum virgatum
  misc_feature: Ceres CLONE 1900653
  misc_feature: Encodes the peptide sequence at SEQ ID NO. 30570
gagactacaaccagcagaccgagctcgctcgcctcgccttttgagaagaacaaacgcgtcctctctggtcttcgtccttcccacttccacagtcctatccacacgtacgcacgagaaggaccacgctcgtgagccgccggccggtgcgagtgcgacgacgacgaacacccatggcgccgtccgaggactgcggctggctgctgtacctctccctggccgccaaatgcggcggcccccaccgcctgctcggcttcgccgcggtcgtcgccgccgccttcgtcgtcacggcgctgctgcactgggcgtcccccggcggccccgcgtggggctggtactggtggaccaggagggccggcctgggcatcgttggcgccgccatcccggggccccgggggctgccggtgctcggcagcatggggctcatgacgggcctggcgcaccggaagctcgcggcggccggcaaggccaggcgccgcctcatggcgttctcgctcggcgagacccgcgtcgtggtgaccgccgacccggacgtcgcgcgggagctgctcgccagcgccgccttcgccgaccgccccgtgaaggagtccgcgtacgggcttctcttccaccgcgccatcggcttcgccccgcacggcgcctactggcgcgcgctccgccgcgtggcgtccgcgcacctcttctcgccgcgccagatcgccggctccgccgcgcagcgc

SEQ ID NO: 30570 - protein, 181 aa, Panicum virgatum
  misc_feature: Ceres CLONE 1900653
  misc_feature: SWISSPROT Homolog: EC 1.14.13.21 Flavonoid 3'-monooxygenase
  misc_feature: Useful for biocontainment applications
  misc_feature: Useful for making plants with modulated flowering time
  misc_feature: Useful for making plants with modulated nitrogen use efficiency
MAPSEDCGWLLYLSLAAKCGGPHRLLGFAAVVAAAFVVTALLHWASPGGPAWGWYWWTRRAGLGIVGAAIPGPRGLPVLGSMGLMTGLAHRKLAAAGKARRRLMAFSLGETRVVVTADPDVARELLASAAFADRPVKESAYGLLFHRAIGFAPHGAYWRALRRVASAHLFSPRQIAGSAAQ

SEQ ID NO: 30571 - DNA, 685 bp, Panicum virgatum
  misc_feature: Ceres CLONE 1900654
  misc_feature: Encodes the peptide sequence at SEQ ID NO. 30572
acttacgcaagtcatcgttcccttctctggacggaagcaccgagccgaggcgcctgcgtgcagatcttcgtctcccagcatccagaaatgggtcatcaagaacatgaagagctggagcgtatcttgattgagaaggatgcaaatgcaatccccctatcatacacatttttagaatatattacaaataatttctctaatgatagagagatcggtcgtggtgggtttggaattgtctacaagggagttcttcgaaatgggaatgtagctgtgaagaaacttttgagaacagatgacacttctgataaacagttcgaggatgaacttttttgcttgataagggttaaacacaaaaatatagtgaggtttttaggatattgctctaatatatcaagagaagtggtacatcacaatgggagagatattttagcagatgtccaacagaggttcctgtgctttgagtacatacctaataaaaacctacaacagtatctcgaagataaatcaacttgtggacgtgaatgggagacacgttatcacttgatcgaaggaatttgtcatggtttgcaatatcttcacaaagaacgcatcaatcatttggatcttaaaccggcaaacattttgctagactatgggatggttccaaaaataacagattttggcttgtctagacgctttggagaacaat

SEQ ID NO: 30572 - protein, 199 aa, Panicum virgatum
  misc_feature: Ceres CLONE 1900654
  misc_feature (35)..(199): Pfam Name: Pkinase_Tyr Pfam Description: Protein tyrosine kinase
  misc_feature: SWISSPROT Homolog: EC 2.7.11.1 Non-specific serine/threonine protein kinase
MGHQEHEELERILIEKDANAIPLSYTFLEYITNNFSNDREIGRGGFGIVYKGVLRNGNVAVKKLLRTDDTSDKQFEDELFCLIRVKHKNIVRFLGYCSNISREVVHHNGRDILADVQQRFLCFEYIPNKNLQQYLEDKSTCGREWETRYHLIEGICHGLQYLHKERINHLDLKPANILLDYGMVPKITDFGLSRRFGEQ

SEQ ID NO: 30573 - DNA, 650 bp, Panicum virgatum
  misc_feature: Ceres CLONE 1900667
  misc_feature: Encodes the peptide sequence at SEQ ID NO. 30574
aaccgcgcatttgccgattggattggacccggacccggtcggccgggccggtcgcctcccttctcttgttttcgtatcacgccacccgccgcgggcgacccatgtaataccgcgctgcccccgctccttttccctttcccttttttctcctcgtcttccttcccccgcccgctgctctcctcccctgcgtgcgagagcaccagcagcttccgcttccaattccgccgcccccgccgccgtgcctctcctccattggctcgccgtcgccgcggcctcgaccgcctcgcctcacccgtcgccaccggcctcgtcacctcctgtgctactccgtgccatcggggcctgacagggacggcctacccgcacagcggaggacggcgtcaggacaagcgctcccgagcaacaagtatcccggcagcgcttcgctgccgctcggcgctcgagctccacatacaccagcagcagcagcacgccagcacgagcggaagcgggagggagcgctggctgcttgattcggtcaactcccgcgcgctcgcggcaggatcaaggccaatggggcgggagaggaggccgtggccggcggcggccgccgccgttcttctgctcgtcgcctcctgcgtcgccgcggcgccgctgcagcagcaccagcg

SEQ ID NO: 30574 - protein, 32 aa, Panicum virgatum
  misc_feature: Ceres CLONE 1900667
  misc_feature: Useful for making plants with altered carbohydrate content
MGRERRPWPAAAAAVLLLVASCVAAAPLQQHQ

SEQ ID NO: 30575 - DNA, 1260 bp, Panicum virgatum
  misc_feature: Ceres CLONE 1900681
  misc_feature: Encodes the peptide sequence at SEQ ID NO. 30576
ccaccagcctttctcctcctctcgctccgttcctcttcgcgtgcgggttgacgaggaatttctagagcgccgtaccggcgcacgactcccgagcaccgccccgccgctcgccggaatcgggaggcagccttgcctttgccttgcgccgcggcgagaggcgcggctaaggaggaggaggaggagggagggggtgatgtacccggtggccacgggcccgccgccggcgcggctgccggcggcgtcgcgggtggacaaggccacgagccacctgctgcagggtcccgactgggccgtcaacctcgaaatctgcgacacgctcaacgctgaccgctggcaaaccaaggatgtggtaaaagcagtgaagaagcgattgcagcataaggacccacaagttcaattcctaactttgacgttgttggagacaatgatgaagaattgtggtgaaaatgttcattttgaagttgttgatcaacatattttacaggagatggttaaaattgtccagaagaggcatgatatgcaagtgagggataaggcattattacttctagattcatggcaagaggcgtttggtggacctggaggcaaatatccgcagtattactggtcatacattgaactcaagaggtcaggagtaatgtttccacgacgtcctgtggatgctcctccaatatttactccacccgcagtacatcaagcatatggttcacctagatatccttctggaagtctaaatgagagaatgacatccgatgttgaaacattgagtttcgagggcttgaataatattagaaatgcagcagaattgctgcgcgatatggtgaatgctttgaaccccgctgatcgcatggcagttaaagatgagattattacagatcttgtaaatcaatgtcgttcaaatcaacaaaagctcatgcgatttgtcagttccacaggggatgaggaactgctaaagcaaggcctagaaataaatgatggcttacagagtgtacttgcaaaacatgatgctattgcttctggtttgccattaccggttgaaacaccaagtagagaagagttacagagaggggatcaaaaccaacaggcatccacaccagcaattccacatgataataaggttcaagttgaagaggatgaagatgatgagtttgctcaaattgcaagaagacaaaacaaatctgtgataagcagtgatgaggcatcgtccagtgctggtgatcaggcccttatagctgttgatccagcactttctgaagtctc

SEQ ID NO: 30576 - protein, 355 aa, Panicum virgatum
  misc_feature: Ceres CLONE 1900681
  misc_feature (13)..(147): Pfam Name: VHS Pfam Description: VHS domain
  misc_feature (186)..(283): Pfam Name: GAT Pfam Description: GAT domain
MYPVATGPPPARLPAASRVDKATSHLLQGPDWAVNLEICDTLNADRWQTKDVVKAVKKRLQHKDPQVQFLTLTLLETMMKNCGENVHFEVVDQHILQEMVKIVQKRHDMQVRDKALLLLDSWQEAFGGPGGKYPQYYWSYIELKRSGVMFPRRPVDAPPIFTPPAVHQAYGSPRYPSGSLNERMTSDVETLSFEGLNNIRNAAELLRDMVNALNPADRMAVKDEIITDLVNQCRSNQQKLMRFVSSTGDEELLKQGLEINDGLQSVLAKHDAIASGLPLPVETPSREELQRGDQNQQASTPAIPHDNKVQVEEDEDDEFAQIARRQNKSVISSDEASSSAGDQALIAVDPALSEV

SEQ ID NO: 30577 - DNA, 1275 bp, Panicum virgatum
  misc_feature: Ceres CLONE 1900705
  misc_feature: Encodes the peptide sequence at SEQ ID NO. 30578
acttatctgcctttccgctctcgcagtcgccggagagggagggagagaaacggagaggccgccgcccggacggccggccgaaccgcggctgcagctgcaaccggaggagctagcagagggcagatacattcaagattggccggccatttgatctcgagagctcaggtactgcgcgcgaacacgaaattggactcggaatcacagcaatgtcagtgagccatgccgacgagcacgagatttcgctgtgcgaccccaactccgaggacgaccggcgccgccggaagatcgggtcgttccggcggaaggccatccacgcgctccggaagaagcgcggcaggcggcgcgtcaccgacttccgcttccccgccgccatctccatcgaggacgtccgcgacgccgaggaggagcgcgccgtggccgcgttccgcgaccgcctcgcctcgcacggcctcctgcccgacaagcacgacgactaccacatgatgctgaggtttctgaaggccaggaagtttgatcccgacaaagcgacgcaaatgtgggcggagatgctgagatggaggaaagagtttggagccgacacaatcgtcgaggactttgagttcgacgagctcgatgacgtgctccggtactaccctcagggttaccacggcgtcgaccgggaaggccggccggtctacattgagaggctcggcaaggtcgatccaaacaagctcatgcagatcacttcggtggatagatacatcaagtaccatgtgctggagttcgagaaggcttttagggagaagtttcctgcttgcacattagcagccaagagacacattgattccactactaccatattggacgtccatggcgtgggctttaagaatttctcgaagactgcaagggagcttgttcaacgtatgcagagaatagacagtgactactatcctgagacactacatcagatgtatgttgtgaatgctggtagtggattcaagttgatctggaatagtgttaaaggatttcttgacccaaaaacttcttccaagattcatgttcttggctcaaactaccagagcaggctaattgaagttattgactcaagtgaattgccagagttccttggtggttcatgcacttgtagtgacaagggtggttgcctcgggtctaacaaagggccatggaatgatcctgccattttgaagctgatacacagtatgggaggcagtggtagtacgagagaaaccaagcaaatttctgacgggtacgaaagaagtggatcttccctaaggg

SEQ ID NO: 30578 - protein, 356 aa, Panicum virgatum
  misc_feature: Ceres CLONE 1900705
  misc_feature (143)..(329): Pfam Name: CRAL_TRIO Pfam Description: CRAL/TRIO domain
  misc_feature (57)..(126): Pfam Name: CRAL_TRIO_N Pfam Description: CRAL/TRIO, N-terminus
MSVSHADEHEISLCDPNSEDDRRRRKIGSFRRKAIHALRKKRGRRRVTDFRFPAAISIEDVRDAEEERAVAAFRDRLASHGLLPDKHDDYHMMLRFLKARKFDPDKATQMWAEMLRWRKEFGADTIVEDFEFDELDDVLRYYPQGYHGVDREGRPVYIERLGKVDPNKLMQITSVDRYIKYHVLEFEKAFREKFPACTLAAKRHIDSTTTILDVHGVGFKNFSKTARELVQRMQRIDSDYYPETLHQMYVVNAGSGFKLIWNSVKGFLDPKTSSKIHVLGSNYQSRLIEVIDSSELPEFLGGSCTCSDKGGCLGSNKGPWNDPAILKLIHSMGGSGSTRETKQISDGYERSGSSLR

SEQ ID NO: 30579 - DNA, 723 bp, Panicum virgatum
  misc_feature: Ceres CLONE 1900705-R
tagaggactggctacagtcttggtcaggatatcatccttattccactttgtctgtagacaagaaacgatgataggaaatgtccattcttatgctgaagcagagcaaggaaactctcaaactgtaagagatggagacatgagtgcttgtttacaacgccttgaaaacctcgagtcactgtgcaatgatatgatgagcaaacctccagatatgccaaaggataaagaacttgtactgttgcagtctttcgatcggataaagtcccttgaagctgacctggagaggacaaaagcagcgttgcaggccgccatggcaaagcaaatggaattggaggagactctgcagcgccggtcatctagtgttaagaggagattttgctgttcataggagtaagatcgccgttaaaccgtctggattaactgatgaggctgaagctggcgaccccatttttttgactcgagttcttgtcagctctgtgcgcgaaagatcaggcgttttggtgttgctgtctgtggacgcacatgatcaatcggcttctgtagttgctagcactagcgtctgttgctacacttgtgatctccatgggctgtaagaacgagctggatgacacagcttttgcacattctctgtaaacgcagcagttgacgccattggaggacagaagcttcttcacgaacgtttctgaccgtccaaagacacctgctatttttgaaacgctccgtgct

SEQ ID NO: 30580 - DNA, 1319 bp, Panicum virgatum
  misc_feature: Ceres CLONE 1900706
  misc_feature: Encodes the peptide sequence at SEQ ID NO. 30581
aggccattagtgggccaacgctagcagcactcgttcgctctcggccttcctttcctagcgacgacggcgccctcgacgacggcagggtgagtggcgccgcccgccagttcttcgtcgtgtgcttcgctggcgacgagcatccggcaggggaagccacatgttgtcgttgtcaattgctgtttttggtttggctctgcgtgtacgctaggttaggtaacttaggttctcatttaccttgagtcttgacgaaattctgggtttaaggagcaagatgagtagaaaaatagacagtgaaaatgactctcagagaatcactagtgaagggacatctgcgcgcacaagacctctgagcattcaggacattatgttgaggcgtgaaaaaaaggctgcatcagaagctaagaaaaccaaggaagagctccaagaaaatgataagggtacatctaatcacttggaacagggaagaggatacaaaagcagaaaggattccaaagatatgcctgtggaaggttcaaaaatgaagattagagatgcatcgagggaggaatccaagagagaaaatccaagagtaccaagggaaggtcctaaaaaggaggacacgagatatacaccaaaagtggtctccaagaaggagaactctaaagataggtccaaagggggttccaagatggacgacctgaaagatacaccgaagttctcagagaaggaagacctgagagatgcaccaaggaagggctccaagaaagagataccctccataagagatgactatcattcagttggcaatgataaaggcattggtaattctcagaaacttgccaaaagcaggagtagccgagctgacggaagcaaagataggaaccttggtgagatcagagcaaggaatggtgatgcaatgagatctgaatatctgaaaggacctgggaaaagagggaatgatgaaataattgtcaatgatagaatcaaggataggagtgagaagcttcgaaatgaaacaaagagaaaaggtcgcagctttgataatgagaagagttcagaggttgatcgaccaatgttgaagaaactggactctgcacggttccaagattccaaacattttgatagaaatgatggaaggaatgagtatgcaaaaacataccatgtagatccaaggttgaaaaggagaaggtctagaagcagggatcatgaccgcgaaagatatggcaggtctatctcaccaccaccaagggaacaaaggcataattaccgtggacacgattttggcaattatcctccatactactcaatggataaatcaaggaggaagtatgctgaagttg

SEQ ID NO: 30581 - protein, 349 aa, Panicum virgatum
  misc_feature: Ceres CLONE 1900706
  misc_feature: SWISSPROT Homolog: EC 5.2.1.8 Peptidylprolyl isomerase
MSRKIDSENDSQRITSEGTSARTRPLSIQDIMLRREKKAASEAKKTKEELQENDKGTSNHLEQGRGYKSRKDSKDMPVEGSKMKIRDASREESKRENPRVPREGPKKEDTRYTPKVVSKKENSKDRSKGGSKMDDLKDTPKFSEKEDLRDAPRKGSKKEIPSIRDDYHSVGNDKGIGNSQKLAKSRSSRADGSKDRNLGEIRARNGDAMRSEYLKGPGKRGNDEIIVNDRIKDRSEKLRNETKRKGRSFDNEKSSEVDRPMLKKLDSARFQDSKHFDRNDGRNEYAKTYHVDPRLKRRRSRSRDHDRERYGRSISPPPREQRHNYRGHDFGNYPPYYSMDKSRRKYAEV

SEQ ID NO: 30582 - DNA, 728 bp, Panicum virgatum
  misc_feature: Ceres CLONE 1900706-R
gatagacatgtcctgttaggtgcagccctttgtgagaatgaagcacccgtagcagatgagcgcacagacatagatgacattcagaataaagctgttatccccacttcgcatcattctgaaactgatgaagcagctgcggatgtgaataaacatacagaagcggtggaggccaccagaactgcaatggatgatgatggagtagaaaggagacatcaagacctaagaacatcagagatctgtagacctgcagagcctggagaggaagtggaggagcctgcaagggactgggaactacaaggtgctgttgatgtgactgaagatcatgcagaaaaagtacctgctgttgtgactagtgacactgttttcgtgtttgaacctggttctgtgcttgtggagttcttgcgtaaggaagctgcatgcatggccgcacattcattacatggacggcgttttggcaacagaaccgtttatactggatatgttccatatgatctctacttgaaaaagtaccctaggtgattctcggtttgagactgctgctactctgattagcaattagataagctttgcatatgtgccaacagttgtagagactccatagttttgagccattagatggttcattacttcagtcaagatgatggtattgttagtaagaatgaaatattaggagattattattccacagcagaatgaaatattgggtgatgagcaggatactggatacc

SEQ ID NO: 30583 - DNA, 751 bp, Panicum virgatum
  misc_feature: Ceres CLONE 1900749-R
  misc_feature: Encodes the peptide sequence at SEQ ID NO. 30584
tggtggcaaggatgcccttagagccttcaaggaatcagatgagaagggctatcttgaagtcgagaccgaagggttaaagcagctcacgtccatgggtagccttgtgctttgctgtggggatggcgctgtcatgaactcaactaatctgggcttactgaggcatggtgtctccatttggattgacgttcctctcgagatggcagcgaacgatatgctgaagagcacgggaacacaagctactacagatccagactctttctcacaggcaatgagcaagctccgtcagcagtatgatgaactgaaagaacgctatggaatttctgatattactgtttcagtacaaaaagtggcttctcagctgggctacagcagtgttgactctgtgacccttgaggacatggttcttgaaattgtgaggcaaattgagagactgatccgagcaaaagcgatgatggaagctgcagggaagcccttctagacaataggcgcgacattccgctccggcatttacatattatctccagttgccagagcaggcatttggctcttccatggagctgattacagttaacccacgaatcaagcacaagcattttcaaatccgaggagcagaatcactgttgtgctcgaatatgcttatttcgtattgtaaaatcgcatgtcatttgatagcccattgtgtaaatctgccatggtgcagcaactttcagattgtatttactgtcaatggaaatgacagatctgcctgtcc

SEQ ID NO: 30584 - protein, 158 aa, Panicum virgatum
  misc_feature: Ceres CLONE 1900749-R
  misc_feature (2)..(142): Pfam Name: SKI Pfam Description: Shikimate kinase
  misc_feature: SWISSPROT Homolog: EC 2.7.1.71 Shikimate kinase
GGKDALRAFKESDEKGYLEVETEGLKQLTSMGSLVLCCGDGAVMNSTNLGLLRHGVSIWIDVPLEMAANDMLKSTGTQATTDPDSFSQAMSKLRQQYDELKERYGISDITVSVQKVASQLGYSSVDSVTLEDMVLEIVRQIERLIRAKAMMEAAGKPF

SEQ ID NO: 30585 - DNA, 1333 bp, Panicum virgatum
  misc_feature: Ceres CLONE 1900749
gagcgtcagtgcgtcgcggacgggagaggcgccatggcgatgcgagcagctacggcggcggccacaggcttcttttcttcgccctcctccgtctccccgaggcgtttctcgtcctcctcgccgccggcgtcgctctccgccgggcgctgcatccgtcgccatcgtctccgcgcctttccgagttcggaattgcctctggaggaactcaacccatccgttgatctactgagaaaaactgctgaggccgtcggtgatttcaggaaaacgccaatctatatcgttggtatgcttcttcacctccctcttgttgggattaaaaaggcctttatggttttccaccatcgataaccaagccaaatgttggaatcagcaatcaaaatgagacagttttttttttgtacgaaaatttggtaacacaatgaaacctaaatttaaagtttagcaatccaaatgtgtccaacctgcccgtgggaatgtttattctctcctaaaacaaattcttggcttctcataaaacctggcttcgttgcgagtcaatcaacattattatgtttgtttttgttgctaaattttggcatataccaggttttgttatgataaaatattctgggggaatagccttgtcattgtataatggggattaagtatttacatgttgcgtcgatacaaagtgccagactgccaggtcatgcacctaaacaggaaaagagaaaacaactatctgaggatattgtcgagttcttgaatctctgaagtttcatcagcaaacaaaatctgcagtaattgatcaccaccatagaataggggctttgctgttgctgcctggctaagcaattctagtcccaccagccttcaattttctggcaaactacttgagagaaaaaagcagattactgtgtggccaagggctatttcatccttgttcgtacatcctacggagcttcatgatcggattgaccacacaattgcttgttcgttgtgaggactttgtattgccataggaaccacgaacaaaacttgctttaattttcaacctatggcttccagttccaaatcagcatccaatctttttttcctttttctttcttccttttttgggggtagacgaaccaaataattgtgccttataagctgatttgcctttccatgaggagatgaacaccaggctatcttctgcccttgatacgatagagttatgccttggatatgggaccaaaccaatgtttagcaaactgcaacaatttgttgtcaagataacatgctctgaaggcctttcttttggttactgctctgaagagcagctgcaagcttctattgtttccctctaggccag

SEQ ID NO: 30586 - DNA, 1339 bp, Panicum virgatum
  misc_feature: Ceres CLONE 1900761
  misc_feature: Encodes the peptide sequence at SEQ ID NO. 30587
gtctctctcacacattccccgacccctcctcgcctcccctctcccaccgctgcagccgcgattccatctgctctcccgtcccttccgccgctcgccactccccccccccccgccgccacgccgctagggtttcgcctcggggctccgctccccacttccgtgtcgcgcgagccacccgcccgcccgcggaggccgtcgctgtcgtcgctcgcttcctcgctaggctctagggtgcggcgactggccggcgcgccgcgggaggagcagccatgtcgcagactaactgggaggcggacaagatgctggatgtttacatatacgactattttatgaagagaaatttgcaggcaactgcaaaggccttccaagcagaaggaaaggtctcttcagatccagttgcaattgatgcacctggtggctttcttttcgagtggtggtcagttttttgggatatattcatagcacgaacaaacgagaagcattcggatgttgcagcgtcatacattgagactcagctcatgaaagccagggagcaacagcagcaacagccacctcaacagaggcagcagcagccacagcatatacaaatgcaacaaatgctgctacaaagagctgtgcatcagcagcagcagcagcagcaacaacaacagcagcagcagcagcaaccgcaacagcagcagcagcagcagcagcagcagcagcagcagcagcagcagcagcagcagccgcagctgctgcaacagcagcgtagagatggttcccatcttctcaatggttcggcaaatggaatttctggaaacaatcctttaatgcgacagaaccaaagtacagcgaatgttatggcaacaaaaatgtatgaggaaaggttaaaggtaccttcacaaagagaatctttggaagagccatcaatgaagcaaagatatggagagaatgctgggcaactacttgattcaaatgaagcatcattgttgaaagcagcttcaagcggacaatcatcagggcaaattttgcatggaactgttggtggattgtcaggcactctgcaacaagttcaggccagaagtccccaacttcctgggcctgctcagagtatcaaaacagagatcaatccaattctgacgcccagagctgcaggtgcagaaggatcttttattggtgtccaaggatctaatcaagttgggaacaatttgactttgaagggatggccactcacgggacttgagcaacttaggtccggaattcttcagcagaaatcatttatacagaatcaacagcaactgcaccagcagatccagatgctgactccacagcagcagcagcagcttatgctgcaggctca

SEQ ID NO: 30587 - protein, 356 aa, Panicum virgatum
  misc_feature: Ceres CLONE 1900761
  misc_feature (72)..(335): Pfam Name: SSDP Pfam Description: Single-stranded DNA binding protein, SSDP
  misc_feature (10)..(36): Pfam Name: LisH Pfam Description: LisH
MSQTNWEADKMLDVYIYDYFMKRNLQATAKAFQAEGKVSSDPVAIDAPGGFLFEWWSVFWDIFIARTNEKHSDVAASYIETQLMKAREQQQQQPPQQRQQQPQHIQMQQMLLQRAVHQQQQQQQQQQQQQQQPQQQQQQQQQQQQQQQQQQQPQLLQQQRRDGSHLLNGSANGISGNNPLMRQNQSTANVMATKMYEERLKVPSQRESLEEPSMKQRYGENAGQLLDSNEASLLKAASSGQSSGQILHGTVGGLSGTLQQVQARSPQLPGPAQSIKTEINPILTPRAAGAEGSFIGVQGSNQVGNNLTLKGWPLTGLEQLRSGILQQKSFIQNQQQLHQQIQMLTPQQQQQLMLQA

SEQ ID NO: 30588 - DNA, 700 bp, Panicum virgatum
  misc_feature: Ceres CLONE 1900772
  misc_feature: Encodes the peptide sequence at SEQ ID NO. 30589
cgacacctgtccaccattcccgtctcccactggccttcgcctcgcctcgccgccgtggccgcgcaacgccttcccgcacccaccaacgcgcgtcttccacctcgcgcgccctctcaggtctcctccaaatcccgcctaatccgctggatttcccttgctaattctggcagctcttgtcgctgctctgccaaacccctgctctgagctcatccgattggcggctccggcctctgggcgaagcgggtgttttgaagcgacggcgaatcagggatggatttccccagaggaagcgggaggcggccacagcagcagcagcagcagccagagccggagcacctgccgccgatgacgccgctgccgctggcgcggcaggggtcggtctactcgctcacgttcgacgagttccagagcgcgctcggcggtgcgggcaaggacttcggatccatgaacatggacgagctcctccgcagcatctggacggccgaggagacgcacgccgtcgccgccgccaacgcgtcggcggcgtccgcggccgcggcggacctcgccgcgcgggcggcgtccatccagcggcagggatcgctcaccctcccccgcacgctcagccagaagaccgtcgacgaggtctggcgcgacatcatgtgcttcggcgggccctccgccgcgcaggccgaggcgccgcccccgccgggccagcggc

SEQ ID NO: 30589 - protein, 143 aa, Panicum virgatum
  misc_feature: Ceres CLONE 1900772
  misc_feature: Useful for making plants with modulated water use efficiency
  misc_feature: Useful for making plants with modulated drought sensitivity
MDFPRGSGRRPQQQQQQPEPEHLPPMTPLPLARQGSVYSLTFDEFQSALGGAGKDFGSMNMDELLRSIWTAEETHAVAAANASAASAAAADLAARAASIQRQGSLTLPRTLSQKTVDEVWRDIMCFGGPSAAQAEAPPPPGQR

SEQ ID NO: 30590 - DNA, 1376 bp, Panicum virgatum
  misc_feature: Ceres CLONE 1900777
  misc_feature: Encodes the peptide sequence at SEQ ID NO. 30591
acctcctccttccacagcaaacttccctatttgcaaatccaacccaatacctactacccgcgcgtcgtggcacccaccattagtgtcaaaaccccaaccaaacatatcaacgacgcctcctcggccaccgcgcgcccgtccgccggtggcaatgcatgggcacggcatggctcacttcatgctcttaccggctctagcgctggtgatggttgcctccgcgtggctgaccccggccgcccttggggacccgcaggccacgcagctcaacctgggttgcagcccgtacaacgccacgcccgcgtccgccttcctcctcgccctcaactccacctttgccgacctgcgcgccaacctctcagctggcggcggcttcgccaccgcagcggagccgcgcgccgccgccccggcgttcgcgatggcgcagtgccgcccgtacgtcgcgggccgagactgcgtcgcctgcttcgacgcagccgccgcgcgcctccgcggcgcgtgcggcggcgccaacggcgctcgtgtcatattcgacggctgcgtcatccgctacgagagcacggccttcttcgaccaggccacgctcccgggaaacacgcagatctgcaacgggtccgccgtggacgtcgccggcttcgccgacgcggcgcgagcactggtttccgatcttgcggccgccgtccctaacgcaccagggctcgccgcggcgtccgcgagcggcggcgtgtacgcggcggcgcagtgtgtggagacggttggggacagcggctgcgcgcagtgcctcaaggtggcgatggggaacatcgacgggtgcccgcccagctccgacggccgtgccgtggacgccggctgcttcatgagatattccactaagccgttcttcccggcgaatgcaaccgtggacctcgccgcgtacttgcgctctgggaagaaatcaagtcggaaaggagccatcatagcaggcattatgggaggtgtagccttcctgatttttattgggctattgattttcttattgatccggtggtctagaaagtttaggcctcagagaggagatatacttggaacaacagaattacaaggtccaacaagtttctactatcacgatcttaagacagcaaccaataatttcaatgagacaagcaaactcggagaaggaggttttggagatgtctataagggtttgctgaaaaatgggaaaacagttgcagtaaaaaggttgatagtaatggacactaggaaggccaaagcgaattttgaaagtgaggtgaagttaatcagcaatgttcatcaccggaatcttgtccggcttcttggttgctctcagaaggcctctgagttcctacttgtttatgaatacatggcaaatggtagtctgg

SEQ ID NO: 30591 - protein, 403 aa, Panicum virgatum
  misc_feature: Ceres CLONE 1900777
  misc_feature: SWISSPROT Homolog: EC 2.7.11.1 Non-specific serine/threonine protein kinase
MAHFMLLPALALVMVASAWLTPAALGDPQATQLNLGCSPYNATPASAFLLALNSTFADLRANLSAGGGFATAAEPRAAAPAFAMAQCRPYVAGRDCVACFDAAAARLRGACGGANGARVIFDGCVIRYESTAFFDQATLPGNTQICNGSAVDVAGFADAARALVSDLAAAVPNAPGLAAASASGGVYAAAQCVETVGDSGCAQCLKVAMGNIDGCPPSSDGRAVDAGCFMRYSTKPFFPANATVDLAAYLRSGKKSSRKGAIIAGIMGGVAFLIFIGLLIFLLIRWSRKFRPQRGDILGTTELQGPTSFYYHDLKTATNNFNETSKLGEGGFGDVYKGLLKNGKTVAVKRLIVMDTRKAKANFESEVKLISNVHHRNLVRLLGCSQKASEFLLVYEYMANGSL

SEQ ID NO: 30592 - DNA, 1087 bp, Panicum virgatum
  misc_feature: Ceres CLONE 1900779
  misc_feature: Encodes the peptide sequence at SEQ ID NO. 30593
atgccaactcgtgggcgggggcctgcgccgcccactccgcctgaagctctggccgccgccggctttcctttgtacaacgacccgaggagatatattatctcccgttccacctttgccgtcggaaaatccaacaaacctctgcacttcggcgcttcccagccgaggacggaagcgagaggagagggggagcctgcggcgggcgccggcggaggtggggaaaatggcggcggcgagggaccagctcctggacgtgatccgcgggctcatggcgggccagtcgccgccgctccacgcgctggtcgtcccctccgaggacgcgcaccagagcgagtacgtctcggagcaggacaagcggcgggagttcatctccgggttcacggggagcgctggcttggctcttatcaccatgaatgaggccttgttgtggacggatggacgctacttcttgcaagcaacacagcaactgagtaatcgctggaaattaatgcgcatgggagaagacccaccggttgaagcttggatagctgataatttggcagatggagctgccattggaatcaatccatggtgtatttcggttgactctgctcaaagatatgagcatgcattttcaaagaagcaccagactttgtttcagctttatattgacttggtggatgaagtatggatggatcgcccaccagtcgaacctaggcctgtaattgtacacccagtagaatttgcagggcgtagtgtatcagaaaagatcaaggagctaagagaaaagctattacatgaaaaagctactgcaattataataactgctcttgatgaggttgcttggttgtacaacattcgaggaagtgatgtggattatagcccagtggttcattcttatgctattgtaaccttgcacagtgctttcttttatgtggacaagagaaaagtaacagctgaggttcagaaatacatgattgaaaatggtattgatataagagactatgaaatggttcaatcagatgtgagtctacttgcatctggcaatctaaaaagttttgtgcatgggggaaacgatatcaatgtggaaggttcaaaaatttggattgat

SEQ ID NO: 30593 - protein, 288 aa, Panicum virgatum
  misc_feature: Ceres CLONE 1900779
MAAARDQLLDVIRGLMAGQSPPLHALVVPSEDAHQSEYVSEQDKRREFISGFTGSAGLALITMNEALLWTDGRYFLQATQQLSNRWKLMRMGEDPPVEAWIADNLADGAAIGINPWCISVDSAQRYEHAFSKKHQTLFQLYIDLVDEVWMDRPPVEPRPVIVHPVEFAGRSVSEKIKELREKLLHEKATAIIITALDEVAWLYNIRGSDVDYSPVVHSYAIVTLHSAFFYVDKRKVTAEVQKYMIENGIDIRDYEMVQSDVSLLASGNLKSFVHGGNDINVEGSKIWI

SEQ ID NO: 30594 - DNA, 717 bp, Panicum virgatum
  misc_feature: Ceres CLONE 1900779-R
  misc_feature: Encodes the peptide sequence at SEQ ID NO. 30595
tgacattgctgtatttcctaacgggacaacagggcatgctcttgatatcctttcacgaaccccactatggagagagggtcttgactatcggcatggtacaggccatggaatcgggtcgtatttgaatgttcatgaaggtcctcatctaattagcttcagacctactgctcgaaatgtgccattacaagcatcaatgactgtaacagatgagcctggttattatgaagatgggagctttggtatcagattggagaatgttcttatttgcaaagaggccaatgctaaatttaattttggagataaaggttatctggcatttgaacatataacatgggctccataccaggccaaaatgatagacaacaagctgctgacccctgtcgagatcgagtgggtaaacacataccactctgactgccggagaatcttggaaccctatctgaacgagcaagagaaagaatggctgcggaaagccactgagcccattgccctaagtggctgagcccattcatgtagttctgtagcgtcccgtgcgtagatagattccctgctcctcctcgcatgcaaaataacaccagcgaaggaaaatgcgtagacaaattgttcttcttcaagttattcttgctgcgaaaatggagtcagtctcgaaataaaattaagtgctggataatgtacatacagttttcaaattaaataacctgttgatctttcaccccg

SEQ ID NO: 30595 - protein, 166 aa, Panicum virgatum
  misc_feature: Ceres CLONE 1900779-R
DIAVFPNGTTGHALDILSRTPLWREGLDYRHGTGHGIGSYLNVHEGPHLISFRPTARNVPLQASMTVTDEPGYYEDGSFGIRLENVLICKEANAKFNFGDKGYLAFEHITWAPYQAKMIDNKLLTPVEIEWVNTYHSDCRRILEPYLNEQEKEWLRKATEPIALSG

SEQ ID NO: 30596 - DNA, 987 bp, Panicum virgatum
  misc_feature: Ceres CLONE 1900786
  misc_feature: Encodes the peptide sequence at SEQ ID NO. 30597
agcaaaagcagcggccagcgtcgtgcgccgatccagcagaggagccccgcgccgccgcccaacccctctcgaccgctctgcctctgcgagctcgatcgagtcgagccccctcgctcgtcgccgcgccaccaccaccaccagtacctcgggcctgtagcctctccagtctccaccctgatcagccggcgctgagcaatagactagtgcgtccgcgatggctaccatcctgccggagaccgcgtcggacggcaaggccctcacggacgcctgggactacaagggccgcccggccagccgcgccaccaccggcggatggggctgcgccgccatgatcctaggcgcggagctgttcgagcggatgacgacgctgggcatcgcggtgaacctggtgccgtacatgaccggcacgatgcacctcggcaatgccgccgccgccaacacggtcaccaacttcatcggcacctccttcatgctctgcctcctcggcggcttcgtcgccgacagctacctcggccgctacctcaccatcgccatcttcaccgccgtccaggccacgggcgtgatgatcctgaccatctcgacggcggcgccgggcctgcagccgccgccgtgctcggacgccaaaggcgcgagcccggactgcgtgccggccaacgggacgcagctcggggtgctgtacctgggcctgtacctgacagcgctgggcacgggcgggctcaagtccagcgtgtccgggttcgggtcggaccagttcgacgaggcgcacgacggcgagcgcggcaagatgctgcgcttcttcaactggttctacttcttcgtcagcatcggcgcgctgctggccgtcacggtgctggtgtacgtgcaggacaacgtcggccgccgctggggctacggcatctgcgccgccggcatcctcgtcgggctcgccgtcttcctgctgggcaccaggaggtaccggttcaagaagctggtagggagcccgctgac

SEQ ID NO: 30597 - protein, 257 aa, Panicum virgatum
  misc_feature: Ceres CLONE 1900786
  misc_feature: Useful for making plants with modulated carbon-nitrogen partitioning
MATILPETASDGKALTDAWDYKGRPASRATTGGWGCAAMILGAELFERMTTLGIAVNLVPYMTGTMHLGNAAAANTVTNFIGTSFMLCLLGGFVADSYLGRYLTIAIFTAVQATGVMILTISTAAPGLQPPPCSDAKGASPDCVPANGTQLGVLYLGLYLTALGTGGLKSSVSGFGSDQFDEAHDGERGKMLRFFNWFYFFVSIGALLAVTVLVYVQDNVGRRWGYGICAAGILVGLAVFLLGTRRYRFKKLVGSPL

SEQ ID NO: 30598 - DNA, 1331 bp, Panicum virgatum
  misc_feature: Ceres CLONE 1900801
  misc_feature: Encodes the peptide sequence at SEQ ID NO. 30599
gtccgccccgcgccgcggcaactcccaccgcctctgccgccgctgcagctgcccacttccctaaccccacgcgcccgctcgctccgctgccgtccactccgcctctcccgctgctttcctccgggcgcctcggcggcgcctcggcgccttaaaccctagatctgcgacccccggctctacgctggccgctctcgcatcccgacgccggcgcgccgccgatcgccgcccgtcgcccgatcccaggtttagttgctccaagtttagatagcttccttcgatgcatcgtgttgggagtgctggtaacacggccggctcgactcgaccgagaaaggagaagcgcttcacatatgtgcttaatgatgctgattctaaaaagcattgtgcagggatcaactgcttggcctatctaaatggttctgcatttagtacaagtgattatctttttagcgggagtcgtgatggtaccctgaaaagatgggaattaaataatggggatgcaagcttctcagcaacttttgagtcacatgtcgattgggttaatgatgctattatagttggtgaaaggcttgtttcctgttcctcagacaccaccctaaaggtgtggaattgcttctccgagggtgcctgtactaggactctccgccagcattctgattatgtgatttgtcttgctgctgccgagaagaatagcaacattgtcgcctctggtggtcttggtggtgaggtcttcatttgggacatcgatgctgctcttgctcctgtagccaaatctgttgatgcaaaagaggatgaggttcctaatggaaactccggacctgctttgacaactttgtacaatgtaaattctagtagcaacatcgcttcctctaatggacaaacacatggttacagtccaattaccgccaaaggacacaaagattcagtttatgcactggctatgaatgatacaggaacccttcttgtctctggtggcactgaaaaggttgttcgagtgtgggatcccaggacaggttcaaaaaagatgaaattgagggggcacacagacaatatcaggaccttacttcttgattccacaggaaggtattgtctatcaggttcatctgattcgatgataagactatgggatctaggacagcaacgttgtgttcattcttatgctgtgcatactgattcagtttgggcacttgcaaccactccttcatttgggcatgtctacagtggtggaagagaccagtctgtatacctgacagatttgtccacaagagagagtgtcttactctgcacaaatgaataccctattctacagttgtctctgcaagatgacacaatat

SEQ ID NO: 30599 - protein, 351 aa, Panicum virgatum
  misc_feature: Ceres CLONE 1900801
  misc_feature (245)..(283): Pfam Name: WD40 Pfam Description: WD domain, G-beta repeat
  misc_feature (115)..(154): Pfam Name: WD40 Pfam Description: WD domain, G-beta repeat
  misc_feature (203)..(241): Pfam Name: WD40 Pfam Description: WD domain, G-beta repeat
  misc_feature (74)..(110): Pfam Name: WD40 Pfam Description: WD domain, G-beta repeat
  misc_feature (287)..(325): Pfam Name: WD40 Pfam Description: WD domain, G-beta repeat
  misc_feature: SWISSPROT Homolog: EC 2.7.11.7 [Myosin heavy-chain] kinase
MHRVGSAGNTAGSTRPRKEKRFTYVLNDADSKKHCAGINCLAYLNGSAFSTSDYLFSGSRDGTLKRWELNNGDASFSATFESHVDWVNDAIIVGERLVSCSSDTTLKVWNCFSEGACTRTLRQHSDYVICLAAAEKNSNIVASGGLGGEVFIWDIDAALAPVAKSVDAKEDEVPNGNSGPALTTLYNVNSSSNIASSNGQTHGYSPITAKGHKDSVYALAMNDTGTLLVSGGTEKVVRVWDPRTGSKKMKLRGHTDNIRTLLLDSTGRYCLSGSSDSMIRLWDLGQQRCVHSYAVHTDSVWALATTPSFGHVYSGGRDQSVYLTDLSTRESVLLCTNEYPILQLSLQDDTI

SEQ ID NO: 30600 - DNA, 650 bp, Panicum virgatum
  misc_feature: Ceres CLONE 1900813
  misc_feature: Encodes the peptide sequence at SEQ ID NO. 30601
atatctacaaacaaccacggtgcatttcttaccgagtcataagaatacatcttccttctttgatcgagttacaagctaccgtcatgctcgacgtgtggaacacacctttcatcgtgtgccttctcctctccctcagctctagccttgtagccaccaatgagtctcaagtacaattttcctactcagggtttggaggtgctaacctctccctcgacggagttgctgctgtaagaccagatgggctccttcaactgacaaacagcaccgatgttaaaggttatgcattctacccaactcctctgcattttcgcaagtcacccaatagcatggtgcagtccttctcagtctccttggtgtttggtatccaatctgacttcaccgatgtaagcgtcgatggaatgactttctttgttgctcccagcaagaacttttccagtgcctttgcaaatcacttccttggcctcttcaatgaccagaccgatggcaacactaacaaccacatctttgctgttgagctagacactttccaaaacagtgagctcaaagatatcgacaataaccatgttggttttgacatcaacagtttgatctcaatagaaagcaaatctgctggattctatgataaccagactgataaaatcaaaaatatg

SEQ ID NO: 30601 - protein, 188 aa, Panicum virgatum
  misc_feature: Ceres CLONE 1900813
  misc_feature (27)..(185): Pfam Name: Lectin_legB Pfam Description: Legume lectin domain
MLDVWNTPFIVCLLLSLSSSLVATNESQVQFSYSGFGGANLSLDGVAAVRPDGLLQLTNSTDVKGYAFYPTPLHFRKSPNSMVQSFSVSLVFGIQSDFTDVSVDGMTFFVAPSKNFSSAFANHFLGLFNDQTDGNTNNHIFAVELDTFQNSELKDIDNNHVGFDINSLISIESKSAGFYDNQTDKIKN

SEQ ID NO: 30602 - DNA, 1193 bp, Panicum virgatum
  misc_feature: Ceres CLONE 1900859
  misc_feature: Encodes the peptide sequence at SEQ ID NO. 30603
gattcccattcgctccgccacggcgcgtgctcccgcccactcccactcccacgagacccgagtcccccctcccctccctccgcctccgcggaatcgcgagggattcccaaatcgccggagctgatcgtgccgtgcacgcgcgcgcgaggtggtagggctaggctgtccccccggaaatggacgcctccgactccggcgggggcgccgcggcggatgccggtgagcccctctgggactggggcaacctcctcgacttcgtccaggatgacgactcgctggtcctcccgtgggacaacgccgcggggataggggcagccgaccccaccgaggccgtcgcgccgatgcttcccgcaccgctgccgcagccgtcggaaccggagccggagccagagccggagcccgggccggtgcttccgccgccccctcttcgggtccaggggatcgggcgccgcgtgcggaagcgggacccgcggctggtgtgcccgaactacctagcggggagggtgccgtgcgcgtgccccgaggtggacgagatggtcgccgccgcggaggtggaggacgtggcgacggagttccttgccggcgcgcggaagaagactaagactgcggcccgccggggcaaagcgggagccgcaggcggcagcggagctgctggaggaactgtccgtgcggtggcgatggagatgaagtgccaggtgcctgggtgcgaggcggacatacgggagctcaaggggtaccaccgccggcaccgggtgtgcctgcgttgcgcgcacgcatctgctgtcatgctcgatggtgtccacaagcgctactgccagcagtgcggcaagttccatgtattactagattttgatgaagataaaaggagttgcagaagaaagttggagcgccacaacaaaaggcgaagaagaaaacctgattctaaaggaatacttgataaagaaatagatgagcaattggatctgtcagctgatgttagcggcgatggtgaacttagagaagagaacatggaaggcacaactagtgagatgcttgagactgttcttagcaacaaggttttggacagaggaacaccggcaggatctgaagatgtgctttcaccaacttgtacacagcccagtttgcaaaatgaacaaagtaaaagtgtagtgacttttgcagcttctgtttgagcctgcattggcgcaaagcag

SEQ ID NO: 30603 - protein, 331 aa, Panicum virgatum
  misc_feature: Ceres CLONE 1900859
  misc_feature (171)..(249): Pfam Name: SBP Pfam Description: SBP domain
  misc_feature: Useful for making plants with altered lignin content
  misc_feature: Useful for making plants with altered terpenoid content
  misc_feature: Useful for making plants with modulated flowering time
MDASDSGGGAAADAGEPLWDWGNLLDFVQDDDSLVLPWDNAAGIGAADPTEAVAPMLPAPLPQPSEPEPEPEPEPGPVLPPPPLRVQGIGRRVRKRDPRLVCPNYLAGRVPCACPEVDEMVAAAEVEDVATEFLAGARKKTKTAARRGKAGAAGGSGAAGGTVRAVAMEMKCQVPGCEADIRELKGYHRRHRVCLRCAHASAVMLDGVHKRYCQQCGKFHVLLDFDEDKRSCRRKLERHNKRRRRKPDSKGILDKEIDEQLDLSADVSGDGELREENMEGTTSEMLETVLSNKVLDRGTPAGSEDVLSPTCTQPSLQNEQSKSVVTFAASV

SEQ ID NO: 30604 - DNA, 1844 bp, Panicum virgatum
  misc_feature: Ceres CLONE 1900887
  misc_feature: Encodes the peptide sequence at SEQ ID NO. 30605
ctcaaagactcgctcctagatacaccggcgccaccaacagcacagctgctgcgctgcgtgcttgccatggaggccaataataatagtaagcacgggaaggcgtactccgtcgccgaggaagatgctacgactaccaataatatgatgatgaagcagaagcacctctccgacgacgaggccgccgccggcgagccggaggagaactaccgcgggtggaaggccatgccttacgtcatagggaacgagacgtgcgagaagcttggcaccatcggcaccacggccaacctgctggtctacctcaccaccgtctacggcatcaagagcgccagcgccgccacgctgctcagcctctggggcggcaccgtcaacctcgcccccgtcctcggcgccttcctcagcgactcgtacctcggccgctacgccaccatcgccctcgcctccatcgcctccttcgtcggcatccgcccctgcaacctcgccttcggcgccgaccagttcgacccccgcacgcccgccggccgccgcgggatcaacagcttcttcaactggtactacttcaccttcaccatcgccatgatggtctccgccacgttcatcatctacctccagagcaacgtcagctgggcgctcggcctcgccgtcccggccacgctcatgggcctctcctgcgcgctcttcttcatgggcacgcgcctctacgtccgcgtccgccccgagggaagccccttcaccagcttcgcccaggtcgtcgtcgccgcctaccgcaagcgccgcctgcaccgaggtccctgcgacctcttattcgacccgccgcaccggaggagcagcctcgtgtccaagatcgcctacacggaccagttcctgtgcctggacaaggccgccattctcaccgctgacgacgagctcgcggtcacggccgacggcaccacgccggcgaacccgtggcggctgtgcacggtgcagcaggtggaggaggtcaagtgcctggtgcggctgctcccggtgtggtcgtcggggatcgtctactacatcgtgctcaccaacctgggcaactacggcgtgctccaggccatgcagacggaccggcgcctcgggcggtcggggttccagatcccggcggggtccctggtggtgttcaacatgctggcgctcacggcgtggctccccgtgtacgacggcgtggtggtgccggcgctgcagcgggtgaccaagcgcgagggcggcatcacccagctgcagcggatgggcgccggcatcgtgctgtccatcgccaccatggtggcggcggcggcggtggagcggcaccggcgcgcggtgggggacgcgacgtcgtgcttcgtgctggtgccgcagcagatgctggcggggctgtcggaggcgttcgcggtgatcgggcaggtggaactgtactacaagcagttcccggagaacatgcgcagcgtggccggcgcgctgctgttcctgggcttcgccgtggccagctacgccagcgggctgatggtgacggtggtgcaccggacgacgggagggagcgacgggcggccggactggctgacgcaggacctcaaccaggggcgcgtcgacctctactatctggtgatcgcgggcatggccgccgtcaacctcgtctacttcgtggcgtgcgcgcgctggtacaggttcaaggagtcggcggaccacgccggcgccgtcgagctggaggagaaggacaaggtcgttgttgttactgatgcaggcgccgccgcacctccacctccagtatgaagctccgtaccgtacctctccgatgcttaaataatcggaaaagctaagttcgaaaattaaatgaagatgcagcgtcgatc

SEQ ID NO: 30605 - protein, 565 aa, Panicum virgatum
  misc_feature: Ceres CLONE 1900887
  misc_feature (87)..(468): Pfam Name: PTR2 Pfam Description: POT family
MEANNNSKHGKAYSVAEEDATTTNNMMMKQKHLSDDEAAAGEPEENYRGWKAMPYVIGNETCEKLGTIGTTANLLVYLTTVYGIKSASAATLLSLWGGTVNLAPVLGAFLSDSYLGRYATIALASIASFVGIRPCNLAFGADQFDPRTPAGRRGINSFFNWYYFTFTIAMMVSATFIIYLQSNVSWALGLAVPATLMGLSCALFFMGTRLYVRVRPEGSPFTSFAQVVVAAYRKRRLHRGPCDLLFDPPHRRSSLVSKIAYTDQFLCLDKAAILTADDELAVTADGTTPANPWRLCTVQQVEEVKCLVRLLPVWSSGIVYYIVLTNLGNYGVLQAMQTDRRLGRSGFQIPAGSLVVFNMLALTAWLPVYDGVVVPALQRVTKREGGITQLQRMGAGIVLSIATMVAAAAVERHRRAVGDATSCFVLVPQQMLAGLSEAFAVIGQVELYYKQFPENMRSVAGALLFLGFAVASYASGLMVTVVHRTTGGSDGRPDWLTQDLNQGRVDLYYLVIAGMAAVNLVYFVACARWYRFKESADHAGAVELEEKDKVVVVTDAGAAAPPPPV

SEQ ID NO: 30606 - DNA, 686 bp, Panicum virgatum
  misc_feature: Ceres CLONE 1900901
  misc_feature: Encodes the peptide sequence at SEQ ID NO. 30607
attcgcctttccgcacccgccgctcggtcgccttcgagttccaccagccaccaaacccgccggggagaagtcgagaggagcaagtcgccgagaagaggagatggcccgtacgaagcagaccgcccgcaagtccaccggagggaaggcccctcgcaagcagctcgccaccaaggcggcgaggaagtcggcgccgacgaccggcggcgtgaagaagccccaccgctacaggcccgggaccgtggcgctccgcgagatccgcaagtaccagaagagcacggagctcctgatccgcaagctccccttccagcgcctggtccgcgagatcgcgcaggacttcaagacggacctccggttccagagccacgccgtgctggctctccaggaggccgccgaggcctacctcgtcgggctattcgaggacaccaacctctgcgccatccacgccaagcgcgtcaccatcatgcccaaggacatccagctcgcccgccgcatccgcggcgagcgcgcgtaagccgcagccgccgctgccgtaccggtagtggagatgtaggaggtcaagatgcttagtgggtctggatttagctgtactagttttcgttatcggtttggttagtgtaaaaacaggtttacaagtctattttgtgcttcgctgctattttggctctcgcttcgtgatgaagcgacct

SEQ ID NO: 30607 - protein, 136 aa, Panicum virgatum; identical to SEQ ID NO: 9871
  misc_feature: Ceres CLONE 1900901
  misc_feature (58)..(132): Pfam Name: Histone Pfam Description: Core histone H2A/H2B/H3/H4

SEQ ID NO: 30608 - DNA, 1144 bp, Panicum virgatum
  misc_feature: Ceres CLONE 1900930
  misc_feature: Encodes the peptide sequence at SEQ ID NO. 30609
acacacgcgcacggccgcactccatctccagcggctagagagagagagagagagttcgcccgcgaaaaaaaaagaaaaagaatatcgcctccatttgacagagggaggagggagggagataggggagacggggaggaggaggagcaggtcgtgagcccaggagggagcggggggacgccggcggccgcgcggcagatcgggcctcgagctcgaggcgcaccgttttagggggggggccgcccgccccatgcgccggtgaggtggtggggcccgctctgcgcgcgagtcggaatggcggcggcggtgaggtggtgggcggtggtgctcgcggcggcggtggtgctcgggccggggcgggtcgtcgctaacaccgagggtgatgctctgtacagcctgcgtcagagcttgagagatgctaacaatgtcttgcagagttgggatcccactcttgttaatccctgtacatggttccatgttacgtgtaacaacgataacagtgttatcagagttgaccttggaaatgcacaattatcaggtgtactagtcccccagcttggtcagctgaaaaatcttcaatatttggagctttacagcaacaacataagtgggacaataccccctgaactgggcaacctaactaacctggtcagtttggatctgtatatgaacaacttctctggcagtatcccggacagccttgggtacctattgaagctacgtttcctccgtcttaacaacaacagcttggttggtcaaattcctgaatccttgaccaatatctccactctccaagtactggatctttcgaacaacaacctctcaggacaagtcccatcgactggttccttttcactcttcactcctataagttttgccaacaatccattgctctgtggtcctggtacttcaaagccctgccctggggctcctcctttttccccgccgcctccatataaccctccatctccaccaaccccatcaacaggtgcctctagcactggagcaattgctggaggtgttgctgctggtgctgcattggtatttgctgttcctgcaattgcatttgcaatgtggcgccgtcgtaaacctgaagagcatttctttgatgtgcctgctgaggaggatccagaagttcatcttggtc

SEQ ID NO: 30609 - protein, 284 aa, Panicum virgatum
  misc_feature: Ceres CLONE 1900930
  misc_feature (25)..(65): Pfam Name: LRRNT_2 Pfam Description: Leucine rich repeat N-terminal domain
  misc_feature: SWISSPROT Homolog: EC 2.7.11.1 Non-specific serine/threonine protein kinase
MAAAVRWWAVVLAAAVVLGPGRVVANTEGDALYSLRQSLRDANNVLQSWDPTLVNPCTWFHVTCNNDNSVIRVDLGNAQLSGVLVPQLGQLKNLQYLELYSNNISGTIPPELGNLTNLVSLDLYMNNFSGSIPDSLGYLLKLRFLRLNNNSLVGQIPESLTNISTLQVLDLSNNNLSGQVPSTGSFSLFTPISFANNPLLCGPGTSKPCPGAPPFSPPPPYNPPSPPTPSTGASSTGAIAGGVAAGAALVFAVPAIAFAMWRRRKPEEHFFDVPAEEDPEVHLG

SEQ ID NO: 30610 - DNA, 639 bp, Panicum virgatum
  misc_feature: Ceres CLONE 1900930-R
  misc_feature: Encodes the peptide sequence at SEQ ID NO. 30611
ttttggctacgggatcatgcttctggagcttattactggacagagggcgttcgatcttgctcgtcttgcaaatgatgatgatgttatgctgcttgactgggtgaaaggactgctcaaggagaagaaggtcgagatgttggtggacccagacctgcagaacgcctaccaggagaccgaggtggagaacctgatccaggtggccctcctctgcacacagggctccccgttggaccgacccaagatgtcagaggtggtgaggatgctggaaggcgatggcctggcggagcgatgggatgagtggcagaaggtggaggtggtgaggcaggaggctgagtcagcgccgctccgcaatgactggatcgtcgattcaacatataacctgcgcgctgtggagctgtccggcccaaggtgacatccttacggggcaccaagtcaatccgcgactccgaaagaagaattcgaaacttaattggcagattcagtctaattgctgcttgtgtatatgaaaggtagcttttggaattattagtgacagcttgaagggatgatattatttttggattcctcactagcctcagaagttgggggtaggctgttgttgtgtcgttaagatgaaattcgtatattcgagggtgaatt

SEQ ID NO: 30611 - protein, 136 aa, Panicum virgatum
  misc_feature: Ceres CLONE 1900930-R
  misc_feature: SWISSPROT Homolog: EC 2.7.11.1 Non-specific serine/threonine protein kinase
  misc_feature: Useful for making plants with modulated nitrogen use efficiency
FGYGIMLLELITGQRAFDLARLANDDDVMLLDWVKGLLKEKKVEMLVDPDLQNAYQETEVENLIQVALLCTQGSPLDRPKMSEVVRMLEGDGLAERWDEWQKVEVVRQEAESAPLRNDWIVDSTYNLRAVELSGPR

SEQ ID NO: 30612 - DNA, 1717 bp, Panicum virgatum
  misc_feature: Ceres CLONE 1900933
  misc_feature: Encodes the peptide sequence at SEQ ID NO. 30613
atacttctcggcccaagtctcaattagggacaactagaaattaggggaacttgcaccctatctttaagctcagcaagacaaagcaactatgttttgtttcagttgcatcaaaagctcttactatcctgatttgtgaatgtgacttgcattgtacataatcccagaaactaaagacaatattgaatattccttacatgcactgatactactttgatgttgtgcactttctcaagaaccttgtagaaaagctgcatctcacaagaatgttttttcagcacggcaagtttaccccaatctgttcttttttatgcatatttctacatggtgttaacatccttgttggtgctagttaattgtttaacattctgtactgtgaatgaacaagagtcggcgttcccctgccagcagcaatggaattatttctgacaaggtgctgttcggttcctggaacatggcgctggatgcttggagttgctgctgtgcctgccattgtacagtttgtgctgatgctttttctgccagaatctccccgttggctttactggaaggatgagaaggcacaatctattgctgtcctggagaagatctacgactctgatcgtttggaagaagaggtagagctgcttgcttcatcttccatgcatgaattccaggctgacaatactgcaagctatttggacgtcttcaagtcaaaggaattaagactagcgtttttggctggagctggtcttcaggccttccaacaattcactgggatcaacaccgtcatgtattacagccccacgatcgtccagatggctggtttcacttccaacaaattggccttgctcctttccctctttgtcgctgcgatgaacgctgctgggaccattgttggaatctaccttattgaccgttgtggccgccgtcgcctggcccttacaagcttgtccggtgtcgtgatctcccttgtcatccttgctatggccttcatactgcagtcatcatccagcctctgcatggctgccgctaacggcacctgccaaggcgcgctaggctggttcgcggtggcaggtctcgccctgtacatcgccgccttctctccaggcatgggcccggtcccgtgggctgtgaactcggagatctaccctgaggcataccgtggaatgtgcgggggcatgtcagccaccatcaactggatctccaacctcatcatggcgcagacgttcctctcgatcgtggggctggttggggccggcgtgaccttcctgatcatcgccggaatcggggtgctggccttcatcttcgtggcactgtacgtaccggagacgaagggcctgagctttgagcaggtggagcagctctggaagaagagagcgtggggaagccgtggcaactgccagagctttttgggtgctaagccgtaggctataaacattttagcactgatcaagcatggcagcaacggtggcgtcagttttaagatggctgcgttgcgcttgatcgcctccatccggctaaaaagaaggttcgtaagaaagctggatgcagatccaaactgtactctgtggtggcagattgcaattctgttgcccgattgtatgtaatggccgtagtgcccagtggaaaatgttcagtgtcggtaaaggccatgtttggttgtggagtgaaaatattttgatgagagagaaacgatgctttgaccactaattaggagtattaaataaagtctaattac

SEQ ID NO: 30613 - protein, 331 aa, Panicum virgatum
  misc_feature: Ceres CLONE 1900933
  misc_feature (1)..(312): Pfam Name: Sugar_tr Pfam Description: Sugar (and other) transporter
MELFLTRCCSVPGTWRWMLGVAAVPAIVQFVLMLFLPESPRWLYWKDEKAQSIAVLEKIYDSDRLEEEVELLASSSMHEFQADNTASYLDVFKSKELRLAFLAGAGLQAFQQFTGINTVMYYSPTIVQMAGFTSNKLALLLSLFVAAMNAAGTIVGIYLIDRCGRRRLALTSLSGVVISLVILAMAFILQSSSSLCMAAANGTCQGALGWFAVAGLALYIAAFSPGMGPVPWAVNSEIYPEAYRGMCGGMSATINWISNLIMAQTFLSIVGLVGAGVTFLIIAGIGVLAFIFVALYVPETKGLSFEQVEQLWKKRAWGSRGNCQSFLGAKP

SEQ ID NO: 30614 - DNA, 661 bp, Panicum virgatum
  misc_feature: Ceres CLONE 1900951
  misc_feature: Encodes the peptide sequence at SEQ ID NO. 30615
cctccattccgcccccctctcttcttcgatcctcctgtgcggcggagttggagggagaggggagacgctttccgccgccgaccccgcggcccgtgtcgccgatccgcgcgccgagccgatccggttgatcgaatacatcggtgtctttgctctttggggaagcccattgaacggtagtttgtaccacaactcacataattctgtcacggcgtggcctcggcaggggtgacgcgctcttctgtgggatttcctaatgacacgaacgcaacttgttgcagtgatgcagatccacttccatacgagtgggggactatgaacattaaggatgataaggacattgaagatattgcggtctctggccatgggacagagcctggtcatatcttactgactagcattgatgggagaaacgggcaggctaagcagaccattagctacatggcggagcgcgtggtaggtcatgggtccttcgggactgttttccaggccaagtgtctggaaactggtgagactgtagctctaaaaaaggttcttcgagacaagagatataacagtcgtgagctgcaaactatgcgagtgcttgaccacccgaatgtggttgctctgacgcactgtttcttttcagagactgcgacggaagaactttacctcaatttggtgc

SEQ ID NO: 30615 - protein, 116 aa, Panicum virgatum
  misc_feature: Ceres CLONE 1900951
  misc_feature: SWISSPROT Homolog: EC 2.7.11.1 Non-specific serine/threonine protein kinase
  misc_feature: Useful for making plants with modulated water use efficiency
  misc_feature: Useful for making plants with modulated biomass
MNIKDDKDIEDIAVSGHGTEPGHILLTSIDGRNGQAKQTISYMAERVVGHGSFGTVFQAKCLETGETVALKKVLRDKRYNSRELQTMRVLDHPNVVALTHCFFSETATEELYLNLV

SEQ ID NO: 30616 - DNA, 642 bp, Panicum virgatum
  misc_feature: Ceres CLONE 1900964
  misc_feature: Encodes the peptide sequence at SEQ ID NO. 30617
ctctcgctctcgctctcgtcggacgccgtccctagcttgcttccctcacaagcacccgggcggagcgaaccagccggcgacgaccggtggttgccgccgcggccgcccccgcgctttttatgctcgcggctgctcggttcgtgggctccggtagcgcgctgcgatcctctcggccacggacctttcagcgggagtgaagattccggtatggaggtggaggcgacgcccacgacggccgtgtcgtcttccggcggcgccgcgcagctgccgccgcccggcccgccctccaagaagaagcgtgccctccccggcatgccagatcctgacgcggaggtgatcgcgctgtcgcccaagacgctgctggcgacgaaccggttcgtgtgcgagatctgcaacaaggggttccagcgggaccagaacctgcagctccaccgccggggccacaacctcccctggaagctgcggcaacggagcggcaaggaggcccggaagcgggtgtacgtctgcccggagcccagctgcgtgcaccacgacccgtcgcgcgcgctcggcgacctcaccggcatcaagaagcacttctgtcggaagcacggcgagaagaagtggaagtgcgacaagtgctccaagaagtacgccgtgcag

SEQ ID NO: 30617 - protein, 144 aa, Panicum virgatum
  misc_feature: Ceres CLONE 1900964
  misc_feature (57)..(79): Pfam Name: zf-C2H2 Pfam Description: Zinc finger, C2H2 type
  misc_feature: Useful for making plants with modulated biomass
  misc_feature: The sequence is a functional homolog of SEQ ID NO 1086 in the 10/666,642 US patent application
  misc_feature: The sequence is a functional homolog of SEQ ID NO 312 in the 10/666,642 US patent application
  misc_feature: Useful for making plants with altered lignin content
  misc_feature: Useful for making plants with altered terpenoid content
  misc_feature: The sequence is a functional homolog of SEQ ID NO 1719 in the 11/479,226 US patent application
  misc_feature: The sequence is a functional homolog of SEQ ID NO 1524 in the 10/666,642 US patent application
  misc_feature: The sequence is a functional homolog of SEQ ID NO 214 in the 10/225,066 US patent application
  misc_feature: The sequence is a functional homolog of SEQ ID NO 2450 in the 10/374,780 US patent application
  misc_feature: The sequence is a functional homolog of SEQ ID NO 604 in the 10/412,699 US patent application
  misc_feature: The sequence is a functional homolog of SEQ ID NO 650 in the 10/666,642 US patent application
  misc_feature: The sequence is a functional homolog of SEQ ID NO 960 in the 11/435,388 US patent application
  misc_feature: The sequence is a functional homolog of SEQ ID NO 178 in the 10/225,068 US patent application
  misc_feature: The sequence is a functional homolog of SEQ ID NO 358 in the 10/374,780 US patent application
  misc_feature: The sequence is a functional homolog of SEQ ID NO 584 in the 10/666,642 US patent application
  misc_feature: The sequence is a functional homolog of SEQ ID NO 902 in the 11/435,388 US patent application
MEVEATPTTAVSSSGGAAQLPPPGPPSKKKRALPGMPDPDAEVIALSPKTLLATNRFVCEICNKGFQRDQNLQLHRRGHNLPWKLRQRSGKEARKRVYVCPEPSCVHHDPSRALGDLTGIKKHFCRKHGEKKWKCDKCSKKYAV

SEQ ID NO: 30618 - DNA, 1448 bp, Panicum virgatum
  misc_feature: Ceres CLONE 1900974
  misc_feature: Encodes the peptide sequence at SEQ ID NO. 30619
attatttctttctcctcccttgtcccggctcaaatcgcagggctgcgttcttgcaaatcgcctttggctttgccccaagattcgccgcccggcgccctcgctggaatcatgggcgctgaggtgagggtaggactcgaggcggccgtcgcttgccgcttgtcttgtgaatcccccgcccgccggcctcttgttttcttgcggcgattcagcctgatttagaggagggaattgttcgtatcggccccgttctgctcggtccggaccgacgattcggggcagttctgaaggaaatgctaggtctttcttgccgttagcttgagatcatccagttccacttgccacgattgagcttctcaacctgtctcctaatcatcctggaatgcggttcgccgcagccccgtagaagattgataaatttaagaggcatctgatacgagttcttctcgtgcgctctgaaggaagggagctgtgccgtgaaggcctcatcttgggcatccatgggattcctcagtcttgtgggcaactcctttgggtgctctgcttccggtgagcggcttgtctcagctgcccgcgacggcgacctgcaggaggcgcgtgcgctcctcgagtacaaccctcgccttgcccggtactccacatttggcggccgcaactcaccgctgcactatgccgctgcgcaaggccaccatgagattgtgtctctattgcttgaatccggcgttgagatcaaccttaggaattacaggggccagactgctttgatgcaagccggtcaatatggccactgggaggttgttcaaacactgattctcttcaatgcaaatgttcacaggacagattatctcaatggtggaactgctgtccatttcgctgcactgcacggtcatgcccgatgccttcgtcttgttcttgcagattacgtgccaagcataccaaatttcttcacccagacaaatcatagatcatctgaagaagattcaactactgattttgatcatgatgctttggtcaagatggtaaatcagaaggcagatggaggcttaaccccacttcatatggcagcgttaaatgggcatgtagagtgcgtgcaacttttactggacttaggagcatctgtttttgaggttactattgaggatggaacgactatagatttaataggagctggtagcaccccacttcactatgctgcttgtggtggaaatgctgtctgttgtcaactccttatggctcgaggagcttccattactgcacaaaatgctagcggatggaccccattgatggtggctcattcctggcaacggaattcaattgaagaaattttaagtaaagaaccagagggccagatacgcactcttccatctccatatctttgtcttccactcatgagtatcatgaacattgcaagggagtgtggatggagatacctgaaccagtcacctgtttgt

SEQ ID NO: 30619 - protein, 316 aa, Panicum virgatum
  misc_feature: Ceres CLONE 1900974
  misc_feature (180)..(212): Pfam Name: Ank Pfam Description: Ankyrin repeat
  misc_feature (223)..(255): Pfam Name: Ank Pfam Description: Ankyrin repeat
  misc_feature (50)..(82): Pfam Name: Ank Pfam Description: Ankyrin repeat
  misc_feature (83)..(115): Pfam Name: Ank Pfam Description: Ankyrin repeat
  misc_feature: SWISSPROT Homolog: EC 2.1.1.43 Histone-lysine N-methyltransferase
MGFLSLVGNSFGCSASGERLVSAARDGDLQEARALLEYNPRLARYSTFGGRNSPLHYAAAQGHHEIVSLLLESGVEINLRNYRGQTALMQAGQYGHWEVVQTLILFNANVHRTDYLNGGTAVHFAALHGHARCLRLVLADYVPSIPNFFTQTNHRSSEEDSTTDFDHDALVKMVNQKADGGLTPLHMAALNGHVECVQLLLDLGASVFEVTIEDGTTIDLIGAGSTPLHYAACGGNAVCCQLLMARGASITAQNASGWTPLMVAHSWQRNSIEEILSKEPEGQIRTLPSPYLCLPLMSIMNIARECGWRYLNQSPV

SEQ ID NO: 30620 - DNA, 518 bp, Panicum virgatum
  misc_feature: Ceres CLONE 1900974-R
gcttcgattgctgcccatctgtatcggtctgaattccagtgtgggcgcatgccaccgatgggctcgtcctccttccgctcgctgagctgccagaggataccagcgatgaaactgaacccagcattttgtatgggcatggacacaaatccctgccttttaagatgctcgaggttcggatctagcttgcggcgctcggcttcccaaggagagactaccagaagagcctggccggtaacctttaacccaattgttgctactggcaactgatagagcgaataggcatttgcatctccccagttttgtgcgctttttgagttgaggtctgttttttgtgtattctttggtcggcttggttggtctgatgttcgcgtccagttgtggtatgaattcgccggtcccaactcctagttaatatatcaggagcaacatgtaactactacctttttggtttgtaaataaccttgtggtgttatatattttccggaagcaatgaaatgcagaggcatcatcgatttttc

SEQ ID NO: 30621 - DNA, 1859 bp, Panicum virgatum
  misc_feature: Ceres CLONE 1900989
  misc_feature: Encodes the peptide sequence at SEQ ID NO. 30622
aatccaatctccgagcgcgccgcgccgcgccgctcgaccccgacccgacccgacccgaccagacgaccagacccatccccgtgccgtcgtggcgcgcggccccgccccggccgtccaccccccggcccgcgcgtctatatatcccccgtgcgtccagctcgccgcaccaccaccaccaccagaccatcctcccagcgcacgcaacacctcggatcgaaggagaaggcgtcggcgcaaactccgcgatgaggacgaggaaggagaaggcgtcggcgtggaggtcgctgctgggcggctgcctcggcggcggagccaagggggacaggcggcggaaggtgcgtccgggcggcggcgggcggctgtcgttcacggacctgagcggcgcggcggaccaggacctgtcggtgtcgctggtggggtcgaacctgcacgtgttcagcgtcgcggagctgcgcgaggccaccaggggcttcgtctccggcaacttcctgggcgagggcggcttcggccccgtctacaagggcttcgtcgccgacggcgtcaagaaggggctcaggccgcaggccatcgccgtcaagctctgggaccccgagggcgcccagggccacaaagagtggctggcggaggtgatcttcctggggcagctgcggcaccccaacctggtgaagctggtcggctactgctgcgaggacgagcaccgcctcctcgtctacgagtacatggagcacggcagcctcgagaaccacctcttcaagcagattcctgccgtgctgccttggtcaacccgactaaacattgcagtgggcgccgcaaagggtttggctttcctccacgacgcagagaagccggtgatctaccgtgacttcaaggcctccaacatcctgctcgactcggactacaaggccaagctgtcagactttgggctggccaaggacggcccggagggcgacgacacccacgtctcgacgcgcgtgatgggcacccatggctacgccgcgccggagtacatcatgacgggccacctcacggcgaagagcgacgtgtacagcttcggcgtggtgctgctggagatcctgaccgggcggcggtcggtggacaaggcgcggccgagccgggagcagaacctggtcgactacgcgcggccgtgcctcaaggacccgctcaagcttgcccggatcatggacccggccatggagggccagtactcggcgcgggcggcgcagagcgcggcgctcgtcgcgtaccggtgcctcagcggcagccccaagaaccggccggacatgtccgccgtcgtggaggccctggagccgctgctcagcctcaaggacgacgagcccctggggccggcggggcccgttggtccgttggtgctgttcgtggcggcgacggatcaggcgccggcgccggaggagaagaaggagcgggcaccgaggaaggacgtccgccggcgcaggcccatgtcgcccaaggcgagccccaggaagcgcgccggcgccggccagaaggaggagttctgggtgtggcacctgccggccgagcagatggcctgacgcgtctgagatgagcggatgagccgttgcgtgcatgcgtgtgtgtacatatgaggtggccaagtgctattggttatgatcatatgcatccctgtaaatctccttgggtttttcatttcattattattatctgtcgttacagtgagatgcagagtgtggctcgaaactagagcagtttatatacaccggaagctttctgttctttacacgtctgtatgcttgtcttcaaatgaagctacaacaagaattgtacaaaaacatgtctatacaggccatgggcatgtgacagagagggtacggttcttgagc

SEQ ID NO: 30622 - protein, 434 aa, Panicum virgatum
  misc_feature: Ceres CLONE 1900989
  misc_feature (76)..(353): Pfam Name: Pkinase_Tyr Pfam Description: Protein tyrosine kinase
  misc_feature: SWISSPROT Homolog: EC 2.7.11.1 Non-specific serine/threonine protein kinase
  misc_feature: Useful for making plants with modulated drought sensitivity
  misc_feature: Useful for making plants with modulated heat sensitivity
MRTRKEKASAWRSLLGGCLGGGAKGDRRRKVRPGGGGRLSFTDLSGAADQDLSVSLVGSNLHVFSVAELREATRGFVSGNFLGEGGFGPVYKGFVADGVKKGLRPQAIAVKLWDPEGAQGHKEWLAEVIFLGQLRHPNLVKLVGYCCEDEHRLLVYEYMEHGSLENHLFKQIPAVLPWSTRLNIAVGAAKGLAFLHDAEKPVIYRDFKASNILLDSDYKAKLSDFGLAKDGPEGDDTHVSTRVMGTHGYAAPEYIMTGHLTAKSDVYSFGVVLLEILTGRRSVDKARPSREQNLVDYARPCLKDPLKLARIMDPAMEGQYSARAAQSAALVAYRCLSGSPKNRPDMSAVVEALEPLLSLKDDEPLGPAGPVGPLVLFVAATDQAPAPEEKKERAPRKDVRRRRPMSPKASPRKRAGAGQKEEFWVWHLPAEQMA

SEQ ID NO: 30623 - DNA, 571 bp, Panicum virgatum
  misc_feature: Ceres CLONE 1900990
  misc_feature: Encodes the peptide sequence at SEQ ID NO. 30624
atcgtttggttcaaaatctcccttcccattcctctttctctctctctcagccttgttggttggtttggttggcaagagccatggcgctgacgctgcgatccaccacgtcgttcctgtcgcccgtcgaccccatctccaagctcctccacaagcccggcgccgacgacgcgccgccgagctgcgccgccgtgccgtccccgccccacgccgccgcgccgagccgcaggctgcgcctcgtcagggcggccgccgcggcggcgcccgcgccggccggggccgccgagctgctgcacgccggcggcgcgggccaagagaacgggcgcgcgcgcggcggggtccccgtctacgtgatgctgccgctggacacggtggggcccggcggccagctgtcgcggcagcgcgcggtggcggcgagtctgatggagctgcggggcgccggggtggagggcgtcatggtggacgtttggtggggcgtcgtcgagcgggagggccccggccgctacgactgggaggcctacgccgagctggtgcgcatggtggagcgcgccggcctgcggctccaggccgtcat

SEQ ID NO: 30624 - protein, 163 aa, Panicum virgatum
  misc_feature: Ceres CLONE 1900990
  misc_feature: SWISSPROT Homolog: EC 3.2.1.2 Beta-amylase
MALTLRSTTSFLSPVDPISKLLHKPGADDAPPSCAAVPSPPHAAAPSRRLRLVRAAAAAAPAPAGAAELLHAGGAGQENGRARGGVPVYVMLPLDTVGPGGQLSRQRAVAASLMELRGAGVEGVMVDVWWGVVEREGPGRYDWEAYAELVRMVERAGLRLQAV

SEQ ID NO: 30625 - DNA, 1444 bp, Panicum virgatum
  misc_feature: Ceres CLONE 1901029
  misc_feature: Encodes the peptide sequence at SEQ ID NO. 30626
ccttttcttctcctctgcttttgcttctgcttcccctctcgtcgcgtcacccaggttgccccccaaaccctcgtcaataaccgtccgccgccatggcgccgccggagcaccccacccccgccgcgccgtcggagcactcgcagcctccgccgccggcggcggcggctaaggggaagggcaagaagaaggatgacgacgatctgtcggaggaggatcaggcgctcaaggagcagctggagctgtacgtcctgcgggcgcaggacgcggatcccggtgtgcagaagctcgccctcgagagcatgaggcaggagattcgttctgccacaagctcaatgacttctattccaaagccgctgaaatttctccgcccgcactatggaaccctcaagtcctactttgagaccatgccagaatctgaattgaagaaatacatggcggacattctgtcggtgttagctttgacaatgtccattgaaggagaaagggagtccctgaaatatcgtttattgggctctgaaggagacatcggttcatggggtcatgaatatgtaagaaatttggctggcgagattgcacaagagttccaaaagcgtcaggatgatgacttgcccattgatgccttaatggagctcgtgcagcaaattatttcatttcacatgaagcataatgctgaacctgaagctgtagatcttctaatggaggttgaagaccttgatttgctagttgagcatgtggacactacaaactacaaaagggcttgcttgtaccttactagttcgtccaaatatcttcctgctcctgatgatatgttggcacttgacatagcatataccatctacatgaagtttggagaccttgcaagcactttgagaattgctctgcaacttgaaaaacccatgcagtatgtgaagcaagtctacacatcaactgatgattttctgctcaagaaacaattctcatacatcatagcacgccatggtttgtctatggagattgatgatgagatagctgctgatgacaatgacaaggagattttgcaagaaatagttaataatactaagctgagtgagggataccttactcttgctcgcgatattgaggtcatggagccaaaatctcctgaggatatatataaggtccatttgattgatggccgtggcgccagctccagtcttgattctgcaagacagaatttggctgcaacatttgtcaatgcatttgtgaatgctgggtttggtcaggacaagttgatgactgctccatctgattcgtccagcagtaggtcttccggaaactggttattcaagaacaaggaacatggaaaagccagcgcagccgctagtctgggaatgattctcctgtgggatactgattctgggcttgctcagcttgacaaatacttgcatagtaatgacactcatgttgttgctggagcattgctagg

SEQ ID NO: 30626 - protein, 450 aa, Panicum virgatum
  misc_feature: Ceres CLONE 1901029
  misc_feature (413)..(446): Pfam Name: PC_rep Pfam Description: Proteasome/cyclosome repeat
MAPPEHPTPAAPSEHSQPPPPAAAAKGKGKKKDDDDLSEEDQALKEQLELYVLRAQDADPGVQKLALESMRQEIRSATSSMTSIPKPLKFLRPHYGTLKSYFETMPESELKKYMADILSVLALTMSIEGERESLKYRLLGSEGDIGSWGHEYVRNLAGEIAQEFQKRQDDDLPIDALMELVQQIISFHMKHNAEPEAVDLLMEVEDLDLLVEHVDTTNYKRACLYLTSSSKYLPAPDDMLALDIAYTIYMKFGDLASTLRIALQLEKPMQYVKQVYTSTDDFLLKKQFSYIIARHGLSMEIDDEIAADDNDKEILQEIVNNTKLSEGYLTLARDIEVMEPKSPEDIYKVHLIDGRGASSSLDSARQNLAATFVNAFVNAGFGQDKLMTAPSDSSSSRSSGNWLFKNKEHGKASAAASLGMILLWDTDSGLAQLDKYLHSNDTHVVAGALL

SEQ ID NO: 30627 - DNA, 701 bp, Panicum virgatum
  misc_feature: Ceres CLONE 1901029-R
cttgatatgaagtctactatcctagggaaatatcactacatcctttacattattgtcctggcaatgcagccgaggatgcttttgacggtggatgaggatctgaagcccctctctgttccagtccgggttgggcaagctgttgatgttgttggtcaggcaggaaggcccaaaacaattacaggctttcagacacattccacacctgtcttgcttgcagctggggagcgtgctgaactagcaactgaaaaatacattccactgacaccggtacttgagggctttgtaattctcaagaaaaacccagaatatcacgaggagtgagacggtatgcctgatagatataatgctgattacgggctcgcctgcactgcaacctcataagccctggtggttacccttgatatggacacccttgttatgcccttccatctcttgctcggcactttttggtggttcatcaaataggctagcttttctcaccagagttgtagctgacttaatcgcatgtttggttgtgtgatggcatactagttggatatgcatgctggggggcgcataggtgttgttttttacttgtaccaccagactatttgtatctatctttgtatcggaattactgaggggcatgcttagaactgactcgatgatacgatggtacacactagcatttttggctttcgactcgcgtgatcaagttagac

SEQ ID NO: 30628 - DNA, 726 bp, Panicum virgatum
  misc_feature: Ceres CLONE 1901042
  misc_feature: Encodes the peptide sequence at SEQ ID NO. 30629
agtcacgctccctcacaatggagctcgctctccccctcctcctcgtccttgcaagcctctcgcttgccaatgccggcggcggcaacacgacaacctacatcgtgttcacggacccggagcggatgccggccgtgcacgcgtccccggcgcgctggcacgcggcgcacctcgagtcactgtccatcgacccggcgcgccacctgctctactcctactccgccgcggcccacggattcgcggcggcgctgctcccggaccaccttaccatgctccgcggcacccccgaggtgctccaggtcgtccccgacgaggtgttccagctccacaccacgcgctccccggagttcttgggcctgttaacgccggcgtaccagccggccatcggcaatctggaggcggccacgcacgacgtcgtcataggcgtcctggacaccggcgtctggccggagtcgtcgagcttcgcgggcggcagcctgccgccaccgcccgcgcggtggaagggggtgtgcgaggccggcgtcgatttcccgccgagcgcctgcgggaggaagttggtgggcgcgcgcagcttctcccgcgggctccgcgcggcgaacggcggcgccataggcgtgaggaagacgacgttcaggtcggcgcgcgacagggacgggcacgggacgcacacggcgagcacagcggcgggcgcggtggtggcgaacgcgagcctgctcgggtacgccacgg

SEQ ID NO: 30629 - protein, 236 aa, Panicum virgatum
  misc_feature: Ceres CLONE 1901042
  misc_feature (25)..(103): Pfam Name: Subtilisin_N Pfam Description: Subtilisin N-terminal Region
  misc_feature: SWISSPROT Homolog: EC 3.4.21.25 Cucumisin
MELALPLLLVLASLSLANAGGGNTTTYIVFTDPERMPAVHASPARWHAAHLESLSIDPARHLLYSYSAAAHGFAAALLPDHLTMLRGTPEVLQVVPDEVFQLHTTRSPEFLGLLTPAYQPAIGNLEAATHDVVIGVLDTGVWPESSSFAGGSLPPPPARWKGVCEAGVDFPPSACGRKLVGARSFSRGLRAANGGAIGVRKTTFRSARDRDGHGTHTASTAAGAVVANASLLGYAT

SEQ ID NO: 30630 - DNA, 642 bp, Panicum virgatum
  misc_feature: Ceres CLONE 1901049
  misc_feature: Encodes the peptide sequence at SEQ ID NO. 30631
aacagcaccagccgaggccagagagagggggaggcgagcacaagaggccaccgcagcgggcaggcggcgagcaagacgcctccacacgtctctcccccttccccttccccttcttccttccccgtccctgtagcggcgcccagaccagccaaaccccgtggaatcctcgcccgatgcggcgcgggtaggcgccggggggcggagcggaatggcggggggaggcgagaagcggcgccgggtgggaggtggggaccacgacgaggaggaggaggaggaggtggaccgcatctcggagctgccggacgcgctgcggctgcagattctgagcctgctgccgctcaaatcggccatccgcaccggcgcgctctcctcgcggtggcggggcctctgggagcagcgctggccggagccatcctcgctgcgcatccgcctcccgcccggcgcggcgggggcggcggcgcgggtggagcagttcggggccatcgaccgccgagggaggcgccggatggactgcttctcgctcgccttccacagcgggcagctcgcgcagccggacctcaggcgctgcctcgactacgcggccgcgtgcgaggtcgaggacctgcacctccgcctcgacggcgccgcggggagggggtcgcg

SEQ ID NO: 30631 - protein, 144 aa, Panicum virgatum
  misc_feature: Ceres CLONE 1901049
  misc_feature (25)..(72): Pfam Name: F-box Pfam Description: F-box domain
MAGGGEKRRRVGGGDHDEEEEEEVDRISELPDALRLQILSLLPLKSAIRTGALSSRWRGLWEQRWPEPSSLRIRLPPGAAGAAARVEQFGAIDRRGRRRMDCFSLAFHSGQLAQPDLRRCLDYAAACEVEDLHLRLDGAAGRGS

SEQ ID NO: 30632 - DNA, 698 bp, Panicum virgatum
  misc_feature: Ceres CLONE 1901051
  misc_feature: Encodes the peptide sequence at SEQ ID NO. 30633
ttctccagctcccaacctgcacgtccccccgtcctcgctccaaaactccaccaagtaccagccgccgccgatcaccgcccgccatggcgccgccccctacctgtggtcccggctcgccgcagcggcggctcttccaggcggcggccgacggcaacctccatctcttcaagaggactgcgagcgcgctggacgccgggaggggccgcctcacggaggcggtcgaggccgtgaggagccgcggtgccagggcgctgcacgtcgccgcgggccacgggaggatgtcggtgtgctcgtacctcgtcgaggagctcctcgtggacgtcaacgcgtccgacgactcaggagatacacctctggcctatgcagttcgtagtggcactttggacactgtgcaatatcttcttgatcatgatgctaatccagataagcctaatggaaaagggtctacccctctccatttagctgctgcaggaggaagttgtgaaatgttgaaagccttactctcaaaaggggccaatgttgattcattttgtgttactgggacaccattgcatatggctgcttactttaaacaggatggtgctatgaagattttgttggaccacaatgcagattgtaacaaggtagttaacacagtctgcactcctcttttcatggcactctctgctggctcacttaaatgtgtgaagcttctgatt

SEQ ID NO: 30633 - protein, 204 aa, Panicum virgatum
  misc_feature: Ceres CLONE 1901051
  misc_feature (86)..(118): Pfam Name: Ank Pfam Description: Ankyrin repeat
  misc_feature (119)..(151): Pfam Name: Ank Pfam Description: Ankyrin repeat
  misc_feature: SWISSPROT Homolog: EC 2.7.11.1 Non-specific serine/threonine protein kinase
MAPPPTCGPGSPQRRLFQAAADGNLHLFKRTASALDAGRGRLTEAVEAVRSRGARALHVAAGHGRMSVCSYLVEELLVDVNASDDSGDTPLAYAVRSGTLDTVQYLLDHDANPDKPNGKGSTPLHLAAAGGSCEMLKALLSKGANVDSFCVTGTPLHMAAYFKQDGAMKILLDHNADCNKVVNTVCTPLFMALSAGSLKCVKLL

SEQ ID NO: 30634 - DNA, 722 bp, Panicum virgatum
  misc_feature: Ceres CLONE 1901064
  misc_feature: Encodes the peptide sequence at SEQ ID NO. 30635
agcttctcgctccgaagcttcaactacccatccagttacctgagcagagcacgaaagcagaggcggagaggtagctacctgacctgagcggagctgacagctgagctgattggtgtggcaatggctgcggcgagtatgatcagggcgccggtcgggcagaatccgaggctcgcggggaggggcggcggcgtggtccggtgctcgttacagggcgcggtggtgggcggccgggcggagtggcagagcagctgcgcggtgctgtccagcaaggtggccgcggtcggcgcgcactccgtcaacggccacgtcgcgccgcccgcgccgccgcagaacggggcggcggtgctggatctgatccccgtgagcagcatcgacagcggcggcggcggcgtcccgacgaagctgccgcagccgctgcgcatcgcggacctgtccccggcgccgatgcacgggtcgcagctgcgcgtggcgtaccagggcgtgccgggcgcgtacagcgagaaggcggccggcaaggcgtacccgggctgcgacgccatcccctgcgaccagttcgaggtggcgttccaggccgtggagctctggatcgccgaccgcgccgtgctccccgtggagaactcgctgggcggcagcatccaccgcaactacgacctgctgctccggcaccggctccacatcggtcggcgaggtgcagctccccgtgcaccactggctgctggggc

SEQ ID NO: 30635 - protein, 200 aa, Panicum virgatum
  misc_feature: Ceres CLONE 1901064
  misc_feature (116)..(200): Pfam Name: PDT Pfam Description: Prephenate dehydratase
  misc_feature: Useful for making plants with altered lignin content
MAAASMIRAPVGQNPRLAGRGGGVVRCSLQGAVVGGRAEWQSSCAVLSSKVAAVGAHSVNGHVAPPAPPQNGAAVLDLIPVSSIDSGGGGVPTKLPQPLRIADLSPAPMHGSQLRVAYQGVPGAYSEKAAGKAYPGCDAIPCDQFEVAFQAVELWIADRAVLPVENSLGGSIHRNYDLLLRHRLHIGRRGAAPRAPLAAG

SEQ ID NO: 30636 - DNA, 2795 bp, Panicum virgatum
  misc_feature: Ceres CLONE 1901075
  misc_feature: Encodes the peptide sequence at SEQ ID NO. 30637
gatcccgtcccgtgcgcctctgacttgcttgcctcggctccttcgtccgtctcgttcgcccggtcctctcactccaagtcgaagactcctctgtcctctcgcttcgcttcgcttccaagcccgccgctcctcccgatggcgacgcaaccgcttacctcaccacggcgccgcccacgcgcctgagcgagaccgccccaccgaccgcgcgcgcgcatggcggcgccggggctggaccaggtcatggcgttcctcaccgaccacggcttcgcgggcgccgcgtccgcgctccgcgacgacgtcctcgagcgcaccgccgccggtgagggcgcccgcgacgcggcattagatccccagctcccgccgctccggatgcccggctccgcctccgcctcaggcggcggcggcggcgctggagctggcgctagcacgccggcgcccgagagccccggctccagctccggctcggcgtcctcgtccgctttcgtcagcatgcgctccacgccctcagggctgttgaacccatatgggctatggtcgccgcggcactcgcagtcggacgcgtcgtcatcggagatggagtttgatactgcgcgccagtacgacaccaccgaccttttcttccaagagggttggctctacgacgaccacctcttccctagcaagctggacgatgaggatgacgaaggcaaagaggaggacaagtttgtactcggggttcacgatggctcagaactgatagaaataggcaagcttggggcaggccacagccaccgtcacgaacacatcggcaatgacagctgtgaggggtgcgctgaggtgtacacatgctcatcgccactctgtggttgctgtggagggggactcaagattgacgggcttgaggtagccaggagctcaagctccaccgtgtacgggagataccagatcatggatgaccagacagaaatactggatgattgtgcccaggatgggtttcagttcaagcagagtggagatgttgtgcctgagtgcgatatgccgagggatcctgggcgaggagatgatgattcagagctgagtgttgtggagaaggagcttcaaatgctcagttcatttgataatgatgctgttgcgaatcatagtgtacatgatttcatggacaatggtgagcttgatgacagcagggaaaaaaatctgaaaagcagtagtgataaagaatatctgaaagaaggtaatagggtacaacctttccctgaaagtggcgatgatgcatatgagtttcaaaatattgggctgttaaattcagatattcaacattcaactgctcttaaagctgaggaagatccagagacaaatattgatcttgctctcgctaattttcaccaagaatatgaggtatttgaattgagaattatccaccgcaagaacaggactggctttgaagaaagcaaagattttcctattgtcttgaattcagttattgctggaagatattatgtcaccgaatatctaggctcagctgcattcagcaaggtcgtgcaagcacatgatcttcagacaggaatggatgtttgccttaaaataattaaaaatgataaggacttcttcgaccaaagcttggatgagataaaactcctgaagttcgtgaacaaatatgatccactagatgagcaccatgttttgcgcctctatgactacttctaccatcaggaacacctctttatcgtcaccgaactattacgagcaaatctttatgagtttcagaaatataatcatgaatctggtggtgaggtgtattttactttgcctaggatacaggttgtagctcggcaatgcttagaggcgttggtttacttgcatcatttgaggatcattcattgtgacctgaagccagagaatattcttatcaaaagctacagcagatgcgaaattaaagtcatcgatctgggaagtagttgctttttgacagacaacttatgcctctatgtccaatcacgctcatatcgagctcctgaagtcattctgggcctaccatatgatcagaggattgatatttggtctcttggttgcatccttgctgaactatacactggtgaggtgttatttcctaacgagcctgtgcccatgatgcttgcacaaatgattgggatagtcggtccaattgacatggaaatgctagaattgggacaggagacacataagtatttcactgatgattacgatctttttaccaagaatgaggagacaaatcagctggagtacttgatcccggagaaatcatccttgcgacgacacttgcaatgtcctgattcagaatttgttgattttttgtcctatttgttgcaaataaatcccaggagaagaccaacagccgatgaagcactacaacatccatggctttcttttgcgtactaacgagaagccgtccgttgcttctactttgggacagctttcttcacacataaggatgagtttgtgtttctcctaatttggagccttgtaaagttcctgaaaagtatcggttttcttggagttccccttaacatgaaacattactctattccttcagctgtagagccctttgtggttacaggattccttcttcttcttcttcttcttcttcttcttcttcttcttctttttgtcttcagggtaattctcggtgtggaacccctgccctgtgagtcctgagtgtatcagtgtatgtaaatatcagaaattttccacggtgtgtatctgtacagttgttgaaagcccactcttgtactccatctgattcgttaatgataacatgagaaaataatgtccaaggtttc

SEQ ID NO: 30637 - protein, 726 aa, Panicum virgatum
  misc_feature: Ceres CLONE 1901075
  misc_feature (420)..(722): Pfam Name: Pkinase Pfam Description: Protein kinase domain
  misc_feature: SWISSPROT Homolog: EC 2.7.12.1 Dual-specificity kinase
MAAPGLDQVMAFLTDHGFAGAASALRDDVLERTAAGEGARDAALDPQLPPLRMPGSASASGGGGGAGAGASTPAPESPGSSSGSASSSAFVSMRSTPSGLLNPYGLWSPRHSQSDASSSEMEFDTARQYDTTDLFFQEGWLYDDHLFPSKLDDEDDEGKEEDKFVLGVHDGSELIEIGKLGAGHSHRHEHIGNDSCEGCAEVYTCSSPLCGCCGGGLKIDGLEVARSSSSTVYGRYQIMDDQTEILDDCAQDGFQFKQSGDVVPECDMPRDPGRGDDDSELSVVEKELQMLSSFDNDAVANHSVHDFMDNGELDDSREKNLKSSSDKEYLKEGNRVQPFPESGDDAYEFQNIGLLNSDIQHSTALKAEEDPETNIDLALANFHQEYEVFELRIIHRKNRTGFEESKDFPIVLNSVIAGRYYVTEYLGSAAFSKVVQAHDLQTGMDVCLKIIKNDKDFFDQSLDEIKLLKFVNKYDPLDEHHVLRLYDYFYHQEHLFIVTELLRANLYEFQKYNHESGGEVYFTLPRIQVVARQCLEALVYLHHLRIIHCDLKPENILIKSYSRCEIKVIDLGSSCFLTDNLCLYVQSRSYRAPEVILGLPYDQRIDIWSLGCILAELYTGEVLFPNEPVPMMLAQMIGIVGPIDMEMLELGQETHKYFTDDYDLFTKNEETNQLEYLIPEKSSLRRHLQCPDSEFVDFLSYLLQINPRRRPTADEALQHPWLSFAY

SEQ ID NO: 30638 - DNA, 702 bp, Panicum virgatum
  misc_feature: Ceres CLONE 1901077
  misc_feature: Encodes the peptide sequence at SEQ ID NO. 30639
agaggacgacgttgaagaaagaaacctctccgtccacacaagttaatactgctaagcgatcgagaagccagttgggttgtgccaggcgatccatagatagagctagcagcaatggcgacctccctcccggccgcgcccctcctcgcccataccactaccagcctccggcatagtggcgccgccgcacgagctcctaatcctcggtccgttgccacggcgaggcccgcgggcgccaggaggagctcgctccgcaccgtcgccgtcaggtacggtgtcgacgaggcgttgcgccccgaggcggaggcggcggcggcggtgccgcgctccgtgccggtgcgcgtcgcctacgagctccatcaggccggccaccggtacctcgacgtcagaaccgaggccgagttcagcgctgggcatcccgaaggagctgtaaatatcccctacatgaacaagaccggctcagggatgaccaaaaacacccactttcttgagcaagtatcgagcatcttcggcaaggatgatgagatcatcgttggatgccaaagtggcaagaggtctctcatggcagcaactgaactctgctctgctggtttcactgctgtgaccgacatcgctggtttcactgctgtgaccgacatcgctggtggattttcttcttggagggataatggattgcctatcacccaatgatccgagcttgccagc

SEQ ID NO: 30639 - protein, 191 aa, Panicum virgatum
  misc_feature: Ceres CLONE 1901077
  misc_feature (73)..(175): Pfam Name: Rhodanese Pfam Description: Rhodanese-like domain
  misc_feature: SWISSPROT Homolog: EC 2.8.1.1 Thiosulfate sulfurtransferase
MATSLPAAPLLAHTTTSLRHSGAAARAPNPRSVATARPAGARRSSLRTVAVRYGVDEALRPEAEAAAAVPRSVPVRVAYELHQAGHRYLDVRTEAEFSAGHPEGAVNIPYMNKTGSGMTKNTHFLEQVSSIFGKDDEIIVGCQSGKRSLMAATELCSAGFTAVTDIAGFTAVTDIAGGFSSWRDNGLPITQ

SEQ ID NO: 30640 - DNA, 2263 bp, Panicum virgatum
  misc_feature: Ceres CLONE 1901084
  misc_feature: Encodes the peptide sequence at SEQ ID NO. 30641
ttctctgcatacacacatacataccgatatacgtatatgcttgttctccggcgcctccgtctcccgctgccacgcccacttcccgtctcctcctcctcctcctcctcctcctggtggtggtcgtcgacaagccaacggagacccgccatggcgtcatcctcttccgccgcggtcgtcgccgagggctcggcggcccgccgcttctggatcgccgcctccacgcgagaggccgccttcgccgcgtacacacccttcctcctctccctcgccgccggcaacctgcgcctcgacgccttccgccattacatcgcgcaggacgcgcacttcctccacgccttcgcgcgcgcctacgagatggccgaggactgcgccgacgacgacgacgaccgggccaccatcgccgccctcaggaaggccatcctccaagagctcagcctccacgcctccgtcctcaaggagtggggtgttgatcctaccaaggagatccctccaagtgcagcaacagccaagtacactgatttcctacttgcaactgcagctggaaaagttgatggtgcaaaaggttctgacaaaatggtcacaccattcgagaagactaaaattgctgcatacactgttggggccatgactccatgcatgaggctttatgcgtatctaggcaaagaactcgtggttttccttaaacaagatgaaaatcacccatacaagaaatggattaacacatatgcatccaatgattttgagggtaatgcactccaaatagaagagttgctggacaaactgagtatctcattaactggtgaggagcttgagattattgccaagctctaccagcaagctatgaaacttgaagtggagttcttttctgctcagcttgtagaccagcctgtcgtagctccacttttaagatattatgatccaaaatataaactcttggtcttttctgattttgatttgacatgcactgttgttgattcgtctgccattttggcggagattgcaattttgtcattccaaaagacaagtcaaagtgggattgataataccctcgaccgtacgaaatcagcagacctgagaaattcgtggaacatgctctctaagcaatacatggaagagtacgaggaatgcatggaaagactacttcctccagaagaattaaagtcactagattatgatcaactgtacaaaggcttggaggtgctagcagagtttgagaagcttgcaaattctagggttgttgactctggtgttcttaggggaatgaatttagaaggtatcaggaaagctggggagcggcttattcttcaagatggctgtaaaaatttctttcagaagattggaaaaacaagggagaacctcaatttggatatccatatcctttcctattgctggtgcgcagaactaatacggtcggccttttcatcagttggttgtctagatggtctgaacatacattccaacgagtttgtctttgaggggtctgtttcaactggtcagattgagaggaaaatgcagtctccactagacaaagttgaaaagtttaagagcatcaaaagtggcatggacagtacagctccatcactatctgtgtatattggagactcagttggagatttgctctgcctattggaggcagatattggtatcgtcgttgggtcaagcacaagcttgcggagagtgggcaaacagtttggtgtttcttttgtgccgttgttccctggtctagtagagaagcagaggcagctgacggagcaagagaaatccaggttcaagtcacgttctggggtcctttatacggtttccagctggtcagagatacacgctttcattctgggaagtgattttagctgatggaggtgctgtttcttttctctgggtgtttttttctcgttgagaagtgagaacttttgccagttgattgatgcacatgatacgtgaatccccaatttggtcattttatgaaagccacatgccaattctggcccgccgcacctgtatgtatgagcgagtaccgatatctgcagcttgtgctttgtaatggctttacccgcgatcaatgttcattgattcgtccatattcagtttgtgattaatttctggagtggttgctgatggcattatacagcagcgacggctccggtatatataacagctagacatcgagtggtgtatgcaacagtatacacccaagtccaagtgtagcagcaaaactgcatgtagaggtgcttgttttcagttggcaataaatggaatggatttattt

SEQ ID NO: 30641 - protein, 567 aa, Panicum virgatum
  misc_feature: Ceres CLONE 1901084
  misc_feature (22)..(245): Pfam Name: TENA_THI-4 Pfam Description: TENA/THI-4/PQQC family
  misc_feature: SWISSPROT Homolog: EC 3.5.99.2 Thiaminase
MASSSSAAVVAEGSAARRFWIAASTREAAFAAYTPFLLSLAAGNLRLDAFRHYIAQDAHFLHAFARAYEMAEDCADDDDDRATIAALRKAILQELSLHASVLKEWGVDPTKEIPPSAATAKYTDFLLATAAGKVDGAKGSDKMVTPFEKTKIAAYTVGAMTPCMRLYAYLGKELVVFLKQDENHPYKKWINTYASNDFEGNALQIEELLDKLSISLTGEELEIIAKLYQQAMKLEVEFFSAQLVDQPVVAPLLRYYDPKYKLLVFSDFDLTCTVVDSSAILAEIAILSFQKTSQSGIDNTLDRTKSADLRNSWNMLSKQYMEEYEECMERLLPPEELKSLDYDQLYKGLEVLAEFEKLANSRVVDSGVLRGMNLEGIRKAGERLILQDGCKNFFQKIGKTRENLNLDIHILSYCWCAELIRSAFSSVGCLDGLNIHSNEFVFEGSVSTGQIERKMQSPLDKVEKFKSIKSGMDSTAPSLSVYIGDSVGDLLCLLEADIGIVVGSSTSLRRVGKQFGVSFVPLFPGLVEKQRQLTEQEKSRFKSRSGVLYTVSSWSEIHAFILGSDFS

SEQ ID NO: 30642 - DNA, 660 bp, Panicum virgatum
  misc_feature: Ceres CLONE 1901085
  misc_feature: Encodes the peptide sequence at SEQ ID NO. 30643
ctcaaagccccaactccctctccttgctcgctcgctcgctctccatggacgctccaggaagctgcacgcctcctgcacgctaagtgatcacagaagctagctgctgccaagatttaccagttttgaccctgaaccaaacaggagctacctgctagctagctcctggtagaagcagcagcggctaacagtgtgcacgagcaggtgtactagctaatagctaagcgagctagctcgttatagctgtgcgcgtagcttgattgattggctagcgcctagcggtagtagcgttaggtagctggtgaatttttttggggggcatggagagcgcgccggtgctggtgaggcacgccggcggcgtggccgtggcggcgctgcggcagctgccgccggggttccggttccgccccacggacgaggagctggtggtgcagtacctccgccgcaaggccctgggcgtgccgctccccgccgccgtcatccccgtcgtccgcgacctctacagcctcgacccctgggacatccctgccgccgctgcagatgcgagcgagggggagaagtacttcttcgcggtccggccggcgggcgtcggcggcagcggatgcagcggcaagctgggcggcggcgccagggcagcgaccgcgagcgggcgttggaagccgt

SEQ ID NO: 30643 - protein, 114 aa, Panicum virgatum
  misc_feature: Ceres CLONE 1901085
  misc_feature (22)..(114): Pfam Name: NAM Pfam Description: No apical meristem (NAM) protein
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: Useful for making plants with altered cell wall content and/or composition
  misc_feature: Useful for making plants with altered lignin content
  misc_feature: The sequence is a functional homolog of SEQ ID NO 2110 in the 10/374,780 US patent application
  misc_feature: The sequence is a functional homolog of SEQ ID NO 304 in the 10/225,066 US patent application
  misc_feature: The sequence is a functional homolog of SEQ ID NO 954 in the 11/435,388 US patent application
  misc_feature: Useful for making plants with modulated oxidative stress sensitivity
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: The sequence is a functional homolog of SEQ ID NO 853 in the 10/374,780 US patent application
MESAPVLVRHAGGVAVAALRQLPPGFRFRPTDEELVVQYLRRKALGVPLPAAVIPVVRDLYSLDPWDIPAAAADASEGEKYFFAVRPAGVGGSGCSGKLGGGARAATASGRWKP

SEQ ID NO: 30644 - DNA, 338 bp, Panicum virgatum
  misc_feature: Ceres CLONE 1901085-R
ggccaagggtcaggagaagttgttcgattcttatcaggtacagtaaaaaaaggtccgaaaggatctgccccagccggcaggagccttccccggggcggagggttagaggaagcttgggggttcgtactctttcgaaaagtgggaaatgaagaataggaagatggtttaggaggtttttggacatcctggcttgcgatgttagagagatgataaagaagtttaagaaacctgatgagtgaaggaggaatgtcttccaagtggcggcgcgcaaatgggcgagtaggacctgtgagtttttggaaggtgaaagtatgggtgggggtcttttcttgccattg

SEQ ID NO: 30645 - DNA, 727 bp, Panicum virgatum
  misc_feature: Ceres CLONE 1901112
  misc_feature: Encodes the peptide sequence at SEQ ID NO. 30646
  misc_feature (654)..(654): n is a, c, t, g, unknown, or other
ctagcccctgttcctcccccccgcacaagcgccaccgccgaatcgaatccgagacgccgatctcggattcgccgccgccgcacccagagtttcctcctcgccgtggccgcgctctcctcctccccgccgctcgtcagccatggcaggactagcaccagagggttcccagtttgatgccaagcagtatgacaacaagatgcaggagctactgactgaagacttctttacctcgtatgatgaggtctgtgaaagttttgataacatggggctccaagagaaccttctgagaggcatctatgcctatggttttgagaagccatcagccattcagcaaaggggaattgttcctttctgcgaggggcttgatgtgattcagcaagctcagtctggaacagggaaaacagcaaccttctgttctggaattttgcagcagcttgattatggattggttgagtgccaggcattggttcttgctccaacccgtgagcttgcgcagcagattgagaaggtcatgcgtgctcttggggactatttgggtgtcaaaatgcatgcctgtgttggtggaacatctgtccgtgaggaccagaggattcttgctagtggagtgcatgttgttgtgggcacaccagggcgtgtgtttgatatgttgcgtangcagtctctacgcccggacaaacattagatgtttgtgttggatgaagctgatgagatgctctctcgtggtttc

SEQ ID NO: 30646 - protein, 180 aa, Panicum virgatum
  misc_feature: Ceres CLONE 1901112
  misc_feature (61)..(180): Pfam Name: DEAD Pfam Description: DEAD/DEAH box helicase
  misc_feature: Useful for making plants with altered alkaloid content
  misc_feature: Useful for making plants with altered lignin content
  misc_feature (172)..(172): Xaa is any aa, unknown, or other
MAGLAPEGSQFDAKQYDNKMQELLTEDFFTSYDEVCESFDNMGLQENLLRGIYAYGFEKPSAIQQRGIVPFCEGLDVIQQAQSGTGKTATFCSGILQQLDYGLVECQALVLAPTRELAQQIEKVMRALGDYLGVKMHACVGGTSVREDQRILASGVHVVVGTPGRVFDMLRXQSLRPDKH

SEQ ID NO: 30647 - DNA, 514 bp, Panicum virgatum
  misc_feature: Ceres CLONE 1901134
  misc_feature: Encodes the peptide sequence at SEQ ID NO. 30648
ggaggcgagcgaccggccgattcgagcagcagccagctagccatggcgacgcaggccgcgctgttcgctgggttctcgcagctcgccgcgcagccggcccgcgaccgcgccgggacgggggcgccggcgcgggttggcgtggcggcgatcgggggcgcccgggcggggggcgtgaaggcgggggccgccgggcccggggggggtgcggggaggagcagttggggctcccgggccagtccgacggcgacagagggacggcggttcgcttaacttcggcacgcccagaagagccgcctgagccctgaggtacccgctcgaccggggcggcgacccacgcgtgcgtggcgctgccggagtgcacgcctctgcacaacacaccggaacaagggcatggtcacgctggcaagctgctgcagtgcgagggtgctgatgcgtatccactccattaccgcgcgacgaccgtggccctggtcgacgctatggacgaggatcaatctatccaagtcctgctgga

SEQ ID NO: 30648 - protein, 75 aa, Panicum virgatum
  misc_feature: Ceres CLONE 1901134
  misc_feature: The sequence is a functional homolog of SEQ ID NO 4 in US patent 7038109
MATQAALFAGFSQLAAQPARDRAGTGAPARVGVAAIGGARAGGVKAGAAGPGGGAGRSSWGSRASPTATEGRRFA

SEQ ID NO: 30649 - DNA, 1317 bp, Panicum virgatum
  misc_feature: Ceres CLONE 1901136
  misc_feature: Encodes the peptide sequence at SEQ ID NO. 30650
aaagtcttcctcctcgccttgcactcctacttcctctgttcctcctcgggtcgccgtcgcgtcacgttacagccgcagggcgcggccccgaggagaagcggggtagcgggaagcggcggcggggagagatgatctcgcagttcttcgtgctgtcgcagcgcggcgaccacatcgtcttccgcgactatcgcggcgaggtgcctaagggcagcgcggagatcttctttcggaaggtgaagttctggaacgacgacgaggcagaggaggcgcccccagtcttcaatgttgatggggttaactatattcacgtcaaggttgcaggactattttttgtagtaactacaatggttaatgtttctccatcccttctcttggaacttctgcaaaggattgcacgtgtcacaaaagattatcttggtgttctgaatgaagattcactgcggaagaattttattttggtgtatgaattgctcgacgaagtcattgactttggatacccacaaacaacctctactgaggttctgaagtcatacatattcaatgaacctatcatggttgatgctggacggctaccaccgcttggtcctgctgctatgttcatgcaaggcacaaagcgtatgcctggtacagctgttacaaaatctgttgttgctaatgagcctggggggatgaagatggaggaaatttttgttgatatgattgagacaataaatgtgacattcagctctagtggctacatacttacatctgagattgatggaacaattcaaatgaaaagttacctcactggaaacccaaaaattcgtcttgctctcgatgaggatttgagcattggaagaaccggatcttcttcctatgattacagaagttcttcttctggaggagcattcattcttgatgattgtaacttccatgagtcattatatctggacagctttgacattgaccgagctttgactttaataccacctgatggagaatttgctgtaatgaactaccggatgacccaagaatttaagccaccattccgtgtaactgcactgattgaagaagctggaccatcaagggctgaagttctactgaacataagagcagacttctctgcaaatgtcacagctaacacgatctcaatacaaatgccagtgccctcctacacaatgagagcaagttttgagttggaagctggaacacttgggcaaacaacagattttacggagggatccatgagacttgagtgcaatctaaagaaaattgttggtggttctgagcacaccctttcgtgccagctgacattatccccggaatctcttggaaata

SEQ ID NO: 30650 - protein, 396 aa, Panicum virgatum
  misc_feature: Ceres CLONE 1901136
  misc_feature (171)..(396): Pfam Name: Adap_comp_sub Pfam Description: Adaptor complexes medium subunit family
MISQFFVLSQRGDHIVFRDYRGEVPKGSAEIFFRKVKFWNDDEAEEAPPVFNVDGVNYIHVKVAGLFFVVTTMVNVSPSLLLELLQRIARVTKDYLGVLNEDSLRKNFILVYELLDEVIDFGYPQTTSTEVLKSYIFNEPIMVDAGRLPPLGPAAMFMQGTKRMPGTAVTKSVVANEPGGMKMEEIFVDMIETINVTFSSSGYILTSEIDGTIQMKSYLTGNPKIRLALDEDLSIGRTGSSSYDYRSSSSGGAFILDDCNFHESLYLDSFDIDRALTLIPPDGEFAVMNYRMTQEFKPPFRVTALIEEAGPSRAEVLLNIRADFSANVTANTISIQMPVPSYTMRASFELEAGTLGQTTDFTEGSMRLECNLKKIVGGSEHTLSCQLTLSPESLGN

SEQ ID NO: 30651 - DNA, 675 bp, Panicum virgatum
  misc_feature: Ceres CLONE 1901145
  misc_feature: Encodes the peptide sequence at SEQ ID NO. 30652
atcagcacccgctagtccaaggagcctgctccaagcaagaagagacgccagggatgagcaggattcgcgggaaaggaaggagcagcaagcaagctgcaagggagagccgtcagctcaagagggtcgtcaagagcaagaagatgggcagcacgcagcagcagcagcagcagctactcctgcagctcttcttattcttcctcctatctgcggtcgccccgcaggtagtcagagcagtgaaaccaatcccaaattccattcttggggtcgaggaaggagacaattccataggaatcatacagaaggacatcatagaggtggtcaacaagcatcccaatgctgggtggacggctgcacacaatccttactttgccaactatactattgcacaatttaaacgtatccttggagtgaagcccacaccaaagagtgtgctgaccgatgttcctgccaaaacttattcaagatcactgaaacttccaaaggagttcgacgccagatctaagtggtctcagtgcagcacaattgggaacattcttgtagatcaaggtcattgtggctcctgttgggcatttggtgccgtggagtgcctccaggatcgtttttgcattcatatgaacatgagcatttcactatcagtcaatgacctactggcatgctgcggttttatgtgcggtg

SEQ ID NO: 30652 - protein, 178 aa, Panicum virgatum
  misc_feature: Ceres CLONE 1901145
  misc_feature (52)..(95): Pfam Name: Propeptide_C1 Pfam Description: Peptidase family C1 propeptide
  misc_feature: SWISSPROT Homolog: EC 3.4.22.1 Cathepsin B
MGSTQQQQQQLLLQLFLFFLLSAVAPQVVRAVKPIPNSILGVEEGDNSIGIIQKDIIEVVNKHPNAGWTAAHNPYFANYTIAQFKRILGVKPTPKSVLTDVPAKTYSRSLKLPKEFDARSKWSQCSTIGNILVDQGHCGSCWAFGAVECLQDRFCIHMNMSISLSVNDLLACCGFMCG

SEQ ID NO: 30653 - DNA, 2011 bp, Panicum virgatum
  misc_feature: Ceres CLONE 1901157
  misc_feature: Encodes the peptide sequence at SEQ ID NO. 30654
aaagtgagtgcggccacgtcgtagggttttgcttttcccggcggtaaagcggggaggcggaggcggaggcgaggcggaggggcgcggcgaccgccgcccggccatggagatcgggcgctaccccgtgagcggctgctccaaggagcaccagaagatctaccaggagtggttcgcgctcgcggactcagatggggatggccgcatcacgggccctgacgccatcaagttcttcggcatgtccaagctctcccgccccgacctcaagcaggtatgggcgatcgcggactccagacggcaggggtacctgggtttccccgaatttgtcgcggcaatgcagctagtctctctggctcaagcagggaatgagatcactcaagatagccttaagcgcgatgatttaggcagtttgaatccacctgtgatggaaggtttggatgctctacttgcgaaatctaagcatatggtgaagcgggtggatccagaattggatggatttcctcaggaacaatcaccttcaaataaatggttcagctcaaagtcatcaaagaagataccgctgactgctgttacttctgtcatcgatggcttgaaaaaattatacatcgaaaagctaaagcctttggaagttacatacaaattcaatgatttcgtttctcctttgctgacgagtagtgattttgatgcaaagccaatggttatgctcttaggtcaatattctactggtaaaacaacttttatcaagcatctgctaagaacaagctatccaggtgcccatattggaccagagccaacaacagacagatttgtcgtagtcatgtcaggaactgatgaaaggactattcctgggaatactattgctgttcaagccgacatgccttttagtggtcttacaacatttgggactgcatttttatccaagtttgagtgctctcagatgcgacatccactgcttgagcatatcacatttgtcgacacacctggtgttctttctggtgaaaagcaacggactcaacgtagctatgatttcactggtgtgacatcatggtttgctgcgaagtgtgatcttattcttcttctgtttgatcctcataagcttgatatcagcgatgagttcaaacgtgtcatcggatctttacgtgggcatgatgataaaatacgtgttgttttaaacaaggcagatcaagtagacactcaacagcttatgagagtttatggtgcattgatgtggtctctcgggaaagtattgaatacacctgaggtttcacgtgtttatattgggtcattcaatgacaaaccagtaaatgaatcagctgttggtccacttggaaaggaactatttgagagagagcaagatgatctcctttctgatctcaaagatatccccaagaaagcatgtgatcgtcgaatcaatgaatttgttaaacgtgctagagctgccaagattcatgcttatataattggccatctaaagaaggagatgcctacaatgatgggcaaagcgaaagcccaacaacgactcatagacaatttgcaggatgagtttgcgaaggtgcaacgggaataccatcttccggcaggggatttcccctacgtggagcacttcaaagaggtcttgagtgggtatagcttcgacaagtttgagaaagtcaaacccaagatgatacaggcagtggatgatatgcttgggtacgacattcctgaacttctcaagaacttcaggaacccatatgagtgaaccggttggaagatgattttggtcttgcactggaacgagagatcagtcaggcaccgatagatgcctcctgtagcgatggaatagtctggctacatgaattattgtggactgtggtcaaggtcctgtggtgtcttctttgccatccacgcctcaccattgttgtacaactgtattcataagaacgggagagcaattgctcaagctttcacggacatctgaccatgtaaaatcaactagtatgtgatttttagtgctatagagccacacttatccttt

SEQ ID NO: 30654 - protein, 543 aa, Panicum virgatum
  misc_feature: Ceres CLONE 1901157
  misc_feature (198)..(358): Pfam Name: Dynamin_N Pfam Description: Dynamin family
MEIGRYPVSGCSKEHQKIYQEWFALADSDGDGRITGPDAIKFFGMSKLSRPDLKQVWAIADSRRQGYLGFPEFVAAMQLVSLAQAGNEITQDSLKRDDLGSLNPPVMEGLDALLAKSKHMVKRVDPELDGFPQEQSPSNKWFSSKSSKKIPLTAVTSVIDGLKKLYIEKLKPLEVTYKFNDFVSPLLTSSDFDAKPMVMLLGQYSTGKTTFIKHLLRTSYPGAHIGPEPTTDRFVVVMSGTDERTIPGNTIAVQADMPFSGLTTFGTAFLSKFECSQMRHPLLEHITFVDTPGVLSGEKQRTQRSYDFTGVTSWFAAKCDLILLLFDPHKLDISDEFKRVIGSLRGHDDKIRVVLNKADQVDTQQLMRVYGALMWSLGKVLNTPEVSRVYIGSFNDKPVNESAVGPLGKELFEREQDDLLSDLKDIPKKACDRRINEFVKRARAAKIHAYIIGHLKKEMPTMMGKAKAQQRLIDNLQDEFAKVQREYHLPAGDFPYVEHFKEVLSGYSFDKFEKVKPKMIQAVDDMLGYDIPELLKNFRNPYE

SEQ ID NO: 30655 - DNA, 2038 bp, Panicum virgatum
  misc_feature: Ceres CLONE 1901172
  misc_feature: Encodes the peptide sequence at SEQ ID NO. 30656
cctcctccccccgccccccaacccaacccgacgctccatctccgtccacctctctctctcctgccggctgccgaacaccatggcatccggagaaggtgacacgtggtcggagatcgtggccagcggcgggctccggccgccccacatcgccgtcgtgtacgggcgccgccaggtcgagcagtcgtccggctggaggaacatggatgtgacgggcagcttcggcggccagcagcggccgagcttcgtgccgaggaagaggaccagctggaaccggtcgctttccatcagaggaagagagagtatttttgttgctcctggtgcaaatcttcaaaaccaacaaaagccctgcagagcacaaaaacgaccacccaaaccgtgcaaccaagtgaagaaaactccaagtggccctccggacttgaggaaggagaagacatattttgaagaagttgatgcatttgagctcatggaagaaagtccttctcccaaggcctcatggaccagaggaatggagcagaatcccatcaatcatgatctgcttgcaatattggagaggtggaaaatttccaatattgcacgacgcgtattatctgagcccatgtttgtcaccatggacttggagacgccgatcataaagagtagtacaaaagaaaccaacattatttcatcattcgataagctgaacattaaggaggaggctgttgaaaccagcattccatggagtggtgaagctctgactgcttttgagcagctcctcatggtttgcagacagtctgaaccagtcacactcgcagaagttttctccgcttactgcgagctagaaagcattaagaagttaggtgaaggaacatacggagaggcctacagggctggaatgactgtttgcaaagttgttccttttgacggagacttgatagtcaatggagaaacccagaagaggtcagaagaaatacttgaggaagtgttgctttctctaacgcttaataatctaagatcaaaccggggtgatgagaaaaaggattcgtgcaattgcttcattgaaacaaaagactttcgggtttgtcgtggaccatatgacccttgtctgattagtgcttgggaagactatgatgccaaatgtggatcagaaaatgatcatcctaaggactttacaagtgagcagtcttacatcgtatttgtgctagctgatggtggtactgatctagaaagctttgctctggttgattacaatgaggctcgcagtttactagttcaggttactgcttccttagcagtagctgaaagtgcttgtgaatttgaacatagagatttgcactggggtaacattcttttggctcaagatgaaaattcagacacaaatcatacaatgagctttgctcttcaagggaagaggatgcttgcaagaacttttggtctgaatgtctccataattgacttcactctttcacggatgaacacagggactgccattctctttctggacctgtctgcggatcctgcattatttcaagggaaaagaggagataagcaggcagaaacatatcgaaggatgagagatattacccaggaacactgggagggcagcttcccaaagatcaacgtggtgtggttaatttaccttgtagatatggtgctgcataagacgaaatcacttgcgcttggtgccaaagtggaccgggagcttcgctcgctcaaaaaacgtctggcatcgtgcgagtccgctagggattgtctcgccgatcccttcttcagtgatctactattggaggacgcgcagctctttccaatgcagcagctggagtcggatctgtgaactggcagatagaatctctgtgggggttcaggattttagggtttaaacttttcgccatgtgcaaccactaattcacctgacgtgcgtgtgatccagaagaacagaacggatcgaacgcaggttcgtcagcccctggcatgcaagagagcttgcagttggctgttgcccaggcgctttttgtaacttgagtgtgcataatttatcacgttggcggtcctgaccgtggcc

SEQ ID NO: 30656 - protein, 576 aa, Panicum virgatum
  misc_feature: Ceres CLONE 1901172
  misc_feature: SWISSPROT Homolog: EC 2.7.11.1 Non-specific serine/threonine protein kinase
MASGEGDTWSEIVASGGLRPPHIAVVYGRRQVEQSSGWRNMDVTGSFGGQQRPSFVPRKRTSWNRSLSIRGRESIFVAPGANLQNQQKPCRAQKRPPKPCNQVKKTPSGPPDLRKEKTYFEEVDAFELMEESPSPKASWTRGMEQNPINHDLLAILERWKISNIARRVLSEPMFVTMDLETPIIKSSTKETNIISSFDKLNIKEEAVETSIPWSGEALTAFEQLLMVCRQSEPVTLAEVFSAYCELESIKKLGEGTYGEAYRAGMTVCKVVPFDGDLIVNGETQKRSEEILEEVLLSLTLNNLRSNRGDEKKDSCNCFIETKDFRVCRGPYDPCLISAWEDYDAKCGSENDHPKDFTSEQSYIVFVLADGGTDLESFALVDYNEARSLLVQVTASLAVAESACEFEHRDLHWGNILLAQDENSDTNHTMSFALQGKRMLARTFGLNVSIIDFTLSRMNTGTAILFLDLSADPALFQGKRGDKQAETYRRMRDITQEHWEGSFPKINVVWLIYLVDMVLHKTKSLALGAKVDRELRSLKKRLASCESARDCLADPFFSDLLLEDAQLFPMQQLESDL

SEQ ID NO: 30657 - DNA, 625 bp, Panicum virgatum
  misc_feature: Ceres CLONE 1901191
  misc_feature: Encodes the peptide sequence at SEQ ID NO. 30658
tctggcgcttccgagctctcttcgttccggcgcttcctcctacctcgccatagcaaataaccaacaagccatgggttcctctggggccggcatccgcctccgccgtcgcgtcagcctgctcctcctgctcctggtcgtcggcggcacgacggcgcgtgccagggaggcgcagccgctgcccgaggcggcggccgccggcaccaggcgcgcgccggagcggcacgggctgtcgctcgacttctacgccaagacgtgccccgcggtcgaccagatcgtcgccaacgtcaccgccgcccgctacagggacttccccgccgccgggcccgccgtgctccgcctctttcaccacgactgcttcgtcgagggctgcgacgcgtccatcctgatcgccccgaccccgacggccagcgcctcgtccaaggtggagcgcgacatggaggagaacaagaacctggcgcaggaggcgttcgacacggtggagctggccaaggccgccgtcgagagcaggtgcccccgcgtcgtctcctgcgccgacgtcctcgccctcgccgcccgggactacgtccagcaggccggtgggccgttctacgccgtgaagaagggccggaaggacagcaaggtgtcc

SEQ ID NO: 30658 - protein, 184 aa, Panicum virgatum
  misc_feature: Ceres CLONE 1901191
  misc_feature (69)..(184): Pfam Name: peroxidase Pfam Description: Peroxidase
  misc_feature: SWISSPROT Homolog: EC 1.11.1.7 Peroxidase
  misc_feature: Useful for making plants with altered carbohydrate content
  misc_feature: Useful for making plants with altered cell wall content and/or composition
MGSSGAGIRLRRRVSLLLLLLVVGGTTARAREAQPLPEAAAAGTRRAPERHGLSLDFYAKTCPAVDQIVANVTAARYRDFPAAGPAVLRLFHHDCFVEGCDASILIAPTPTASASSKVERDMEENKNLAQEAFDTVELAKAAVESRCPRVVSCADVLALAARDYVQQAGGPFYAVKKGRKDSKV

SEQ ID NO: 30659 - DNA, 302 bp, Panicum virgatum
  misc_feature: Ceres CLONE 1901193
  misc_feature: Encodes the peptide sequence at SEQ ID NO. 30660
cccgtgctctctcttaggtgggttggcttctccccctcttacgggtcctcttgttctagggttttaattagaaggggagatggcggcagcggatgtggaataccgctgcttcgtcggcggcctcgcctgggccaccgacagctcgtccctcctacaggccttcgcctcctacggcaacgtcctctactcccagggcttcaccaaccgtgatacggggaggtcccgcgggttcggcttcttcaccttctcttccgatctttcaatgctcgactccatcgaacccatgaacggcaaggacctcc

SEQ ID NO: 30660 - protein, 74 aa, Panicum virgatum
  misc_feature: Ceres CLONE 1901193
  misc_feature (10)..(74): Pfam Name: RRM_1 Pfam Description: RNA recognition motif. (a.k.a. RRM, RBD, or RNP domain)
  misc_feature: Useful for making plants with altered lignin content
  misc_feature: Useful for making plants with modulated nitrogen use efficiency
  misc_feature: Useful for making plants with modulated flowering time
  misc_feature: Useful for making plants with altered alkaloid content
  misc_feature: Useful for making plants with modulated biomass
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
MAAADVEYRCFVGGLAWATDSSSLLQAFASYGNVLYSQGFTNRDTGRSRGFGFFTFSSDLSMLDSIEPMNGKDL

SEQ ID NO: 30661 - DNA, 562 bp, Panicum virgatum
  misc_feature: Ceres CLONE 1901222-R
  misc_feature: Encodes the peptide sequence at SEQ ID NO. 30662
aaatggaaaaggtcaggtcttttcaaagatgcgcaaccatacagttacaaacaaaatgacgggtgtagggaacacactaaagaggcactacgagacatatttgctggaatacgaacttgcacatgatgatgttgatggggagtgttgcttgatttgccacagcagtgctctgggcgactgggtgaattgtgggttatgtagagaatgggcccactttggctgtgacagacggcaagggctgggcactttcaaggactatgcgaagacagatgggttggaatatatttgcccccagtgtagcctcgcgaaaagcaaaaagccaccgctgcccgttagagtaggcaatggcttagccgcctctggattacgaactgtaaattaacttacgttatttttcttttcccttcgccttttgtcccactttttggggggtgattgtttgggtagataatattggccaggcatatgttttttttttttgaggagatggcatgtgtagtgttgttgatctgtgctatcatttaacccgtaggttccaaattaagttatatatatagattgc

SEQ ID NO: 30662 - protein, 126 aa, Panicum virgatum
  misc_feature: Ceres CLONE 1901222-R
  misc_feature (48)..(102): Pfam Name: PHD Pfam Description: PHD-finger
  misc_feature: SWISSPROT Homolog: EC 2.1.1.43 Histone-lysine N-methyltransferase
NGKGQVFSKMRNHTVTNKMTGVGNTLKRHYETYLLEYELAHDDVDGECCLICHSSALGDWVNCGLCREWAHFGCDRRQGLGTFKDYAKTDGLEYICPQCSLAKSKKPPLPVRVGNGLAASGLRTVN

SEQ ID NO: 30663 - DNA, 2778 bp, Panicum virgatum
  misc_feature: Ceres CLONE 1901222
ctaattctcctcatcgtcaaaatgccgtccttcagctgagagctcgcccctggctagagaaagggtgctaattctcctcatccctgcgggtgcgcctccctccggttggagcaacggttgatatggatccagtacatgctcgatgaaatgcctccaaagcaaactgctaagtggataaactttcggcctagacatcctcggccctggaacaacagaacaagattacaacttcctgggccatgtcttattcgcgctcgatgaaacggtggcagcagcatcgatcagaagccgcgtgaggaggagaatccgcgcccacacgcgccgccacctgcgaggccgattctcccaatccgagcggttcagttttggcatgagctgaggtccaggagcttgttattccttcggccatgtctcaaatccagagcacctcacgctgcgtgctccttgctgttcgatgtgggcggttcgccgaggagcagcagaccccggctcacctggcacctgagccgaagcgggtgcgtccatcctaccccttcccggagctcgtctcctgtgggagattagagagaggcgcagcaggcggtgcaacctaacttgttgtatcttcaggggcagcagctagagaacgcggagataggttcactcgtctggggtgatactgatttatctgacccgcagacatttagctcactcatcagcccaccatttccgaccatagtttatttggaagttcccgtaggggaaaagtttgcccagtcacttcattcaaaggggataccatatgtaatatattggaggaattcatttccatgttatgcagcatctcatttttgccaggcattaatgtcagttattcaaagttcctgcagccatacatgggatgcatttcaacttgcgcatgcctcgtttcgactatattgtgtaagaaataactatgtacaaagtgttaagcttggccctcgcctacttggggatgctccaaaaataaatatcatccctgctgagaatgatgtggatgaggaagaaggttgttctgaagcttttctggctataaaaatatatgatgaagatgtgaacatgaaatttcttgtctgtggagtgccatgcaccttggatgccaggatgcatgtttgttgggcgcactggaggatggtttgaatgctctgttgaatattgaggtaccgccccattttctagtaatcaagattaggttccagaaacgtattgagttttgaatagaagtaatctttacttggaagtgctatactgctgggaggaggtgatgttaacttttattttttccttatagctttaggaactataggaatagcagctgtcattttaagcagctatgcctatgtgcaagtcagtgctaagcacactaatttatatgcagcatgtactcatatgtacattagtaaatgtcatttagtgcggacggaagagagaaaacagtataggggatctgcttttgcttcgtataggtttgcatttacctcttttcccaacttaagataagaaactaaacaatatgctaactaaaatgggcaatgcaatgtcttttggcagttgagcccatgcaaggcagccttgattaaaaatgaattgctcacttgacaaatggggcgaccgccagctagctgcttgccactctttagggcattggttggctataagtttcattcaattatcttgcatttcaattgtgaatcccagtactatatggtgtatatcaaagaatgcatatttgaagtaatcactagtgttcaagttcaactcatgattaggttttgttaagcgacaaaacattgttttgatctgttaaatagaggtgtcttgagaggctgttctattgaatcaatatccttagaactctttagcattgtatttgagttttagcatatttgctagaacctgattgatggctgagctttttttatttgtctcagattcgtgggagtaaacttcagaaccgagtcaggtatcttgaacccccagtgtgagcaacatatctcataacttctggcacatcaaacattttataatttgggcatgggtcacgtttacaatgtatgcttggccttttgctcttgtgatatattataattttcttgatctcagaatgcctgtttgcattgtattctttgctcttgcttcagtaatcatgttgataattttgatctaagcatgttttgaagctcaaatttgatggcgcataaaattaactaatactccctctgttccaaaatacagattgttttggcatttttaggttcataatttttgctatgtacctagacatgttatatctaggtgcatagcaaagactatgaatttagaaaagccaaaacgacctacatattggaacggagggagtatatcataatttttcttgactatgaagtgtcaaccaaacagaaactgaagttaactacatttgaaaggaaactggtggcgactggcaaagatttgtgttttcattgattatctggtatataggcttgaagctatattcttaccaagtccactaatgatagtctatatgcttctgttttctctagactgttgttctttgttgtgaatatcagtgcttgtggtcttaataaaatagaaataagaatattattgttcgtgagaaatgtttatttttgttcagagcagaagctcacagcatttctctttccagtgctgctgctccacccctacaagctgaaactctttcacatggggttgtttccatgcgctgtgacatcacaacatgcagttcttcacatgtgt

SEQ ID NO: 30664 - DNA, 720 bp, Panicum virgatum
  misc_feature: Ceres CLONE 1901228
  misc_feature: Encodes the peptide sequence at SEQ ID NO. 30665
actccaatcgtcgcgggcggcgctagggttgggagcacctccatcgcggccgtcggcgtcgccacgagccgccgccgctcgcctcgccgtcccctccccccaccgcacccgtctccggcccgctgcccactcgcgctcaccctcgcccagtcgcggtcgcgcctcccctctccgaccgtgactcccctccccaacagccgccgcgcctgccctcccccacagccgaccgcggctcccctccccgacagcagccccgcttgattctcccggccgccacgatgtcgtcggagactccgcccaccaccgccgcggcggatgaactcgcggctgacctctccgccgccaccctcagcaagaagcagcagaagaaggacgccaggaaggcggagaaggccgagaaggcggcgcagcgccagcagcagcagcagccggcggacgccgaggaccccttcgcgaccaactacggcgatgtccccgtcgaggagatccagtccaaggccatctccggccgctcgtggactaagatcggcgacctcgacgccgacgccgcgggccgctccgtgcttatccgcggggccacgcaggctatccgtccggtcagcaagaagatggccttcgtcgtgctgcgccagagcatgagcaccgtgcagtgcgtgctcgtcgccagcgccgacgccggcgtcagcactcagatggtgcgcttcgccacgccctcagcag

SEQ ID NO: 30665 - protein, 147 aa, Panicum virgatum
  misc_feature: Ceres CLONE 1901228
  misc_feature: SWISSPROT Homolog: EC 6.1.1.12 Aspartate--tRNA ligase
MSSETPPTTAAADELAADLSAATLSKKQQKKDARKAEKAEKAAQRQQQQQPADAEDPFATNYGDVPVEEIQSKAISGRSWTKIGDLDADAAGRSVLIRGATQAIRPVSKKMAFVVLRQSMSTVQCVLVASADAGVSTQMVRFATPSA

SEQ ID NO: 30666 - DNA, 3016 bp, Panicum virgatum
  misc_feature: Ceres CLONE 1901242
  misc_feature: Encodes the peptide sequence at SEQ ID NO. 30667
tcacctccgctccgcgtcgccagacgagacccagcgagcaagcgagagatccccccaaccccaccaccaccgcctccgcccgggatctcctccctcaccgccgtcgccgccgcgaggccaggccagggttgatggataacgtctccccgagcactctgctcagtagtatctcccgtcttggtgtcttaacatctgatggctctaccttgagacccaagcccattcagaagtactgccaaaatgtatatgatatctcgagcattgtgaacccccttcttgaagatctctgcaagactccagaagagcaactcaatgaggtcctaagagatcttgacactgctatcaatgaagcttcaggccttattggaaactggcaccagacaaccagcaaaatatattttggttggcaaattgaatcggtaatatcagatattcagggatgttcccttcagctgtgccagctggctaattctctattgccttctctgactggccgtgcctgcacatgtattgagaaactccaagacataaattatgagcatatgttcgatctagttaaagaggctgccaaggaacttgctgagacaagcgctgtgagtgctgataatctgttgaaactgtcaagttcattgagcctgtcaacaaacatggaattgtacatggaagctatttcccttgagaatctcagaacaagggcactaagaagtgagaatcgtgaagaactggatctagctgagcagatgattccactggtcaaccatatgcatgatcgccttctcagggaaaaacaacagcttagcatcaacggggttcctattcctgctgatttttgctgtccgctgtccttggaactgatgtctgatccagttattgtagcatctggccagacgtatgagcgggtttatatcaagttgtggcttgatgaaggttttactatctgtccaaaaacacgccaaagacttggtcactccaatttaatacctaattatactgtgaaggctttgatagctaactggtgtgaatctcatgacattaggctacctgatcctatgaaatccctgaagttaaactttccttcagctgcctcctccctccaggatttgggtgctgcgggtggcagtcctctatatcctagtgtcatctcaagggctaatattcctgggtccccagaagctgatgcgtatatgagaaacttgaatggagcatctcctccccacagtgtgcccaatcagagccctcatgtgcatgccagccgttctggccatgagatctcgacaagtcaaacttctgaaaatgcaaatggttctgcacctgatgtatcaaggttatcacttgcaagttctgaagcaagagagtctagtttggaaggaagacgtggtggttcgattggacaaacttcagagcagtcgacagaggaagcatttcaatcttctaatttggatatgcaggacaacatggccagttcttcattgaatggcagtcttccaaatagtggtcaacttgatggggaatgtgacaatggggtgacgggggttccaagtgataggacaaactacagtagcgatgcatctggagaggttacagatggtggtggtgcgcctgtggcatcttctgttcctcaaagggaacatttaatcccaagactggccactagaggccaatttatcagacggcaagcatccgataggggtttcgctagaattatatcttcctcatcgatggatgcacggagtgatctctctgccattgagaatcaggttcggaagctgattgaggatttgagaagtgattctgcagatgttcagaggtcagcagcatcagagcttcgtcttctagctaagcacaacatggagaataggattgtcattgcaaactgtggggctgtaaatctactggttggtcttcttcactcaccagatgctaaaacccaagagcatgccgtgacagctcttctgaatctgtcgataaatgacaacaataaaattgctattgcaaatgctgatgctgttgatcctctcattcacgtccttgagactgggaaccctgaagctaaagagaattcagcagccactttattcagtctctcggttattgaagaaaataaagtgaggattgggcgatctggtgcgatcaagcctctagtagacttgctaggaaatggcacccctcgaggaaagaaagatgcagctactgcattgtttaacttgtctatacttcatgaaaacaaaggtcgtattgtgcaagcagatgctgtgagacacctggttgagcttatggatcctgctgctggaatggtcgacaaagctgtggctgtgttggcaaaccttgctacgataccagaagggaggactgcgattgggcaggcacgtggcattccagcccttgttgaagttgttgagttgggttctgcaagagggaaggagaatgctgctgccgcgttgcttcagctctgtacaaacagcaacagattttgcagtatagttcttcaagagggtgcagtgcctcctctagtcgccctttcacagtcaggaacacctcgagcgagagagaaggcacaagctcttctcagctacttccgcagccaaagacatgggaattcagcgaggagatagccttaacaatttttgttgtagtgtacattaagctgtgccttttatgcccctcatcgcgactgggctcctgttgtttcattagcactgccggatgcgtgggctggaattattgcattgcagtgctctgtgctcaaactgttcatagattgagattgttgtaagctcatctcatgtaagtgttgtgggcggtgagtgttgtctgttgagatggtgtctttttggtttcttttcttctcttctttttttgaggatttttttttttgtatagcttatccattggtagcaacttacctattcaccgagatcgagattttgtcctgtatatgctattagctgtggcgttatgattgatggatgtacaagttatagttgttctgtaccaaataagccttgttcgcacacct

SEQ ID NO: 30667 - protein, 826 aa, Panicum virgatum
  misc_feature: Ceres CLONE 1901242
  misc_feature (572)..(612): Pfam Name: Arm Pfam Description: Armadillo/beta-catenin-like repeat
  misc_feature (654)..(694): Pfam Name: Arm Pfam Description: Armadillo/beta-catenin-like repeat
  misc_feature (613)..(653): Pfam Name: Arm Pfam Description: Armadillo/beta-catenin-like repeat
  misc_feature (228)..(302): Pfam Name: U-box Pfam Description: U-box domain
MDNVSPSTLLSSISRLGVLTSDGSTLRPKPIQKYCQNVYDISSIVNPLLEDLCKTPEEQLNEVLRDLDTAINEASGLIGNWHQTTSKIYFGWQIESVISDIQGCSLQLCQLANSLLPSLTGRACTCIEKLQDINYEHMFDLVKEAAKELAETSAVSADNLLKLSSSLSLSTNMELYMEAISLENLRTRALRSENREELDLAEQMIPLVNHMHDRLLREKQQLSINGVPIPADFCCPLSLELMSDPVIVASGQTYERVYIKLWLDEGFTICPKTRQRLGHSNLIPNYTVKALIANWCESHDIRLPDPMKSLKLNFPSAASSLQDLGAAGGSPLYPSVISRANIPGSPEADAYMRNLNGASPPHSVPNQSPHVHASRSGHEISTSQTSENANGSAPDVSRLSLASSEARESSLEGRRGGSIGQTSEQSTEEAFQSSNLDMQDNMASSSLNGSLPNSGQLDGECDNGVTGVPSDRTNYSSDASGEVTDGGGAPVASSVPQREHLIPRLATRGQFIRRQASDRGFARIISSSSMDARSDLSAIENQVRKLIEDLRSDSADVQRSAASELRLLAKHNMENRIVIANCGAVNLLVGLLHSPDAKTQEHAVTALLNLSINDNNKIAIANADAVDPLIHVLETGNPEAKENSAATLFSLSVIEENKVRIGRSGAIKPLVDLLGNGTPRGKKDAATALFNLSILHENKGRIVQADAVRHLVELMDPAAGMVDKAVAVLANLATIPEGRTAIGQARGIPALVEVVELGSARGKENAAAALLQLCTNSNRFCSIVLQEGAVPPLVALSQSGTPRAREKAQALLSYFRSQRHGNSARR

SEQ ID NO: 30668 - DNA, 1858 bp, Panicum virgatum
  misc_feature: Ceres CLONE 1901249
  misc_feature: Encodes the peptide sequence at SEQ ID NO. 30669
aaattcgtttctgtccccatcaccccgcctccgccatcctctatgcccgccggcgcatggccggccgcagccgcagccaccttcgctccgctctccgccgcggtgcgcgcggcgatgcgcacgctcggcggcgtcctcccccgcgcccaccgcccgcactcaaccaccgccaccaccacgacggcctcagacgcctcctcctccccgtcgtcgcacaccctccacgactacaaccgcatcctggccgcgttcgcgcgggacggcgacggcgacgcggctctccgcgtgctccgccgcatgcgcctctcctcccccgcctgcgcgcccaccgccgtctcctacacctccgccatgtccgcgctcgccaaggccgggcgccccgccgacgccgcgtccctcttcgacgacatgctcgccaacggcgtcgcccccgaccgggccgccttctccctcctcctacacgtctactcctcccacctccacctccccgcagccgcgcactctgtcctcctgtggatgtccagcctcggcctcccgctgacccccatcgactacaccgacctcatattctccttctgccgcgccggccgcctggccgacgccctccagctgctcgacgaaatgcgtgccctcaattacccactcacaccacatacatacgcgccgatcctcaaggcattctgcgataatgctgacatccaaggggcagacgcaatcatcaactccatgcgttgctctggatgcctccctgatgttgtcatttacaacatctacatccaggggctatgtaagatggggcattttgatgctgtagagctggttattgatcagagtggacggtacgggtgggtgccagatgcagtcacatacagcacatacattgctgggctttgccggtttggatacatcaaggaagcatttcagcagctggaaattatggtagcaaaggggctacagctgacagtagttggcctgaatatactgttggaccacgtcgcacaggatcttgatatgtgggcaggcaaggaggtgctggagaggtgccaagagcttggctttgtggttgatgttgtgacatacaatacagtcatggatcatttctccaagaaagggaagtggctgcgtgtcctaaagctgttcacagatctgctcaagaaacccataactcccaatgtgcagacatacaacattttgatttcatgtctgtgccgagctggcaagtttcagtttgccaaatttgtgttcagcagcaaggggtttgtggcggacactgttacttgtaatattctcatccatgagttctatgaggccggaaaggaggatgagcttgtgtttttgtttgctgatatggaggcagggaagattgccccagataccatcacatataatacactggtcgattgtctcttcaggtccgggaggaggtcggaggctgtcaattttgtcaggcatatcgatgatggctaccctacggagcctgttgctcatttaacatattggttggttaggagtggaaatacacgtgaggcgttgaaactgtttgatgatatccaaataaaaggattggttttagatagtaggatttttgctaatgtgatcaaggctttctgcagaaagggtccaaccgaatgttcagatatgtcacagttgtgctctgtattggataggatgcttgcaattggatgatctttctgtagcatgggtttataacttgaagtgcttcgattctgcttattcttttcaatactttacatggaagagatctcttttttttttttaatttgtatggttgtaccagtagataatactcatctaatgtaaaatgcacctctggtttcttcatgtagttctttgtcag

SEQ ID NO: 30669 - protein, 547 aa, Panicum virgatum
  misc_feature: Ceres CLONE 1901249
  misc_feature (98)..(132): Pfam Name: PPR Pfam Description: PPR repeat
  misc_feature (344)..(378): Pfam Name: PPR Pfam Description: PPR repeat
  misc_feature (274)..(308): Pfam Name: PPR Pfam Description: PPR repeat
  misc_feature (169)..(203): Pfam Name: PPR Pfam Description: PPR repeat
  misc_feature (411)..(445): Pfam Name: PPR Pfam Description: PPR repeat
MPAGAWPAAAAATFAPLSAAVRAAMRTLGGVLPRAHRPHSTTATTTTASDASSSPSSHTLHDYNRILAAFARDGDGDAALRVLRRMRLSSPACAPTAVSYTSAMSALAKAGRPADAASLFDDMLANGVAPDRAAFSLLLHVYSSHLHLPAAAHSVLLWMSSLGLPLTPIDYTDLIFSFCRAGRLADALQLLDEMRALNYPLTPHTYAPILKAFCDNADIQGADAIINSMRCSGCLPDVVIYNIYIQGLCKMGHFDAVELVIDQSGRYGWVPDAVTYSTYIAGLCRFGYIKEAFQQLEIMVAKGLQLTVVGLNILLDHVAQDLDMWAGKEVLERCQELGFVVDVVTYNTVMDHFSKKGKWLRVLKLFTDLLKKPITPNVQTYNILISCLCRAGKFQFAKFVFSSKGFVADTVTCNILIHEFYEAGKEDELVFLFADMEAGKIAPDTITYNTLVDCLFRSGRRSEAVNFVRHIDDGYPTEPVAHLTYWLVRSGNTREALKLFDDIQIKGLVLDSRIFANVIKAFCRKGPTECSDMSQLCSVLDRMLAIG

SEQ ID NO: 30670 - DNA, 1677 bp, Panicum virgatum
  misc_feature: Ceres CLONE 1901262
  misc_feature: Encodes the peptide sequence at SEQ ID NO. 30671
accatccccattccccaaccccaagcgaaccaccccgcagccgcagccgcagctgccccccaccggcctcggactcagcggcgagcgcggcgatctccgcttcccaccccgacgcatggacgcgccgccggggccggaacccatggcgctggacgcgccccctgccgccaccgccgccgaggacgcagcggcggcggttccccccgccggcggcgagaagaagaaggaaggcgaagagggggagagggtcccgggccacattatctccaccaccatcggtgggaagaacggcgaaccgaagaggactataagttatatggcggagcgtgtcgtgggtacaagttcatttgggattgtcttccaggctaagtgtctggagactggggagacctttgccatcaagaaggtgttgcaagatagacgttacaagaaccgggagctgcaactgatgcgcgccatggaacaccccaatgtcatctgtctgaagcactgcttcttctcgacaacccccagggatgagctgtttttgaaccttgtcatggaatatgttccggagacgctgtatcgtgtcctgaagcactacagcaatgcgaaccagagaatgcctcttatctatgtcaagctctacatgtatcagctttttagagggctagcttatattcatactgtgccaggagtctgccacagggatgtaaagccacaaaatgtcctggttgaccctctcactcaccaagtcaaactgtgtgactttggaagcgctaaagtcctgattcctggtgaaccaaatatatcttacatttgctctcgttattatcgtgctcctgagctcatatttggagcaactgagtatacaacttccatagacatatggtcagctgggtgtgttcttgcggagttacttcttggtcagccactgtttccaggagagagtgcggttgaccagctagtggagataatcaaggttcttggtactccaactcgtgaggagataagatgcatgaaccccaattatactgagttcaggtttcctcagataaaagctcatccatggcacaagattttccacaagagaatgcctccggaagctatagaccttgcttctcgtctcctccaatactcaccaagtcttcgctgctctgctcttgatgcatgtgcacatcccttcttcgatgagctacgggcgccgaatgcacgcctgccaaatggccgtccattccctctgctcttcaacttcaagcatgaactagcaaatgcctctccggatctcatcaacaggctcatacccgaacatatcagacggcaacatggcgtcaatttcgggcacaccggaagctaggagggcaggcactgcgattttcaactttttggtcttggttccccatgagcttgggccgatgcaagcataggcgacatggtaccatcaggagagatcaacccagcagttcctgagagaagtaaaactatgtaaattatcttgaccgtaaagaactaccgccagtgttaagccggtaactggcacatgttggtccagtagttaaggtaagattgtaggtggtgactggttaatgcctagggctgttttttgttattatgttcgtcggtacttctcagcagtagtgtagctgctcctgttttgttcgtccgccatgatgtaaatgatcatctccttgcaatgcc

SEQ ID NO: 30671 - protein, 406 aa, Panicum virgatum
  misc_feature: Ceres CLONE 1901262
  misc_feature (67)..(351): Pfam Name: Pkinase Pfam Description: Protein kinase domain
  misc_feature: SWISSPROT Homolog: EC 2.7.11.1 Non-specific serine/threonine protein kinase
  misc_feature: Useful for making plants with modulated biomass
  misc_feature: Useful for making plants with modulated water use efficiency
MDAPPGPEPMALDAPPAATAAEDAAAAVPPAGGEKKKEGEEGERVPGHIISTTIGGKNGEPKRTISYMAERVVGTSSFGIVFQAKCLETGETFAIKKVLQDRRYKNRELQLMRAMEHPNVICLKHCFFSTTPRDELFLNLVMEYVPETLYRVLKHYSNANQRMPLIYVKLYMYQLFRGLAYIHTVPGVCHRDVKPQNVLVDPLTHQVKLCDFGSAKVLIPGEPNISYICSRYYRAPELIFGATEYTTSIDIWSAGCVLAELLLGQPLFPGESAVDQLVEIIKVLGTPTREEIRCMNPNYTEFRFPQIKAHPWHKIFHKRMPPEAIDLASRLLQYSPSLRCSALDACAHPFFDELRAPNARLPNGRPFPLLFNFKHELANASPDLINRLIPEHIRRQHGVNFGHTGS

SEQ ID NO: 30672 - DNA, 741 bp, Panicum virgatum
  misc_feature: Ceres CLONE 1901273
  misc_feature: Encodes the peptide sequence at SEQ ID NO. 30673
gactctgggtaagcaaggtcagctagctataggacgaagctgcagctagcgcggcagatcagatcgatcgagatggcggctgccttctcctccaccgtcggagctccggcctccaccccggccagcttcctcgggagcaagctcagcaggaagcagcaggcgaccgccgccgtgaactaccatggcaagagctccggcgccaaccggttcagggtcatggccaaggagatcgacgagtcaaagcagaccgacaccgacaggtggaagggcctggcctacgacatctccgacgaccagcaggacatcaccagggggaagggcctggtcgactccctcttccaggcgcccacgggggacggcacccacgaggccgtgctcagctcctacgagtacatgagccagggcctcagggactacagtgcctgggacaacatgaaggacggcttctacatcgcgccggccttcatggacaagctcatcgtccacctctcaaagaacttcatgacactgccaaacatcaaggttcccctcatcctgggtatctggggaggcaagggtcaaggaaaatccttccagtgtgagcttgtcttcgccaagatgggcatcacccccatcatgatgagcgccggcgagcttgagagcggcaacgccggtgagcccgccaagctcatcaggcagcgttaccgtgaggccgccgacatcatcaagaagggcaagatgtgctgcctcttcatcatcgat

SEQ ID NO: 30673 - protein, 222 aa, Panicum virgatum
  misc_feature: Ceres CLONE 1901273
  misc_feature: Useful for making plants with modulated biomass
MAAAFSSTVGAPASTPASFLGSKLSRKQQATAAVNYHGKSSGANRFRVMAKEIDESKQTDTDRWKGLAYDISDDQQDITRGKGLVDSLFQAPTGDGTHEAVLSSYEYMSQGLRDYSAWDNMKDGFYIAPAFMDKLIVHLSKNFMTLPNIKVPLILGIWGGKGQGKSFQCELVFAKMGITPIMMSAGELESGNAGEPAKLIRQRYREAADIIKKGKMCCLFII

SEQ ID NO: 30674 - DNA, 684 bp, Panicum virgatum
  misc_feature: Ceres CLONE 1901277
  misc_feature: Encodes the peptide sequence at SEQ ID NO. 30675
ggaagacgacacccccagtccaaccacgccggagccgggaaggcagcagcagggggaagagagcgcggccggcaccagcagccaacggcgcgccggcggacggagatgaagaagtgcccgtcggagctgcagctggaggcgttcatccgggaaagcgccggcggcgcggagagcaagcccggaacaggacccagcgagcccggcgggagcgccgtgttctcgcccggcgggagcgccgtgttctcgcccggcggcgtcggcttcggcgactcgaacaccatggatggaagcagctggtggtacgggagcatccgccccgcgaacccagtcgtgtcgcagacggcgtccgtctccgcagctagccccagagcaaccacctcagctaatcatgctcttgagagcgagtcggattccgacagcgaatcattgtatgaggtagagggaggttcatgtgagcgaggcaccaaatctatggaaacaaagcgaataaggaggatggtgtccaacagggagtctgctcgacgatccaggcggagaaagcaggcacaactatctgaactcgagtcgcaggtcgaacaacttaaaggtgaaaatgcaactctgttcaagcaactatcagaggccaacctgcagttcaccactgcagtcacagacaacagaatcctcaaatcggatgtagaagcc

SEQ ID NO: 30675 - protein, 192 aa, Panicum virgatum
  misc_feature: Ceres CLONE 1901277
  misc_feature (122)..(182): Pfam Name: bZIP_1 Pfam Description: bZIP transcription factor
MKKCPSELQLEAFIRESAGGAESKPGTGPSEPGGSAVFSPGGSAVFSPGGVGFGDSNTMDGSSWWYGSIRPANPVVSQTASVSAASPRATTSANHALESESDSDSESLYEVEGGSCERGTKSMETKRIRRMVSNRESARRSRRRKQAQLSELESQVEQLKGENATLFKQLSEANLQFTTAVTDNRILKSDVE

SEQ ID NO: 30676 - DNA, 585 bp, Panicum virgatum
  misc_feature: Ceres CLONE 1901285-R
  misc_feature: Encodes the peptide sequence at SEQ ID NO. 30677
ccactacgtcgagatccggcggtggcaggacatcaagaaccccggcagcgtcaaccaggaccccatcttcaagagctacagcctgccgccccacgagtgcggctaccccggcagcgtcttcaaccccctcaacttcgcccccacgctcgaggccaaggagaaggagctcgccaacgggaggctggcgatgctggcgttcctggcgttcctgatccagcacaacgtcaccggcaaggggcccttcgacaacctgctgcagcacctgtccgacccatggcacaacaccatcatccaaaacatctccggttgagtcgatgacggagagcgatcgtcaatttggcggtggtgctagctgatggggatcgattgggagacaaacattgagacgcggtcgagtcgatcgatgtgagttccttcctgtggatcgatcatcagtatgtgatgtgtgcagtgttcagtctggagaggagaattcagggcgtgttgtaatgatgtgtacgcatggtgaggaggagagtgtgaggagtgattggtatgtacattaatgacaggggaggttaagggtagagattgtttgatcagtac

SEQ ID NO: 30677 - protein, 102 aa, Panicum virgatum
  misc_feature: Ceres CLONE 1901285-R
  misc_feature (1)..(74): Pfam Name: Chloroa_b-bind Pfam Description: Chlorophyll A-B binding protein
HYVEIRRWQDIKNPGSVNQDPIFKSYSLPPHECGYPGSVFNPLNFAPTLEAKEKELANGRLAMLAFLAFLIQHNVTGKGPFDNLLQHLSDPWHNTIIQNISG

SEQ ID NO: 30678 - DNA, 726 bp, Panicum virgatum
  misc_feature: Ceres CLONE 1901285
gcaacagtatcagcggctgttcatcccatctctgaccatgatcacctagccgagctcagcgcccctccatctctccccccaattctctctttcccccaaccaagattcccgccccctccgcggctccgccccaggcttgcagcttcccccatctcgctagcccctagctctgggcctcctcttgctgtgcgtgcacagcgaaggagcgcaggctcgagctgtaggggtcgctgcatcgaggagggcgcggcgctgcaggaaggctgcaaggctggcggcttctgcccactgggcgtcgccctgaatagcggagattcccatccccatttcccaattatggatagccagcagccagcgggggaggactgaggccgctcgccattgctcccatttgaggtcgcagcttgtcctacctggtgtagcttagcaacctgttcagcaaaatgaggccttcagatgacagggcgcagctctcaggctttgaacaatcagaagaatcaacacttgatgtggaggggcattgctaccaccaacagtcattcccttgttctccatcaatgcaaccaattgcttctgggtgcacacacacagagaatagtgcggcatacttcttatggccgacatcaaacctacagcattgtgcggctgaggggcgcgcaaactactttggcaacctttcaaaaggactgcttcccaagtctggggcagtgccaagggccagcaagc

SEQ ID NO: 30679 - DNA, 1407 bp, Panicum virgatum
  misc_feature: Ceres CLONE 1901303
  misc_feature: Encodes the peptide sequence at SEQ ID NO. 30680
caaccaagccaagccgccgggatccctccctcccccgatcccgccgccgccgccgccgcccccgccaccgcccctcccccgccgccggccgccgcggcattctccggagcgcgcgcctcggtccggatccagggcctcggagagtcgggcgagccttgcccctgggtgcggcgcatctatctcatgggtgaagaggccgttgagttcagcgtggagaaggttgtcgccggggactgcaagcagagcgcggtggacgtcggcggcaggacgtatgttatcggcagatcagatgatgactccaagtcatccattatcgttaaaattctggacaaactaactcagacttgggttgtacccacagtacttgggacacagcctactctgaccaagtcacagtctgctattcctgtaaatgatgagaagatattggttatcgagaagggtgttcccttgaatgagtccgtctggttccttgagattgacaccccctttgttaagcagcagcggaaaatcaagggcacagaagttgtttcttggagcaagggagtaattggtgtgggccaaaaaccagttgtgattagtgggccttctggtgttggtaaagggacattgattgcaaagttgatgaaagactatccatcaaagttcggattctctgttagccacactacaaggtctccaagggagaaggaaatagatggggttcactaccattttacagagcggagcaaaatagagaaagatataagcgagggcaagtttcttgagtttgctcatgttcatggaaatgtttatggcacaagtattgaagcagttgaatctgttactgatgaggggaagaggtgtattctcgacattgatgtccaaggagctcgatctgtgagggcttcttctcttgaagcaatattcatctttgtatgccctccatcgttcgaggaactagagaagcgccttcgggcacggggaacagaaactgaggagcagatacaaaaacgactcagaaatgctcgggctgaacttgatcagtccaattcaccaggtctctttgatcatcttttggtaaatgatgaccttgaaacttgctatgagaaattgaagaagttgctttctctggatgatgatcaggaggattcagattatctttttatcaaggatggtaaacaatccgcaagttattgtattgtgtccaaacatgactcaaaaattttgttgcaacctgagactattgaagccaaaaatggagctacaagcttactagcccttgatttgtcgtctctctcgggaggtgcacctggacgaacaaggggccttaagatatgctcgattaactccttttgacaagcttatatgggtgttttagatgacccaaagcattcttccaagactgcagaagtgctgacatgaatt

SEQ ID NO: 30680 - protein, 384 aa, Panicum virgatum
  misc_feature: Ceres CLONE 1901303
  misc_feature (163)..(267): Pfam Name: Guanylate_kin Pfam Description: Guanylate kinase
  misc_feature: SWISSPROT Homolog: EC 2.7.4.8 Guanylate kinase
MGEEAVEFSVEKVVAGDCKQSAVDVGGRTYVIGRSDDDSKSSIIVKILDKLTQTWVVPTVLGTQPTLTKSQSAIPVNDEKILVIEKGVPLNESVWFLEIDTPFVKQQRKIKGTEVVSWSKGVIGVGQKPVVISGPSGVGKGTLIAKLMKDYPSKFGFSVSHTTRSPREKEIDGVHYHFTERSKIEKDISEGKFLEFAHVHGNVYGTSIEAVESVTDEGKRCILDIDVQGARSVRASSLEAIFIFVCPPSFEELEKRLRARGTETEEQIQKRLRNARAELDQSNSPGLFDHLLVNDDLETCYEKLKKLLSLDDDQEDSDYLFIKDGKQSASYCIVSKHDSKILLQPETIEAKNGATSLLALDLSSLSGGAPGRTRGLKICSINSF

SEQ ID NO: 30681 - DNA, 721 bp, Panicum virgatum
  misc_feature: Ceres CLONE 1901309
  misc_feature: Encodes the peptide sequence at SEQ ID NO. 30682
gttcgccgtactctgctacagtacaccatccctttcccgagttcaaacaaccactgatccagaggaaggccggcggcgctcctgctcttcctcctcgccgccgtcgcgctgctctacgtctccccgccgccggtctcggaccaccccgtggtggcctcctcccgccgccgccgctcggcccatgctttgctgaacagctccggtggcggcagcatggacgagtccgagcgccgcgaaatttctcgtgttccaacgaatggttcgaccgtcagggacaacctttggggttcaaagcttgctagcaaattttatgggtgcagcaactcaagcaacaagttccttgattcaaatattactacacaaacagaccgctgtttgatgattgttacaagtggaggcctgaatcaacagagaacagggataattgatgctgtcgttgctgcgcgcattttaaatgccacacttgttgttcccaaactggaccaggcatccttctggaaagattcaagcaatttttctgaaatttttgatgccaactggtttatctcatccctatcaaaggatgtaaagattgtgaaagagcttcctgagataggaggtaaacttcgggctcctcacagaatgcgtgttcctcgaaaatgtactgagcggtgttacttgaaccgtgtgttacctgcacttcttaagaaacatgttatacgattgacgaaatttgattata

SEQ ID NO: 30682 - protein, 169 aa, Panicum virgatum
  misc_feature: Ceres CLONE 1901309
  misc_feature: Useful for making plants with modulated nitrogen use efficiency
MDESERREISRVPTNGSTVRDNLWGSKLASKFYGCSNSSNKFLDSNITTQTDRCLMIVTSGGLNQQRTGIIDAVVAARILNATLVVPKLDQASFWKDSSNFSEIFDANWFISSLSKDVKIVKELPEIGGKLRAPHRMRVPRKCTERCYLNRVLPALLKKHVIRLTKFDY

SEQ ID NO: 30683 - DNA, 708 bp, Panicum virgatum
  misc_feature: Ceres CLONE 1901322
  misc_feature: Encodes the peptide sequence at SEQ ID NO. 30684
aaccgaagcggcagcagcagcaatggcagcctccatgatctcgtcgtcagctctggcggcaccggccagggcccagggcctgccgtccctcggccgccgcgcgtcctccttcgccgtcgtctgcggcaccggcaagaagatcaagaccgacaagcccttcgggattggaggtggcctcaccgtcgaccacgatgcctccgggaggaaggtcaagggcaagggcgtgtaccagttcgtcgacaagtacggcgccaacgtcgacggatacaggtgagctagctatcgagacttgtacacatcagtcaattcatcatgaagatagcaggcatgaagatctatccatgtgtttctattgctgtttgggatcgagcaaggatcattgatctgcatgtgtgcgtgaatatatatcagtatatatgcagatgattggacgcttattatgtttgtttgccaaacaatttgcagcccaatctacaaagaggaggactggtctcccaccggtgacgtctacgtcggtggtaagtagatatatagtaatttcacaaattcactatatatgattatgcggtcactaagctagtacagatctggcttgttgttcccgttcccaaccccttttagtccgggttccgggactacaaatttcgaactagagacctggattatttagtcctagtagaactaatacctttggcctcgtccataact

SEQ ID NO: 30684 - protein, 83 aa, Panicum virgatum
  misc_feature: Ceres CLONE 1901322
  misc_feature (35)..(83): Pfam Name: PsbR Pfam Description: Photosystem II 10 kDa polypeptide PsbR
MAASMISSSALAAPARAQGLPSLGRRASSFAVVCGTGKKIKTDKPFGIGGGLTVDHDASGRKVKGKGVYQFVDKYGANVDGYR

SEQ ID NO: 30685 - DNA, 360 bp, Panicum virgatum
  misc_feature: Ceres CLONE 1901332
  misc_feature: Encodes the peptide sequence at SEQ ID NO. 30686
ccctctcaccctcatctctccggcacacactactcatctacacctcttccgctgtgggaggcgccggttctcggtgatccgctcgacctatacccaccctaaatactcccagaccaatgatccggaaaaggcgccaggagcggactgctccaacttccaccagctgctcggcatcttgggcgcccagcatgacaacgacttatggaagatgcttcttcagattactaaaccaatgacgcgccctccgcttgtctgcagagttctctgtgcatcgtctgcctctgtaaatttctattggagggttgacaatgatacaatatctattatatgcataataatgactgatccatgccttactga

SEQ ID NO: 30686 - protein, 119 aa, Panicum virgatum
  misc_feature: Ceres CLONE 1901332
  misc_feature: SWISSPROT Homolog: EC 2.5.1.62 Chlorophyll synthase
PLTLISPAHTTHLHLFRCGRRRFSVIRSTYTHPKYSQTNDPEKAPGADCSNFHQLLGILGAQHDNDLWKMLLQITKPMTRPPLVCRVLCASSASVNFYWRVDNDTISIICIIMTDPCLT

SEQ ID NO: 30687 - DNA, 596 bp, Panicum virgatum
  misc_feature: Ceres CLONE 1901349
  misc_feature: Encodes the peptide sequence at SEQ ID NO. 30688
aagaaaggacggcgaacacttcgatcggttcgattcgattcactcgcgcgaactccgatcccagcggcagctctcgctgcagagccctagctagctcgctcgctcgctcctggaggtggaagctagctagtagtcttgagcaagagaagctaagacgatggcctctgctaccctgctcaagtcctccttccttcccaagaagtccgaatggggcgccagcaggcaggtcgccgcgcccaggccggtcaccgtgtccatggtcgtcgtccgcgccagcgcctacgccgatgagctcgtcaagacggcgaaaacggtggcgtcgccggggcggggcatcctggccatggacgagtcgaacgcgacgtgcgggaagcggctggcgtccatcgggctggagaacacggaggcgaaccggcaggcgtaccggacgctgctggtgaccgcgccggggctcgggcagtacatctcgggcgccatcctcttcgaggagacgctgtaccagtcggccgtggacgggcgcaagatcgtggacatcctggcggaacacggcatcgtgcccgggatcaaggtcgacaacggcctcgtcccgctcgccg

SEQ ID NO: 30688 - protein, 146 aa, Panicum virgatum
  misc_feature: Ceres CLONE 1901349
  misc_feature (45)..(146): Pfam Name: Glycolytic Pfam Description: Fructose-bisphosphate aldolase class-I
  misc_feature: SWISSPROT Homolog: EC 4.1.2.13 Fructose-bisphosphate aldolase
  misc_feature: Useful for making plants with modulated biomass
  misc_feature: Useful for making plants with modulated phosphate use efficiency
MASATLLKSSFLPKKSEWGASRQVAAPRPVTVSMVVVRASAYADELVKTAKTVASPGRGILAMDESNATCGKRLASIGLENTEANRQAYRTLLVTAPGLGQYISGAILFEETLYQSAVDGRKIVDILAEHGIVPGIKVDNGLVPLA

SEQ ID NO: 30689 - DNA, 1755 bp, Panicum virgatum
  misc_feature: Ceres CLONE 1901350
  misc_feature: Encodes the peptide sequence at SEQ ID NO. 30690
aaacgcggagcggccgcgcaggatcggacgaggcgcggtctacggttcaccacaactgtacaccacgccggcgcgctgcccgcctgccctgctattgttcctccgtctccgcgccatcggatcgcggtgcgtgcggcgcggcgcctgcctggtacagagcctcggccgccgacccgccgtccccgcagcggccgctttctagcggcttcccgttggctcgcgggcggccgcggttgtgagcgcccgagcgagtggcagccctgcttttttttttttttggttctcggggtagtcctctgctcgctggtcgcgccaccgttgctttccccaatccgatcctccgaggtcgattgccgcggatggaggcgctgaagaggcacgccagcaagctccgggagcacgttgccaagcagcagcaggcggttttcaagcagttcagtgcgcgatataatcaggacccctctcttgtcgatgaagcggagcttgagtgccaccagaatctccagaggctttacagtaccactagagcagctaagcatttccagcgaaatattgtacgaggcgtggaaggtttcattgccgttagcaccaaacagatggagattgtgaaaagactagctgaggattgttgcaaatatggagtcgacaatgagcattttggttttgctcttgcaaaggcatctgtggagtttggtaattctcataaacaaatagagaaagagcgggaggatcttcttaaagttcttggagagcaggtttttgagcctctccgagaaatgataatgagtgctcctcttgaagatgctcgcttgctaacttaccgttatcagcggatcagacaagacatggagtctcagatagctgatgtgatgagaaagcaacttaagtccaaggaaagtagcggcaacacagataactctgtgaaactgcaacatgcagaatcaaaattatcagatcttcgaactacactggcagcattaggaagagaagcaactgcagctatggaggctgtagaggctcagcaacagcaagttacatatgaacgtctccttgcaatggttgatgctgagagaacgtatcatcaaaacgctgctgatattctgaataaactccatgatgagatgctccttgcaaagcatcataacgaaacaataaaccattatgatgaacagtcatcagagcctgaatcggaaactgctccagcacaagtgcactcagatagcacatctgaagatccagtattaactaaacctagcgaatccacagggaatggtcagggggtacaatttcttggggaggttattcatccattcaatgctcagactgatggtgagctcagtctatcggtgggcgaatatgttgtggtccgccaggtgtcatcaaacggttggtcggaaggggaatgcaagggaaaggctggctggttcccatctgcctatgtagagcggagggacaaagccccggcaagcaaggtgatagagcccggacttctgactacttgatccatcgcgtacttattggttctgacttgctgtcatcgtcctttttcgtcatcattgtacatgacatgttagatgagcgattagtgttccgtagaactttttaccttcctgtgcagattattgttcttctactaggcttttcctttggttgataactgtatgtaaagtgtagttttgggccctaggatttccttttgatatatggccatgtacagaactattggtgatgagaagctgtcaacttgccctttct

SEQ ID NO: 30690 - protein, 380 aa, Panicum virgatum
  misc_feature: Ceres CLONE 1901350
  misc_feature (310)..(364): Pfam Name: SH3_1 Pfam Description: SH3 domain
MEALKRHASKLREHVAKQQQAVFKQFSARYNQDPSLVDEAELECHQNLQRLYSTTRAAKHFQRNIVRGVEGFIAVSTKQMEIVKRLAEDCCKYGVDNEHFGFALAKASVEFGNSHKQIEKEREDLLKVLGEQVFEPLREMIMSAPLEDARLLTYRYQRIRQDMESQIADVMRKQLKSKESSGNTDNSVKLQHAESKLSDLRTTLAALGREATAAMEAVEAQQQQVTYERLLAMVDAERTYHQNAADILNKLHDEMLLAKHHNETINHYDEQSSEPESETAPAQVHSDSTSEDPVLTKPSESTGNGQGVQFLGEVIHPFNAQTDGELSLSVGEYVVVRQVSSNGWSEGECKGKAGWFPSAYVERRDKAPASKVIEPGLLTT

SEQ ID NO: 30691 - DNA, 674 bp, Panicum virgatum
  misc_feature: Ceres CLONE 1901356
  misc_feature: Encodes the peptide sequence at SEQ ID NO. 30692
aaaaaggagacggtggaaagcaacggaggagggcaagcggcaaggacagggctgagaccacacctccactagaggcactggcaccaccgcgccgacgggcgggcactccggaacgatggcgacggacggcgccgacgtgtcgccggagtcggaggcgacggcggcggcggagaagggcggggagatctggggcacgctggaggagctcctcctagcgtgcgcggtgacccggcacggcacggcgagctgggactcggtggccatggaggtgcagacgcggtgcccgctggcggcccggcccggcctcacgccgcacagctgccgcctccgcttccgccacctccaccgccgcttcaccgccgccgggaccggcggggaggacgaccccgacgcctccgccgccgaggggtgggtggacgagctccggcggctgcgcgtcgccgagctccgccgcgacgtcgagcgatgcgatctctccatcgggacgcttcagtcgaaagtgaaacggctcagggaggagcgggagcggagcgtctccggcgaggcgaagccggaggaggcgaacggcgacgaccggctctcaggggaggagcccgggcggtcgtgccgggagtccaactccacggatctgaagccccccacgcaccccggccaccagggcggcggcgccaagg

SEQ ID NO: 30692 - protein, 186 aa, Panicum virgatum
  misc_feature: Ceres CLONE 1901356
  misc_feature (22)..(77): Pfam Name: Myb_DNA-binding Pfam Description: Myb-like DNA-binding domain
MATDGADVSPESEATAAAEKGGEIWGTLEELLLACAVTRHGTASWDSVAMEVQTRCPLAARPGLTPHSCRLRFRHLHRRFTAAGTGGEDDPDASAAEGWVDELRRLRVAELRRDVERCDLSIGTLQSKVKRLREERERSVSGEAKPEEANGDDRLSGEEPGRSCRESNSTDLKPPTHPGHQGGGAK

SEQ ID NO: 30693 - DNA, 658 bp, Panicum virgatum
  misc_feature: Ceres CLONE 1901358
  misc_feature: Encodes the peptide sequence at SEQ ID NO. 30694
ttcttcctcgtggttgtggtcgcagggttgaaggcttgggaggaccggagaagtagagtgtggtctcgccatggagcagcagaagggaggagcggtttctgcgccggcgaccgccgccgccaacgggaccggggagctgatcgggtacgtcgacgtgcacgtgcggagcgcgcgggacatccagaacatctgcatctaccacaagcaggatgtatacgcgcgggtgtcgctgccgggggacggcgcgccggtggcgtccacgcaggtggtcaacggcggcggccgcaacccggtgttcgaccagtcgctgcgcctcggcgtgcgcgcgggggacgtcgacgctgcgctccgctgcgaggtctggatgctcagccgggtcaagaactaccttcaggaccagctgctggggtttgcgctcgtgccgctcccggaggtcgtcgccgccgacggcggcacgctcgcccgggagttcccgctcaccaccagcgacctcttccagacgccctcggggttcctgcagctcgagctgtcctacatcggggtcgtcccggaggtcgtgcccatctcgccgacgcccaagccggcgctggccgacccggaggaggagccggagactaacgccggcgccggcgcggggagcgagaaggaatacgagaag

SEQ ID NO: 30694 - protein, 195 aa, Panicum virgatum
  misc_feature: Ceres CLONE 1901358
  misc_feature (27)..(116): Pfam Name: C2 Pfam Description: C2 domain
  misc_feature: Useful for making plants with modulated biomass
MEQQKGGAVSAPATAAANGTGELIGYVDVHVRSARDIQNICIYHKQDVYARVSLPGDGAPVASTQVVNGGGRNPVFDQSLRLGVRAGDVDAALRCEVWMLSRVKNYLQDQLLGFALVPLPEVVAADGGTLAREFPLTTSDLFQTPSGFLQLELSYIGVVPEVVPISPTPKPALADPEEEPETNAGAGAGSEKEYE

SEQ ID NO: 30695 - DNA, 739 bp, Panicum virgatum
  misc_feature: Ceres CLONE 1901362
  misc_feature: Encodes the peptide sequence at SEQ ID NO. 30696
atagttgttccgcctgatttctcctccgccgcctcctttccacggctaccgaagcggcggcggaggctgctgcgcccactgccgccgccgccgccaccgccgcgaaggcggggaagaaggggggctcgctggcgctctaccgccgtctgtcggcgctgggccgctccggggaggggagcgtgtcgcgggtgctgaacaagtgggtgcgggagggtggtgcgctgcacgtggaagacctcgtcaagcacgtcaaggagctccgcaagtacaagcgccatggccacgccctcgagctgatggattggatggtcaatacaaggggcatgaacatgtcacacactaaccatgcaatacgtctggatcttatctataaagtgcgtggtattgaggcagctgaggcttattttgctgacctccctgatccagcgaagaaccatcgaacttatggtgcacttcttaattgttattgctcagcaaaaatggaagagaaagcaacagacctctacaacaagatggatgagcttggcatctattccaatgcgctaggcatcagtaatctgatgtccctttacatgaagttaggccgacatgggaaggtcgatagtctctttgaggaaatgaaggtgaagaatgttaaaccggataacctcacatgctgcattctgatgaccagctatgcatcatcaaacaagatagatgctattgaagaacttctaaaagaatggcagaaaaggatgtg

SEQ ID NO: 30696 - protein, 147 aa, Panicum virgatum
  misc_feature: Ceres CLONE 1901362
  misc_feature (48)..(82): Pfam Name: PPR Pfam Description: PPR repeat
  misc_feature (83)..(117): Pfam Name: PPR Pfam Description: PPR repeat
MDWMVNTRGMNMSHTNHAIRLDLIYKVRGIEAAEAYFADLPDPAKNHRTYGALLNCYCSAKMEEKATDLYNKMDELGIYSNALGISNLMSLYMKLGRHGKVDSLFEEMKVKNVKPDNLTCCILMTSYASSNKIDAIEELLKEWQKRM

SEQ ID NO: 30697 - DNA, 2892 bp, Panicum virgatum
  misc_feature: Ceres CLONE 1901363
  misc_feature: Encodes the peptide sequence at SEQ ID NO. 30698
acaaatcagaacagcaatttcccattaccctctcctctcccttcctccccccttcgccccccgctcctccgcctcgcgtcgcgtgggaagccaccgcccaggctgcgaagcagctcgctaccgttctacctacctctcccggcgtccgtccccagccgcggatccggcttccctctcaggcggaaccccttcctgcgccgggccaggtgcggagggggggagcgcgatggcgacgcacgagcggaagacgatcgatctggagcaggggtgggagttcatgcagaagggcatcaccaagctcaagaacatcctcgagggcaagcccgagccccaattcagctccgaggactacatgatgctctacacgacgatttacaacatgtgcacgcagaagccgccgcacgactactcgcagcagctctacgagaagtaccgtgagtcatttgaggagtacatcgcgtccatggtcttaccttccttaagggagaaacatgatgaatttatgttgagagagctagtaaaaaggtggtcaaaccataaagtaatggttcggtggctatcacgcttcttccattatcttgatcggtacttcatttcccgaagatcactaccgccgcttagagaagttgggcttagttgtttcagagacttggtatatcaagagatcaaaggaaaagtaaaaagtgcagtcatatctttgattgaccgagaacgtgaaggtgaacaaatagatagggccctgttgaagaatgttctggatatatttgttgaaattggtttgggtagtatggagtgctatgaaaatgattttgaagatttcctgcttaaagatactgccgattactactctatcaagacccaaacctggatccttgaggattcttgtccggattatatgttaaaggctgaagaatgcctgaaaagggaaaaggagcgagttgcccattatttgcattctagcagtgagcagaagttattggagaaagtgcagcatgaactgctaactcagtatgcaagccaactcttggagaaggagcattctgggtgtcatgcactactttgtgatgacaaggttgaggatctgtctaggatgtatagactcttttccagaataactcgtggcctagaacctgtttctcagatatttaagcagcatgttactaatgagggcacagctttagtcaagcaagcagaagatgctgctagcaataaaaagccagagaagaaggacatggttggtttgcaagaacagatctttgtccggaaaatcattgagctgcatgacaagtatgtagcatatgttacagagtgtttccagggccacacactctttcataaggcccttaaagaggcttttgaggttttctgcaacaaaggtgtttctggtagttcaagtgctgaattgctagccacattttgtgacaatattttaaagaaaggtggcagtgaaaagcttagcgatgaagcaattgaagatacccttgagaaggtggtcaggctgcttgcatacatcagcgataaggacttgtttgctgaattttacagaaagaagcttgcgaggagattactttttgacaagagtgctaatgatgagcatgaaagaagcatcctgaccaaactaaaacagcaatgcggagggcaattcacttcaaaaatggagggcatggttaccgatttgactgttgcaagagaccatcaaacgaaatttgaagagttcataagcagccatccggagctgaatcctggaatagacttagctgttactgttctgacaacaggattctggccaagctacaaatcttttgatattaatctaccttctgaaatggttaaatgcgtcgaggttttcaaagagttttaccaaacaagaacaaagcacaggaagcttacctggatatattccctgggaacctgtaatatcagtgctaagtttgaggccaaaactattgagctcattgttacaacttatcaggctgcattgctgctgctatttaatggagctgacaggcttagctattctgagattgtgacacagctaaacctctcagatgatgatgttgttcgccttctccattctctttcttgtgcaaagtacaagattcttaacaaagaacctagtaataaatctatttcaccaaatgatgtctttgagtataattcaaaatttactgacaagatgcggagaataaaggtacctcttcctccagttgatgagaagaagaaagtagttgaagatgttgacaagaatcgtaggtatgcaattgatgcatccattgtgcgcattatgaagagcaggaaagttttgggtcatcaacaacttgtaatgaaatgcgtggaacagcttggtcgcatgttcaagccggacttcaaggcaataaagaagcggattgaggatcttactacaagggattacttggagagggacaaaaataacccaaatgtgtatagatacctggcttgatgaatccactgtctggtcctgcggtgtttgcctgagactgatttcttttgttgtgtggtgttgccacaattattggcaatgctactctgttgtacatccagctgggctagtgcttggcatgccttaaacggagaggacagcgatgaagattgacagatgggccagtggttggccagtgccaggcatgcggccgtgatgtaagctgtagcgccatctatttgatcttgtactatttgttgtattttctccccaatatgtatagcattattttatttcaatcggttagataaatgtttagattgtcatgcgatggcagcacaccgttctgctcggagtgcagtaagatgccaatcttgtatttgttgtgaatcgtgtcttgtacagttgccggagatgccggttgtaatggtcacaagtatggcttttcttgt

SEQ ID NO: 30698 - protein, 744 aa, Panicum virgatum
  misc_feature: Ceres CLONE 1901363
  misc_feature (15)..(648): Pfam Name: Cullin Pfam Description: Cullin family
MATHERKTIDLEQGWEFMQKGITKLKNILEGKPEPQFSSEDYMMLYTTIYNMCTQKPPHDYSQQLYEKYRESFEEYIASMVLPSLREKHDEFMLRELVKRWSNHKVMVRWLSRFFHYLDRYFISRRSLPPLREVGLSCFRDLVYQEIKGKVKSAVISLIDREREGEQIDRALLKNVLDIFVEIGLGSMECYENDFEDFLLKDTADYYSIKTQTWILEDSCPDYMLKAEECLKREKERVAHYLHSSSEQKLLEKVQHELLTQYASQLLEKEHSGCHALLCDDKVEDLSRMYRLFSRITRGLEPVSQIFKQHVTNEGTALVKQAEDAASNKKPEKKDMVGLQEQIFVRKIIELHDKYVAYVTECFQGHTLFHKALKEAFEVFCNKGVSGSSSAELLATFCDNILKKGGSEKLSDEAIEDTLEKVVRLLAYISDKDLFAEFYRKKLARRLLFDKSANDEHERSILTKLKQQCGGQFTSKMEGMVTDLTVARDHQTKFEEFISSHPELNPGIDLAVTVLTTGFWPSYKSFDINLPSEMVKCVEVFKEFYQTRTKHRKLTWIYSLGTCNISAKFEAKTIELIVTTYQAALLLLFNGADRLSYSEIVTQLNLSDDDVVRLLHSLSCAKYKILNKEPSNKSISPNDVFEYNSKFTDKMRRIKVPLPPVDEKKKVVEDVDKNRRYAIDASIVRIMKSRKVLGHQQLVMKCVEQLGRMFKPDFKAIKKRIEDLTTRDYLERDKNNPNVYRYLA

SEQ ID NO: 30699 - DNA, 1409 bp, Panicum virgatum
  misc_feature: Ceres CLONE 1901374
  misc_feature: Encodes the peptide sequence at SEQ ID NO. 30700
acgctgagtcgctgaccacggcctcgtcctccccccacgtctcgcgccatctcgtctcctctcgcatcctcctcactcgtcgcgtgcgccgctagcccagcggcccactcgagtcggatcgagcgccgggggacggcatggctggcgacgacggcagcagcgcgggcgcgggcaggggaagaggcagcacggaagatgaggtccagatacagatcgcaggatcatccaaacctgaaacttcttctactaacgaaacagccagccaaagctctcctaccaagcattggcattggtggttgatggttgttctaaacattttcttcctcattgctggtcagacagcatcaacactccttgggaggttctactacaaccagggtggaaatagcaagtggatgtccacatttgtccaaactgctggctttcctgtgctattcatcgccctatatctgttccgttcaaaatctacacaaacagccaccactagccctgagacttctggcaccaaaattactctgatatatattgccttggggctcatcattgctgcagacgacttgatgtattcctatggcctattataccttcctgtatcaacatattcgctcatatgtgctagccagctggccttcaatgctgtcttctcatatttcctcgatgctcaaaagttcactgcattgattttcaactctgtagtcctccttaccttttctgctgcacttcttggagttgatgaagattctcagggtactaatggtttatcgcatgggaagtacatattgggtttcgtgctgacgctaggagcatcagccacatactccctgattctctctttgatgcaagttacatttgagaaggttattaagagggagactttctcagtcgtcttgaacatgcagatatatacagcacttgtggcaacaatagcttctcttattgggttatttgcaagtggtgaatggaagactttagagggagagatgcatgccttcggctcagggaagctgtcctacgtgatgacacttctgtggactgctatatcttggcagatagcttccgttggagtggtgggtttgatctttgtggtgtcatcactcttttcaaatgtgataagcacactagctctacccatcattccagtttttgctgtgattttcttccacgacaagatggatggagtgaagattattgctatgttgatggccatctggggatttatttcatatggctaccaattatatgttgatgacaagaaagctaggaagacttcagttagtgtggaggagagttcttaagtgcttgttacattgttccccatgctcctgccaatataagttgttggcgctgcactgagtgaggtactagttcttgtagccaaaaaaggctcaacctaatgttgctcaattctt

SEQ ID NO: 30700 - protein, 385 aa, Panicum virgatum
  misc_feature: Ceres CLONE 1901374
  misc_feature (216)..(365): Pfam Name: TPT Pfam Description: Triose-phosphate Transporter family
MAGDDGSSAGAGRGRGSTEDEVQIQIAGSSKPETSSTNETASQSSPTKHWHWWLMVVLNIFFLIAGQTASTLLGRFYYNQGGNSKWMSTFVQTAGFPVLFIALYLFRSKSTQTATTSPETSGTKITLIYIALGLIIAADDLMYSYGLLYLPVSTYSLICASQLAFNAVFSYFLDAQKFTALIFNSVVLLTFSAALLGVDEDSQGTNGLSHGKYILGFVLTLGASATYSLILSLMQVTFEKVIKRETFSVVLNMQIYTALVATIASLIGLFASGEWKTLEGEMHAFGSGKLSYVMTLLWTAISWQIASVGVVGLIFVVSSLFSNVISTLALPIIPVFAVIFFHDKMDGVKIIAMLMAIWGFISYGYQLYVDDKKARKTSVSVEESS

SEQ ID NO: 30701 - DNA, 697 bp, Panicum virgatum
  misc_feature: Ceres CLONE 1901374-R
  misc_feature: Encodes the peptide sequence at SEQ ID NO. 30702
atcctgaaaataagaagataatgatattttcaaaaaaaaacccaagaagccgatcatctctcccctgacaagttcgcagagaaacatctgatcttgcttcgttgacgagccatggccgaggagaagcaccaccacctgttccaccaccgcaaggaggaggagagctccggcgaggtcaactacgagaaggaggagaagcaccacaagcacctggagcagcttggcggcctcggcgccatggccgccggcgcctacgctctgcacgagaagcacaaggccaagaaggaccccgagaacgagcacggccaccggatcaaggaggaggtggccgccgtcgccgccgtgggcgccgctgggttcgccttccacgagcaccacgagaagaaggacgccaagaagcacggcgataactgaacgcgcgcgcgtgtttatttgcctgaagcatccatctattatttgcttgatttttcttttctctttcaactcgtgtgcgctaggtcttgatttggactgatttatctgcacctaggatgaattcgatccggatcctcggtgttcctgaatcaagtgcaaaatcaggcctcgaataataaccgtgtggtgctgtctgcgtttgtgtaccgtgtactggatcatctttgtatttttcttaacgagacgtctcgagaataatatggatttattacatgtttctatc

SEQ ID NO: 30702 - protein, 100 aa, Panicum virgatum; identical to SEQ ID NO: 4230
  misc_feature: Ceres CLONE 1901374-R
  misc_feature (22)..(100): Pfam Name: ABA_WDS Pfam Description: ABA/WDS induced protein

SEQ ID NO: 30703 - DNA, 753 bp, Panicum virgatum
  misc_feature: Ceres CLONE 1901389
  misc_feature: Encodes the peptide sequence at SEQ ID NO. 30704
gagcaggactccgctttgcttgcgtcccgacaagcggaaagaagaggcgcgggagggagggaggtagaaaaggggaggaaaggaggcgccgagcgagagcagccagagggggagaggcggaggaagggggaagaagagctgtagaggaagggggaagcaaatcttggaggggcgtcgtgagattcctgcggtggaggaggaaacgcgagcggagggtagtgaggtgtagccccgtctgggtacaagaacagcagcagcacaagcattggtgctgataagttgcaggatcacatgaacgagctaaagattagagatgataaggaagttgaagcaaccataattaatgggaaagggacagaaactgggcacataattgtgactactactggtggcaagaatggtcaaccaaagcagacggtgagctacatggctgagcgcattgtaggtcaaggttcttttgggattgtcttccaggctaaatgcttggagacgggtgagactgttgccataaagaaggttcttcaggataagcgttacaagaaccgtgagctgcaaaccatgcgccttcttgaccaccctaatgttgttgctttgaagcattgcttcttttcaacaactgagaaggatgaactgtatctaaacttggttcttgagtatgtgcctgagactgttcatcgagtcgtgaagcatcacaacaagatgaaccaacgaatgccacttatctatgtgaagctgtacatgtaccagatatgt

SEQ ID NO: 30704 - protein, 153 aa, Panicum virgatum
  misc_feature: Ceres CLONE 1901389
  misc_feature: SWISSPROT Homolog: EC 2.7.11.1 Non-specific serine/threonine protein kinase
  misc_feature: Useful for making plants with modulated water use efficiency
  misc_feature: Useful for making plants with modulated biomass
MNELKIRDDKEVEATIINGKGTETGHIIVTTTGGKNGQPKQTVSYMAERIVGQGSFGIVFQAKCLETGETVAIKKVLQDKRYKNRELQTMRLLDHPNVVALKHCFFSTTEKDELYLNLVLEYVPETVHRVVKHHNKMNQRMPLIYVKLYMYQI

SEQ ID NO: 30705 - DNA, 606 bp, Panicum virgatum
  misc_feature: Ceres CLONE 1901406
  misc_feature: Encodes the peptide sequence at SEQ ID NO. 30706
acaacccagagctgcagaccccctccgctccccccacccccgcatggccaccgacgccggtgcggcggctatggctgcgtcgtccctctgcgacgacctgcagcccgccgccgtccgcaccggcgtccgcgacgtcctggccgcgggcgccgcgcgggccggggaccgcgtcgaggtcgggggctgggtccggactggcagggagcagggtaagggcaccttcgcctttctcgagctcagtgacggctcctgtgcttccacgctccgggtgattgtcgacgccgccgtgcacccgctcgcgcgcctcaccgccacgggcacctccgtgctcgtcgagggagagatcaaggaaccacccgaggggaccaagcacaacgtcaagctcaaggtcagccgcgtcctcaaggttggcgaggtcgacgccgccgcctacccgctgccctagggcgaggtcacgctcacgctcgagaagctcacggatgtcattcacctccgttcgcgcactaacacgattggtgcagatgctataattaggcatcaggtagccgttgccactctccggttcttccaggagaatgcatttctctatgtacatacaccaataat

SEQ ID NO: 30706 - protein, 133 aa, Panicum virgatum
  misc_feature: Ceres CLONE 1901406
  misc_feature (43)..(122): Pfam Name: tRNA_anti Pfam Description: OB-fold nucleic acid binding domain
  misc_feature: SWISSPROT Homolog: EC 6.1.1.22 Asparagine--tRNA ligase
MATDAGAAAMAASSLCDDLQPAAVRTGVRDVLAAGAARAGDRVEVGGWVRTGREQGKGTFAFLELSDGSCASTLRVIVDAAVHPLARLTATGTSVLVEGEIKEPPEGTKHNVKLKVSRVLKVGEVDAAAYPLP

SEQ ID NO: 30707 - DNA, 1434 bp, Panicum virgatum
  misc_feature: Ceres CLONE 1901412
  misc_feature: Encodes the peptide sequence at SEQ ID NO. 30708
gttttcgcggttgctccctccaccatactctgtcgcttacaccaactccctctcgtccttgacggtgccagcccggcctgttcttgctccgtccatggccatggcggtggcggagtggtgggaggcggcggcggcggccatcctggcgtacacggggatgacccctgcggcgttcttcacgaccgtggcggtggccgccgcgctgtacgtcgcggtttcaggcctcctcgcgcggccggcgcaggtgtcagcgaggaggcgagaggcggaggacgagcgagaggaaatggcgttcgggcctctgccgccaccggtgcagctcggggaggtgacggaggaggagctgagagcttacaatgggtccgaccccaagaaaccgctgctcatggccatcaagggccaaatctacgacgtcacgcagagcaggatgttttatggacctggtggcccatatgcattgttcgcaggcaaagacgcaagtagggctttggcaaagatgtcatttgaaccaagtgatttaactagtgacatttcaggattaggcccttttgaggccgaggcattgcaagaatgggagtacaaattcaagagcaaatacattacggttggaacaatcaagaagactgttccggtagctgagggagatgctgcaacgaatactgtgacaactgaaagggacatcgatgcaagcattgttgacagtaaccatgtgccagaaccaaaagaaactggagcgacaaaccaagggagcgttccggagaagactacagaaacaccagatgtcgatgtgaacacaagaaactacgtggagaaggcaaaagaattgctggattcagatggcacgaatgcgagtagccaagcagatgcagtagagaagccagacgaaacaccagttgtgcctgtaaagaacagcagtactgaagaagcatttgagccaaaggaaacaccagatggggccataaagaacagttgtcctgaagaagcagttgagccaaaggaaacaccagaagcggctgtaaagaactgtagtagcactgaagaagcagttgagccaaaggaaacacctcaggtagtagacaggaagaatagttgtaaacctgaagatgcaaccgagaagtcaaatgaagcagcagatgcagtaggtttggaaaacagaactagccatgaagatgctgggcaatcaaaggaaacacggaatatagatgacaaatatgtaagcagtagtcaagatggtgaggagaagctgaaggaaacttcagatgcggaagccaagaatgcatagagtttgtgactgctgccatgaagctttttagctgtctgcagttagcataataaagtgaaatggacattgtggtcgggattcagttataaatccttgtatagggtataacacttaaacctagaactaaattattaaactatatgtacattccg

SEQ ID NO: 30708 - protein, 393 aa, Panicum virgatum
  misc_feature: Ceres CLONE 1901412
  misc_feature (76)..(173): Pfam Name: Cyt-b5 Pfam Description: Cytochrome b5-like Heme/Steroid binding domain
  misc_feature: Useful for making plants with modulated nitrogen use efficiency
MAVAEWWEAAAAAILAYTGMTPAAFFTTVAVAAALYVAVSGLLARPAQVSARRREAEDEREEMAFGPLPPPVQLGEVTEEELRAYNGSDPKKPLLMAIKGQIYDVTQSRMFYGPGGPYALFAGKDASRALAKMSFEPSDLTSDISGLGPFEAEALQEWEYKFKSKYITVGTIKKTVPVAEGDAATNTVTTERDIDASIVDSNHVPEPKETGATNQGSVPEKTTETPDVDVNTRNYVEKAKELLDSDGTNASSQADAVEKPDETPVVPVKNSSTEEAFEPKETPDGAIKNSCPEEAVEPKETPEAAVKNCSSTEEAVEPKETPQVVDRKNSCKPEDATEKSNEAADAVGLENRTSHEDAGQSKETRNIDDKYVSSSQDGEEKLKETSDAEAKNA

SEQ ID NO: 30709 - DNA, 703 bp, Panicum virgatum
  misc_feature: Ceres CLONE 1901412-R
  misc_feature: Encodes the peptide sequence at SEQ ID NO. 30710
ctgatgctgacaacagatgctgggcatcttttctagaccgcatctcaagagctccacatcaagtgctgaggtactgcagggaggcaaaagcaaaacctctttgggcgatgtcatctgggtctctggccactgcagctatcccgtcatgcatctactgtagcggtccacttcgctatgagtttcagataatgccacagctgctccatttcttccatgttgaaaataagcccgactctcttgattgggcaacaatagttgtgtttacatgtcaagggtcctgtgatcgaaatatcaattacaaggaagaatttgtatgggttcagttatacccaactactgcgacaagataccgcagttctggttaccaatctccttcaacgaataagattctccggtccgatctatagatgtatgtgcacctgtcatggtggaagggggtggaaggttgggggtgctcactcacctcgccaacctgtcatggtgccagttgtatcagttcgttccattatgtgttgatcttgtcaccttcctatttacagttgctgagttctgctaaacgctccaaggcaatactcctattgcattttatgttgttgagtgctgtctgttaaaactaacagattataatgttcattcttctgttattgatagttgtattgtctggtgtggacaattgttgagattaaatattatataatttagc

SEQ ID NO: 30710 - protein, 134 aa, Panicum virgatum
  misc_feature: Ceres CLONE 1901412-R
  misc_feature (1)..(113): Pfam Name: PDCD2_C Pfam Description: Programmed cell death protein 2, C-terminal putative domain
DADNRCWASFLDRISRAPHQVLRYCREAKAKPLWAMSSGSLATAAIPSCIYCSGPLRYEFQIMPQLLHFFHVENKPDSLDWATIVVFTCQGSCDRNINYKEEFVWVQLYPTTATRYRSSGYQSPSTNKILRSDL

SEQ ID NO: 30711 - DNA, 2151 bp, Panicum virgatum
  misc_feature: Ceres CLONE 1901445
  misc_feature: Encodes the peptide sequence at SEQ ID NO. 30712
atcttaacctaaaaggatgtcgcgaactccatcacctgccctcaaaacttgaggatattaagagtttgcagcatcttaacctgtcatgctgtccagcagctcaccagctacttgaatctatcagtggatttcaagaacttcgatttttggatatatcaagttgtacagaacttcaatcattgccagaatccttcggcagactaacaaatttagaggatctaatcctgtccaaatgcaccagactcaagaagttaccagaatcatttggtgaactttgttttcttcagttcttgaatgtatccaattgctgcgagcttgaagaagtgcctgcatctcttggaaggcttgctagttaggaggttctaatactttcaggatgcagaagaattcaaaatcttcctcaatcattcattgacattgcattcttgcggattctagaccttgcagggtgtgtagatcttcacataaaccttggaatgttaccacataataatctagagaaccttaacgtggatggatgtcacaagatcgatgctatgcctgggtggactgcaaacttccctaaactacatcccaaatgtctacaaacctgtgaccaacaaattcgatgcttgattccagaacagcaagtctgtcttagtgacaatgaagtagagattatcaaggagctgaatgtgtgtgtgcatgacggaactgaggaagcaatagcaagtcaatcatgccaagctggtaactctgaacgtatcactaaggaggtctttgagaattcatctgcacgtacaagtcataacgttcctcagcatcccactatcccaactggaagtagttcctccagtactggagtaattggttttgcatgttggccgcgcaggaaaccgaaaaagcatttctccaatgtacctgccaaggaagatccagaggggcatcttggccagcttaaaaaattttcacttcgagaactagaagttgcaacagatggcttcagcgataagaacagtcttggaagaggtgggtttggcaaagtctacaaaggaaggctggcagatggttcattagtagctgttaagagacaaaagcaggagataacacctggtgctggggagctgcaatttcaagcagaagttgatatactttgtacggttgaacacagaaaccttttgcgtcttcgcggattctgtatgacaccaacggaaaggttgcttgtgtatccatacatggccaatggaagtgttgcgtcacgtttaagagaacgcccaggatctgaacctccactagattggcaaactagaaggaggattgcattggggtctgccaagggtctgtcctatttacatgatcagtgtgatccgaagattatccatcatgatgtgaaagctgcaaacattttgttagatgaagacttcgaagctgtagtgggggattttggtttagccaaactaatggattacaaagatgcccatgtaactactccagttagtggaacaatgggtcacattgcaccagaatatcattcaacaggaaaatcctctgaaaaaaccgatgtattcagttatggaattatgcttttggagcttgttacagggcagcgtgtccttgatcttactcgccttgccaatgatgacaatgccagtctgcttgattgggtcaaagagttgctcaaggagaagaaacttgagaatctggttgatgacgatctaaatgacaactacatcgatgttgaggtggaatccctgctccagatcgcgctcctctgcacgcagacggatcccacagaacgtcctaagatgtcagaggtggtgacaatgcttgaaggcgatggtggcctcgctgagagatgggaggagtggctgaaggtagcagtagatcaggatgtcgagcatggttcacgtcgaacatcagattggattgtcgagtcagcctacaagctcagctcagttgagctttcagggccgaggtgatgatagcacacacacagcacactcatgacctgctgttaatatgttgcgatgtgtcgccatggacaccttatcctgagggcatcagagctcgaggagctagtgtcgtgtgcagttgttgcatctttacttcgaccgggtatagggccgttacaatgttttgggggccctggtgcaaaacaaaaaaattaggccc

SEQ ID NO: 30712 - protein, 493 aa, Panicum virgatum
  misc_feature: Ceres CLONE 1901445
  misc_feature (169)..(444): Pfam Name: Pkinase Pfam Description: Protein kinase domain
  misc_feature: SWISSPROT Homolog: EC 2.7.11.1 Non-specific serine/threonine protein kinase
  misc_feature: Useful for making plants with modulated nitrogen use efficiency
MLPHNNLENLNVDGCHKIDAMPGWTANFPKLHPKCLQTCDQQIRCLIPEQQVCLSDNEVEIIKELNVCVHDGTEEAIASQSCQAGNSERITKEVFENSSARTSHNVPQHPTIPTGSSSSSTGVIGFACWPRRKPKKHFSNVPAKEDPEGHLGQLKKFSLRELEVATDGFSDKNSLGRGGFGKVYKGRLADGSLVAVKRQKQEITPGAGELQFQAEVDILCTVEHRNLLRLRGFCMTPTERLLVYPYMANGSVASRLRERPGSEPPLDWQTRRRIALGSAKGLSYLHDQCDPKIIHHDVKAANILLDEDFEAVVGDFGLAKLMDYKDAHVTTPVSGTMGHIAPEYHSTGKSSEKTDVFSYGIMLLELVTGQRVLDLTRLANDDNASLLDWVKELLKEKKLENLVDDDLNDNYIDVEVESLLQIALLCTQTDPTERPKMSEVVTMLEGDGGLAERWEEWLKVAVDQDVEHGSRRTSDWIVESAYKLSSVELSGPR

SEQ ID NO: 30713 - DNA, 721 bp, Panicum virgatum
  misc_feature: Ceres CLONE 1901455
  misc_feature: Encodes the peptide sequence at SEQ ID NO. 30714
aagccgcactgcctccccgagtcctccactgccaccgcccgctccgcgacgcgatggccgcgctccgcctcgcctccttcaccctccgcccggcctccgcggcggtatccccctcctccggcgcggcgccgcggtccgcctccttcgccagtgcggcgcgggggctcccctcgctccgcctggccccgccccgccgccgcggggacctcgccaggccccgcgccgcggcggagggctacgcgaccgcgctgtccgaggtggccgccgagaacggcaccctcgagaagaccgtgtccgacatggagaagctggagaagatcttcgccgacgaggccgtcgccgagttcttcgacaaccccaccgtgccgcgcgaggtgaaggcccagctcatcgacgagatcgccaagtcgtccgagctgcagccgcacgtcgtcaacttcctcaacgtcgtcgttgacaacttccgcgcgggcatcgtgccgcagatcgtcgccgagttcgagaacgtctacaacgcgctcagcggcactgagctcgccaccgtcacctccgtcgtgcagctcgaatcgcaggacctcgcgcagatcgcgcagcacgtccagaagatgaccggcgccaagaacgtccgcctcaagacacagctcgacccggagctcatcgccggcttcaccgtgcagtacggccgcgacggatcccacctcatcgacatgagcgtccggaa

SEQ ID NO: 30714 - protein, 222 aa, Panicum virgatum
  misc_feature: Ceres CLONE 1901455
  misc_feature (58)..(222): Pfam Name: OSCP Pfam Description: ATP synthase delta (OSCP) subunit
  misc_feature: SWISSPROT Homolog: EC 3.6.3.14 H(+)-transporting two-sector ATPase
MAALRLASFTLRPASAAVSPSSGAAPRSASFASAARGLPSLRLAPPRRRGDLARPRAAAEGYATALSEVAAENGTLEKTVSDMEKLEKIFADEAVAEFFDNPTVPREVKAQLIDEIAKSSELQPHVVNFLNVVVDNFRAGIVPQIVAEFENVYNALSGTELATVTSVVQLESQDLAQIAQHVQKMTGAKNVRLKTQLDPELIAGFTVQYGRDGSHLIDMSVR

SEQ ID NO: 30715 - DNA, 723 bp, Panicum virgatum
  misc_feature: Ceres CLONE 1901464
  misc_feature: Encodes the peptide sequence at SEQ ID NO. 30716
aagcatctccattggttgactttcgagtttgctgagcagcaaggataaggacgggcgcatactgcatggagcatacagcaagcagccttatcctaaattcctaatccgtgctaacacaaattctcctcaggtgctcttggttctctgggatgatgaggcgcaggcagctcttgctggcgactgcctgcttgtgggctctgtcgtgcgccccgctgttccgtgcttccacccctgacggacttctcagggtcggcctgaacaagaacaagctcaaccgcgaggcgctggccgcggccaaggttgaaaggcagcacgacagccgccgcctgagggccgccggcgccgacgaggtccctctcatcgactacctcaacacccagtacttcggggtcgtcggcatcggcacgccgccgcagaacttcaccgtcatcttcgacaccgggagctccaacctctggatcccctcctccaaatgctatttctcgatagcatgttacttccaccacagatacaggtccggcaagtctagcacttacaaggctgatggtgaggcttgcgaaattacttatggctctggatcaatttccgggttcttcagcaaggataacgtgctggttggagaccttgttgttaaaagccagaagttcattgagactactcgcgaacccagtttctcattcatcctttgggagtttgatggcattcttggtcttggataccctg

SEQ ID NO: 30716 - protein, 191 aa, Panicum virgatum
  misc_feature: Ceres CLONE 1901464
  misc_feature (77)..(191): Pfam Name: Asp Pfam Description: Eukaryotic aspartyl protease
  misc_feature: SWISSPROT Homolog: EC 3.4.23.40 Phytepsin
MMRRRQLLLATACLWALSCAPLFRASTPDGLLRVGLNKNKLNREALAAAKVERQHDSRRLRAAGADEVPLIDYLNTQYFGVVGIGTPPQNFTVIFDTGSSNLWIPSSKCYFSIACYFHHRYRSGKSSTYKADGEACEITYGSGSISGFFSKDNVLVGDLVVKSQKFIETTREPSFSFILWEFDGILGLGYP

SEQ ID NO: 30717 - DNA, 689 bp, Panicum virgatum
  misc_feature: Ceres CLONE 1901468
  misc_feature: Encodes the peptide sequence at SEQ ID NO. 30718
tctacagaaggttgtgaaacctttaaagggtcatctcgagcttttgatcccaacaggtggtctaaatgtccatcggccttcagatgaaccgtgctggtccattattgcacataatcttgaagatgttgggaaattcttcaaagatactatcgataacagagacgagggcattatactgaaggaccttgattccaaatgggagcctggtgatcgaaatggaaagtggcttaaactaaagcctgattatatacacgctggtgctgatcttgatgttattattataggaggatactatggatctggacgtcgaggaggagaggttgcacagtttttagttggccttgcagtgccttcagatgataacagttatcccaaaagatttctttccttttgccgggttggcactggcctctctgatgaagagcgtgatgctcttgtcaccaaactgaagccttatttcaggaaaaatgagtacccccaaaaacctcccaaattttatgaagttacaaataactcaaaggagaggccagatgtttggatagatagccctgataagtcagtcataatgtctgtgacaagtgacattcgtacaatcaagtccgaggtatttgctgctccatactgtttgagattcccccgtattcagagagtgagatatgataagccatggcatgagtgccttgatgttc

SEQ ID NO: 30718 - protein, 229 aa, Panicum virgatum
  misc_feature: Ceres CLONE 1901468
  misc_feature (103)..(180): Pfam Name: DNA_ligase_A_C Pfam Description: ATP dependent DNA ligase C terminal region
  misc_feature: SWISSPROT Homolog: EC 6.5.1.1 DNA ligase (ATP)
LQKVVKPLKGHLELLIPTGGLNVHRPSDEPCWSIIAHNLEDVGKFFKDTIDNRDEGIILKDLDSKWEPGDRNGKWLKLKPDYIHAGADLDVIIIGGYYGSGRRGGEVAQFLVGLAVPSDDNSYPKRFLSFCRVGTGLSDEERDALVTKLKPYFRKNEYPQKPPKFYEVTNNSKERPDVWIDSPDKSVIMSVTSDIRTIKSEVFAAPYCLRFPRIQRVRYDKPWHECLDV

SEQ ID NO: 30719 - DNA, 704 bp, Panicum virgatum
  misc_feature: Ceres CLONE 1901480
  misc_feature: Encodes the peptide sequence at SEQ ID NO. 30720
atcagttccgtcttctcctccccgcctcccgtctcctctccggccggccgacgtcttcccttgcttgctggtcactcaattgattttagactcaagatggcggtcgtttcgtcaaatgtcaactccgaggcaggccttcaaaagcttaacgattacctcctcactcgcagttacataaccggataccaagcttcaaaggatgacatggccgtcttcactgcattgtcatcggctcccccatcgagctatgtcaatgttacaaggtggtacgatcatatcattgctctccttaggtccagtggagtcactgcagaaggtgaaggtgttaaggttgagtcatctgcttgttctatggcttcaactcctcgagttgctgaccaaaagccatcgacagctgatgaagatgatgatgatgatgttgacctatttggtgaggagactgaacaggagcgtgcagcagctgaagcacgtgtagaagctgttaaagcttctggcaagaagaaagagtctgggaagtcatcacttcttctagatgtgaagccatgggacgatgaaactgacatgcaaaaacttgaggaagctgttaggagcgtgaagatggaaggtctactctggagtgcatcaaaacttgttccagttggatatggcatcaagaagatgcaaattatgatgaccattgtggatgaccttgtttctgtcgacag

SEQ ID NO: 30720 - protein, 202 aa, Panicum virgatum
  misc_feature: Ceres CLONE 1901480
  misc_feature (140)..(202): Pfam Name: EF1_GNE Pfam Description: EF-1 guanine nucleotide exchange domain
  misc_feature: SWISSPROT Homolog: EC 6.1.1.16 Cysteine--tRNA ligase
MAVVSSNVNSEAGLQKLNDYLLTRSYITGYQASKDDMAVFTALSSAPPSSYVNVTRWYDHIIALLRSSGVTAEGEGVKVESSACSMASTPRVADQKPSTADEDDDDDVDLFGEETEQERAAAEARVEAVKASGKKKESGKSSLLLDVKPWDDETDMQKLEEAVRSVKMEGLLWSASKLVPVGYGIKKMQIMMTIVDDLVSVD

SEQ ID NO: 30721 - DNA, 1628 bp, Panicum virgatum
  misc_feature: Ceres CLONE 1901488
  misc_feature: Encodes the peptide sequence at SEQ ID NO. 30722
gccttccagttccctgccgagctgccccgaggccccgacctctctttcgcttcttctccccccactgcgcgagcccaaacaaaacgcaacgcgaacgtgacgagagccacaccagcgcacgcgccccgtcccgctcggcgctccctccctctcctcccgtccgcgtctcctccgccgcgcacgacagagggcgcgatgaggccgggcgggccgcccaactcgcgggcgctgcagccgccgcagcagccgggcacgccggggcggtcgcgccggcgcccggatctcacgctgccgctgccgcagcgagacctgacctcgctcgcggtgccgctgccgctgccgctcccgccgtcctcggcgccgtcgtccacgtcgtcgtctggggccatgtcggggccggcgtcgctcggcgcgcccaccccgccgacctcggccggctccgcgccgccgaacccgccgccgctgtgcgagctggagcgcgtgcgccgcatcgggagcggggccggcgggacggtctggatggtgcgccaccgccccacgggccgcgcctacgcgctcaaggtgctctacggcaaccacgacgacgccgtgcggcggcagatcacgcgcgagatcgccatcctccgcaccgccgagcacccggccgtcgtgcgctgccacggcatgtacgagcaggccggcgagctccagatcctgctcgagtacatggacggcggctccctcgagggccaccgcatcaccgacgagggcttcctcgcgcacgtggcgcgccaggtgctctccggcatcgcctacctccaccggcgccacatcgtgcaccgcgacatcaagccctccaacctcctgatcgactccggccggcgcgtcaagatcgccgacttcggcgtggggcgcatcctgaaccagaccatggacccctgcaactcctccgtgggcaccatagcgtacatgagccccgagcgcatcaacaccgacctcaacgacggcgcctacgacgggtacgccggcgacatctggagcttcggcctcagcatcctcgagttctacctgggccgcttccccctcggcgagaacctcggcaagcagggcgattgggccgcgctcatgtgcgccatctgctactccgactcgccgcaggcgccgcgcaccgcctcgccggacttcaagaacttcatcagcctgtgcctccagaagaacccggcgaaccggccgtccgcgatgcggctgctgcagcacccgttcgtggcccagccccaggcgcagccgcagcccctggccgccccgccgccgtcatgatgactcgccacaaatccacaattcccaccgattgattggttcccgtcctgatccgaccgggtggattgatcacggatggaaggttggttgcctgattggttggcaggcaatgagatgtgggatctaggggcgttcccccctagccattttgggaattcaagccgccgccacagcaaccaccatcaccacatcatccattgttgtcgcagttgctccaggaattaagttcgcgtctttttagcacttgtttctttttttttctctctcccctctttctctacctcaatgttgttcatggtcctccagatgataatcatataatatgggttgtt

SEQ ID NO: 30722 - protein, 366 aa, Panicum virgatum
  misc_feature: Ceres CLONE 1901488
  misc_feature (93)..(350): Pfam Name: Pkinase Pfam Description: Protein kinase domain
  misc_feature: SWISSPROT Homolog: EC 2.7.12.2 Mitogen-activated protein kinase kinase
MRPGGPPNSRALQPPQQPGTPGRSRRRPDLTLPLPQRDLTSLAVPLPLPLPPSSAPSSTSSSGAMSGPASLGAPTPPTSAGSAPPNPPPLCELERVRRIGSGAGGTVWMVRHRPTGRAYALKVLYGNHDDAVRRQITREIAILRTAEHPAVVRCHGMYEQAGELQILLEYMDGGSLEGHRITDEGFLAHVARQVLSGIAYLHRRHIVHRDIKPSNLLIDSGRRVKIADFGVGRILNQTMDPCNSSVGTIAYMSPERINTDLNDGAYDGYAGDIWSFGLSILEFYLGRFPLGENLGKQGDWAALMCAICYSDSPQAPRTASPDFKNFISLCLQKNPANRPSAMRLLQHPFVAQPQAQPQPLAAPPPS

SEQ ID NO: 30723 - DNA, 2672 bp, Panicum virgatum
  misc_feature: Ceres CLONE 1901500
  misc_feature: Encodes the peptide sequence at SEQ ID NO. 30724
ataatcgcactcgcggagcgggcacgccgacggccgcccgcccgccctcggagattcagctgtcggaccccgtctcaggaatcgccgattacacctgaactacagttctgccagtcctgtggctttctgtcctatgcatgccattcatctatcgatcgtagctacctacatgcatgtgccaggcactgctatcatcgtggttccaagttctaattgttacacctttgataacgagagccgccttattgattttacacatctggtcggaaaggaatatgaatacaatgaacagggttcagaaccgcctgatttggttgttgagttctgcaaagatgtgcagagaagatctcaaaagggttacattgaatttggacgttttgttagttctcgctcctttctgcttggttcagggcctactgactatattcagaaattccatgatggagatttagtgcactgtgaaactacatttgaaaagatgggtcgtacagcacaggtaaacatcatatgtggacattgctcaaataatgcgtgaagagatgaacaaggatgcatttgtagcatatcttatgatgaaaggatgtgcagggtgcttgttgaacttgctattccttgtgttaaaagtggtccaagagtattcaagggtttcactgtgggattccatcccagatcatcagaaattgtttataatggattgactcagctgggatttgagcaactccatcatggctttagctttcaaactgagcagattcatgtgtccctgtatcttactgctatgtcttccctcgcagaactggttggaaaacctaccttcaaggttaatccagtgaaagggcttagtgttacaattacaggatcagggctcaatggtgccatgcctactaccctgtctcctacagttctgaatgtggattggagatgtgaaattgctcgaagcagtccgtatgaagtcaatattttgatcccagttgagggctatgatccaattgagtttacacttaccaaagaatgtgtttatgcacaagaaaaaggagagagagagggagcgccctgccaaaggaagaagccgcggcgagaggaggagagggaggaggaacggcggagggcgagcgagatgagagagatcatcagcatccacatcggccaggccgggatccaggtcggcaacgcctgctgggagctctactgcctcgagcacggcatcgagcccgatggcaccatgcccagtgatacctcggttggcgttgcacatgatgccttcaacaccttcttcagcgagaccggttctggcaagcatgtgccgagggctatctttgtcgatcttgagcccactgtcatcgacgaggtgcgcactggctcgtaccgccagctcttccatccagagcagctcatctccgggaaggaggatgcggctaacaactttgcccgtggccactacactgttgggaaggagattgtcgatctatgccttgaccgtgttcgcaagctagcagacaattgcactgggctgcagggattcttggtcttcaatgctgttggtggtggtactggttctggacttggttcactcctgttggagcgcctctcagttgattatggcaagaagtccaagctcgggttcaccatctatccttccccacaggtgtcaacagctgttgtagagccatacaacagtgtcctctcgacccactccttgcttgagcacacagatgttgcagtcctcctggacaatgaggctatctatgacatatgccggaggtcccttgacattgaaaggccaacctatactaacttgaacaggctgatctcacagatcatatcttcgcttaccacctccctgaggtttgatggcgctatcaacgtggatgttacagagttccagaccaaccttgttccatacccacgtatccatttcatgctttcatcatatgcccccgttatctctgctgagaaggcctaccatgagcagctctctgtgcctgaaatcaccaatgctgtctttgagccctcaagcatgatggccaagtgtgacccaaggcatgggaagtacatggcttgctgcttgatgtaccgtggtgatgtagttccgaaggatgtcaatgctgcagttgcaaccatcaagaccaagcgaactgtccagtttgtggactggtgccccactggtttcaagtgtggcatcaactaccagccacccactgttgtccctggaggcgacctggcaaaggtccagcgtgccgtgtgcatgatcagcaacaacacagccgttgccgaggtgttctctcgcatcgaccacaagttcgacctgatgtacgccaagcgtgcgttcgtgcactggtacgttggtgagggtatggaggaaggcgagttctcggaggcccgtgaggacttggctgcccttgagaaggactacgaggaggttggcgcagagggcgcggatgatgaaggcgacgagggagaagactattgagtagctggttaataagtagttcgcggttggttaatggtttgggttgtcgagtatactctgcatggttccattccattgcgtactgctgccgtgtgtgtttccattttgtgttatgtggtaaattgttcgtagcccccggttggccatgattgttcatatcatcttgctttggtttgcaatgctattcgtccaagttcggtgt

SEQ ID NO: 30724 - protein, 629 aa, Panicum virgatum
  misc_feature: Ceres CLONE 1901500
  misc_feature (228)..(425): Pfam Name: Tubulin Pfam Description: Tubulin/FtsZ family, GTPase domain
  misc_feature (427)..(572): Pfam Name: Tubulin_C Pfam Description: Tubulin/FtsZ family, C-terminal domain
  misc_feature: Useful for making plants with altered cell wall content and/or composition
MCRVLVELAIPCVKSGPRVFKGFTVGFHPRSSEIVYNGLTQLGFEQLHHGFSFQTEQIHVSLYLTAMSSLAELVGKPTFKVNPVKGLSVTITGSGLNGAMPTTLSPTVLNVDWRCEIARSSPYEVNILIPVEGYDPIEFTLTKECVYAQEKGEREGAPCQRKKPRREEEREEERRRASEMREIISIHIGQAGIQVGNACWELYCLEHGIEPDGTMPSDTSVGVAHDAFNTFFSETGSGKHVPRAIFVDLEPTVIDEVRTGSYRQLFHPEQLISGKEDAANNFARGHYTVGKEIVDLCLDRVRKLADNCTGLQGFLVFNAVGGGTGSGLGSLLLERLSVDYGKKSKLGFTIYPSPQVSTAVVEPYNSVLSTHSLLEHTDVAVLLDNEAIYDICRRSLDIERPTYTNLNRLISQIISSLTTSLRFDGAINVDVTEFQTNLVPYPRIHFMLSSYAPVISAEKAYHEQLSVPEITNAVFEPSSMMAKCDPRHGKYMACCLMYRGDVVPKDVNAAVATIKTKRTVQFVDWCPTGFKCGINYQPPTVVPGGDLAKVQRAVCMISNNTAVAEVFSRIDHKFDLMYAKRAFVHWYVGEGMEEGEFSEAREDLAALEKDYEEVGAEGADDEGDEGEDY

SEQ ID NO: 30725 - DNA, 613 bp, Panicum virgatum
  misc_feature: Ceres CLONE 1901505-R
  misc_feature: Encodes the peptide sequence at SEQ ID NO. 30726
gatcaaagcatgggaagagaatgagaagacaaaagctgagaacaaagctgttaaaaaaatatctgctattctttcatgggagaactcaaagaaagcgaacatagaagctgaactgaagaaggttgaggagcaactggaaaagaagaaggctgaatacgccgagaagatgaagaacaagatcgcaatcatccacaaggaagccgaagagaagcgggcaatggtcgaagcaaaacgcggcgaggaggtcctgaaggctgatgagatggctgccaagtaccgcgccaccggccacgctcccaagaagctcattggatgctttggagcctaagaaacgtcccgagtaacaccaagcagaaagtgaataacgtcaatccgtgattgcttggttctctcgctctatcaagtgtgtagtttgtcttcaaaagtgtgtaaagcctaccgttgctgtatatacgcatattccttcaaagacaggcgtttggtggtggtgtacatgttgaatgcttgacgagcaacattcttatgtgtagttaagaagtcacattgttgttgttgttgacatttaagcagacatttttttcttttcctagtgttattgctatttttttgtctc

SEQ ID NO: 30726 - protein, 108 aa, Panicum virgatum
  misc_feature: Ceres CLONE 1901505-R
  misc_feature (1)..(103): Pfam Name: Remorin_C Pfam Description: Remorin, C-terminal region
  misc_feature: The sequence is a functional homolog of SEQ ID NO 1773 in the 11/479,226 US patent application
  misc_feature: The sequence is a functional homolog of SEQ ID NO 20 in the 10/286,264 US patent application
  misc_feature: The sequence is a functional homolog of SEQ ID NO 876 in the 10/412,699 US patent application
  misc_feature: The sequence is a functional homolog of SEQ ID NO 1492 in the 11/479,226 US patent application
  misc_feature: The sequence is a functional homolog of SEQ ID NO 644 in the 11/435,388 US patent application
  misc_feature: The sequence is a functional homolog of SEQ ID NO 716 in the 10/412,699 US patent application
  misc_feature: The sequence is a functional homolog of SEQ ID NO 438 in the 10/666,642 US patent application
  misc_feature: The sequence is a functional homolog of SEQ ID NO 496 in the 11/435,388 US patent application
IKAWEENEKTKAENKAVKKISAILSWENSKKANIEAELKKVEEQLEKKKAEYAEKMKNKIAIIHKEAEEKRAMVEAKRGEEVLKADEMAAKYRATGHAPKKLIGCFGA

SEQ ID NO: 30727 - DNA, 1327 bp, Panicum virgatum
  misc_feature: Ceres CLONE 1901505
gggagttcctctccgccggagtcgcacgccggttcaaggcagtcgacctcgacggagagagaagtgcgttcttctcctcaggctcagtcggcttcagccttaggtcgagccagaaagcgacaagggcattcctgcgcgcgggagttggtcgccggttcgggagagccaacctcgacggcgagagaagcgcgtccttcacccccagctccgtcggctgccgttttaggtaaacctcttacccgcgccatcctcctcaatcctaccgacgtcagatggcaaatctggactagtttagcgaggatagcaaaagaaaccctagggcatcgggtagggttacagtggtcgccgtggatctacgactccacatttgatggcggaatggagaaattgcagattttggactccaaacattgtgcttctcatatttaccattagaaacatcaacttcgaaaatttgggactccaaacgtgtgcacagcgaccttgacgctgatccaccctgagcgcactcccaagccagcagctcggccaccgggcgcgcgcgccggctctgcatcacgcgctgcacgccggcccaagtcaccggcaggatgtgctaattttctcgtcgggatgtgctaattttttccctacgtttcccccttgcaatcctctggttgccttgcaatcctctgcttgcctgagtttgctttacttctttgggtttgcgcatccgagagggatgcagtggtcgccgagtctatgactgacttcatgtttgatgtctgaatgggctattttggtacgtacgttttcccttgcaatcctgcttggcttagtttgcttgccttctatgttcgcagctgacaggttgggccataatggtatcattctgctgctgtttgagacgccctctggcttcgcaattttcaaatattatggcgtccaactcttcctaccaaatgctaaggaggtacttgctttattctttctctattttcatgttttatagtcattgcttgcttattcctctttgtaccgacctattttttctgtatcttgtttcctgcagaatatctggtcaaagttcataaataatgataagacacgccttgtcagtgccctttctcctctcctgtttgtcgtgtctttaagttgtttttcaccaatttaatccgagcagcaaccttggaccgtcatgagcttatgattgcctcctgttgtattgcaatatacctatttttagctacacactaggacaagcactaattatgcaaattgcagtaacttgcttttcctgtccctttttttaaggcagtacaatttatgcctgagattgtacctacta

SEQ ID NO: 30728 - DNA, 785 bp, Panicum virgatum
  misc_feature: Ceres CLONE 1901515
  misc_feature: Encodes the peptide sequence at SEQ ID NO. 30729
accgtccagtccagccaccgcccgccacccgcctcccatgccgtcagcttccctccgcctcgccgtcatcggcgcgggcgcggcggggctagccgccgcccgcgagctccgccgcgagggccacgcgcccgtcgtcttcgagcgcgccgccgccgtggggggcacctggctctacgcgccccccgccacgccctccgacccgctcggtgccgccgcgacgcactccagcctctacgcctcgctccgcaccaacctgccccgcgagaccatgggcttcctcgacttccccttcgccgcggaggcgcccggctccgccgaccaccgcaggttccccgggcacgaggaggtgctccggtacctggaggcgttcgcgcggcggttcgatctgctccggctcgtccggttcgagacggaggtgctcagggtgcggagggaggaccgcgggggatgggcggtgacgtctaggaagcttggggacaagggaagcggcgatgaggaggtgtacgacgccgtcgtggtttgcaacgggcactacacggagccgcgcatcgccgtcattccaggtgtagacgcttggccagggaagcagatgcatagccacaattaccgtgtgcccgagccattccttgatcaagtagtgatcataatcggggcttcagcaagcgcagttgacatttcaagagacgttgcaagcactgcaaaagaggtccatattgccgataggtcagcaccagttcgcacctgtgagaagcagcctggctacaataatctgtgggcttcattcc

SEQ ID NO: 30729 - protein, 249 aa, Panicum virgatum
  misc_feature: Ceres CLONE 1901515
  misc_feature (7)..(249): Pfam Name: FMO-like Pfam Description: Flavin-binding monooxygenase-like
  misc_feature: SWISSPROT Homolog: EC 1.14.13.8 Flavin-containing monooxygenase
  misc_feature: Useful for making plants with modulated biomass
  misc_feature: Useful for making plants with modulated flowering time
MPSASLRLAVIGAGAAGLAAARELRREGHAPVVFERAAAVGGTWLYAPPATPSDPLGAAATHSSLYASLRTNLPRETMGFLDFPFAAEAPGSADHRRFPGHEEVLRYLEAFARRFDLLRLVRFETEVLRVRREDRGGWAVTSRKLGDKGSGDEEVYDAVVVCNGHYTEPRIAVIPGVDAWPGKQMHSHNYRVPEPFLDQVVIIIGASASAVDISRDVASTAKEVHIADRSAPVRTCEKQPGYNNLWASF

SEQ ID NO: 30730 - DNA, 525 bp, Panicum virgatum
  misc_feature: Ceres CLONE 1901529-R
  misc_feature: Encodes the peptide sequence at SEQ ID NO. 30731
ctaccgtgaacgttttggccatgacatagatcttgacacaaatgagctggttctacgcgatcaaccggaagaagtgatcctgctgaaagtcaacaacaaggtcccagggcttgggctccaactcgatgcttcagaactcaacctgctttaccgggataagtacgacaccgaggttccagattcatatgagcatcttctcctggatgtgctagatggtgacagtcatctattcatgcgcagcgatgaactagcagctgcatggaacgtgctgaccccggtaatccatgagatcgatcagaacagagtggctcctgagctctacgaggctggagataaagggcctatcaatgcttactatctagctgctaaacatggtgtgcgatgggatgacgactggtgagctaacccagcacagatgctcgatgtatgagatctacctccaatctttgttgttgtatcgtatcgcagtcaatgatgtacagtacgccttctgttataaacggtctgatcaagactttcaagcag

SEQ ID NO: 30731 - protein, 132 aa, Panicum virgatum
  misc_feature: Ceres CLONE 1901529-R
  misc_feature (1)..(131): Pfam Name: G6PD_C Pfam Description: Glucose-6-phosphate dehydrogenase, C-terminal domain
  misc_feature: SWISSPROT Homolog: EC 1.1.1.49 Glucose-6-phosphate 1-dehydrogenase
YRERFGHDIDLDTNELVLRDQPEEVILLKVNNKVPGLGLQLDASELNLLYRDKYDTEVPDSYEHLLLDVLDGDSHLFMRSDELAAAWNVLTPVIHEIDQNRVAPELYEAGDKGPINAYYLAAKHGVRWDDDW

SEQ ID NO: 30732 - DNA, 687 bp, Panicum virgatum
  misc_feature: Ceres CLONE 1901529
gcgccgcgcagtagggaggttcggttcggggtgccccgtggattgttctaggcagatgagaacaaggggcgggccgatccttgatcctgcttttgtgcaagcggagcagcggggcgcgtgcaggggcactccgatccgctccctttgcaggctgactctcttccttcccgcatttcagtacttgtccacgcgaccaacgattcaacgaagggagcaggcaagtgctgcaggagcaagcaggcgactaagcgagcagtgccgggccgcccaaagatggcagggctggccgtggcggcgtccgcagcaacggtggcgctcttccagttccagccctcgctgtccggatcgcgcttcgccccggttgcagcacctgctgccagtttcagaacgcaagcatgtggattgaggtgctggattgctgcaaagttgaagctccggaaggcattgaaaaggcatggatggcatcttcaaagaaatctagatgctcgaaggaatgataaacttcctgatcacttggaggctgcattgctgactgaaaacagaacccatcggaacatgcatcatgcttatgattctggaggtgaaatggccagtgcaagctctgtttttttggatggttcttcaatgcaacaaggacccaatccatctgaaatccgttcccctgtgctaaatgaagagtcttccatg

SEQ ID NO: 30733 - DNA, 733 bp, Panicum virgatum
  misc_feature: Ceres CLONE 1901541
  misc_feature: Encodes the peptide sequence at SEQ ID NO. 30734
tctgctcctcgcgccgccgccgccgccgccgcgatggcttccgccgcggtgctccggaacgccggctcccgccgtctcttctcctacccgatcctccgcgccgccacgatctcggcgcccgccgctctccccgatgcgcccgccgcggcggcggcgccgacccagccgcaaccgatggccgggaccctctgggcgaggtccatggccaccttcacgcggacgaagccccatgtaaacgtcggtaccattgggcacgtcgatcacggcaaaaccactctcactgctgccattaccaaggttctagccgaggcggggaaagccaaagccatcgcttttgacgagatcgacaaggctccggaggagaaagcgagaggaatcaccatatctacggctcatgtggagtatgagacggctaaaaggcattatgctcatgtggattgcccaggacacgctgattatgtcaagaacatgatcactggagctgctcaaatggatggcggtattcttgtcgtgtcagcacctgatggcccgatgccacaaacaaaggagcatattcttcttgctagacaggttggtgtaccttcacttgtgtgcttcttaaacaaagttgatgctgtcgatgatccagagttgctcgaacttgtagagatggagcttcgtgagctcctcagtttctataagtttccaggtgatgagattccgatcatccgtggatctgccttgtcagcattgc

SEQ ID NO: 30734 - protein, 233 aa, Panicum virgatum
  misc_feature: Ceres CLONE 1901541
  misc_feature (64)..(233): Pfam Name: GTP_EFTU Pfam Description: Elongation factor Tu GTP binding domain
  misc_feature: SWISSPROT Homolog: EC 2.7.7.4 Sulfate adenylyltransferase
  misc_feature: Useful for making plants with modulated oxidative stress sensitivity
MASAAVLRNAGSRRLFSYPILRAATISAPAALPDAPAAAAAPTQPQPMAGTLWARSMATFTRTKPHVNVGTIGHVDHGKTTLTAAITKVLAEAGKAKAIAFDEIDKAPEEKARGITISTAHVEYETAKRHYAHVDCPGHADYVKNMITGAAQMDGGILVVSAPDGPMPQTKEHILLARQVGVPSLVCFLNKVDAVDDPELLELVEMELRELLSFYKFPGDEIPIIRGSALSAL

SEQ ID NO: 30735 - DNA, 675 bp, Panicum virgatum
  misc_feature: Ceres CLONE 1901551
  misc_feature: Encodes the peptide sequence at SEQ ID NO. 30736
aagcagaggcctcagctccctgcatctgccacctccactctctccctcctcccactgaatcattcgtcttttgaacatttttttgtgctctctaggcaaaagagcacacttgactcttgcagctccagtctctctctctctctctcgctcttactccattggaggttggagccatggcgatgccagctccggtgagctgctccagcagggcactggccatggtgctcgtgctcgtcgctacggcgctgtgctgccgcctgggctcttgcgacggagctgccgccgacaggatcaggcggctccccgggcagccggaggtgagcttcgcccagtactccggctacgtcgccgtggacgacgccggcaagagggcgctcttctactacttcatcgaggccgaggtcgaccctgcctccaagcctctcgtcctctggctcaatggaggccccgggtgttcttcactgggtgtaggggccttctcggagaacggccccttcagacctagtgggcaggtgctggtgaagaatgaatacagctggaacaaagaggccaatgtgatttacctggagacgccggctggtgtaggctactcctactctgctgatgctgcctactaccagggcgtggatgacaagatgacagccacggacaacatggtgttcctgcaaaggtggc

SEQ ID NO: 30736 - protein, 167 aa, Panicum virgatum
  misc_feature: Ceres CLONE 1901551
  misc_feature (44)..(167): Pfam Name: Peptidase_S10 Pfam Description: Serine carboxypeptidase
  misc_feature: SWISSPROT Homolog: EC 3.4.16.6 Carboxypeptidase D
MAMPAPVSCSSRALAMVLVLVATALCCRLGSCDGAAADRIRRLPGQPEVSFAQYSGYVAVDDAGKRALFYYFIEAEVDPASKPLVLWLNGGPGCSSLGVGAFSENGPFRPSGQVLVKNEYSWNKEANVIYLETPAGVGYSYSADAAYYQGVDDKMTATDNMVFLQRW

SEQ ID NO: 30737 - DNA, 734 bp, Panicum virgatum
  misc_feature: Ceres CLONE 1901610
  misc_feature: Encodes the peptide sequence at SEQ ID NO. 30738
acctggccaccttcccatcttgtgcgcgcgcgggtacctgcagcgactgacggggagcaatggagaaggccatcgacaggcagcgggtcctgctgcggcacctcgaccccgcggcgccgggccccgcccagcccgccatctccgcgagcgcgtgcgcggcgtaccaccggagggcggccttcgccgacgacgtcgtcatcgtcgctgcatacaggacggcgatttgcaaggccaagagagggggtttcaaggatacgttcgctgaggacctattggttcctgtcttcaaggctttagtagataaaacaaagctgaaccctagcgaagttggcgacatcgttgttggtactgtcttagctcctgggtcccagagggcaatcgaatgcagaatggcagcactgtatgctggtattcctgacactgttcctctgaagactgtaaacaggcaatgctcttctggccttcaggcagttgcagatgttgctgctgctattaaagcagggctgtatgatattggtattgctgctggcctcgagtccatgacagtgaacaaagttagtcttgacggtcaagtgaatcccaaagttgagctattttctcaagcacgtgattgccttctcccgatgggcctcacatctgagaatgttgcacaccgattcggcataacacgactggaacaagatcaagctgctgttgagtctcacagaaaggctgctgcagctgcagctgctggt

SEQ ID NO: 30738 - protein, 224 aa, Panicum virgatum
  misc_feature: Ceres CLONE 1901610
  misc_feature (42)..(224): Pfam Name: Thiolase_N Pfam Description: Thiolase, N-terminal domain
  misc_feature: SWISSPROT Homolog: EC 2.3.1.16 Acetyl-CoA C-acyltransferase
MEKAIDRQRVLLRHLDPAAPGPAQPAISASACAAYHRRAAFADDVVIVAAYRTAICKAKRGGFKDTFAEDLLVPVFKALVDKTKLNPSEVGDIVVGTVLAPGSQRAIECRMAALYAGIPDTVPLKTVNRQCSSGLQAVADVAAAIKAGLYDIGIAAGLESMTVNKVSLDGQVNPKVELFSQARDCLLPMGLTSENVAHRFGITRLEQDQAAVESHRKAAAAAAA

SEQ ID NO: 30739 - DNA, 683 bp, Panicum virgatum
  misc_feature: Ceres CLONE 1901615-R
  misc_feature: Encodes the peptide sequence at SEQ ID NO. 30740
aagttttcactgctatgggtaaaaccattgagtacaaaattggaactatgattgaaattcccagggcagctctagtggctgatgagatagcagagcaggctgaattcttctcttttgggacgaacgaccttacacagatgacgtttggctacagcagggatgatgtggggaagtttctccccatttatctttctcagggtatcctccaacatgatccctttgaggtgcttgatcagagaggagtgggcgagctggttaagtttgctacagagaggggacgcaaaactaggcctaacctgaaggtgggcatctgtggagaacatggtggggagcctcagtcagttgctttcttcgcaaaggctgggctggattatgtttcttgctcccctttcagggttccgattgctaggctggctgcagctcaggtgctcatctgagagcacctcctcatcggcaaccggatcgccagctcttggtgcatctggtgaagaataatcatacaggtccatgaaacggtggaaactctgctttctggcaaaggctgttgtatgtagtcttctctgtgtgcgcgcgcatgtaagccttaatgggtggtgttctgaatttcccttgaactggcatggtaatgtagtaccaaattaaacagcgatgatgacgaagagctatcgaatatattggcgatt

SEQ ID NO: 30740 - protein, 144 aa, Panicum virgatum
  misc_feature: Ceres CLONE 1901615-R
  misc_feature (1)..(144): Pfam Name: PEP-utilizers_C Pfam Description: PEP-utilising enzyme, TIM barrel domain
  misc_feature: SWISSPROT Homolog: EC 2.7.9.1 Pyruvate, phosphate dikinase
VFTAMGKTIEYKIGTMIEIPRAALVADEIAEQAEFFSFGTNDLTQMTFGYSRDDVGKFLPIYLSQGILQHDPFEVLDQRGVGELVKFATERGRKTRPNLKVGICGEHGGEPQSVAFFAKAGLDYVSCSPFRVPIARLAAAQVLI

SEQ ID NO: 30741 - DNA, 707 bp, Panicum virgatum
  misc_feature: Ceres CLONE 1901615
aacccgcaacccctccacctctcgcggctcgatggccgcctccgcctctcctgccgcatccccgccccgccgccgccacagccaccgcgacgacgactccccgcgccgccgcaagcgccgcgcgtccccatccccgccccgctcgccatccccaggcgccgacgtggatcgccgccgcagatctagagcttcaccgcccggtcccgaccgccgcggcggcggcggcggcgacgccaagccctccgaggagaaggagaacggccacgccaagcccggaagggatgaggagagcgacgaccgccctccccagcgtgctagggtttcgtatggggaagaggatggcgaccaccggaggcggcgcgctagggtttccgacgacgagaaggaggatggccggcggcggaggcgggctagggattcggatgaggagagggacgaccgccgcggcaagcgcgaccgggagagggacagccggcgccaccgccgccggagccccagcacggagtcgggatcctcacccgacgagcgccgccggcgccgccaccgacgagatgagggctctaggcggcgggatgaccgaaggcgccgggatgacgaccgtggcgagcgccggaggagccctgagaagagggagcggagaagccctgagaagaggaagccgacgccacccctgcccccacctccgccgctgctgccggagatgatcc

SEQ ID NO: 30742 - DNA, 1411 bp, Panicum virgatum
  misc_feature: Ceres CLONE 1901617
  misc_feature: Encodes the peptide sequence at SEQ ID NO. 30743
gagatccacactttcctccgatccctcccgggccaggccccctctctctctccaccgatcgctcttcgcccgccgggcgatccgatcgacgccgccatggacgtcgagtacgacgtcatcgtgctggggacggggctcaaggagtgcatcctcagcggcctcctctccgtcgaccgcctcaaggtgctgcatatggacaggaatgactactacggtggagactccacatcgctcaacctcaatcagctctggaaaaggttcaagggcgacgaaacaccccctgcacagataggagctagcagagactacaatgtcgatatggttccaaagtttatgatggcaaatggtgctctggtccgtgtactcattcacactggtgtcaccaagtacttgtccttcaaagctgtggatggaagctacgtcttcaacaagggaaagattcacaaggttccttctactgatatggaagctctcaagtctccactgatgggattgtttgagaagcgacgagcagggaaattcttcctttatgtccaagattataaggaaaatgacccaagcactcataagggttatgaccttacaaaactaactactaaacaacttatctcaaaatatggtttggatgataacactatagacttcatcggtcatgctgtggctcttcatagagatgacaactacctttcagaacctgcacttgacactgtaaagcggatgaagctttatgcagaatcggtggctcgttttcaaggaggatcaccatatatttatcccttgtatggcttaggagagcttccacagggttttgctcgactgagtgctgtctatggaggcacctatatgctgaataaaccagagtgcaaggtcgaatttgactccgaaggtaaagtctgtggtgttacatcagaaggagagactgccaaatgcaaaaaggttgtctgtgatccatcctacctacctgacaaggtcaaaaaagttggaaaagtttttcgggcaattgctatcatgagtcatcccattccaaatactgctgaatcgcactcagttcagattatactaccacagaagcagcttggccgtaaatcagacatgtatgttttctgttgctcctactctcataacgtcgcatcaaaggggaagttcattgcattcgtgtccgcacaagcagagactgataatctacagacagaactgaagcctgggatcgatcttcttgggccagtggatgagttattttttgacacatatgacagatatgaacctactaatgactcatcatcagacaattgttacatctcaacaagttatgatgctacaacacactttgaatccactgttatggatgtgctttccctttatacaaagataactgggaagatggttgatcttagcgtggatctaagcgctg

SEQ ID NO: 30743 - protein, 438 aa, Panicum virgatum
  misc_feature: Ceres CLONE 1901617
  misc_feature (1)..(438): Pfam Name: GDI Pfam Description: GDP dissociation inhibitor
MDVEYDVIVLGTGLKECILSGLLSVDRLKVLHMDRNDYYGGDSTSLNLNQLWKRFKGDETPPAQIGASRDYNVDMVPKFMMANGALVRVLIHTGVTKYLSFKAVDGSYVFNKGKIHKVPSTDMEALKSPLMGLFEKRRAGKFFLYVQDYKENDPSTHKGYDLTKLTTKQLISKYGLDDNTIDFIGHAVALHRDDNYLSEPALDTVKRMKLYAESVARFQGGSPYIYPLYGLGELPQGFARLSAVYGGTYMLNKPECKVEFDSEGKVCGVTSEGETAKCKKVVCDPSYLPDKVKKVGKVFRAIAIMSHPIPNTAESHSVQIILPQKQLGRKSDMYVFCCSYSHNVASKGKFIAFVSAQAETDNLQTELKPGIDLLGPVDELFFDTYDRYEPTNDSSSDNCYISTSYDATTHFESTVMDVLSLYTKITGKMVDLSVDLSA

SEQ ID NO: 30744 - DNA, 621 bp, Panicum virgatum
  misc_feature: Ceres CLONE 1901620
  misc_feature: Encodes the peptide sequence at SEQ ID NO. 30745
agatccgagcccgccgcgatccatggccgccacggcggcggcggcgcgcctcctcatcgtcctcgccgccttcctcggcgaggtgccgcgcggggcggacgcgctcaggtcgctaggcgtcgggggcgcgggcgcggcccacggcgacgcggccgtggacctcgacgcctccaacttcaccgccttcctccacgccgcgccggagtcgttcgcggtcgtcgagttcttcgcccactggtgtccagcctgcagaaactacaagcctcactatgagaaggttgcaaaacttttcaatggtccagatgctgcacatccagggattattgtgatggcacaggttgattgtgcatcaaaggtgaacgtggatctttgcaataaattctctgttgatcattatcctttcctagtgtggggtccaccagcaaaatttgattcccctcagtggaaaccgaagcaagagaatagtgagttagaattaattgatgatggacgaacagcagagcgtttacttaaatggataaataagaagatgggaagctctttcagtttagatgacaaaaagtatgagaatgaaagtgcgctcccaaaaaatgcttcagatcctgaacagattgtccgagg

SEQ ID NO: 30745 - protein, 199 aa, Panicum virgatum
  misc_feature: Ceres CLONE 1901620
  misc_feature (43)..(169): Pfam Name: Thioredoxin Pfam Description: Thioredoxin
  misc_feature: SWISSPROT Homolog: EC 5.3.4.1 Protein disulfide-isomerase
MAATAAAARLLIVLAAFLGEVPRGADALRSLGVGGAGAAHGDAAVDLDASNFTAFLHAAPESFAVVEFFAHWCPACRNYKPHYEKVAKLFNGPDAAHPGIIVMAQVDCASKVNVDLCNKFSVDHYPFLVWGPPAKFDSPQWKPKQENSELELIDDGRTAERLLKWINKKMGSSFSLDDKKYENESALPKNASDPEQIVR

SEQ ID NO: 30746 - DNA, 663 bp, Panicum virgatum
  misc_feature: Ceres CLONE 1901627
  misc_feature: Encodes the peptide sequence at SEQ ID NO. 30747
gtgaaagctttattcccccgggggccatggaatctgaaacctttcctctgtctcgtgccctgggctctatcgtagattgtccttgctttgtctcgtctctatctgatcctcttgcgagctcggcaatgtctctgctccatgagctggacgcgtgcggatacgtgtacaccctgtaagaagatccttgtttgatcgggcgcgcgccatgtcggagtccagcagggcgttccagctcgatgcgccgtcgtcgtcggccgccggcgccggcgccggcgccggccccgcccgcggctggaaggctggcccgagcggcggcagcgtgccgttctacaggctgttcgcgttcgcggacggcgccgacgcggcgctcatgtccctgggcgcgctcggcgccgtcgccaacggcgcggccctgccgctcatgaccgtcctcttcggccgcctcatagacgccttcggcggcgccgccaccacccgcgacgtcgtgggccgcgtctccggggtctcgctcgacttcgtctacctcgccgtcgcctccgccgccgcctcgttcctgcaggtggcttgctggatgatcaccggcgagcgccaggcggcgcggatacggaacctgtacctcaggaccatcctgcgccaggagatcgccttcttcgaccagcacac

SEQ ID NO: 30747 - protein, 152 aa, Panicum virgatum
  misc_feature: Ceres CLONE 1901627
  misc_feature: SWISSPROT Homolog: EC 3.6.3.44 Xenobiotic-transporting ATPase
MSESSRAFQLDAPSSSAAGAGAGAGPARGWKAGPSGGSVPFYRLFAFADGADAALMSLGALGAVANGAALPLMTVLFGRLIDAFGGAATTRDVVGRVSGVSLDFVYLAVASAAASFLQVACWMITGERQAARIRNLYLRTILRQEIAFFDQH

SEQ ID NO: 30748 - DNA, 579 bp, Panicum virgatum
  misc_feature: Ceres CLONE 1901627-R
cctgttatctaatgctgaagaaagggcagacaatgtggttgttgatattgaaagaccacataacaggcaggttaatggaaacacagcatcgaacacaatgcctagggcatcagaggatatcgaggatggtgaggttgttggtatcatcacacttgaagatgtctttgaagaactcctgcaggaggagatagtggatgagactgatgaatatgttgatgttcataaaaggatccgagtggctgctgctgctgctgcatcatcggttgcaagggctccatctgttaggagattaacgggtcaaaaggctgcaggagcgcagaatcgccaaggacagcagcagcctgctggaatcctgaagaagcctactgaaggtgaatcgaacccatcaaaacaagtgaaccttgtggagccgctgctggaaaacaggaggtaactcgtaaatgtgtcgtgtaatgtagagataaaaaatgcacggaaccatgcttgaagagcctacggttcttgctatattcagcaagaggtatatacgggtgtactcattgttgtaaattccagctggagcaatgtgcactctgtgcc

SEQ ID NO: 30749 - DNA, 1399 bp, Panicum virgatum
  misc_feature: Ceres CLONE 1901634
  misc_feature: Encodes the peptide sequence at SEQ ID NO. 30750
acgttggacccgccacgagctcaccacccaaccaccttccttccgacggagtccgagtccgaaaccccccaccaccgagcgaaaggaaggaggcctcgtcacgttccttccgccctcccccgccgccgataggccgagcccgcaaccctaaacctgccggcgaagaagcttttggggcgtccgcgggcgggcgggcgagcgtgcgccccctcccttcccggctcccttcccgccgcgggcgaggccgcccacctcgatccgccctcccccccgaggcggcggaggatctgggaggggcgggggagcctcgcggagggggcgccacggtccggcggcctgctcccagctctctcatccgcgccggagagcgccaggcgtcaccccaggacttcagtatttacaagtctgggaattggtgcttcaactcagacaagaaagctactctcttaaccagacatgatgatgacacaggcctgtaaaaagaggagggcagtttatataagcagtgaatcaggagattctggtacagattctgaggttgagggaagcaagctctcccaaaaatttggtgtgacatcaatttctacatgcgagcatcaatcatcttataagatcaagattgaaagtatgaatactagcaagataaggctgtgcggaaatatcttaaggaagctcatggatcacaagggtggttggctattcaatcaaccggttgacccagtgctgtttaagattcctgattactttgatgttatccgccatccgatggatttgggtactgttaagaagaaactcggaagcaagcagtatgtgagcacagatgagtttgcagcagatgtgaggctaacattttcaaatgccatgaagtataatcctccaggcaatgatgtccatgaaatagctaaagaattgaatggaatatttgattcagagtgggaagcagtggaaaggaaatttagaggccgaaacccagtacaagagcagcagacagtgaaggtcataaaaattcgaactgccacggattcaaagtctacagttgctacagggacggctgcgtcatcagctcgagggccagtagcttgctcaaattcacttgcgaagaagacactgacagatgcgataacttccaaagtgaaaattaaattttccgtgcgcagctctgagcagacctcttctaaagatacacctgttcaagcagttggtagcaaagagggatccttaaatcatcctcttcaaactggcaacagggaggcatctttaaaacgttctctcccttccactaaggagaatgctaaagtatcaaggatacaagcaaccgagcacagctccggtttagttggaaatgaatcacggtcttgcaatgaaacttcaacatcgcctctcgcttcctctgggcaag

SEQ ID NO: 30750 - protein, 314 aa, Panicum virgatum
  misc_feature: Ceres CLONE 1901634
  misc_feature (62)..(151): Pfam Name: Bromodomain Pfam Description: Bromodomain
  misc_feature: SWISSPROT Homolog: EC 2.3.1.48 Histone acetyltransferase
MMMTQACKKRRAVYISSESGDSGTDSEVEGSKLSQKFGVTSISTCEHQSSYKIKIESMNTSKIRLCGNILRKLMDHKGGWLFNQPVDPVLFKIPDYFDVIRHPMDLGTVKKKLGSKQYVSTDEFAADVRLTFSNAMKYNPPGNDVHEIAKELNGIFDSEWEAVERKFRGRNPVQEQQTVKVIKIRTATDSKSTVATGTAASSARGPVACSNSLAKKTLTDAITSKVKIKFSVRSSEQTSSKDTPVQAVGSKEGSLNHPLQTGNREASLKRSLPSTKENAKVSRIQATEHSSGLVGNESRSCNETSTSPLASSGQ

SEQ ID NO: 30751 - DNA, 614 bp, Panicum virgatum
  misc_feature: Ceres CLONE 1901634-R
agattccgaggaagaatcaggacatgggatgcaggacagcgtctcaccctcgacggtcattggcacaaatgaggatttccaggaagaggcgggacatgagatggaagacagcttatcacctccaacggtcgtcgacatgaagaaagatgcggaggaagaggtagaacacgagatggtggacagcgtatcgcccttgatgaatgttgacacggaggaaggagagatcagctgctgacggcagcaccactcccaccccctcccgcataatttattctggccgtgaggcggacatccttgctgggttgtttagattaggcgacctcataagcagagtgatgaagaaacattagttcctctgtggctgtgttgtagaacgaactttgtggagaacgtgtctcaagccgaactgtggagtgtagtgatttgggccttttgctgcggattttgcttctcacggtctcccaagttgggcaagagcatgatgattcctctgtatgttggatgtgttctagatatctatttaggggctgagcgagctcgtcggctgtataacctgtataaaaaaaaagatgagaaaaaattagagtaatggagtgctagtgtgtattttgtag

SEQ ID NO: 30752 - DNA, 1732 bp, Panicum virgatum
  misc_feature: Ceres CLONE 1901636
  misc_feature: Encodes the peptide sequence at SEQ ID NO. 30753
gactcgagtcgattctgacgaggcgaccggaatggcctcgtcgtcctcctccggcgctggccgcgtcgccggaaccctagccctgcgcacgagctcggcggtgccggcggcgtcgctgatcccagggctcccggacgacgtcgcggccgtcatcctctgcctgctcaccttccccgaccagtcccgcctccgcgccacctcccgcgcgtggcgcctgctcctctccgcggcttcgctgctcccgctccgccgcagcctccgcctcccgcgccgacacctcctctgcctcttccccacggacccctccctcgcctcgccgatccttctcgaccccgccgcccccaccgcctggtggcccctcccgccgctcccctgctcgccgcagctctacggcctcgccaacttcgccgccctctccgtcggccgccacctctacgtcctcggcggttcgtgcttcgacgcccgcagctacccccttgggcacccctctccctccgccgcggcctaccggctcgatctcgcccactcccgacactactgggagcgcctccccgacatgcaaatcccgcgcgggagcttcgcgtgtgcccccgcacccagcggtggcgtggtcattgtcgctggtggcggttcccgacaccccatgtttccctccaacggcagccgcaccgacagcaccgagtggtatgatgccacagctcgcgcatggtgcggtgccgcatcgatgccccgtcatcgggctgggtgcgtggggtttgtggctcacggtgctggggacggtggtgaggatgagttctgggtgatgggtggctacgacgagtacaccacactcgggggagtggtgccaactgatgtgtactgccggaatgcggtggcgctcggactctggagcgggaaatggagggagatcggagacatgtgggaggaaggggaaagaaggcggctcggacccgttgcagctttatctacggatgatggaaggattaccgaggtgttcatgcttgacggcaatgatatcttcaggtatgcctttgcttcaaacaggtggctgagagaggctaccacgaggaggaggatccgaaacactgaatcttgcggtttcgtatcaatgaatggggaactttacatgctcagatctgcagaagttcctgtcgaagcctcaggtccttggaggcagctgaagaagaagctggctctggagttacaggtgtacaaccctgggacaaagaaatggagagtgctcaccacacatccacctgtcgatgcacccattgatttcaggactgcagctctctgtacagttgagttgtagatccattggtggtcaccgttaactgtatagattcagccattcaggtggcaagctgaatattcaattaaagaatacagccccaaagatgccttgcaacttcagatgactccgccggtaagatagtttgtggagattgttgtgtgccagcgtgtatagacatagtagtaactttggttatatagcacaagaacaggtatcttcgccgccatgcagtatcactagttgttcacttgtttgtgttgtaataacctcaaataacaaatgtggcgggattctggtgtttgtggatgggcacgaaatacgggtgatatttcgatgtttgaatgtaagatctggtcccgaacttgtaggcagcgagataacaacgatttggcggacaacaggtcagaacaaattagaggcaacctggcatggcaactc

SEQ ID NO: 30753 - protein, 426 aa, Panicum virgatum
  misc_feature: Ceres CLONE 1901636
  misc_feature (121)..(177): Pfam Name: Kelch_1 Pfam Description: Kelch motif
  misc_feature (28)..(75): Pfam Name: F-box Pfam Description: F-box domain
MASSSSSGAGRVAGTLALRTSSAVPAASLIPGLPDDVAAVILCLLTFPDQSRLRATSRAWRLLLSAASLLPLRRSLRLPRRHLLCLFPTDPSLASPILLDPAAPTAWWPLPPLPCSPQLYGLANFAALSVGRHLYVLGGSCFDARSYPLGHPSPSAAAYRLDLAHSRHYWERLPDMQIPRGSFACAPAPSGGVVIVAGGGSRHPMFPSNGSRTDSTEWYDATARAWCGAASMPRHRAGCVGFVAHGAGDGGEDEFWVMGGYDEYTTLGGVVPTDVYCRNAVALGLWSGKWREIGDMWEEGERRRLGPVAALSTDDGRITEVFMLDGNDIFRYAFASNRWLREATTRRRIRNTESCGFVSMNGELYMLRSAEVPVEASGPWRQLKKKLALELQVYNPGTKKWRVLTTHPPVDAPIDFRTAALCTVEL

SEQ ID NO: 30754 - DNA, 1905 bp, Panicum virgatum
  misc_feature: Ceres CLONE 1901645
  misc_feature: Encodes the peptide sequence at SEQ ID NO. 30755
acaacactttccccactcggctagtcaatctccacctccctcacggactcgcccttctttctcgcgtgcgtccaccctccgccgtccccaaatcggagtcaatcccggcgaaaccctagaaatcctcccgccatgaaggccgccaacccgaacccgaagcacaagccaatgcctccacccgcggcgccagcggcggcggcgcacaacccgcaggccgccccctccagggcgtcctcctcctcctcgtctgctgccgaccccaacaacaagcgcccccaccccagcgacgccgccgccactgccaccagtggtgcggcgcccgcgcccccggaccctgcccctaacctcaacggggaggcccgccggtcccctctgctccccgcgccgcaccgacccctgggcgcatcgccgctgctgccgccgccgccgccgccgcccgtgcccctgcccccgtcgcagccactgctcaccgtggccgcggtggaggccgtgatggaggccatcccgccgccgccgccgtacgggctggaggacctcgaccgccgcaccgtcacgctctccgacggcaccgtgcgcacctacttcgcgctcccgcacgagccgccgccgctattccaaccgcgcccgctcttcgagctctgggctccgcctccgccgcccatgcccgcgatcctgcccactgctgggttgcttcccatgccggccccgaagcggaagtgggaggatcaggccaatggtggcgcgcctgggcaatcctccggacgccagcagcagcagaaggctgaggggcgtgccgtgaagcaggtgaaggaggtgaaggtggaagagacgggggtggaccccaaggcgctgaagagctcctttcttaagatggtgaagctgatgaatgagaacgaagcagataagaagaattaccgggccaatgggaagctttcccagctgaagtgccctgtctgtgaaagggattctgtagatttgcatgcgctcctcaatcatgcataccatgcaaagaatgcggagcatcgtgctgatcacctagggtttcacaaagccttatgtgttcttatgggttggaattactccgtagcccctgttttcaaaaccgcttaccaagcattatctactgccgccgctgaagccaatcaaggagatcttatcttatggcctccaacagtgataattgaaaacacatacaagtcaaagaacgacgggcaaaaggatgtcatgagtaataaagagctggagagcaagctgagagaaatgggctttgccgatgtcgatgtgcagccactgcctgggaaggatgggcacaggtctatgcaagcgaagtttccagctagcctcgacggtctcaacaaagcatcacagcttgttgagttatttgagcgccaaggccacgggcgggcaacttgggctcgcatccgtagcatggcccccaccgctgatggggccaacaacccaatgctggtgaaggtagatggcaagggggagcggacctgggtcctctatggctacttggccacggcatgggacctggacgtgcttgaccccgagtcaaagcagagtgtgactgtaaagagcagaaaggagctcgatttagactaggagaacctgaccctgatagaaccgtgtatgttacatataaatggtgaatccataggatggctggttgtctggttcggtttgagaaattctttcttgagtaatcagtttcaattgatatggaaggcaaataacggttctcttccatgtaaattttgattttttgggttgtgaaagagtccattacattgctgcaagccttcaattgtagcattgtatgactacgtaatttttttttcagcagctagaactctgcctttagtacccattcttactgacagtggaagcacagggcttgtttgt

SEQ ID NO: 30755 - protein, 370 aa, Panicum virgatum
  misc_feature: Ceres CLONE 1901645
  misc_feature (218)..(326): Pfam Name: XS Pfam Description: XS domain
MEAIPPPPPYGLEDLDRRTVTLSDGTVRTYFALPHEPPPLFQPRPLFELWAPPPPPMPAILPTAGLLPMPAPKRKWEDQANGGAPGQSSGRQQQQKAEGRAVKQVKEVKVEETGVDPKALKSSFLKMVKLMNENEADKKNYRANGKLSQLKCPVCERDSVDLHALLNHAYHAKNAEHRADHLGFHKALCVLMGWNYSVAPVFKTAYQALSTAAAEANQGDLILWPPTVIIENTYKSKNDGQKDVMSNKELESKLREMGFADVDVQPLPGKDGHRSMQAKFPASLDGLNKASQLVELFERQGHGRATWARIRSMAPTADGANNPMLVKVDGKGERTWVLYGYLATAWDLDVLDPESKQSVTVKSRKELDLD

SEQ ID NO: 30756 - DNA, 1829 bp, Panicum virgatum
  misc_feature: Ceres CLONE 1901648
  misc_feature: Encodes the peptide sequence at SEQ ID NO. 30757
accagttgcctgcctgcctctccgggccacctccctctcctctccggaccaggctcgagaggaaggggaacgagccgggggagagatgggatcggactcgtcgcccaagaaatggaacctcaaggagcagcgcaacacctacctccagtggttctccctcgccgacgaagacggggatgggcgcctgacggggaacgatgcgctcaagttcttcgccatgtccaatctctccaagcccgagctgaaacaggtttgggcaatcgctgactccaaacgtcaggggtatcttggattctacgagtttatgactgcaatgcagctggtttctctcgcacaagcagggaatgagatcagtcaagacaccatttcaaatgcagatttggaaaggttgcagccccccacaatggaaggtctggctaaaaaactaaaaaagcactctgggagcaagggcgagtctgctattgttgcatgtcatccagcagaatcacctataccagccagctggtttaactccaagtcaggaaagaagattcctttaaaatcagttacttcaattgtcgatgggctaaagaaatcgtacattgagaagttgaggcctctggaaaaaacttaccagttccaagactttgtatctcccttgctgactagcagtgattttgatgcgaagccaatggtcatgctgttgggtcaatattccacgggaaaaacaacattcataaagcacttactaaagacaagttatccaggtgctcatattggaccagagcctacaacagacagatttgttgtcatcacttctggacctgatgaaagatgcattcctggaaacacaattgctgtccaagctgacatgccatacagtggcctgtcatctttcggaacagcatttttgtcaaagtttgagtgttctcagatgcctcatccgttattagaacatgtaaccttcgtggatactcctggaattttatcaggggaaaagcagcgaacacagcgcagctatgatttcactggagttacatcatggtttgcggccaaatgtgatcttattcttctcctgtttgatccacataagcttgacatcagcgatgagttcaagcgtgtgattgggtcactccgtgggcatgatgacaaaatacgcatagttctcaacaaagccgaccaagttgatgcacaacagctgatgagagtgtatggagcactattatggtctctcgggaaagtcctgaacacaccagaagttatgcgtgtctacataggttcattcaacgacaagccgatcagggagacagctgctggcccactgggcatggagctgttccagaaacaacaagatgacttgctctccgacctgaacgacatccccaagaaagcttgtgatcgccggatcaacgaatttgtgaagcgcgcgagggctgccaaagttcatgcacacatagtcagtcatctgaagaaagaaatgcctgcgctgatgggcaaggccaaggctcagcagaagctgctcgacagcctcgatgaacagttcgccaaggtccagaaggagctgcacctgccgccaggggacttccccagcgtggaggagtacagggagcttctgagctcgtacaacttcgacaagttcgagaagctgaggccgaagatggttcagggcgtcgctgacatgctggcctacgacattccggagctcctgaagaagttcaggaacccctacgactgaaggaggaatctcccgaggtggcgcagctgcaatggcctagtcaaaaccgtctgtttctggaagttcaactgttcgagacggcaaaaaattcacattgtagccatcctggactgcc

SEQ ID NO: 30757 - protein, 542 aa, Panicum virgatum
  misc_feature: Ceres CLONE 1901648
  misc_feature (197)..(357): Pfam Name: Dynamin_N Pfam Description: Dynamin family
MGSDSSPKKWNLKEQRNTYLQWFSLADEDGDGRLTGNDALKFFAMSNLSKPELKQVWAIADSKRQGYLGFYEFMTAMQLVSLAQAGNEISQDTISNADLERLQPPTMEGLAKKLKKHSGSKGESAIVACHPAESPIPASWFNSKSGKKIPLKSVTSIVDGLKKSYIEKLRPLEKTYQFQDFVSPLLTSSDFDAKPMVMLLGQYSTGKTTFIKHLLKTSYPGAHIGPEPTTDRFVVITSGPDERCIPGNTIAVQADMPYSGLSSFGTAFLSKFECSQMPHPLLEHVTFVDTPGILSGEKQRTQRSYDFTGVTSWFAAKCDLILLLFDPHKLDISDEFKRVIGSLRGHDDKIRIVLNKADQVDAQQLMRVYGALLWSLGKVLNTPEVMRVYIGSFNDKPIRETAAGPLGMELFQKQQDDLLSDLNDIPKKACDRRINEFVKRARAAKVHAHIVSHLKKEMPALMGKAKAQQKLLDSLDEQFAKVQKELHLPPGDFPSVEEYRELLSSYNFDKFEKLRPKMVQGVADMLAYDIPELLKKFRNPYD

SEQ ID NO: 30758 - DNA, 709 bp, Panicum virgatum
  misc_feature: Ceres CLONE 1901655
  misc_feature: Encodes the peptide sequence at SEQ ID NO. 30759
atgccaagcaaataatttagcagctctccacaagaggtttagaaatggcggtcaagtttgtagttcttcttggtgttgtcctggcctttctcctcgtctcccaggatttggcctgtgctagagagctcactgaaaccaatgagtcgtctaaaggaaaagatgtgaagcccgctggaggagcgcctggactcaaggatgaaaagtggggaggtggatacaatggaggatatggcaacggcggtggttacggtggcgggtacggtggtagctatgggcctagatatggtggaggataccaccatggccacggaggaggctatgggcccggatatggtggaggatacggatctggacatggtggtgggtatggtggccctggatacggtggtggatatggtcagcctgggtatggcggaggatatggcggtggctacggtggtggctatggaggaggatatggtagtggcggcgggtatggtggaggtgggggctatggaggtggatacggagggggtggcggacaccgtggtggatggaattaagagacaaagctatgtatgtctctctacgtcaaataagaaacgcgtcatgatgatatatggtataaaacatggtgatggacatactgtcgatggaatcttgtcttgcatgaagtgtgataataagagctaggcagctagccttgtctggcagtgtgcacagctggctt

SEQ ID NO: 30759 - protein, 165 aa, Panicum virgatum
  misc_feature: Ceres CLONE 1901655
  misc_feature (1)..(148): Pfam Name: GRP Pfam Description: Glycine rich protein family
  misc_feature: Useful for making plants with modulated nitrogen use efficiency
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
MAVKFVVLLGVVLAFLLVSQDLACARELTETNESSKGKDVKPAGGAPGLKDEKWGGGYNGGYGNGGGYGGGYGGSYGPRYGGGYHHGHGGGYGPGYGGGYGSGHGGGYGGPGYGGGYGQPGYGGGYGGGYGGGYGGGYGSGGGYGGGGGYGGGYGGGGGHRGGWN

SEQ ID NO: 30760 - DNA, 1714 bp, Panicum virgatum
  misc_feature: Ceres CLONE 1901670
  misc_feature: Encodes the peptide sequence at SEQ ID NO. 30761
ggatgaacaagattggctgggctggctgggctgatcagcccagccgcagcgcaggcgttcggcagcaccagcccagccgaacggctgatgaaccacctggtggccttaatcgtgccctaccacgctcgcactcccatccgctccgatccgcacggcgccgctagggggttgggggcagctgcgtcgccgccgtcggggccgccccgagccgccgccgctcgcctcgccggcccgcctcccactcgcgctcgccctcgccttcggccactcggccccgccgtctttcccgccgtcggcgtcggcctccgtccgcccccgcccccgctgcagcagctcgtgctggcggcagcctgaggcaccgttgcacccgtagccggcaagacccaccgcccctccccccgcctgccagccgaggtgcgacggcggcggccgcgtcgtctccctccctccttcccctccacccactgcaggactacttccaattcctaggtccgccactgccacctgctcccaactgagcggccaggatgcgggttaagaagcgttcgaagcaccgcaaggcggtcaagttctattccacatgcttcggcttccgtgagccttacaaggtcctcatcgatggcaccttcgtccaccacctcatcacccagcgcctcctcccagccgatgaggcactccgcgacctcctatcggcctccagggcgccagccctcttcacctccaagtgtatcgtcgcagagctcaggcgactcggcaagtcacatgccgaatccttcgacaacgctcagcttctcgccacaaacaagtgtgagcatgacaaggttgtcagtgcagtgaattgtatcctatcactgataggtgataagaatcctgagcgattctttgttgccacccaagacgctgatcttcgggaaaagctaagagagattcctggggttcctgtaatatatggattgaagaactccttatttatagagcaaccctctgttcagcaacgcaagtttgctcaattggatgaggagaagcgtctcaatatggatatatctgagtataagaagttaatgaaggctgcatcagaaggaaagacaacagctagtgaaaatggaagtgacggagaacaacatgagaggcctatcagttcccttgtaaaaaatacacttggtgttgcagataaaagcaagtttaaaaggaacagagcaaagggtccaaacccactctcctgcaagaaaaagaaaccaaagccccagccctcagctattcaaaataagggggctacggttgatggcgaggcaaagagaaagagagttcataagaggaagagaagccagaaagataacaaacaagcagagacctaaatggtcttgcatacaagtttcagtgctcttgctgcgtctccatcttgacccctgaggacctgaacaagaactaagtcaactaggggagacttcatttaggggggaaaaactttgaagacgaatcttccacaagattcaggatgccatgccatgctccttacatgttgacaatgttatgccataccatgctccttgtatgcagagaatgttaagccatgccatgccaaactcctcctttgctgacgatgttccttgcgatgtagtacttgactgtttgcagtaatcaggatctctagaggctgtagctggaatttttttgcagcaatatgcagcacattgcaaactgccaataatttccc

SEQ ID NO: 30761 - protein, 275 aa, Panicum virgatum
  misc_feature: Ceres CLONE 1901670
  misc_feature (51)..(152): Pfam Name: Fcf1 Pfam Description: Fcf1
MRVKKRSKHRKAVKFYSTCFGFREPYKVLIDGTFVHHLITQRLLPADEALRDLLSASRAPALFTSKCIVAELRRLGKSHAESFDNAQLLATNKCEHDKVVSAVNCILSLIGDKNPERFFVATQDADLREKLREIPGVPVIYGLKNSLFIEQPSVQQRKFAQLDEEKRLNMDISEYKKLMKAASEGKTTASENGSDGEQHERPISSLVKNTLGVADKSKFKRNRAKGPNPLSCKKKKPKPQPSAIQNKGATVDGEAKRKRVHKRKRSQKDNKQAET

SEQ ID NO: 30762 - DNA, 750 bp, Panicum virgatum
  misc_feature: Ceres CLONE 1901673
  misc_feature: Encodes the peptide sequence at SEQ ID NO. 30763
gcgaaagccaaaagctaaaacctctccgtgtcacacgagccggagaaaatgcgcgcgacgatcccgaccccctcgctcctcgtcgccccgaggccgccacggctccgctccctccacgctgccgcggctcccatctcccgccaccacgcccgcggagcaggacgtcctcgcacccgcctgctcgtggcggcgccgccgtccgcccccggtgaggcggcggagcagcaggcggagccgagcacgtgggcgcccgagtccggcgagaagttctcgtggagggatcactggtaccccgtgtccctcgtcgaggacctcgatcccagccgccccacgccgttccagctcctcaaccgcgacctcgtcatctggaaggaccccaagtccggcgagtgggccgcgctcgacgaccgctgcccccaccgcctcgctccgctctcggaggggaggatcgatgagacggggtgcttgcagtgctcgtaccacggctggtcattcgacggctccggtgcctgcaccaggatccctcaggccatgcccgagggtcccgaggcccgggcggtgcggtcgccgaaggcgtgcgcgaccaagttccccaccctcgtctcccaggggctgctcttcgtgtggcctgacgagaatgggtgggagaaggctactgccaccaagcctccaatgtagccgaaagagtttgatgacccggccttctccacggtgacgatccagagggactggtactatggttatgatacg

SEQ ID NO: 30763 - protein, 209 aa, Panicum virgatum
  misc_feature: Ceres CLONE 1901673
  misc_feature (79)..(188): Pfam Name: Rieske Pfam Description: Rieske [2Fe-2S] domain
  misc_feature: SWISSPROT Homolog: EC 1.13.12.14 Chlorophyllide-a oxygenase
MRATIPTPSLLVAPRPPRLRSLHAAAAPISRHHARGAGRPRTRLLVAAPPSAPGEAAEQQAEPSTWAPESGEKFSWRDHWYPVSLVEDLDPSRPTPFQLLNRDLVIWKDPKSGEWAALDDRCPHRLAPLSEGRIDETGCLQCSYHGWSFDGSGACTRIPQAMPEGPEARAVRSPKACATKFPTLVSQGLLFVWPDENGWEKATATKPPM

SEQ ID NO: 30764 - DNA, 1467 bp, Panicum virgatum
  misc_feature: Ceres CLONE 1901682
  misc_feature: Encodes the peptide sequence at SEQ ID NO. 30765
atttttccgacaggagcggcggcgggtccgcgtgtcgcgtcgacgaagatgggtggcgccgtcgtggccgtgctcgccgccgccgccacacgccacaaccgttcccttctagcctccttgctctacagggtggcacgtgggctccacgactcttcagcggcagcagaggaggacaaggcgggggtgaggagccgccggtggcggcggaggagcagcagcaggctccttcttggaccggatttccccgacagctgggaccctccaccgcgtggtgcagcgcgagcgccgcctccgcgggacgccggagctgattatggttacaccgcaaccattatcgatggcaagtctattgcagaggacataaggttaaatattgctgaagaagtccgtcaaatgaaaagtacagtcggacatgtgcctggtctagctgttgtattggttggtgatagaagagattctgaatcttatgtgcgatacaaaacaaaaggttgtgaggaagttggaattaaatcattgctggcaaagttgcctggaaactgtacagaagatgaagtgatggattcagtgtcaacatttaatgaagatccttctgttcatggcatcctagttcagctacctctaccacagcatatggatgaggaaaggattttgagtgccatcagtctagagaaggatgttgatggtttccatcccttgaatgttggaaatcttgctctcagaagccgaaaacctctgtttttgccctgtgctgcaaaggcgtgcattgagttgttgctccaatctgggattgaactcatgggaaagcatgtaactgtgatcggaagaagcaaagttgttggattgcccacttccttacttttacaggttaagttttcacaattgagtcacatctattatttttatgcactttttaccatatgagaacagtatatgacattattttttttccagaggcatcatgccactgtcagtgttatccatgccttcacaacaaatccagaggcgattacccgtgaatctgacattgtcatatcagctgctggagtgcccaatcttgtaagaggaacttggttaaagcaaggtgcagttgtgattgatgtggggacaaatccaatcgaggatcctaccagtgattatggttatcgcctaactggtgatgtctgctttgaagaagcagtgaaggtggcttctgctataactccagttcctggcggagttggaccagtgacaatagcgatgcttcttggcaacacacttgattcagctagacgggtttacggcctaagtgactgaaccccctgaactgtacttttgccacacttaccctttgtaaattagtcgtcttttctttttttgctctctattttatttgtatgagagctgggatgtaccatatttttctcaataaatattgtatgcttagcagtgtacactaaataaatatattttgtctggagacaaagcgat

SEQ ID NO: 30765 - protein, 290 aa, Panicum virgatum
  misc_feature: Ceres CLONE 1901682
  misc_feature (94)..(211): Pfam Name: THF_DHG_CYH Pfam Description: Tetrahydrofolate dehydrogenase/cyclohydrolase, catalytic domain
  misc_feature (214)..(289): Pfam Name: THF_DHG_CYH_C Pfam Description: Tetrahydrofolate dehydrogenase/cyclohydrolase, NAD(P)-binding domain
  misc_feature: SWISSPROT Homolog: EC 1.5.1.15 Methylenetetrahydrofolate dehydrogenase (NAD(+))
MGGAVVAVLAAAATRHNRSLLASLLYRVARGLHDSSAAAEEDKAGVRSRRWRRRSSSRLLLGPDFPDSWDPPPRGAARAPPPRDAGADYGYTATIIDGKSIAEDIRLNIAEEVRQMKSTVGHVPGLAVVLVGDRRDSESYVRYKTKGCEEVGIKSLLAKLPGNCTEDEVMDSVSTFNEDPSVHGILVQLPLPQHMDEERILSAISLEKDVDGFHPLNVGNLALRSRKPLFLPCAAKACIELLLQSGIELMGKHVTVIGRSKVVGLPTSLLLQVKFSQLSHIYYFYALFTI

SEQ ID NO: 30766 - DNA, 723 bp, Panicum virgatum
  misc_feature: Ceres CLONE 1901706
  misc_feature: Encodes the peptide sequence at SEQ ID NO. 30767
gactccactccaaaaaagcattctactagctagctccggccacttccttcgtcttaggctgctggagagccttgtcctccgctccatccaccagaccaccaccatggtcctccaaacataccttgctcaagttgcagagagaattagctaggaagcatccgcatactgggggactcttcgacagatcttggaatcgctccttcatcgctcaggtggccagatgccattgcttacaagaaaaagagttttatgttcgaaaaagtgccaagtggtcaattaagattatatcaagcaggcgacaaccacatactcagagtgaccatatcgggtcctctagattttttcatcaacagtgccggaagcccatcagcaaccatggactcagcagatgaggagacgccattgattcaccacctgcgtccacagtatgaaggtccagaatacactagcgacggaacagttgatattaacaagaagccggctctgaagcggagcacggggaactggagagcatgctatttgattttaggtgccgaaatcggtgaaagcctggccttctctgggatacagaagaacttggtcacctatctcacgagcgtgcttcacgaaagcaatgtcgacgctgccgcgaacgtgtccacttggctcggcagctgcttcttcacgccgctcctcggagctttcctggccgacacatactgagggagatacaggacagtagtg

SEQ ID NO: 30767 - protein, 108 aa, Panicum virgatum
  misc_feature: Ceres CLONE 1901706
  misc_feature: Useful for making plants with altered carbon content
  misc_feature: Useful for making plants with altered nitrogen content
MDSADEETPLIHHLRPQYEGPEYTSDGTVDINKKPALKRSTGNWRACYLILGAEIGESLAFSGIQKNLVTYLTSVLHESNVDAAANVSTWLGSCFFTPLLGAFLADTY

SEQ ID NO: 30768 - DNA, 1891 bp, Panicum virgatum
  misc_feature: Ceres CLONE 1901711
  misc_feature: Encodes the peptide sequence at SEQ ID NO. 30769
ctgttcgctcattctccctcgccgccggccagccatcaatcagggtctcctcgctcattctccctcgccgccggcctcgtccctcccggcccgctcctcgtcggttgaccaagagataggctgcgttttctctttttttttcgctgcgcctcagcccgatggaggacgactcgctcaaggggatgatctccgcgatttcctgggtgcccaggggcgccgccaagaacgtccccgtcgtcgccgagccgccaacgcaggaggagatcgacgaggccatcaagaccatggccttgggcggaggcggcgggatcgacgccgacgaggacgatgatgctggcaccatggacctcgacggtgccgaggccgaggaggaggagcttgatgagctctcccgggccaaggctgtcgccaaggcgcttgccaagggcaccagtaaggtggacgacgtcgccgacgagctccaagagctcaacatggatgcttacgacgacgaggaagaaggtatcgagatttttagctctggaatgggggacctgtactatcccagcaatgatatggacccttacctcaagaacaatgacgatgatgatgatgatgacgatgaggagattgaagataagatgatcaagcctaccgattatcttattgtttgtgcacatagtgatgaagatatcttttctcttcaggtcaacatactcgaagaaacagaggatggtgagcaaaatatgtttgtgcatcatgatgtccctctccctgattttccgctctgcactgcttggatggattttaatctgaatggtggtgacaaagggaattttattgctgttggaaccatggatcctgccatcgaaatatgggacttggatatggttgatgaggttaaacctcaaatggttttaggaggactttcaaaaaagaagaaaaaggcaaaggacaaaaaggggaaaaagtataagaagggaagtcatagaaattctgtgcttggtcttgcatggaacaaggaagtcaggaacgttctagctagtgcaagtgcggacacaactgttaaaatttgggatttagctgttggcaaatgtgcagtcacacttgaacatcatgatgacaaggttcaatcagttgcttggtgtccacagtcacctgaagttcttctgagtggatcatttgataaaacagttgccattaatgatatgaaagatggtggacagagatgccataaatggtctgttgaagcagatgtggaaagtttagcttgggatccacacaatgaacattcatttgtggtaagtcttgaaaatgggatggttcaagcatttgataagcgaacagcttcatcaagttcttctggccgatccacatatactcttcatgcacacgaaaaggctgtttcatccatctccttcagcccgtctacccctaattttcttgcaacaggctctactgataaaacggtgaaactctgggatttatcaaacaaccagccatcatgcattgcctctctgaatccaaagcttggagctattttttcagtatcattttcacatgacaatcccttctggttagcctgtggaggatccaaaggcaaactaaaagtctgggacacactaacggagccagcagtagctcaaaaattcggcagacagaagtgaaggaaatttagtcagcactgagaagcaatgtttgtggatccacgagcaaaatagtagccgaagtttgctggcacatgttgtttccagcgtatacatgtttgggtagattgacgtcctagtggaagttttgtgcgtgtgagatgaaagcccaatattggtaaatgaatgaaatcaatgcaactaagtatcttagagcttgtacaacgaatgattcaggcaaggttttggaatgaaactttcaagtc

SEQ ID NO: 30769 - protein, 495 aa, Panicum virgatum
  misc_feature: Ceres CLONE 1901711
  misc_feature (396)..(435): Pfam Name: WD40 Pfam Description: WD domain, G-beta repeat
  misc_feature (304)..(343): Pfam Name: WD40 Pfam Description: WD domain, G-beta repeat
  misc_feature (261)..(300): Pfam Name: WD40 Pfam Description: WD domain, G-beta repeat
  misc_feature (441)..(480): Pfam Name: WD40 Pfam Description: WD domain, G-beta repeat
  misc_feature: SWISSPROT Homolog: EC 2.3.1.48 Histone acetyltransferase
MEDDSLKGMISAISWVPRGAAKNVPVVAEPPTQEEIDEAIKTMALGGGGGIDADEDDDAGTMDLDGAEAEEEELDELSRAKAVAKALAKGTSKVDDVADELQELNMDAYDDEEEGIEIFSSGMGDLYYPSNDMDPYLKNNDDDDDDDDEEIEDKMIKPTDYLIVCAHSDEDIFSLQVNILEETEDGEQNMFVHHDVPLPDFPLCTAWMDFNLNGGDKGNFIAVGTMDPAIEIWDLDMVDEVKPQMVLGGLSKKKKKAKDKKGKKYKKGSHRNSVLGLAWNKEVRNVLASASADTTVKIWDLAVGKCAVTLEHHDDKVQSVAWCPQSPEVLLSGSFDKTVAINDMKDGGQRCHKWSVEADVESLAWDPHNEHSFVVSLENGMVQAFDKRTASSSSSGRSTYTLHAHEKAVSSISFSPSTPNFLATGSTDKTVKLWDLSNNQPSCIASLNPKLGAIFSVSFSHDNPFWLACGGSKGKLKVWDTLTEPAVAQKFGRQK

SEQ ID NO: 30770 - DNA, 734 bp, Panicum virgatum
  misc_feature: Ceres CLONE 1901712
  misc_feature: Encodes the peptide sequence at SEQ ID NO. 30771
atttcctgcaagccatttaagtaccttctctccaacgagaagccacctctctctctctctctctctctctctctctgaatgactgagagatgagaagtgtttgccggttgctgccgttcttgttcttctctccctgatttgggtgctctcatataccagatctgaatcctcttgtgccattggaggctgcatcgtttgaggtgatcaggatgagcaaggaggacacgctcaaggttcagatctgcgtgttaaaagtgaacatccactgtgatgggtgcgagaagaaggtcaagaagatcctccacaagattgatggtgtgtaccagagcagcatagatgcagagcaggggaaggtgacggtgtctggcctgatggatccggacaccgtcatcaggaagctgaacagggccggcaagcccgctcagctttggggcggcaagcctggcgtggtaagcccgcttcagaagctgcagcttggcggtggtggcaagggtcagcaccagaaggacgccggcggcaagggccagcaccagaaggacgccggcggcaagggccagcccaagggtggagcgggtgctggacacggcgggggcggcggcggcgctggcgcgaaagatgcaaggatggcgatgccgcagccgactccgcagcagcttcagcaactgcagcaactgcaacagcagatgcagatgaagggactgaagcttcctccccagctcatgggcatgggcggc

SEQ ID NO: 30771 - protein, 174 aa, Panicum virgatum
  misc_feature: Ceres CLONE 1901712
  misc_feature (13)..(73): Pfam Name: HMA Pfam Description: Heavy-metal-associated domain
MSKEDTLKVQICVLKVNIHCDGCEKKVKKILHKIDGVYQSSIDAEQGKVTVSGLMDPDTVIRKLNRAGKPAQLWGGKPGVVSPLQKLQLGGGGKGQHQKDAGGKGQHQKDAGGKGQPKGGAGAGHGGGGGGAGAKDARMAMPQPTPQQLQQLQQLQQQMQMKGLKLPPQLMGMG

SEQ ID NO: 30772 - DNA, 1717 bp, Panicum virgatum
  misc_feature: Ceres CLONE 1901721
  misc_feature: Encodes the peptide sequence at SEQ ID NO. 30773
aacacagaccaaagagcatgggctcgaagcctcactgacagagctcacggccacagctgcggaccatggccgtcggtctcgtcgacgccggtgccgccggcaatgatcggcagtacggcgggaggatcaccttgttcgtcgcgctctcctgcgtcacggcggccttgggcggcgccatcttcggctacgacctcgggacctcaggcggcgtgtcatccatggggccgttcctcagggagttcttcccggacgtgtaccggcggatgcacggcgacgtgcgcgtcagcaactactgtaggttcgacagccagctgctgacgctcttcacctcgtcgctgtacatcgccggcctgctcaccgcggtgctcctctcgtcgtggttcacggccaggcgcggacgccggccgtccatgatcgtcggcggggtggcgttcctcgccggcgcggcggtcagcggcggcgccgtgaatgtctacatggccatcctcggcagggccctgctcggcgtcggtcttggcttcgccaatcaggcagtgcttctgtacctgtctgaaatggcccctgcacgataccgaggagcattcagcaacggcttccagctgaccctgtgcctgggatctctcgccgcgaacgccatcaactacggcgccgacaagatcaccggcggctggggctggaggctgtcgctgggcctggcctgcgtccccgccgcgttcttcacgctgggcgccgtcttcctgccggagacgcccaacagcctcgtgcagcagggcgcggaccgcggcaaggtgcgagcgctgctgcagaggatcagaggcaccgacgccgtcgacgccgagctcgacgacatcgtggcggcggcgcgcggcggcggcggcggcgacggcctgcggatgatcctctcgcagccgaggtaccggccgcagctggcgatcgccgtgctgatgccggcgttcacgcagctcaacgggatcaacgccatcgggttctacgcgccggtgctgctccgcacggtcggcatgggcgagagcctggccctgctctccacggtcatcacggtggtcatctacacggcgtcgacggtcgtgttcatgttcgtgatcgaccggttcggccggcgcacgctgctcatcgccggcagcctccagatgctcgcctccgagctcctgatcggcgccatcatggcggcggagctcggcgacgagggcggcgtgggccggggctacgcggcgacgctgttcgtgctcatcggcgtgtacgtggcgggctacagctggtcgtggggccccatgacgtggctggtgcccaccgaggtgttcccgctggagatccgggcggcggggcagagcgtgacggtggcgtccgggttcgtgttcaccatcttcgtcgcgcaagggttcctcaccatgctgtgccggatgagggcgtggctcttcttcttcttcgccggatggatcgtggtgatgacgggcttcgtgtacctgttcttgccggagacgaaggggatgcccatcgagcaggtcggcaaggtgtggagggagcactggttctgggggcgggttgtgggtgtggatgaatcgcaggcgagcgacaagctgtgaaaaaaaaaactctagctagatgaccaggttcatctgggttgtagatcggagggccaggaaagagctaatgcatcctggtgttcatctcacaagcagaattcattaagctcttacgg

SEQ ID NO: 30773 - protein, 511 aa, Panicum virgatum
  misc_feature: Ceres CLONE 1901721
  misc_feature (28)..(490): Pfam Name: Sugar_tr Pfam Description: Sugar (and other) transporter
MAVGLVDAGAAGNDRQYGGRITLFVALSCVTAALGGAIFGYDLGTSGGVSSMGPFLREFFPDVYRRMHGDVRVSNYCRFDSQLLTLFTSSLYIAGLLTAVLLSSWFTARRGRRPSMIVGGVAFLAGAAVSGGAVNVYMAILGRALLGVGLGFANQAVLLYLSEMAPARYRGAFSNGFQLTLCLGSLAANAINYGADKITGGWGWRLSLGLACVPAAFFTLGAVFLPETPNSLVQQGADRGKVRALLQRIRGTDAVDAELDDIVAAARGGGGGDGLRMILSQPRYRPQLAIAVLMPAFTQLNGINAIGFYAPVLLRTVGMGESLALLSTVITVVIYTASTVVFMFVIDRFGRRTLLIAGSLQMLASELLIGAIMAAELGDEGGVGRGYAATLFVLIGVYVAGYSWSWGPMTWLVPTEVFPLEIRAAGQSVTVASGFVFTIFVAQGFLTMLCRMRAWLFFFFAGWIVVMTGFVYLFLPETKGMPIEQVGKVWREHWFWGRVVGVDESQASDKL

SEQ ID NO: 30774 - DNA, 2437 bp, Panicum virgatum
  misc_feature: Ceres CLONE 1901724
  misc_feature: Encodes the peptide sequence at SEQ ID NO. 30775
acacagtgtttccatggcggccttcccttcttcttcctctaccaacaccagcccaaatgcacaatgccgcgccgccccgccccgcccgccccgtaccgcactgacaggtcggtcccacgggagatccgctctccaccaacgctcctcttaaaaaaaacagcgccaggcacggggtgctccttccttccttccttcctttgcatcgccgctccactccactccggctcgcctttcgctttgcatcgggttcgttctcttccgctcggagcgcgcgggcggtgctgctcctcgtctccgtccgttcaccggaatgacggcagcgtgggggcgtctcgccatcctcctcctcgtcctcacgccgcgcccgccggcggccggggccgacgacgccaactccacggcggcggcgtgcccgctcgacctgggctacgtggccacgctcccctgggaccacgcgccgtgcgcgccgccggtggccaacagggccgcctgctgcatgacgctgctctcggtgctcggggtcggcctcgcggcgcggctccgcgccacgggtcgcttccgcctcccgtccgcggcggcgtcggcggcctgcctccgcgccttctccgccgcgctcgcggcgccgccgctctcgctgccgggatccctcgtgccggcctgcttcccggtgccgtcccagttcgccatcaccccggactactgcaccggggtcaccaccgccgcggagtacgccgaggtcgcaggcggcgcgtccgtcaccgggctcaacgcctcctgcggcgccgacatcacctcgctgtcgctctgcacgcgctgcctcaacgccggcatcggcgcgtcggctcggctcaccgccgccgccggcaacagctccaagtcccagagctgcttctacctcaccgtgctctacgcggccgggatctccagctccgacggcccagactcccccgccactgccagctgcgccctcggcctcgctctctccacccctcgcccgacgtcgtcgcctacatccagctccaccagccacaccaacatcgcagtagccgccaccatcccgattgccatcgtcctgctgcttgcctccctcgtagctctgcttctctggaggaggcgccaggatgacatcaagaggaggagcatccaaatctcagagtcgcggcggtcgtgcccgcggccaaacaccggctccgtgatgttcgacatctgcgagctggccaaggcgaccggcggtttcgccgagcgtaacctcatcggccgcggcgggttcggcgtcgtgtaccgcggcgtgctcgcggacggcaccgtggtcgccgtcaagaagatgctcgacccggaggtggagggcggggacgaggagttcaccaacgaggtggagatcatcagcctcctccggcaccggaacctggtgccgctgcgcgggtgctgcattgccgacgacgaccccgacgaaggcaagcagatgttcctcgtgtacgactacatgcccaaaggctcgctggatcagtacatcttcgccgacggcgaggtcaggcggcggccggcgttctcctgggcgcagcgtcggactgtgatcctggacgtgggcaggggcctcgagtacctgcactacggcgtcaagccggggatctaccaccgcgacatcaaggccaccaacatcctcctggacgcggacatgcgcgcgcgcgtggcggacttcggcctcgcccgccggagccgcgagggccagtcgcacctcacgacgcgcatcgccggcacgcacggctacctctcgccggagtacgcgctctacgggcagctcaccgagaagagcgacgtgtacagcttcggcgtgctggtgctcgaggtcatgagcggccgccgcgcgctcgacctggccgacccgtccggcgtcgtgctcatcaccgactgggcgtggacgcacgtgaaggccggccggccgagggaggtgctcgccgaggcgctgcggagggagccgagcaccgtcgttgtggtggccatggagaggttcgtgcttgtcgggatcctgtgcgcgcacgtcacggtggcgtgccgcccgaccatgccggaggcgctgaggatgctggaggggggcatggacgtgcccgacctgccggaccgcccgcagccgttcggccagaggattgcgttcgacgaaggcgaaagcaatttcagcgcctcgtcgattctgagcagtccattcgtggacttcggcgacatgctcaggtgatgcaaggcggctgaagtttcaggtcgcggtcacacacactctatatggatgagttgtattcacaacttcacatgctatgctacatgtgctggttagctggatttcagggtgatgtatagccctcacctgatgtacatgaattgtgtatcttaaactgaaatgtcaaatagatgccataaacacaaatattacaacatcgttttatgc

SEQ ID NO: 30775 - protein, 639 aa, Panicum virgatum
  misc_feature: Ceres CLONE 1901724
  misc_feature (309)..(592): Pfam Name: Pkinase Pfam Description: Protein kinase domain
  misc_feature: SWISSPROT Homolog: EC 2.7.11.1 Non-specific serine/threonine protein kinase
MTAAWGRLAILLLVLTPRPPAAGADDANSTAAACPLDLGYVATLPWDHAPCAPPVANRAACCMTLLSVLGVGLAARLRATGRFRLPSAAASAACLRAFSAALAAPPLSLPGSLVPACFPVPSQFAITPDYCTGVTTAAEYAEVAGGASVTGLNASCGADITSLSLCTRCLNAGIGASARLTAAAGNSSKSQSCFYLTVLYAAGISSSDGPDSPATASCALGLALSTPRPTSSPTSSSTSHTNIAVAATIPIAIVLLLASLVALLLWRRRQDDIKRRSIQISESRRSCPRPNTGSVMFDICELAKATGGFAERNLIGRGGFGVVYRGVLADGTVVAVKKMLDPEVEGGDEEFTNEVEIISLLRHRNLVPLRGCCIADDDPDEGKQMFLVYDYMPKGSLDQYIFADGEVRRRPAFSWAQRRTVILDVGRGLEYLHYGVKPGIYHRDIKATNILLDADMRARVADFGLARRSREGQSHLTTRIAGTHGYLSPEYALYGQLTEKSDVYSFGVLVLEVMSGRRALDLADPSGVVLITDWAWTHVKAGRPREVLAEALRREPSTVVVVAMERFVLVGILCAHVTVACRPTMPEALRMLEGGMDVPDLPDRPQPFGQRIAFDEGESNFSASSILSSPFVDFGDMLR

SEQ ID NO: 30776 - DNA, 1583 bp, Panicum virgatum
  misc_feature: Ceres CLONE 1901739
  misc_feature: Encodes the peptide sequence at SEQ ID NO. 30777
atctccccaaacctccaccccgccctcctctaccggcggcttcctttacctccaccgcgtgcgagtgaacgagagcggcggcggcggcgatggggaaggcgtcgaagggctcgcggaaagggaagaaggcgtggcgcgccaacatcagcaccgacgacatcgacgacttcttcgagaagcagacgcgcgacgcccacgccggcgccgtcgccatcccctcgctcccctctgattcccttttctacgtcgacaagcccgctgcctccacttcggcaactagcgcctctgacacaccaaccaaagatattccttccaagaggaagatcgagaagaagagagagaaggttctttaccatgagagtttgttgaagcggaacccatttgtacagccaatcccatcttctgtggtgaggaagaaggataagaagaaggcgaagaagaaggaattgcaggagacacatggagaaaaaagtgtccccatgaaagatgattctgctgaaaagaaccttgacatatgggctggggatggtaatggagataccaaggccaaaaagagatctactacatcagtgattcctgctgttgaagttgaggccccaggatgctcatttaatcctccattcgaagcacatcaagatgctcttgctcaagcagttgcggacgaaaggcaaaaagtgctcatgaaagagttggggcccacacctgtaccgctcatagttcctggtgaagctataactgaagaagataaattctttcttgatgctgatgatggagatgatgatgtcgcagacgatgatggagatcaggatgctgatgcttcagttggacaaaggaagaacaaaacaaaaagagttacaagagtagaaatgaacaaaagagctcgtcttaaggagaggttaagagcagaggcagaagcaaagaaaatggaaaatatttcaaaagaaatagacagtttgccaaatataattgatgagatagctaaagaggatgaagaaaaggaaaagaggcgcctaaggcgaactgttgttaaagaggagaggcttaaatcaggcccacctcgtctgggcagacacaaatttgaaccagctcctgttcaagttcttttgactgaagagattagtggctcccttagaaagctaaaggggtgttgtaatctcgtgagggatcgctacaagagcattgagaaacgtggaatacttgcaccaagcaagagaataagcaaacgtcggtagagaatcaaggtccaatatgatggatgataaggtgatcttaaccttgttttctcctacaatatcaaggggaatgcacttctgatggattgaagaggcttacgaaattggtgctgataaaagacgagaagatccagatataagtgaagagcctgttttatcgcattcttatttcctttcacatgttcagtgtcaactaggcagtcaatctttagcgctagcaatattttgtgagcctgtgaggcaaaattttgcaatagaccttttcagttgttagtgcttagcagatgcaacgtggtgtaatagcatatttgtatcagttctgttctagtagatggtagtgattgctatact

SEQ ID NO: 30777 - protein, 380 aa, Panicum virgatum
  misc_feature: Ceres CLONE 1901739
  misc_feature (8)..(365): Pfam Name: Nop53 Pfam Description: Nop53 (60S ribosomal biogenesis)
MGKASKGSRKGKKAWRANISTDDIDDFFEKQTRDAHAGAVAIPSLPSDSLFYVDKPAASTSATSASDTPTKDIPSKRKIEKKREKVLYHESLLKRNPFVQPIPSSVVRKKDKKKAKKKELQETHGEKSVPMKDDSAEKNLDIWAGDGNGDTKAKKRSTTSVIPAVEVEAPGCSFNPPFEAHQDALAQAVADERQKVLMKELGPTPVPLIVPGEAITEEDKFFLDADDGDDDVADDDGDQDADASVGQRKNKTKRVTRVEMNKRARLKERLRAEAEAKKMENISKEIDSLPNIIDEIAKEDEEKEKRRLRRTVVKEERLKSGPPRLGRHKFEPAPVQVLLTEEISGSLRKLKGCCNLVRDRYKSIEKRGILAPSKRISKRR

SEQ ID NO: 30778 - DNA, 755 bp, Panicum virgatum
  misc_feature: Ceres CLONE 1901767
  misc_feature: Encodes the peptide sequence at SEQ ID NO. 30779
aatcgcaccttctctcacactggtgctctttttcttcttcctacgttttatgttgacaacaaaggttgatcttcaggaggacctgttcttggtccgattccttggagtgatatacagttctgggagtgtgggttagtgtcttttgtttaccagttgtcttcctgtgataaaataggcaaaccatcaacccccaccagctccttgcgagcgctcccttgcctccttttctgctcttggtgttcttggtgagacagagggagaggcagagtttgttaggtaggagttgtgcactatgggtaattgctggtttaaggggaatccatactttaacagggtttcctccaatgcaaccaaatcagaatccccaaaaattcagagcccatcggaaagaattgaaaaggaagatagccggctgccatccaacccaaaagaggtggaggcgctgagaaaggatacagctcgcaaccctttgatagcattcacatttgaggagctcaagagaatcaccaaaaatttcagacaagattcactactagggggtggtggatttggcagagtctacaaagggttcatcaccaaggatctccgcgaaggtttagaaatagaagagcccctgagagttgccgttaaggtccatgacggtgacaatagcttccagggccatagggagtggctggctgaggttatatttcttgggcaactctcccacccgaatttagtgaagttgatcggctattgttgtgaagacgaccacc

SEQ ID NO: 30779 - protein, 154 aa, Panicum virgatum
  misc_feature: Ceres CLONE 1901767
  misc_feature: SWISSPROT Homolog: EC 2.7.11.1 Non-specific serine/threonine protein kinase
MGNCWFKGNPYFNRVSSNATKSESPKIQSPSERIEKEDSRLPSNPKEVEALRKDTARNPLIAFTFEELKRITKNFRQDSLLGGGGFGRVYKGFITKDLREGLEIEEPLRVAVKVHDGDNSFQGHREWLAEVIFLGQLSHPNLVKLIGYCCEDDH

SEQ ID NO: 30780 - DNA, 768 bp, Panicum virgatum
  misc_feature: Ceres CLONE 1901768
  misc_feature: Encodes the peptide sequence at SEQ ID NO. 30781
atcgccattcccccagtcgccgcccaagtcaaaaagagggaagcttcttccaccagtctccccagcccatcaaacgctggtcaagcagcaccaaccctagccccctccccctcctcctccccttcgcgagcggcggcgaggaaggcgacgaggaagccatggattcctccggcggcggcggcggcggcggtggcgcgcagatcagggggatggcgacgcacggcgggcggtacgtgctgtacaacgtgtacggaaacctcttcgaggtctcctccaagtacgcgccgcccatccgccccatcggccgcggcgcctacggcattgtctgtgcggctatgaactcggagacaagcgaggaggttgcgatcaagaaggttggcaatgccttcgacaaccacatcgacgccaagcggacactgagggaaatcaagctgctccgccacatggaccacgagaacatccttgccttaaaggatgtaatacgcccaccaagtagagagaactttaatgatgtctacattgttactgagttaatggataccgatctccatcagattatacgctcaaatcagccattgactgatgatcattgccagtacttcttgtatcagttgctacgagggctaaaatatgtgcactcagcaaatatattgcaccgtgatctaaagccaagcaatttgttcctaaatgcaaattgtgacctcaagatcgcagactttgggcttgcaaggaccacttcggaaacagatctcatgacagagtatggtg

SEQ ID NO: 30781 - protein, 203 aa, Panicum virgatum
  misc_feature: Ceres CLONE 1901768
  misc_feature (42)..(203): Pfam Name: Pkinase Pfam Description: Protein kinase domain
  misc_feature: SWISSPROT Homolog: EC 2.7.11.24 Mitogen-activated protein kinase
  misc_feature: Useful for making plants with altered cell wall content and/or composition
MDSSGGGGGGGGAQIRGMATHGGRYVLYNVYGNLFEVSSKYAPPIRPIGRGAYGIVCAAMNSETSEEVAIKKVGNAFDNHIDAKRTLREIKLLRHMDHENILALKDVIRPPSRENFNDVYIVTELMDTDLHQIIRSNQPLTDDHCQYFLYQLLRGLKYVHSANILHRDLKPSNLFLNANCDLKIADFGLARTTSETDLMTEYG

SEQ ID NO: 30782 - DNA, 743 bp, Panicum virgatum
  misc_feature: Ceres CLONE 1901776
  misc_feature: Encodes the peptide sequence at SEQ ID NO. 30783
  misc_feature (667)..(667): n is a, c, t, g, unknown, or other
aattcgatcctcttcctcgcggtcgcggctcgcggctccctctcctcctcaagaccccaacccgtcgctgaggcgggtgcggccaccgatcgacgcgtcctccctgcttcctggttcccacccgttcactgtccccgccgctcgtcacggatccatcagggatttggatcgatttggcactctgtcagccgcagagttgaatcatggcggagcacttggcttccatctttggcactgagaaggatagggtcaactgccctttctacttcaagattggggcttgccatcatggggatcgctgttcccgtctgcacaacaggccaaccatatcaccgactcttgtgcttgctaacatgtatcagcgtcctgatatgataacccctggagtagatgctcaaggccaacctattgatcctgagaagatgcaggagcattttgaggacttctatgaggacatccatgaggagttgggcaagttcggtgagattgagaacctgaatgtctgcgacaaccttgctgaccacatgatagggaatgtctatgtccagttcaaggaggaagaacaggcagctgcagcatgcaatgctcttcagggtcgcttttactctggccgcccaataattttggagtattctcctgtgactgacttccgtgaagcaacctgcangcagtttgaggagaacagctgcaaccgtggtggctactgtaacttcatgcatgtgaaacaaattggcagggatctc

SEQ ID NO: 30783 - protein, 179 aa, Panicum virgatum
  misc_feature: Ceres CLONE 1901776
  misc_feature (13)..(39): Pfam Name: zf-CCCH Pfam Description: Zinc finger C-x8-C-x5-C-x3-H type (and similar)
  misc_feature (155)..(155): Xaa is any aa, unknown, or other
MAEHLASIFGTEKDRVNCPFYFKIGACHHGDRCSRLHNRPTISPTLVLANMYQRPDMITPGVDAQGQPIDPEKMQEHFEDFYEDIHEELGKFGEIENLNVCDNLADHMIGNVYVQFKEEEQAAAACNALQGRFYSGRPIILEYSPVTDFREATCXQFEENSCNRGGYCNFMHVKQIGRD

SEQ ID NO: 30784 - DNA, 747 bp, Panicum virgatum
  misc_feature: Ceres CLONE 1901781
  misc_feature: Encodes the peptide sequence at SEQ ID NO. 30785
aaacccacgcgaccgcgagagctctccgaaagcaccaccacgagagagacgaatcttccgaatctctcggcggcgatggcgctctccgaccgctcccgcgagtcgctcctcccgagcttcctctacgactcctcctcggcgcgctccttcgccgccaccccctcgcgcctctcagtccccgtccccgccccggccgcggctggagcgggtggcggcgcgcccttcacgatccaggcgcccaaggagaagatcgagctctactcgccggcgttctacgccgcctgcacggccggagggatcgccagctgcgggctcacccacatggccgtcaccccgctcgacctcgtcaagtgcaacatgcagattgatccagcgaaatacaagagcatctcatctggatttggtgtcctgttaaaggagcaaggggctaggggcttcttcaggggatgggtgcctaccttgcttggttacagtgctcagggggcttgcaagtttggcttctatgagttcttcaagaagtactactcagatattgcagggcctgagtatgcccagaagtacaagactctaatctacctggcaggttctgcttctgctgaggtaattgccgatgtggctctctgcccctttgaagctgtgaaggtacgtgtgcagacgcagcctggatttgctcgtgggttgagcgatgggctccccaaatttgtccgatctgagggtgctctcgggctctacaagggacttgttcct

SEQ ID NO: 30785 - protein, 223 aa, Panicum virgatum
  misc_feature: Ceres CLONE 1901781
  misc_feature (66)..(154): Pfam Name: Mito_carr Pfam Description: Mitochondrial carrier protein
MALSDRSRESLLPSFLYDSSSARSFAATPSRLSVPVPAPAAAGAGGGAPFTIQAPKEKIELYSPAFYAACTAGGIASCGLTHMAVTPLDLVKCNMQIDPAKYKSISSGFGVLLKEQGARGFFRGWVPTLLGYSAQGACKFGFYEFFKKYYSDIAGPEYAQKYKTLIYLAGSASAEVIADVALCPFEAVKVRVQTQPGFARGLSDGLPKFVRSEGALGLYKGLV

SEQ ID NO: 30786 - DNA, 1907 bp, Panicum virgatum
  misc_feature: Ceres CLONE 1901803
  misc_feature: Encodes the peptide sequence at SEQ ID NO. 30787
gtcagggagacgcacgccgcgtgcacggtgaggaaggaagagtgcttggggagagaggggaatcgaggcctcgagggacccatccgcgtggcttgatcagttgatctcagcagcgatggaggcggcgctagtggagcggctggaggcggcggtggcgcggctggaggccgccgtggcctccggcgcctcgctcgcgtcggcggccccgcgcgacctcgacgtcccggcggccgcggatccggccatcgtggcctacgaggagttcgtcgcggaggcagtcgggcggctcacggccgcggcagagaagatcggcgggaaggtgctcgacgccaccaagctgctcgccgaggccttcgccgtcgccaaggatctgctcgtccaggccaagcagctccagaaaccagcatcaatggctgatgcacaggacttctttaagcccctaagtgatgttatcgccaaagcaactgcaatgactgaaggaaggaggcccgactatttcaaccatttaaagagtgttgctgacagtctccctgctttggcttgggttgcattcttagggaaggatcgcggcatgagtttcccaaccgctcatgtagaggaaagctggcagatggctgagttctataataataaggttcttgtggagtacagaaacaaagaccctgatcatgttgagtgggctaaagcactgaaggatctatacatgcctggtttgcgggattatgttaagaagcattatcctcttggtcctgtctggggtcccgctggaggtgctgctgcttcccaaccaaaggttgttgctcctacacctaaagcaccagcagctaaggctcctcctccaccggctcctccttcagcgcctctttttaccaccgagaagtctccgaaatcttcacagcctaaacaagggatgtcagctgtctttcaagagattagttccaaacctgtgactgcagggttgcgaaaggttaccgatgacatgaaaactaaaaaccgtgctgatagaagcggtgttgtcagcagctcggctgctcctcctgcagctcctgagaagacctctcgtgcagggtctttctccttcaagtctggacccccaaagctggaacttcagatgggacgcaaatgggtagttgagaatcaggttggtaagaagacccttgctattgatgattgtgattccagacaatccatctatgtgtacggatgcaaggattccgtccttcgagtaaatggcaaggttaacaatatcactgttgacaaatgcactaaatttggaattgttttcaaggatgttgtagcagcttttgaggttgtcaactgcaatggcgttgaggtccaatgtcagggtacagcaccgacaatatcaatcgacaacacatctggatgtcaattatacttgagcaaagattcgctgggagcttcaattacttctgctaaatctagtgaaatcaatgtgatggttcctagtggtgctaccgatggtgattgggtggagcatgctttgcctcagcagtacatccatagtttcaaggatgggcaatttgtcacgtcaccagtttcgcactctggagcgtaaatacaatgattattactgctattgtgtgtgtttgtttgactggcattgccatgtttgaagatgatggtatgctgagatctgtagcagttttggggtctgttgcagcactgtaccggggctgcagtgttgtttttgctgtcggctcagtgctcggtgtgtatgttttgtttacacactagtttggtttggtggttccgtttgtttgtttgtttatttgttttttgtattccagcacacccgttggtgtatgtcttcaactgttcattctttgacacctgatcttaccatatttcaattgatgtggacggttgctccgtggagtcactttttc

SEQ ID NO: 30787 - protein, 486 aa, Panicum virgatum
  misc_feature: Ceres CLONE 1901803
  misc_feature (324)..(484): Pfam Name: CAP_C Pfam Description: DE   Adenylate cyclase associated (CAP) C terminal
  misc_feature (1)..(311): Pfam Name: CAP_N Pfam Description: Adenylate cyclase associated (CAP) N terminal
MEAALVERLEAAVARLEAAVASGASLASAAPRDLDVPAAADPAIVAYEEFVAEAVGRLTAAAEKIGGKVLDATKLLAEAFAVAKDLLVQAKQLQKPASMADAQDFFKPLSDVIAKATAMTEGRRPDYFNHLKSVADSLPALAWVAFLGKDRGMSFPTAHVEESWQMAEFYNNKVLVEYRNKDPDHVEWAKALKDLYMPGLRDYVKKHYPLGPVWGPAGGAAASQPKVVAPTPKAPAAKAPPPPAPPSAPLFTTEKSPKSSQPKQGMSAVFQEISSKPVTAGLRKVTDDMKTKNRADRSGVVSSSAAPPAAPEKTSRAGSFSFKSGPPKLELQMGRKWVVENQVGKKTLAIDDCDSRQSIYVYGCKDSVLRVNGKVNNITVDKCTKFGIVFKDVVAAFEVVNCNGVEVQCQGTAPTISIDNTSGCQLYLSKDSLGASITSAKSSEINVMVPSGATDGDWVEHALPQQYIHSFKDGQFVTSPVSHSGA

SEQ ID NO: 30788 - DNA, 745 bp, Panicum virgatum
  misc_feature: Ceres CLONE 1901806-R
  misc_feature: Encodes the peptide sequence at SEQ ID NO. 30789
gtccgcaaggctatcagcgaaacacatgagctgaagcagttccccactcttcgcgtggaagtaagcaatgcagcttttgagtcattggatggaatgagagatgaaagcaagaagaatacattaaagctggttgatatggaatgcagctacttgactgtggatttcttcaggaagcttcctcaggatgttgagaagggtggaaatccaagccactctatttttgacagatataatgactcttatcttagacgaattggacaaactgttctatcatatgtcaatatggtgtgcgcaacattgagaaactccataccgaaatctattgtgtattgtcaagtccgtgaggcaaagcgctcacttctcgaccactttttcactgaactaggagcaagagagatgaagcaactttccaagcttcttgatgaagaccctgcagtcatggaacgaagaactaacctcgccaaaaggctggaactgtaccgaagcgcccaagcagaaatcgatgcagttgcgtggtccaaataatcttgctggcctacctaccctgttcttgcatgctctctactccttgtttggtgattctcccctattctgggggcatatatagctgatttttttcctgttgtaggtaaggtcatttatagatcatttggtttgtgcttttgttccttgtgcttgaggatctaggggacaccaggctgctgtacttctgtatcacgacaagttcatatattgtgtttctatt

SEQ ID NO: 30789 - protein, 174 aa, Panicum virgatum
  misc_feature: Ceres CLONE 1901806-R
  misc_feature (77)..(170): Pfam Name: GED Pfam Description: Dynamin GTPase effector domain
  misc_feature: SWISSPROT Homolog: EC 3.6.5.5 Dynamin GTPase
VRKAISETHELKQFPTLRVEVSNAAFESLDGMRDESKKNTLKLVDMECSYLTVDFFRKLPQDVEKGGNPSHSIFDRYNDSYLRRIGQTVLSYVNMVCATLRNSIPKSIVYCQVREAKRSLLDHFFTELGAREMKQLSKLLDEDPAVMERRTNLAKRLELYRSAQAEIDAVAWSK

SEQ ID NO: 30790 - DNA, 743 bp, Panicum virgatum
  misc_feature: Ceres CLONE 1901806
gatcccactccctcctcctcctcccccctccccaatcgcctattcgctcgctccaccaccgccgctgcgctgccgtctcacccccgctcgtattgctccccgcgagacccccaccacaagcaatgcagcctagtcccggcttgtctcaggcggcgccgctgccgccggcggtcgcggcggagctcgcgcggctcgagcggaggctgaggcaggtcgccgaagaaccggcgctccgcgagctcggggcgctcggggaagcacccgcggttcgcgtcctgcggaggatcgggagctcccagcgggaggtgaggacgctcaccggctatatcatcacgcttgccaggcaggaggcgttcgcactcaacgcgcaggccgtacccaccgccaagagcgccacctgcagcttctcatctccttgcctcagagatgaatctgtacatgggctgcagtatcacaacgacgtccaaatggaagaaattacttcggacctcgcaaaccattgtatggtgatggacgagagtcaaggtcaggagggatctccggtgatgatggcagttgacaacccatctgattgcatctcccaaagggatttgaaccatgattgcattgaagttgataatgttgtcccaggaatggcttctcaggcaaaccagatgcttacgcattatggtgacagcatccaaaaattgatttctattgtacctcatggtgttatcatgctgggctgaaagtcttggaaatgg

SEQ ID NO: 30791 - DNA, 760 bp, Panicum virgatum
  misc_feature: Ceres CLONE 1901810
  misc_feature: Encodes the peptide sequence at SEQ ID NO. 30792
tccgatccgggacacatggcggcggcggcggtgacgtccaacggcggcgcggcggcggcagcgaacgggccgtcgcccgggcggctggcctccgtgtacagcgaggtgcagacgagccgcctcctgcacgcgctgcccctcccctccgtcctccgctccgacttctccgtcgtcgacgggcccgccagctccgccgcgggcaaccccgatgagatcgccaagctcttccccaacctgttcggccagccttcggcgtcgctggtgccgtcgaccgagcccgcggcgacaaggccgctcaaggtcggtgtcgtgctctccggtggacaggcgccaggcgggcacaatgtgatctgcggcatcttcgattacctgcaggagcgtgctaaaggcagcactatgtatggattcaagggaggtccagctgggatcatgaagtgcaagtatgtggagttcaattctgactttgtatacccctacagaaaccagggaggatttgatatgatctgcagcggaagggacaaaattgaaacgccagagcagttcaagcaagctgaagacacaaccaacaagcttgatttggatggacttgttgtcattggtggtgatgattcaaacaccaatgcctgcctccttgcagaatattttagatcaaaaaacatgaagactcgtgtcattggctgcccaaagactattgatggagatctgaaatgtaaggaggttcccacaagctttggatttgatactgcttgcaagatatact

SEQ ID NO: 30792 - protein, 248 aa, Panicum virgatum
  misc_feature: Ceres CLONE 1901810
  misc_feature: SWISSPROT Homolog: EC 2.7.1.90 Diphosphate--fructose-6-phosphate 1-phosphotransferase
MAAAAVTSNGGAAAAANGPSPGRLASVYSEVQTSRLLHALPLPSVLRSDFSVVDGPASSAAGNPDEIAKLFPNLFGQPSASLVPSTEPAATRPLKVGVVLSGGQAPGGHNVICGIFDYLQERAKGSTMYGFKGGPAGIMKCKYVEFNSDFVYPYRNQGGFDMICSGRDKIETPEQFKQAEDTTNKLDLDGLVVIGGDDSNTNACLLAEYFRSKNMKTRVIGCPKTIDGDLKCKEVPTSFGFDTACKIY

SEQ ID NO: 30793 - DNA, 335 bp, Panicum virgatum
  misc_feature: Ceres CLONE 1901822
  misc_feature: Encodes the peptide sequence at SEQ ID NO. 30794
atcccctgtgctacacatctcatcgcatcttcttctttgccaactaagctctctcgcgttcttgattttgcttgtgagcgatggccagcctcaccgatctcgttaacctcaacctcagcgattgcaccgacaagatcatcgccgagtacatctggattggagggtccggcatagacctcaggagcaaagcaaggacggtgaaaggccccatcaccagtgcgagccagctcccaaaatggaactacgatggctccagcaccgggcaggctcccggagaggacagcgaagtcatcctctaccctcctcccaccatcttcaacggacccgtacgggag

SEQ ID NO: 30794 - protein, 84 aa, Panicum virgatum
  misc_feature: Ceres CLONE 1901822
  misc_feature (17)..(84): Pfam Name: Gln-synt_N Pfam Description: Glutamine synthetase, beta-Grasp domain
  misc_feature: SWISSPROT Homolog: EC 6.3.1.2 Glutamate--ammonia ligase
  misc_feature: Useful for making plants with modulated water use efficiency
MASLTDLVNLNLSDCTDKIIAEYIWIGGSGIDLRSKARTVKGPITSASQLPKWNYDGSSTGQAPGEDSEVILYPPPTIFNGPVR

SEQ ID NO: 30795 - DNA, 698 bp, Panicum virgatum
  misc_feature: Ceres CLONE 1901823
  misc_feature: Encodes the peptide sequence at SEQ ID NO. 30796
aagcaacttccccccaccacctccctcccctcccctcccctcccctcccatgcccgcatcgagatcttaagcgggacaacgagaggagaggcgacgcgggcgcgggcgacccccgatccgtcctcgccgccgccgccgccgccgccgccgaccgaccgaccgggggaggagtaggggaggggaggacggacgtcatggaggtcgactccgggaagctcttcgtcggcggcatctcctgggagacggacgaggaccgcctccgcgagtacttcggccgcttcggggaggtcaccgaggccgtcatcatgcgggaccgcaacaccggccgcgcccgcggcttcggattcgtggtcttcgccgactccacggtcgccgaacgcgttaccatggacaaacatatgatcgacggccggatggtggaagccaagaaggctgttcccagggacgaccagagtatcacaagcaagaacaatggcagcagcatagggtcacctggaccaggacgtactagaaagatctttgtgggaggcctagcttcaaatgttactgaggttgaattcagaaggtactttgagcaattcggtgtgataaccgacgtggttgtgatgtacgaccacaacacgcagaggcctaggggatttggtttcatcacctatgactcagaagacgcagtggataaggctctgcacaagaacttc

SEQ ID NO: 30796 - protein, 167 aa, Panicum virgatum
  misc_feature: Ceres CLONE 1901823
  misc_feature (8)..(77): Pfam Name: RRM_1 Pfam Description: RNA recognition motif. (a.k.a. RRM, RBD, or RNP domain)
  misc_feature (108)..(165): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with altered alkaloid content
MEVDSGKLFVGGISWETDEDRLREYFGRFGEVTEAVIMRDRNTGRARGFGFVVFADSTVAERVTMDKHMIDGRMVEAKKAVPRDDQSITSKNNGSSIGSPGPGRTRKIFVGGLASNVTEVEFRRYFEQFGVITDVVVMYDHNTQRPRGFGFITYDSEDAVDKALHKN

SEQ ID NO: 30797 - DNA, 730 bp, Panicum virgatum
  misc_feature: Ceres CLONE 1901839
  misc_feature: Encodes the peptide sequence at SEQ ID NO. 30798
attcagctgagtgtgctcgatcatcaagcaatcaacaaagcctcccaattatcctttcatcagatcatcttccttcttccaagatgtcttgcagctgcggatcaagctgcaactgcggctccaactgcaagtgcggcaagatgtaccctgaccttgaggagaagagcagcggcggcgctcaggccaccatcgtcctcggcgtggccccggagaagaagactggccagttcgaggcggcagcggagtccggcgagaccgcccacgcctgcaagtgcggtaacagctgcagctgcgacccctgcaactgctgatttcgatgggggaacgtcagaacacacctgcatgcatgcatgctagctactacctactactctgcttgtgtgtgacttgatgattgaacaagaataaggatgagcctgagccatcatgtctcatgtatcggtttggctccggcctcatcaagcatgcatgcgtcgcctgcccctctgtgtgctttgcgtccgtcctgtgtctgtatgtgttgatcattgcaaagaaaccatgcaggcatacatctctgcatgtgtctctgtaatgatcggtccagagtgatgaatatataaaactggtttgctttatctgcctaaaaaacagccaagcaactctcgatcccgtccctaatcagcagctcgagctcgctttagcttgagaagcagcgcgtgtgtttgcagcaatggcggcccgcaatgtc

SEQ ID NO: 30798 - protein, 75 aa, Panicum virgatum; identical to SEQ ID NO: 12252
  misc_feature: Ceres CLONE 1901839
  misc_feature (1)..(75): Pfam Name: Metallothio_2 Pfam Description: Metallothionein

SEQ ID NO: 30799 - DNA, 645 bp, Panicum virgatum
  misc_feature: Ceres CLONE 1901841
  misc_feature: Encodes the peptide sequence at SEQ ID NO. 30800
catctcaccgccccctcctccgcgtgcccgtcgcttcccccccctggagccggtgccgctggcgacggccgccgggatggggggccctggtcccgggcccgggtaccccgagtccacggagtcctccccacgcagccacggcggggactcgtgggacgagcccttcccgtcctccgcggcggccgcggccggcggcgggggccggctccgcctgatgtgcatcttcgggggccggatcctcccgcgcccgacggacgagtccctctgctacctgggcggagagacccggatcgtggccgtcgaccgccacccctcgctcgccgacgtccgcgctcgcctctcgcggtcgctgctcgggggccggcccttcacgctcctgtaccacctccccaacgaggacctcgactctctcatctccgactccaccgacgaggacctcgacaacctcctctacgagtacgacctcttcgccgcctcctcctccggcggcgagatcctcgcgcacctcggggatcctggtcttcctcttccccgcctagcccgagtcctcctcctccctctgctccctcctcgacgactcctccaaatccgagaactggctcgtccacgccctcatcagcgccatctccggctccctcgacggca

SEQ ID NO: 30800 - protein, 214 aa, Panicum virgatum
  misc_feature: Ceres CLONE 1901841
  misc_feature (83)..(172): Pfam Name: PB1 Pfam Description: PB1 domain
ISPPPPPRARRFPPLEPVPLATAAGMGGPGPGPGYPESTESSPRSHGGDSWDEPFPSSAAAAAGGGGRLRLMCIFGGRILPRPTDESLCYLGGETRIVAVDRHPSLADVRARLSRSLLGGRPFTLLYHLPNEDLDSLISDSTDEDLDNLLYEYDLFAASSSGGEILAHLGDPGLPLPRLARVLLLPLLPPRRLLQIRELARPRPHQRHLRLPRR

SEQ ID NO: 30801 - DNA, 298 bp, Panicum virgatum
  misc_feature: Ceres CLONE 1901842
  misc_feature: Encodes the peptide sequence at SEQ ID NO. 30802
aacagcccgtgcagaacgatcactagacaccagtcgtgcgtccccagaatgcccttcccgcctcggccgtaacagcctccagcaattactccgctcctccgcctcgcccccacaacgccggagcccatggacgccagcctccgcacgctgcccccggccagcttccccggggaaggtcggctcgggcgtctcctctgtgtctgctcccccccccgggacgaacggcccccaaacacggttttcccccaccccccgccgccggacaccatcccgccgctcggctcccgcgtctactacc

SEQ ID NO: 30802 - protein, 57 aa, Panicum virgatum
  misc_feature: Ceres CLONE 1901842
  misc_feature: The sequence is a functional homolog of SEQ ID NO 1194 in the 10/666,642 US patent application
MDASLRTLPPASFPGEGRLGRLLCVCSPPRDERPPNTVFPHPPPPDTIPPLGSRVYY

SEQ ID NO: 30803 - DNA, 726 bp, Panicum virgatum
  misc_feature: Ceres CLONE 1901848
  misc_feature: Encodes the peptide sequence at SEQ ID NO. 30804
aagcaaagcaagagagctgcgagttgctcctcctcctcctccgtcctcctcatcctcctcctcctcctgctgctcttccgagtaggaactcaggtgcccgtagctctcggtcgccggaaatgtcgaccaactcgagatccaactccagggccaacttcaacaacgagatccatgacatcgccacgccgcagaactccaccatgccccccatgtactacagcgaccggtcgctggcggatttcttccctccccacctcctcaagaaggtcgtctcggaggtggtgtcgacgttcctgctggtgttcgtgacgtgcggggcgtcggcgatcagcggcagcgacctgcaccgcatatcgcagctggggcagtcggtcgccggcgggctcatcgtcacggtgatgatctacgccgtcggccacatctccggcgcgcacatgaaccccgccgtcacgctcgcgttcgccgtcttccgccattttccatggattcaggtccccttctactgggcggcgcagttcaccggcgccatctgcgcgtcgttcgtgctcaaggcggtgctgcaccccatcacggtgctgggcaccaccacgccgacggggccgcactggcacgcgctcgtcatcgaggtcatcgtgaccttcaacatgatgttcgtcaccctcgccgtcgccacggacacgagagcggtgggtgagttggcggggttggcggttgggtccgcggttg

SEQ ID NO: 30804 - protein, 202 aa, Panicum virgatum
  misc_feature: Ceres CLONE 1901848
  misc_feature (40)..(202): Pfam Name: MIP Pfam Description: Major intrinsic protein
  misc_feature: Useful for making plants with modulated silicon content
MSTNSRSNSRANFNNEIHDIATPQNSTMPPMYYSDRSLADFFPPHLLKKVVSEVVSTFLLVFVTCGASAISGSDLHRISQLGQSVAGGLIVTVMIYAVGHISGAHMNPAVTLAFAVFRHFPWIQVPFYWAAQFTGAICASFVLKAVLHPITVLGTTTPTGPHWHALVIEVIVTFNMMFVTLAVATDTRAVGELAGLAVGSAV

SEQ ID NO: 30805 - DNA, 465 bp, Panicum virgatum
  misc_feature: Ceres CLONE 1901866
  misc_feature: Encodes the peptide sequence at SEQ ID NO. 30806
gaattgccctactctttctgcctttgcccccgccgagagggacagaggacgagagactgcgaacagaagcaatggtcccccatagcctgttcgggatgccgctgtcggccaacctgatccttccttgccgccgtgatcggcgacaagggcctcgacttccacatcctccccgccgacctcggcaccgacccccacttcatgacggacttcctctcccccaggactttcagccagatcactgcggtggatgacggagatgaatttctcggcgaattttgggatatcgacctcttgttctgtatcccttacgtctcctacggtcccgacctcctcgctacgctctgtgtgatctctggaggatgtcggttggaggttgattcgcatttttttctttcctttttgtcttgccgggtgtttcgactcctcattaagctccttctgtgcggcgccccggaccttgtggtg

SEQ ID NO: 30806 - protein, 88 aa, Panicum virgatum
  misc_feature: Ceres CLONE 1901866
  misc_feature: SWISSPROT Homolog: EC 2.5.1.18 Glutathione transferase
MTDFLSPRTFSQITAVDDGDEFLGEFWDIDLLFCIPYVSYGPDLLATLCVISGGCRLEVDSHFFLSFLSCRVFRLLIKLLLCGAPDLV

SEQ ID NO: 30807 - DNA, 458 bp, Panicum virgatum
  misc_feature: Ceres CLONE 1901878
  misc_feature: Encodes the peptide sequence at SEQ ID NO. 30808
acactcgcgtttcttgcattgtttctcaccgtttgatgtatacagcagcatctgtctgaacaagatgatctcctaccccggacgcgcaggcacgagatcgccggagtggtcaccgaggtgggcgcgagcgtgacgaggttcaaggccggcgaccgcgtcggcgtgggctgcatggtggactcgtgccggtcctgcgaccgctgcgccggcggcttcgagaacctctgccgcggcgtcgtgtggacctacaactccgtcgacccgcgggacggcgccgccacctacggcggctactcgagcgcggtggtcgtgcacgagcgcttcgtggtgcggttcccgggcggcttgccgctgctgtgcgcgggcgtcaccgtgtacagccccctgcggcgccacgggctgggcgcgcccgggaaccgcgtcggcgtggcggggctgggggggctgggccacgtcac

SEQ ID NO: 30808 - protein, 95 aa, Panicum virgatum
  misc_feature: Ceres CLONE 1901878
  misc_feature: SWISSPROT Homolog: EC 1.1.1.195 Cinnamyl-alcohol dehydrogenase
  misc_feature: The sequence is a functional homolog of SEQ ID NO 2 in US patent 7288696
  misc_feature: Useful for making plants with altered cell wall content and/or composition
  misc_feature: Useful for making plants with altered carbohydrate content
MVDSCRSCDRCAGGFENLCRGVVWTYNSVDPRDGAATYGGYSSAVVVHERFVVRFPGGLPLLCAGVTVYSPLRRHGLGAPGNRVGVAGLGGLGHV

SEQ ID NO: 30809 - DNA, 383 bp, Panicum virgatum
  misc_feature: Ceres CLONE 1901896
  misc_feature: Encodes the peptide sequence at SEQ ID NO. 30810
agagagagagagagagagccatggaggcggcggtggcgacgcagcagccgcacaagttccggtggggcgagctcgaggacgacggcggcgacaacctcggccccctcctcccgccgcgggtcgtcctcgagcccgacgcgggcggcctccggacggtgatagagtaccgcctcgacgacaacggcaacaaggtcaaggtcaccaccaccacccgcacccgcagcctcgcacacgcacgcctctccaagagcgccgtcgagcgccgctcgtgggccaagttcggcgacgccgtcgagggggacgacgacggctcgcgcctcaccatggtctccacagaagaggtcctcctccttccccccccactcgccgagggagaaatacga

SEQ ID NO: 30810 - protein, 120 aa, Panicum virgatum
  misc_feature: Ceres CLONE 1901896
  misc_feature: Useful for making plants with altered alkaloid content
MEAAVATQQPHKFRWGELEDDGGDNLGPLLPPRVVLEPDAGGLRTVIEYRLDDNGNKVKVTTTTRTRSLAHARLSKSAVERRSWAKFGDAVEGDDDGSRLTMVSTEEVLLLPPPLAEGEI

SEQ ID NO: 30811 - DNA, 749 bp, Panicum virgatum
  misc_feature: Ceres CLONE 1901897
  misc_feature: Encodes the peptide sequence at SEQ ID NO. 30812
agcccaggctactacgctttgcatgcgtcgagagggcacccagagaagctgccactgccagcactcgagcagcgagcgagagcgagagctatcggcgatggggagcgtgccggaggaggtcgccctgggcttcggcggcctggtgggggacctgagggaggtgtacgagagcggcaggacccggggtctggagtggcgccgctcgcagctccggggcctcgtcaggctgctcgaggacaaggaggagaacatcttcgacgcgctccgcgaggacctcggcaagcaccgcgccgagtccttccgagacgaggttggggttctgaagaagtcggtcgtcgacaagctgcggaacctcaagaactgggcggcacccgagaaggctcacacgccgctggttgccttcccggcgaccgcgctgctggtgccggagccgctcggggtcgtgctcatcttctcctgctggaacctcccaataggcctggctctggagccgctctccggagccttggcggccggtaacgccgtggtggtgaagccgtccgagctcgcgccgtccacctccgcgttcctggcggccaacatcccaaggtacctggacgccaaggccgtgaaggtcgtcgagggcgggccggaggtcggggagaagctcatggagcacagatgggacaaggtcctcttcaccggcggcagccgtgtcgggcgcctcatcatgaccaaggccgccaagcacctggacccgggtggcgctc

SEQ ID NO: 30812 - protein, 217 aa, Panicum virgatum
  misc_feature: Ceres CLONE 1901897
  misc_feature: SWISSPROT Homolog: EC 1.2.1.3 Aldehyde dehydrogenase (NAD(+))
MGSVPEEVALGFGGLVGDLREVYESGRTRGLEWRRSQLRGLVRLLEDKEENIFDALREDLGKHRAESFRDEVGVLKKSVVDKLRNLKNWAAPEKAHTPLVAFPATALLVPEPLGVVLIFSCWNLPIGLALEPLSGALAAGNAVVVKPSELAPSTSAFLAANIPRYLDAKAVKVVEGGPEVGEKLMEHRWDKVLFTGGSRVGRLIMTKAAKHLDPGGA

SEQ ID NO: 30813 - DNA, 621 bp, Panicum virgatum
  misc_feature: Ceres CLONE 1901913
  misc_feature: Encodes the peptide sequence at SEQ ID NO. 30814
atccaccaccacccagccgaacaatctcagctcgccggacacgcagatcttctccgagggcgggctggactacctggggaacccgaacctggtgcacgcgcagagcatcctggccatctgggcgtgccaggtggtgctcatgggcttcgtcgagggctaccgcgtcggcggcgggccgctcggcgaggggctcgacaaggtgtaccccggcggcgccttcgacccgctgggcctcgccgacgacccggacaccgccgcggagctcaaggtcaaggagctcaagaacggccgcctcgccatgttctccatgttcggcttcttcgtgcaggccatcgtcaccggcaagggccccatcgagaacctcttcgaccacgtcgccgaccccgtcgccaacaacgcctgggcctacgccaccaacttcgtccccggcaaatgaatgctgctctgctctgcttgtccaagaatgcagtaggcgtgtagagttgcacgcgccggcgtatgcttcgtaagctcgtcagattcagatcagatcagcggctgcgtctgcctgcacgtgatgtaaacttgtaaactacgcacagagatgcatgtgtaagatcaatggtgtaccgtaccattcag

SEQ ID NO: 30814 - protein, 144 aa, Panicum virgatum
  misc_feature: Ceres CLONE 1901913
  misc_feature (4)..(111): Pfam Name: Chloroa_b-bind Pfam Description: Chlorophyll A-B binding protein
STTTQPNNLSSPDTQIFSEGGLDYLGNPNLVHAQSILAIWACQVVLMGFVEGYRVGGGPLGEGLDKVYPGGAFDPLGLADDPDTAAELKVKELKNGRLAMFSMFGFFVQAIVTGKGPIENLFDHVADPVANNAWAYATNFVPGK

SEQ ID NO: 30815 - DNA, 655 bp, Panicum virgatum
  misc_feature: Ceres CLONE 1901917
  misc_feature: Encodes the peptide sequence at SEQ ID NO. 30816
acttcttcctccgcccgcacgcgcgcctcgcgaaatcaccccctcgccgccgccgccagtcgttccccggaggaagccagccagccagccggccagccaggcccgccggagatgtcgtacgcctacctcttcaagtacatcatcatcggcgacacaggcgtcggcaagtcgtgcctgctgctgcagttcaccgacaagcgcttccagcccgtccacgacctcaccatcggcgtcgagttcggggcccggatgatcaccatcgacagcaagcccatcaagctccagatttgggacacggcaggccaagagtcattcagatccataactagatcatactacagaagggccgctggtgctcttttggtctataatatcaccaggtaattacactcccataagcccaaagttgcttgggcagtccttctatgctcatggcttcctgaatcgtgcacatactggcattcgaatccatgttgggctgattccaggagggagactttcaatcacctcgcaagctggctggaggatgcgaggcagcatgccaacgccaacatgacgataatgctggttgggaactagtgtgatctgtctcacaggcgtgcagtgagctatgaggaaggcgagcagtttgcaaaggaacatggcctgatcttca

SEQ ID NO: 30816 - protein, 90 aa, Panicum virgatum
  misc_feature: Ceres CLONE 1901917
  misc_feature (8)..(90): Pfam Name: Ras Pfam Description: Ras family
  misc_feature: SWISSPROT Homolog: EC 2.7.11.1 Non-specific serine/threonine protein kinase
  misc_feature: Useful for making plants with altered lignin content
  misc_feature: Useful for making plants with modulated oxidative stress sensitivity
  misc_feature: Useful for making plants with altered terpenoid content
  misc_feature: Useful for making plants with altered alkaloid content
MSYAYLFKYIIIGDTGVGKSCLLLQFTDKRFQPVHDLTIGVEFGARMITIDSKPIKLQIWDTAGQESFRSITRSYYRRAAGALLVYNITR

SEQ ID NO: 30817 - DNA, 705 bp, Panicum virgatum
  misc_feature: Ceres CLONE 1901919
  misc_feature: Encodes the peptide sequence at SEQ ID NO. 30818
atcctttcctcgcgagtcccacccaaaccctcgttccctctcttccgacctcgccgccgccgcctcgacctacgccgggttccacgccgccggccgagcccgcccgaccggagaggaggatgggtagcggcggggatgaggcctcgcgaacagtcccaccgctggcgccggggggcacccgcgaggagctggcgttcgtgaaggagacggtgctgaagaagcgcaaggagaacgcggactgggcggtccggaaccgggagcgcaaggcagcgaagcgcctgcgcatccgcgaggagaacaaggtcgtcgtcaagcgcccggaggacttcgtcacggcgttccggaacaaggagcgcgacttcctacggatgaggacccgcctcaaggtccgcaagcagccgcccgccgaggcgctcggttccaagctcatcttcgcgatccgcatccctggctctgtggacttgcatccgcacatcaggaagatcttgaggaagctacggctgacgaaggtcctcaccggcgtgttcctcaaggccaccgatttgacgctcaagaggcttctcgtggttgaaccgttcatcacctacgggttcccgaacttgaagaatgtgaaagagcttatttacaagaagggccgtgggttcttggataaggagcctttccctcttaccagcaacgatctaattgagaaggctcttggagatc

SEQ ID NO: 30818 - protein, 195 aa, Panicum virgatum
  misc_feature: Ceres CLONE 1901919
  misc_feature (30)..(98): Pfam Name: Ribosomal_L30_N Pfam Description: Ribosomal L30 N-terminal domain
  misc_feature (103)..(154): Pfam Name: Ribosomal_L30 Pfam Description: Ribosomal protein L30p/L7e
MGSGGDEASRTVPPLAPGGTREELAFVKETVLKKRKENADWAVRNRERKAAKRLRIREENKVVVKRPEDFVTAFRNKERDFLRMRTRLKVRKQPPAEALGSKLIFAIRIPGSVDLHPHIRKILRKLRLTKVLTGVFLKATDLTLKRLLVVEPFITYGFPNLKNVKELIYKKGRGFLDKEPFPLTSNDLIEKALGD

SEQ ID NO: 30819 - DNA, 488 bp, Panicum virgatum
  misc_feature: Ceres CLONE 1901919-R
ggagataccgggcgaggagaccccttggtcgctgcgggactcgatgacgagccgcgtcaactcggcgtgggagctcgggcgcggcgtgtacctgggctaccggcggggcgcctacttccgcgaggggtggctgctgctgctgctgcgggcgctggcggtggcgctgcccggcctgccgttccaccgggtgcaggactacgtcaacgccgtcgtgctgggcctgggcggctacattcccaaggaaaactgatcgagccgtcagaggctcagagagctccctgcttattataatcatctgatcgtcaggtcatgctgaaggggcctgcaactgccgtgacatcacctgcatatcgatcccaagctatgcgatgtatgctaatgttttagtgtactacttgtaacaagcactaagcacgtaagcatgactgcatgagcttggagagacggtctgcttccgtacctatgcatctaagcatttcctgtactct

SEQ ID NO: 30820 - DNA, 713 bp, Panicum virgatum
  misc_feature: Ceres CLONE 1901932
  misc_feature: Encodes the peptide sequence at SEQ ID NO. 30821
gagcagctctcagttgcggcgctggatagatctcaccgatgggctgcggcgacagggacgtcgtgacggcggcgatggagcggcagccctggcgccgccgccacggatggcagctccccctacacccgctccagctagtgggcgcggcagtgttcgcgctcctcgtcgccgcgttctacgtcgtcctgggaccctacatcggcaacaccctcgccgggaacatcctcctcggcgccttctccttctcggccattgcggcggcggcgctctacgtgcgctgcacggcagtggacccgtccgactggacggaagcgaagaaggacaagcggaagcggcagctcgcgcggggcggcggccatggtggcgcggggaggctgccgcggctgcggtacggctacatcctgtggcggtacgcggtgcggttgctgcggcgggttgagacgtgggtcaccaaccgctgggtgcggaggagctaccttgagcagtggaacaccagcgtgcagctcgaccccatgcttcccttcgccttcaccagcctcgacgacatcgtctcgccttgcgccaccacggacggtcacgacatctccttctgccccatctgcgactgcgaggttaaattgcgcagcaagcactgcaagacttgtgagcgttgtgttgatggatttgatcaccactgcaggtggctgagcaattgcattggaagaaggaactat

SEQ ID NO: 30821 - protein, 224 aa, Panicum virgatum
  misc_feature: Ceres CLONE 1901932
  misc_feature (176)..(224): Pfam Name: zf-DHHC Pfam Description: DHHC zinc finger domain
MGCGDRDVVTAAMERQPWRRRHGWQLPLHPLQLVGAAVFALLVAAFYVVLGPYIGNTLAGNILLGAFSFSAIAAAALYVRCTAVDPSDWTEAKKDKRKRQLARGGGHGGAGRLPRLRYGYILWRYAVRLLRRVETWVTNRWVRRSYLEQWNTSVQLDPMLPFAFTSLDDIVSPCATTDGHDISFCPICDCEVKLRSKHCKTCERCVDGFDHHCRWLSNCIGRRN

SEQ ID NO: 30822 - DNA, 637 bp, Panicum virgatum
  misc_feature: Ceres CLONE 1901932-R
ctgtacctaatgctgaagagtgaagaatcatccaagttgctccacatgtaaacattggagatgtacgaagatcctctcatttgctttgaccctcaccatgcaatacaacatcttcgaggtaaaaaaaggactggatatcagatgttccctggtgatccagttttgtgcttttattctgatattgctgagatgattaactgctgtcccggttcaagctccagccatcttagtaggaggtggctgttgctttttattttgaagcattgtgatttattttgggaatcttaagcgatcttctcaggcacattaatgattcgcatgagctcaaggtgcctcattcttttaaaagttgattcctttctttcataatctgcatagcttctggtgtcgacaagttattgcggattttggctgtcgctaatctcattgaaacatcatggtgcaaatcctgcttcgaggtctgcttttggtagttatagttgatgcttctacatcctttgggacttgagcccatttgctttcgtatttatggtgtaagcatatggggatgcctcaggtggttgatctcatcaactgcgcttggttggaattattatcaacttgcttggaggatgcacatcggctcaaggagtctctt

SEQ ID NO: 30823 - DNA, 720 bp, Panicum virgatum
  misc_feature: Ceres CLONE 1901936
  misc_feature: Encodes the peptide sequence at SEQ ID NO. 30824
acacagccaaaggctagaagcatcctccttcagcagcttgaatcggcggcttccagcgcctctctcttccgatccacgcttctctttctagcaaccgctgctgtctagctgaccatgacgaagcacggcgtggtgctcggccccgaggacgccgtcgtcgcggcggcggcggccgcgcggcatttctcgttcccgccgccgaggacggggggcgactcgtgcaggaagctggcggcgcaggtcgacctcggcgccgccgtcatgggatcctggctcgactccatgaaggcctcctcgcccaggcacgccgacgcggagcacgacgactggatggagcggcacccgtcggcattggaccggttcgacgcgctggcggcggcggccaaggggaagcaggtggccgtgttcctggactacgacggcacgctgtccccgatcgtcgaggaccccgaccgcgccgtcatgaccgacgagatgagggaggcggtgcgcggcgtggcggcgcgcttcccgacggcgatcgtcagcgggcgttgccgtgacaaggtgttcggcttcgtgcggctggcggagctctactacgccgggagccacgagatggacatccgagggcccaccgccgaccccaaccaccacggcaaggagggcaagtcggtgctgtgccagccggcgagcgagttcctgccggtgatcgaggaggcgtacggcgcgctggtggag

SEQ ID NO: 30824 - protein, 201 aa, Panicum virgatum
  misc_feature: Ceres CLONE 1901936
  misc_feature: Useful for making plants with modulated drought sensitivity
  misc_feature: Useful for making plants with modulated flowering time
  misc_feature: Useful for making plants with modulated low light sensitivity
  misc_feature: Useful for making plants with modulated water use efficiency
  misc_feature: The sequence is a functional homolog of SEQ ID NO 16 in US patent 7214858
MTKHGVVLGPEDAVVAAAAAARHFSFPPPRTGGDSCRKLAAQVDLGAAVMGSWLDSMKASSPRHADAEHDDWMERHPSALDRFDALAAAAKGKQVAVFLDYDGTLSPIVEDPDRAVMTDEMREAVRGVAARFPTAIVSGRCRDKVFGFVRLAELYYAGSHEMDIRGPTADPNHHGKEGKSVLCQPASEFLPVIEEAYGALV

SEQ ID NO: 30825 - DNA, 753 bp, Panicum virgatum
  misc_feature: Ceres CLONE 1901947
  misc_feature: Encodes the peptide sequence at SEQ ID NO. 30826
gctttgctcggcgcaggtgagagccgcttgctgcttccacctccatagttcgattcggtgctcagatccgagcgcgcttggaattccgctctcacttcccagcctgctgctctctttgctcacctgcaggttgccttccgactcttttttttttcctttcccccctcccctttcttcctactccgtctccgggttcggctggatccaaatgggcgcctgcgtgtccagggtcaccgtctgctgctgccgcacgccgcgcaacggcgtaaccaacgactacactgatgctgtgacggaggagcagggggaggcatacgagctaccggtcttccaggagttcacctttgagcagttgcgcctcgctacgtcagggttcgccgtcgagaacatcgtgtctgagcacggcgagaaggcgcccaatgtggtatacaaggggaagctcgatgcccagcgccgcatcgccgtcaagcgcttcaaccgctctgcctggcctgacccacgccagttcctggaagaagctagatcagttggccagatccagagcaaaagattggcaaatttgcttggttgttgctgtgaaggtgatgagagattgcttgttgcagagtacatgcccaatgacacgctagccaaacatcttttccattgggaatcacaagcaatgaaatggtccatgagattaagggttgttctctatcttgccgaggctttagatactgcaccagcaggggtcgtgcgctctaccatgatctc

SEQ ID NO: 30826 - protein, 181 aa, Panicum virgatum
  misc_feature: Ceres CLONE 1901947
  misc_feature: SWISSPROT Homolog: EC 2.7.11.1 Non-specific serine/threonine protein kinase
MGACVSRVTVCCCRTPRNGVTNDYTDAVTEEQGEAYELPVFQEFTFEQLRLATSGFAVENIVSEHGEKAPNVVYKGKLDAQRRIAVKRFNRSAWPDPRQFLEEARSVGQIQSKRLANLLGCCCEGDERLLVAEYMPNDTLAKHLFHWESQAMKWSMRLRVVLYLAEALDTAPAGVVRSTMI

SEQ ID NO: 30827 - DNA, 735 bp, Panicum virgatum
  misc_feature: Ceres CLONE 1901952
  misc_feature: Encodes the peptide sequence at SEQ ID NO. 30828
gtcctcctctctctgccccccacattccccggcgcgcctcctctgcccgcggtcgccgccgctgtccggagcgagatcgtggtgatgtgctcgggcgcggctcctgtatctgtcgatgggagacgccgcgcgtgtccgtgggagcgggtggggaggaaccgaacgatggccgccgccggcccatccgccccgtgctgcaccgccgtgctggtcgcggccgcgctgctcctctcggcccctactgccacagaggattatgattccttggatccgaacggcgacctcgctataacatgggatattatgcactgcactcatgatggatatgtcgctgttgtcacgatgttcaactatcacctattccgggtcgttggggcacctgggtggcatgttgagtggacatggccaaataaagacgtcatatggtcaatggttggggcacagactaccgaacaggatgactgctcgaaattcttgggcaacactccccactgcggcgagaaagatcccacgatcatcgatttacttccaggcactcaatacaacatagcaatatgcaattgctgctaagcatgagttataattacatgtaatcaagacccatggtatgctgcttcctccttccagattagtgtatgtcttgctgagactaccgatatgagcggtaaggtgtctaatatcttcagtcttaagactcgaggtcctgcgtactcctgtgggcgtgccattgttggc

SEQ ID NO: 30828 - protein, 134 aa, Panicum virgatum
  misc_feature: Ceres CLONE 1901952
  misc_feature (54)..(134): Pfam Name: Phytochel_synth Pfam Description: Phytochelatin synthetase-like conserved region
  misc_feature: Useful for making plants with altered carbohydrate content
  misc_feature: The sequence is a functional homolog of SEQ ID NO 4 in US patent 7109001
  misc_feature: Useful for making plants with altered cell wall content and/or composition
  misc_feature: Useful for making plants with altered lignin content
MAAAGPSAPCCTAVLVAAALLLSAPTATEDYDSLDPNGDLAITWDIMHCTHDGYVAVVTMFNYHLFRVVGAPGWHVEWTWPNKDVIWSMVGAQTTEQDDCSKFLGNTPHCGEKDPTIIDLLPGTQYNIAICNCC

SEQ ID NO: 30829 - DNA, 642 bp, Panicum virgatum
  misc_feature: Ceres CLONE 1901959
  misc_feature: Encodes the peptide sequence at SEQ ID NO. 30830
gctcttcgctctagcttgcttccgtgctgatctttactaccactggttgcctggtgtcgagaggaagcccccggagcacgggaggcccgggagcttctccaggagcgaggggggcgggcatgaggatcctgtgcgacgcgggcgagggcgcggcggcctcggtggtgtgctgcgcggacgaggaggcgctgtgcgcgcgctgccacctctagatccactccgccaaactcctcggcggcaagcaccaactcctcccgctcggcgccggcgccggcgccggagggcacgccccgcgctgccacgtctgacacgataatccggccttcctcttctgcctccaggaccgggcgctcctccgccgcgaccgccacgaacccatccacgtccccggcacgctctccgggaaccgaccgcgctgcctccccaccactttccgcgtcggcttcacctccggctgcggcgcccgcccccgctccggccccaattcccctccgacaggtgttgccacctcagagaccgcaggtgccgcctcgtcctctagagcacctgcctccacgacctgctcgacctccgatgcgccgtcggcgcctctcctggctccgacctgatgagccgtccactatctccggctgctcaactagt

SEQ ID NO: 30830 - protein, 30 aa, Panicum virgatum
  misc_feature: Ceres CLONE 1901959
  misc_feature: Useful for making plants with altered alkaloid content
  misc_feature: Useful for making plants with altered lignin content
  misc_feature: Useful for making plants with modulated flowering time
  misc_feature: The sequence is a functional homolog of SEQ ID NO 1961 in the 11/479,226 US patent application
  misc_feature: The sequence is a functional homolog of SEQ ID NO 1300 in the 11/479,226 US patent application
  misc_feature: The sequence is a functional homolog of SEQ ID NO 602 in the 10/412,699 US patent application
  misc_feature: The sequence is a functional homolog of SEQ ID NO 465 in the 11/479,226 US patent application
  misc_feature: The sequence is a functional homolog of SEQ ID NO 1023 in the 10/666,642 US patent application
  misc_feature: The sequence is a functional homolog of SEQ ID NO 1645 in the 10/374,780 US patent application
  misc_feature: The sequence is a functional homolog of SEQ ID NO 1671 in the 10/412,699 US patent application
  misc_feature: The sequence is a functional homolog of SEQ ID NO 1024 in the 10/666,642 US patent application
  misc_feature: The sequence is a functional homolog of SEQ ID NO 1646 in the 10/374,780 US patent application
  misc_feature: The sequence is a functional homolog of SEQ ID NO 1672 in the 10/412,699 US patent application
  misc_feature: The sequence is a functional homolog of SEQ ID NO 1478 in the 10/666,642 US patent application
  misc_feature: The sequence is a functional homolog of SEQ ID NO 1890 in the 10/412,699 US patent application
  misc_feature: The sequence is a functional homolog of SEQ ID NO 2148 in the 10/374,780 US patent application
  misc_feature: The sequence is a functional homolog of SEQ ID NO 454 in the 11/435,388 US patent application
  misc_feature: The sequence is a functional homolog of SEQ ID NO 676 in the 10/225,066 US patent application
MRILCDAGEGAAASVVCCADEEALCARCHL

SEQ ID NO: 30831 - DNA, 1275 bp, Panicum virgatum
  misc_feature: Ceres CLONE 1901975
  misc_feature: Encodes the peptide sequence at SEQ ID NO. 30832
ctacatgagactgtccatctcatttattcggacagctaataacataagcatggccgctcaccttaaattgcctttcacccaacgcctcctcttgcttctttcctattatgttgccaccgcagtgtctgatccttcttctcgtcaagaactattccacgaaacaagccagcatcctataccatacgacctacagccagagctcttccccaacgagcggctctaccaagcctacctggtcatccagcgtttcaagagcactatcactagtgaccccaagaacataacagcaacctggaccggtcatgacatctgcggcgaaaagacctacctcggcttctactgcgccacactgccagggttagctgagaagctaacagtcacggaggttcttttgaatggatttagcctgcgcgcacccaaattgcaaggcttcatcgatcagctcccggatatcgcgcttttccatgctgcctccaacaatttcgatggaaatatccctcaactcgacagactgccttacctgtaccagctcagtatatctaactacgatacccagcctttgcatccttctggtactggcgccgacggtgttggggaagttagagcaggatacggccgacggccaccggtaccaaaccaaacgccatgcacaaaggggtttcttcattttacatttcacatcagtgctggcaatgcgacttcagaaggcctcattccgggcattccgaatccaaggattccgggccttccagagcatccaaagtttccgggcataccgggcgccacggattataaggcgctcctcctcaactacaacaacctgtccgggcaacttccggcgaacctcggcctctccaagttgagctacctcgccctcgccaacaacaagctcacgggtccaatcccaccgtcgatcgagcacctgcaagactccctcttcgagctgctcctcctcaacaaccagctctccggctgcctaccccacgagctcggcatgctccacaaggcggccgtcatcgacgccggcctgaaccggctcaccggcccgatcccgtcatccttctcctgcctcagcagcgtcgagcagctcaacctcgccgggaaccgcctctacggcccggtgcccgacgctttctgcaagctcgccgggcccgccggccgcctcgccaacctcacgctgtccggcaactacttcacctccgtcggggcggcgtgcgcggcgctgatcaaggacggcgtgctggacgtgaagagcaactgcatcccgggcctcgc

SEQ ID NO: 30832 - protein, 408 aa, Panicum virgatum
  misc_feature: Ceres CLONE 1901975
  misc_feature: SWISSPROT Homolog: EC 2.7.11.1 Non-specific serine/threonine protein kinase
MAAHLKLPFTQRLLLLLSYYVATAVSDPSSRQELFHETSQHPIPYDLQPELFPNERLYQAYLVIQRFKSTITSDPKNITATWTGHDICGEKTYLGFYCATLPGLAEKLTVTEVLLNGFSLRAPKLQGFIDQLPDIALFHAASNNFDGNIPQLDRLPYLYQLSISNYDTQPLHPSGTGADGVGEVRAGYGRRPPVPNQTPCTKGFLHFTFHISAGNATSEGLIPGIPNPRIPGLPEHPKFPGIPGATDYKALLLNYNNLSGQLPANLGLSKLSYLALANNKLTGPIPPSIEHLQDSLFELLLLNNQLSGCLPHELGMLHKAAVIDAGLNRLTGPIPSSFSCLSSVEQLNLAGNRLYGPVPDAFCKLAGPAGRLANLTLSGNYFTSVGAACAALIKDGVLDVKSNCIPGL

SEQ ID NO: 30833 - DNA, 607 bp, Panicum virgatum
  misc_feature: Ceres CLONE 1901984
  misc_feature: Encodes the peptide sequence at SEQ ID NO. 30834
tcccatcgaggagagtgcacgggcaccgacggctatgggagcgcccctccgaggcgcgggcaccctgatgtacccggccaacatgggcggccccgcctccacctcgctgccgtcccggcacccgtcccacctcgccgaggcggtcggcgtcgacaacgacacggccaagatcacgtgctccctgcactccgacatcagggaggtcgcgagcaagtgcgtcgacgccgccaagctcgccggcttcgcgctcgccacctcggcgctcctcgtctccggcgcgagcgcggagggcacgcccaggaggctgacctacgacgagatccagagcaagacgtacatggaggtgaaggggaccggcacggcgaaccagtgcccgaccatcgacggcggtgtcgagtccttcccgttcaagcccggcaagtaccagatgaagaagttctgcctggagccgacgtccttcaccgtcaaggccgagggcatcgccaagaacgcgccgcccgagttccagaagaccaagctcatgacccgcctcacctacacgctcgacgagatcgagggcccgctcgaggtcggctccgaccgcgccctcaaattcgaggagaaggac

SEQ ID NO: 30834 - protein, 190 aa, Panicum virgatum
  misc_feature: Ceres CLONE 1901984
  misc_feature (95)..(190): Pfam Name: MSP Pfam Description: Manganese-stabilising protein / photosystem II polypeptide
MGAPLRGAGTLMYPANMGGPASTSLPSRHPSHLAEAVGVDNDTAKITCSLHSDIREVASKCVDAAKLAGFALATSALLVSGASAEGTPRRLTYDEIQSKTYMEVKGTGTANQCPTIDGGVESFPFKPGKYQMKKFCLEPTSFTVKAEGIAKNAPPEFQKTKLMTRLTYTLDEIEGPLEVGSDRALKFEEK

SEQ ID NO: 30835 - DNA, 673 bp, Panicum virgatum
  misc_feature: Ceres CLONE 1901989-R
  misc_feature: Encodes the peptide sequence at SEQ ID NO. 30836
cgcgggtgcaggaggcggccatgaggctctaccacagccggaggcgcggcgagggcgaggagcccggcaaggtggagctgctccaggccttccagtccgtggaggcggccgtgaggaggttcttcttcgcgtaccggcagctggtggcggcggtgatgggcacggcggaggcgtcgggcaaccggacgctgttcgtgccggcggaggggatggacccgctcgcgcagatgttcctcgagccgccctactaccccagcctggacgccgccaagacgttcttggcggactactgggttcagaagatggcgggggcctctgctccgtcccggcagagctgaaaccacgagatggcgctgcggctggatagcgaccggatcgaagttttgcccgacctgctctcatgcatgcttgatgcatcctaattccggtggtgattgtgtggtccattcctatagagattgtgtacttacttgtagcaccagattctcttttttttttgtgtgcactgcttctgcattgtgttgtgttctactcctacccagagagtttgattcagttagatgccatttgtaactctagggaaagcatttcaatttgaaattatgtacatatcacattttgtaaatattttagatggtttcatgtattggattgactgaatgttttgatcgat

SEQ ID NO: 30836 - protein, 111 aa, Panicum virgatum
  misc_feature: Ceres CLONE 1901989-R
  misc_feature (1)..(100): Pfam Name: Hs1pro-1_C Pfam Description: Hs1pro-1 protein C-terminus
RVQEAAMRLYHSRRRGEGEEPGKVELLQAFQSVEAAVRRFFFAYRQLVAAVMGTAEASGNRTLFVPAEGMDPLAQMFLEPPYYPSLDAAKTFLADYWVQKMAGASAPSRQS

SEQ ID NO: 30837 - DNA, 667 bp, Panicum virgatum
  misc_feature: Ceres CLONE 1901989
acactctgcaactaaacaaggcctaaggcctcctccaaaggtcccagctagtgatagctctaagccagcaggagagagaagataaaagtgcccatgcaggagcttcgggagatgcattgtgagaggaaaatgtatcgggaagcgagcgagctaatcttctctgcaagcgctagcgcgggttgttttctactgttcatcatatagaataatgtttatgctagctctaagccagcctgttgtaggaggcctaagagcaagcctaataatttagctgtttgctgcaaagattcttctagcctacctcttagcctacttgtatactggttagtcattcatcattaataaatggttcacttgtctctctcacaagatttcttggttcttgtgtcgaagcgggctgtaagtttacaacctactataatagttgctctagcagtgcactttcatagctcattacatctttggaacctcgtgaaatgcagagaagcctgagggacatcgctgcattgtataactgtgaagcctcactcgagaaggttgaggagttcaggacggctgaaggattgacattgatcggctcgaaatgcttccaagctgccaacatatctgccgtccttatagatgatggcataacgtttgacaaaatgctggacttggattcccacaa

SEQ ID NO: 30838 - DNA, 378 bp, Panicum virgatum
  misc_feature: Ceres CLONE 1901994
  misc_feature: Encodes the peptide sequence at SEQ ID NO. 30839
atctcgtcctctctcccgctacaaattcctccccagccatccatctccaatcccacctgtctcccctgatcctctcctcatgcacattgttgttaatacccttcccggtcagaccatctcttatggatgttgagtgctctgaccccgttgcgcctgtgaaagccaggatgtcggactcggagggcttccctcccgatcatcaccgtctgatctttgatggacatgttcttgaggatggccgcgccctgccacagtacaacctccgaaatgactccccccgcctcctggtgctctgtctgcggggaggtatgcgtatctttgtgaggactctcgctggccaaagagtttccttggagggggactcttcctacctcttcc

SEQ ID NO: 30839 - protein, 85 aa, Panicum virgatum
  misc_feature: Ceres CLONE 1901994
  misc_feature: Useful for making plants with modulated nitrogen use efficiency
MDVECSDPVAPVKARMSDSEGFPPDHHRLIFDGHVLEDGRALPQYNLRNDSPRLLVLCLRGGMRIFVRTLAGQRVSLEGDSSYLF

SEQ ID NO: 30840 - DNA, 726 bp, Panicum virgatum
  misc_feature: Ceres CLONE 1901997
  misc_feature: Encodes the peptide sequence at SEQ ID NO. 30841
gaaagcaacaaactactctagtatcagagagagaagaggagagagcgaagatctttttctattagagagagagagagagaggcattgccgtgacccctctctcgccggcgaccgatgggctcggaggcggagatcacgggcccgctcctcgcggccggcggcggcgcggaggcggaggcggtgccgccgtggcgggagcaggtgacggtgcgggggctggcggtcagcgcggtcctgggggtgctcttctgcctcatcacgcacaagctcaacctcaccgtcgggatcatcccctcgctcaacgtcgccgcggggctgctcggctacttcctcgtccgcacgtagacggcggcgctcgagaggctcggcgtcgtctccaagcccttcaccaagcaggagaacaccgtcatccagacgtgcgtcgtcgcctgctacgggctcgccttcagcggggggtttggaagttatatacttgcgatggatcagaaaacctacgagcttatcgggacagattatcctggtaacagggctgtgaatgttaagaatccttcacttggttggatgattgggtttatgttcgtcgttagcttcctcggcctatttagtcttgttgcgctacgcaaggtcatggtaatcgattacaagctgacctaccctagcgggacagccacggccatgttgataaatagcttccacacgaccactggagctgagcttgcagacaag

SEQ ID NO: 30841 - protein, 82 aa, Panicum virgatum
  misc_feature: Ceres CLONE 1901997
  misc_feature: The sequence is a functional homolog of SEQ ID NO 214 in the 10/412,699 US patent application
MDQKTYELIGTDYPGNRAVNVKNPSLGWMIGFMFVVSFLGLFSLVALRKVMVIDYKLTYPSGTATAMLINSFHTTTGAELAD

SEQ ID NO: 30842 - DNA, 356 bp, Panicum virgatum
  misc_feature: Ceres CLONE 1902019
  misc_feature: Encodes the peptide sequence at SEQ ID NO. 30843
gtaaacccctctctctctctctctctctctctctctctctctctcttcctcggccggcctgctcctgcgatccgtgctgcagatcgccagatcagtcgacatggcgctcgtattacattctggacctggtaacaagaatgccttcaggcacttattgggcagaaaatacaatggggttaagattgagttgacaaagaattttgagatgggtgtcaccaacaagacccctgagtttcttaagatgaacccccttgggaaggtgcctgttctggagactcctgaaggtgctgtttttgagagccatgctattgcacgatatgttgctcgcttgaatgatggcaaccctctttttggct

SEQ ID NO: 30843 - protein, 85 aa, Panicum virgatum
  misc_feature: Ceres CLONE 1902019
  misc_feature (1)..(76): Pfam Name: GST_N Pfam Description: Glutathione S-transferase, N-terminal domain
  misc_feature: SWISSPROT Homolog: EC 2.5.1.18 Glutathione transferase
MALVLHSGPGNKNAFRHLLGRKYNGVKIELTKNFEMGVTNKTPEFLKMNPLGKVPVLETPEGAVFESHAIARYVARLNDGNPLFG

SEQ ID NO: 30844 - DNA, 697 bp, Panicum virgatum
  misc_feature: Ceres CLONE 1902037
  misc_feature: Encodes the peptide sequence at SEQ ID NO. 30845
aaggctctcggaatcctatcgccacccacgacacgacgccgcggagggcggcggagctcagtgttctgtttcccgaactctttgtccttcctccttcgccatgttgccggcggtcgccgccgcatcccctgctctctcccatctgccgcgccaccaacaccttggccgtcgcttccacctccggtgccaccgcctcctccctgctactcccgccaaggcctcgtgtggcgcccgccgccggctcctagcaggcgcgttcgccgccggcgatggtccttcgggacaggatgttgattactctactggtactacgagttctggatctgcataccttggtctctttgttcgattgcttggtttggacaatgacgctcgtgatagggagcatgctgtttgcacactttatcaatactcccttggcggccggaagagcattgatgagataatgcaattccctggttgcattgtcctcatcattagcctcctgaagtcagagtccactcgagcccgtgaagcagctgctggtcttctgcgtaacataacgtcagttcaaatatacaggaagatggccattgagagtggagcaatggaagaagtcatgagtcttctgtgtaaatctacaataagccctgagatgatggagcagtgtttgtgtaccatttggaacttttctattgatgaaaactggagatacaag

SEQ ID NO: 30845 - protein, 198 aa, Panicum virgatum
  misc_feature: Ceres CLONE 1902037
  misc_feature (108)..(149): Pfam Name: Arm Pfam Description: Armadillo/beta-catenin-like repeat
MLPAVAAASPALSHLPRHQHLGRRFHLRCHRLLPATPAKASCGARRRLLAGAFAAGDGPSGQDVDYSTGTTSSGSAYLGLFVRLLGLDNDARDREHAVCTLYQYSLGGRKSIDEIMQFPGCIVLIISLLKSESTRAREAAAGLLRNITSVQIYRKMAIESGAMEEVMSLLCKSTISPEMMEQCLCTIWNFSIDENWRY

SEQ ID NO: 30846 - DNA, 700 bp, Panicum virgatum
  misc_feature: Ceres CLONE 1902037-R
ccaagggcccgctcgagaccttcgccgaccatctcgccgaccccgtcaacaacaacgcctgggcctacgccaccaacttcgtgcccggcaagtgaggcgtctgttcccgaactgttcgatttgtaggaggtccggatgtgagcgcgcattggtttcagtttgtgccatgatgtaaaaaaaaaaagcacacaaccaaactgaacacctgcaaggtcaaggaaggagtcaaaattcccaacaagcaaaggggaagtctgtgagctggttcgagttgctgctgctagctgcctgcgatcatggacaagatcctggccttctcgatcctgagctcgtcgccggcggacatctccgcgagcgggctctccacgcggctgtcgtggaggacctccgcctccgccgggagccagaagcagcggcaggcggagcaggcgccgaagcggcaggaggggaagcccgcggagcagcggccggcgccggcggagaggaaggcgcggttcgcgctggagttcgacgggatcaactgcttcgagtccatagtctccttctgagcccggagagcggttggattgatccaccggctcgctgatttttttcttggttgttgctgggtgaagcgacgagtgagtaatttgtacagactacagagctgtgtaccgcgcgcaaagccaatcaatggatgatcatggcgcatttgatttgc

SEQ ID NO: 30847 - DNA, 602 bp, Panicum virgatum
  misc_feature: Ceres CLONE 1902049
  misc_feature: Encodes the peptide sequence at SEQ ID NO. 30848
aataaacaatagacagcacccgcgaatgtctagcttcgccgggcgagcctcgaccacatcaagcatcgtggccagcctctccacccccacgacgccgtccaaggccacctgcgccgccttcacctccgcgagccgccccaggctcatcatgaacgcgcccgtcttcgccgcccccagcgccgtcgcgagcatggacgcggtggagcgcttgaagagcgggttcgagcacttcaagacccacgtctacgacatgaagccggagctgatcgagccgctcaaggccggccaatgcccgatgtacatggtgttcgcctgcgccgactcccgctgctgcccgtcggtgaccctgggactgcagcccggcgaggccttcaccatccgcaacatcgccgccatggtcccgccctacgacaagaacaagtacgccggcatcggcgccgccatcgagtacgccgtctgcgccctcaaggtggaggtcctcaccgtcattggccacagccgctgctgtggcatcagggcgctcctctccctccaggacggcgcagccgacaccttccacttcgtcgaggactgggtcaggatcggctaccaggccaagaaga

SEQ ID NO: 30848 - protein, 192 aa, Panicum virgatum
  misc_feature: Ceres CLONE 1902049
  misc_feature (85)..(192): Pfam Name: Pro_CA Pfam Description: Carbonic anhydrase
  misc_feature: SWISSPROT Homolog: EC 4.2.1.1 Carbonate dehydratase
MSSFAGRASTTSSIVASLSTPTTPSKATCAAFTSASRPRLIMNAPVFAAPSAVASMDAVERLKSGFEHFKTHVYDMKPELIEPLKAGQCPMYMVFACADSRCCPSVTLGLQPGEAFTIRNIAAMVPPYDKNKYAGIGAAIEYAVCALKVEVLTVIGHSRCCGIRALLSLQDGAADTFHFVEDWVRIGYQAKK

SEQ ID NO: 30849 - DNA, 709 bp, Panicum virgatum
  misc_feature: Ceres CLONE 1902054
  misc_feature: Encodes the peptide sequence at SEQ ID NO. 30850
attcagatccgccactattcttcttcatttcttcttccacagctagctagctagcagccggtgggtgcagcagcagcagcagcagcaggacaccgatccgcccgactacaagcaaggatgctggccatcttccagaagcaggtggcgcacgcgccgcaggagctcaacagcccccggagcggcggcgccgccaagcccaggagccccgacgagatcctccgggacttccacgccgcgcgcgcctgccctgctgccggggccggccaccaccagcgcatgttctgcggcctcgacgacatctactgcgtcttcctcggccgcctcgacaacctcagcgccctcatccgccagtacggcctctgcggcaagtccaccaacgaggcgctgctcgtcatcgaggcctaccgcaccctgcgcgaccgcgggccctaccccgccgaccaggtcgtcaaggacctcgccggatcattcgccttcgtcgtcttcgacaacaagtccggcgccgtattcgcagccctgagcgccgacggcggcgttccgctcttctggggcatcgcggcggacggctccgtggtgatctgcgaggaccgggagatcgtcaagcgcgggtgcggcaagtcgtacgcgcccttccccgtggggtgcatgttccacagcgaaggcggcctcaagagcttcgagcaccccatgaacaggctcaaggcgatgc

SEQ ID NO: 30850 - protein, 197 aa, Panicum virgatum
  misc_feature: Ceres CLONE 1902054
  misc_feature: SWISSPROT Homolog: EC 6.3.5.4 Asparagine synthase (glutamine-hydrolyzing)
MLAIFQKQVAHAPQELNSPRSGGAAKPRSPDEILRDFHAARACPAAGAGHHQRMFCGLDDIYCVFLGRLDNLSALIRQYGLCGKSTNEALLVIEAYRTLRDRGPYPADQVVKDLAGSFAFVVFDNKSGAVFAALSADGGVPLFWGIAADGSVVICEDREIVKRGCGKSYAPFPVGCMFHSEGGLKSFEHPMNRLKAM

SEQ ID NO: 30851 - DNA, 1126 bp, Panicum virgatum
  misc_feature: Ceres CLONE 1902059
  misc_feature: Encodes the peptide sequence at SEQ ID NO. 30852
gtaacgaaatggtcatcgccccaaccaaaccaaacacccctccgccgctcccaccaactccccccgatctcggccatggcggcgggggagggcgccggcgccggcgcggaaatggacgcgctcatccggcggctgaggctccaccaggcggggccatccccgtacgaccccgcaccggcggcgacccccgtggccgacggaggcggcggcggcgagctcttccggccgcggagggccgccgtgctcttatgcctcttccggggcgccgcaggcgagctccgcgtcatcctcaccaagcgctcgtccacgctctccgcccattccggtgaagtttctttgccaggaggaaaggccgaggagagtgatgcagatgatgcagcaacagcattaagggagtcaagagaggagattgggcttgatccatctctggtcacagttgttgcatctcttgaacacttcttgtccaagcatcttctggtagttgttcctgttattggcatactgtcagacatacaagtgtttatacctgttctaaatgttgctgaggtggatgaaatatttgatgtgcccctggagatgttcctcaaggatgagaacaggacatcagaggaacgggaaaagatggggcagacattcacagttcattacttcacttatgtaaaaggggatcagaagtacttaatctggggtctgacgacccgcatccttatccatgctgcttcagttgtatacgagcgatcgcctgactttcctgagcaaagaacacatttcaacttgccaaagtacacaaaggattgttcttcaatgctggcagggcttgctaaacactagtctctatgacactgtctgaagtatagactactggggcgtgtaagagatttcactgcaagaaatggttacaggatccaaggggagtccaaatcatatggtgtctttataatttagattctttgcacagtcttttacttgacactatagtaacatttacaattagaacaatgcttaaaatactttatacccgtcaaatggtccatttagatactgttgatgatatcaaacactctctgatgcaattgaattgtatgtattattcgtttgttctataaggataaggttctgaactttc

SEQ ID NO: 30852 - protein, 251 aa, Panicum virgatum
  misc_feature: Ceres CLONE 1902059
  misc_feature (52)..(190): Pfam Name: NUDIX Pfam Description: NUDIX domain
MAAGEGAGAGAEMDALIRRLRLHQAGPSPYDPAPAATPVADGGGGGELFRPRRAAVLLCLFRGAAGELRVILTKRSSTLSAHSGEVSLPGGKAEESDADDAATALRESREEIGLDPSLVTVVASLEHFLSKHLLVVVPVIGILSDIQVFIPVLNVAEVDEIFDVPLEMFLKDENRTSEEREKMGQTFTVHYFTYVKGDQKYLIWGLTTRILIHAASVVYERSPDFPEQRTHFNLPKYTKDCSSMLAGLAKH

SEQ ID NO: 30853 - DNA, 495 bp, Panicum virgatum
  misc_feature: Ceres CLONE 1902076
  misc_feature: Encodes the peptide sequence at SEQ ID NO. 30854
gtcgtcccgtgctcatcctcccctctatcgggtatcctcctggcgcctcctcagctccctaatccccactggcatctcaatctctcccatatctcttcctccgggggatcaagaaggaggagcatggaagggcctccactcgcgcttttctacagagccaaggctgcctaacaattcttcttgcataccacggcgcgatgcgactgaatcggaggagcatgtcctcaccatggccacacacattaaaggcatcacaaccaagcttgggatcccccttgtgttcatctccagctttgataaagcaaatcctacatcatcaaaatctttccgtggtcctggtctggaagaaggcctaaagatccttgaaaaggtgaaagcaatatatgaccttccagttgtcactgatgtgcatgacagccaccattgtgaagctgttggaaaagttgctgacattatacaaattccagctttcctctgtcctcagactgatcttct

SEQ ID NO: 30854 - protein, 88 aa, Panicum virgatum
  misc_feature: Ceres CLONE 1902076
  misc_feature: SWISSPROT Homolog: EC 2.5.1.55 3-deoxy-8-phosphooctulonate synthase
MATHIKGITTKLGIPLVFISSFDKANPTSSKSFRGPGLEEGLKILEKVKAIYDLPVVTDVHDSHHCEAVGKVADIIQIPAFLCPQTDL

SEQ ID NO: 30855 - DNA, 616 bp, Panicum virgatum
  misc_feature: Ceres CLONE 1902089-R
  misc_feature: Encodes the peptide sequence at SEQ ID NO. 30856
cagagaagtgtcttgagctagatcccaccttcagcaaagggtacacacggaaaggtgcaattcaattcttcatgaaggaatatgacaaggccatggaaacctaccaggctggcctaaagcatgatcctaataaccaggaactgcttgatggtgttaggaggtgtattgaacagatcaacaaggccaacagaggagaaataagccaggacgaattgcaagaaagacagaataaagctatgcaagacccagaaatccagaacatccttacagatcctatcatgcgacaggtgctaattgatttccaggagaaccccagggccgctcaggagcacctgaagaaccctggagttctgcagaagattcagaaactcgtaagcgctggaatagtccagatgagataatgatgcgattgtacccacctgtttgtgtcttgtactgggcttgttaattcacatgcccccgttcgtatctttcaaaaatgtagccgcggcaaaggttcatcaacttattgggggctagtgtcgtcctcttcccattggattgtaagggcagttgacattggattattcatgtttgtggtgctgagttataggcgacgtcgttttttcttgatcct

SEQ ID NO: 30856 - protein, 132 aa, Panicum virgatum
  misc_feature: Ceres CLONE 1902089-R
  misc_feature (11)..(44): Pfam Name: TPR_1 Pfam Description: Tetratricopeptide repeat
  misc_feature: SWISSPROT Homolog: EC 3.1.3.16 Phosphoprotein phosphatase
EKCLELDPTFSKGYTRKGAIQFFMKEYDKAMETYQAGLKHDPNNQELLDGVRRCIEQINKANRGEISQDELQERQNKAMQDPEIQNILTDPIMRQVLIDFQENPRAAQEHLKNPGVLQKIQKLVSAGIVQMR

SEQ ID NO: 30857 - DNA, 651 bp, Panicum virgatum
  misc_feature: Ceres CLONE 1902089
gcaatcagatctcaaaagcaatctcctatcaaacggaaggaactagcaacaagaactgatccaagataagtaaagcccacaagtgacaaaaaaaaggtttccttgcattgtcaaataattagcaatgcagggcaaaataactccattatcagagctgcatcccgtgaacactctgtacaatgttcatgtcagggtgtcaaggacttgggaatataggggtaaaagtgagaacaatcctctgatccattttgacatggtggtcattgatcaaatgggttatgcagtgtactgtgaggtacctccacaagtgctggacaagttgaagcaatatttacaagaaggaaagattctctatatatgcaatgcatgtgttgaaagggctaaacctggatttagagttgtggataccccttacatattaaaactgatcatgagaacacagatcttcgaaggaaatagcaatgatacaactttcccaaagtatgtattttcattgaccccaatcgaaatgctaccacaatatgcaaggaggacagaccgttttctagatgtcattggaaaaatcactgccatcttaaatgcagctgtagcatgtaacacatctggagaccttatgatgcgtaggctgataacacttcaagatgaaaaggg

SEQ ID NO: 30858 - DNA, 618 bp, Panicum virgatum
  misc_feature: Ceres CLONE 1902091
  misc_feature: Encodes the peptide sequence at SEQ ID NO. 30859
ctgcccagcccagctcccgctgcccagccctgccaagccaagcccgtcggccaccgcacatcccggggaacccaatcccatcgcgaacgcagagatcccgtgccagcgggctgcggcggcggcggcggcgacggtggtggactggacggactactactagccataacccgtatccaatagcccgtccattccatccagccggagccggacctcccacccgcatcctcctccccgccgacggggatggccaggctcgtgctctcggactgctgctggctctcgccgctgggactgcgcttctgctggggcggcggtgcgggcggcggccgtcgctgccctctatactcctcaactcccacaccgacgtcgtgccgtcggagccgcagaagtgggaccacccgcccttctccgccgccctcgacgaggcatccggtcgcatctacgcccggggctcccaggacatgaagtgtgtggggatgcaataccttgaagccatccgctgtctccgttctgcaggatttgttccagatcgaaacatctatataacttttgttcctgatgaggagattggtaggcatgagggtgttgagctgtttgtatcatctaaagaattcaaaa

SEQ ID NO: 30859 - protein, 205 aa, Panicum virgatum
  misc_feature: Ceres CLONE 1902091
  misc_feature: SWISSPROT Homolog: EC 3.5.1.14 Aminoacylase
AQPSSRCPALPSQARRPPHIPGNPIPSRTQRSRASGLRRRRRRRWWTGRTTTSHNPYPIARPFHPAGAGPPTRILLPADGDGQARALGLLLALAAGTALLLGRRCGRRPSLPSILLNSHTDVVPSEPQKWDHPPFSAALDEASGRIYARGSQDMKCVGMQYLEAIRCLRSAGFVPDRNIYITFVPDEEIGRHEGVELFVSSKEFK

SEQ ID NO: 30860 - DNA, 591 bp, Panicum virgatum
  misc_feature: Ceres CLONE 1902095-R
  misc_feature: Encodes the peptide sequence at SEQ ID NO. 30861
gaagaatacacattccaagagatcattgccaagatggggcctattccaagtacatactctgctgttcatctccccgcctatttgctggagcaaaccgatcggtacagatatcttcttccaggccagtgcatgagagagagtggctaggcagctactacggtctgcatcatgacctgacgagcatggatgtcgcctgccgatgtccccctggaggaacacccctgccttggcggggttgtatttgatacgattggctgacttagttgagtgatcgcttggctgctggttgagttcatatgagattctgtaccgtgtaattcaaaccttggaaggccctgactgcagcattgctgcgttcttgttttgcggaggagctcagcagtgtgtgtgcttatttataccacctgagtttttattcattgcttccatgattgatatatgaactcaagctattgtagattttataccgagcgatatttcagtttcttttttttcctctttcacttcgtgctgtacatcatctttacttaccagattactgacagtggctctcacttctgattactgacggtcgagctgagttgtttgctc

SEQ ID NO: 30861 - protein, 48 aa, Panicum virgatum
  misc_feature: Ceres CLONE 1902095-R
  misc_feature: Useful for making plants with altered carbohydrate content
EEYTFQEIIAKMGPIPSTYSAVHLPAYLLEQTDRYRYLLPGQCMRESG

SEQ ID NO: 30862 - DNA, 677 bp, Panicum virgatum
  misc_feature: Ceres CLONE 1902095
atacgcgccgatcgatcgccagcgacgacgggccaagaaaggggaaaggacgccggaggagagcaaccacacctggaggcaagggaaccgggcgaatcgaagcaagtttcgtgctgattccggttggttcgggggcttgtttcctcctctgcttccgtgagagatttgaggtgcgcgcgcgcggggaagatggctcctgcgaaatccatggagagggccaccagcttcgccatggcctgcagcctcctcagccgctacgtcagggagaagggcgccgccgccggggaggtcggcctcggcatcagaggtgagcccctgtctcctgaatctcgaggaggaaaagtcggaatctttaggagcttagaactgtatatgttggggaacaagttgtaaatttgtaatttgagctaggttcgtgcaagaaactgcgatttcaggtgctctggtagttgtcttatgttagatctggaccccggtagttgtgatttttgaaccaaaactctaccttttggtttccttcaagaatttgggcatcgatcagctctagtgtcttgaatctgacaactttttgttcatttagcgatctttttgctaaagaagtgtgttattcttctggtttcagttgaagcagcggatgcacagaggacgtcggcagacgcacagaaaggggacgcgag

SEQ ID NO: 30863 - DNA, 314 bp, Panicum virgatum
  misc_feature: Ceres CLONE 1902122
  misc_feature: Encodes the peptide sequence at SEQ ID NO. 30864
acaagcataggttttatctgttacgtcgcagcatctgcacgcggcctgcgttcgagcgatcagctcccctgtgctgcgcgaccatggccgccgagtcggaggtggcggtcgacggcgtcgtcttcacgccggtggcacgcccgccgggctccgggcgctcgcacttcctcgccggcgcaggtgtgcgagggatggagattggcggcaacttcatcaacttcccggcctttggcgggtacctggaggagggccccccctcgcccccgctgggaaaaaggtgggccggcaagtccgccgacaagctcgccgccaac

SEQ ID NO: 30864 - protein, 76 aa, Panicum virgatum
  misc_feature: Ceres CLONE 1902122
  misc_feature: SWISSPROT Homolog: EC 5.5.1.6 Chalcone isomerase
MAAESEVAVDGVVFTPVARPPGSGRSHFLAGAGVRGMEIGGNFINFPAFGGYLEEGPPSPPLGKRWAGKSADKLAA

SEQ ID NO: 30865 - DNA, 2200 bp, Panicum virgatum
  misc_feature: Ceres CLONE 1902131
  misc_feature: Encodes the peptide sequence at SEQ ID NO. 30866
aaacaaagcgctccggctcaaaggccaaggcgcagctcggcgcccgcggcggaggactggaggaggcggaggcaaaacccccccgcgccgcattgccccccgggaccctccgattcggcccgcgccgagctcgaatccgcgcaacctcgccggcggcgggctcgatctgcgccggcgcgggcggcgaggaatggggagcgtggacggcgaggtcgacgggatccacgcagcaaatcggcgtgctgagttggtcaaatggctcaatgccttgctcccagaagttaatttgccatcggattcatcggatgaagagctgagagagcttctcggtgacggtgtggtcctgtgccgtattgcgaacaccctcatccccggtgttcttgaggggtcatggggtggttatgcatcgttggatcagaggtcaggcaatgtgaagaagttcctctcagtagttgctgatatggggttgccaggtttcagtgtgacagaacttgatgagggaccaatgtcttcagtagtggaatgcctcttggttttgagggacagtgttgatcctagattgggtgatgatagtccaccagatgttgccaaaactcctttgaggaaacaatggggagttccggaaatggacaggcctcaggttcctggtgcagcactagggaaaagatcccctggagaggacatgagaaatggtgttccagaatccaaggctcatcagaaaacttctgttttttctggacaaaagtttcgagaagttttccaattaaaacgcggatcctattccgatcttcctgcttccaagatttcagaaatgatgcactctagtagcttagataatgcaccgacgcagtcacttattagtgttgttaatggcattctggatgaaagcatagaaaggaaaaagggagaaataccacatcgtgtagtttacttactgaggaaggtcgttcaagagattgagctccgtctctgtattcaagcagagcatataagaagtcaaaatattatcatcaagacaagagaagagaagtactgttcaaaaattaaagcacttgaaatattggtcaatggcacaaatgaagaaaataagatggccgcaaacagacttcggatactcaaggatgagaagtcaaaaattgaagagagaagaaaagtcagtgagcaagatgttcatcgattaatgaaagagaaagaacattctgaaactattatagaaagcctaaagaaagatatggaagccatgaataggatgcataaggaacatcttgagcaaattgaaagaaaggcaaagcagatggaggaacagtttaccaccaaagttaaagaagttgagtaccttttactacaatcaaataagaaagttgaagaagttgaggctgcctccaagctaaaatcacagttgtgggataagaaagagcacatttttcagagttacatggataatcaacactttcatatcaaggacataaggatatcatcacgatcaattaaaaatgatatgtatgcacttcaaatgaagtggagagatgagatttccaacttagggtctgggttaaaatgtttggttgatgccgccgaaaattatcacaaagttttggcagagaaccaaaagttgtttaatgaagtgcaagaactaaaaggtaatataagagtgtattgtcgtgttaggccgtttcttcctggtcaagataagaaatctaccacaattgactatatgggggaaaatggcgagcttcttatttcaaatccatttaagcaaggaaaggatgggcatagaatgttcaagtttaacaaagtgtttaatccatttgcttcccaagctgaggttttctctgacattcaaccactggttcgatcagttcttgatggattcaacgtttgtatttttgcatatggccagactggttctggcaaaacttacacaatgagtgggcctagcacatcgaagcaagactggggtgtcaattaccgtgctttaaatgatttgtttgatatttcactaagtaggagaaatgccttctcgtatgaggtgggagtacagatggttgagatatacaatgaacaagttcgtgatcttttatcaaatgatattgcacaaagaagacttgggatttggagcacttctcaaccgaatgggcttgttgtcccagatgcaagcttgcacccagttaagtcgacatcagatgtattagacttgatg

SEQ ID NO: 30866 - protein, 669 aa, Panicum virgatum
  misc_feature: Ceres CLONE 1902131
  misc_feature (491)..(664): Pfam Name: Kinesin Pfam Description: Kinesin motor domain
  misc_feature (15)..(121): Pfam Name: CH Pfam Description: Calponin homology (CH) domain
MGSVDGEVDGIHAANRRAELVKWLNALLPEVNLPSDSSDEELRELLGDGVVLCRIANTLIPGVLEGSWGGYASLDQRSGNVKKFLSVVADMGLPGFSVTELDEGPMSSVVECLLVLRDSVDPRLGDDSPPDVAKTPLRKQWGVPEMDRPQVPGAALGKRSPGEDMRNGVPESKAHQKTSVFSGQKFREVFQLKRGSYSDLPASKISEMMHSSSLDNAPTQSLISVVNGILDESIERKKGEIPHRVVYLLRKVVQEIELRLCIQAEHIRSQNIIIKTREEKYCSKIKALEILVNGTNEENKMAANRLRILKDEKSKIEERRKVSEQDVHRLMKEKEHSETIIESLKKDMEAMNRMHKEHLEQIERKAKQMEEQFTTKVKEVEYLLLQSNKKVEEVEAASKLKSQLWDKKEHIFQSYMDNQHFHIKDIRISSRSIKNDMYALQMKWRDEISNLGSGLKCLVDAAENYHKVLAENQKLFNEVQELKGNIRVYCRVRPFLPGQDKKSTTIDYMGENGELLISNPFKQGKDGHRMFKFNKVFNPFASQAEVFSDIQPLVRSVLDGFNVCIFAYGQTGSGKTYTMSGPSTSKQDWGVNYRALNDLFDISLSRRNAFSYEVGVQMVEIYNEQVRDLLSNDIAQRRLGIWSTSQPNGLVVPDASLHPVKSTSDVLDL

SEQ ID NO: 30867 - DNA, 647 bp, Panicum virgatum
  misc_feature: Ceres CLONE 1902131-R
tgaacgaatgctcaagtctagtgacagagttctatcagatcctcagagttatgctgaggcgaatggagatactaaaaataattcaactgacattgcacctgtggatttagatgaagcagaatatgagggccatgcatctgatgatggtttatcagcaggtgaaactgagaatttcaactcagataaaactattgagatgacagcagaacggcatagaattccatcaagaataaccagatttactctcacgaagaatgggcaaccatctatgtctaggtcgaaaccaaaggatgcggttttgaagacaccgagtaatgcaaaagctccgtcaagccaaatgactggaggctctttagccaggggctctaaaagatggcagtagtgaagcacgaatgcatgattgtgttgctcgtttgatatccattgtaatccaaatgtgaattcctggggtagctgtaggacccatatatgattgtagcttttagaaatggggagatgtgagacattttgatggtcatgtttgaccttttgcttatgcggatcaaactccaagcaatgctctattgcatgtgaaacattctgacttgtgacccatttgtagaggttggtgggcctccggagttgtatatcaatgcaacagtgaattc

SEQ ID NO: 30868 - DNA, 1379 bp, Panicum virgatum
  misc_feature: Ceres CLONE 1902143
  misc_feature: Encodes the peptide sequence at SEQ ID NO. 30869
acagccaccagcaccgcgcccccgttgttcatttgctccaacggacggccggcgcaccaattccttagtccgtacacacgtacatcgatcggtcgccatgtctgccgcgaccgcttgcatgcccctggtccctccgcctccgtcgtctcctcgccacggatcgaccgggaagccagcaatggcggccgccgaggtcggcgagaggcggaagcccggtggcatggagactgacatgacgactcagagcagccatggcggcgaggagcggcgtggcgagggcaacggcgatggcgaagtgacgatgagcgagccgcgggcggtggtgcggacgctcgcgtgcgagcgcaagccctacgtcgagggcttcgcgcactggcggagcatcggcaggcctgagctgccggagatggatcctatcctttctttcgacgagttcgagttttccgcgccagctgcatttcttgatcatcctcacagagggtttgagaacgtcacttatatgctcgagggaggcgtcagttaccatgacttttcagggcacaagggcaccatcaacgaaggagatgttcagtggctgatggcggggcgcggcgtcgtgcacgcggaggtgcccgccggcaatggcgtgcagcggggcatcaacatctgggtcaacctctccgccaacgacaagatggtggagccgaggtaccaggacctggcgagccacggcatccccgccgccgccacgggcgacggcggcgtctttgtcaaggtcatcgcgggcgagtgcctgggcgcgcgctccccgctgcggccgcgcaccccggcgctgtgcctcgacgtcgccctgcggcccggcgcgcgcctccgccagcccgtcccgcgcgggtggagcgcgtgcgcctacgtcatcggcggcgaggccgtattcggcgacgcctccgctggggcgcgcacgctcgtcgtgttcggcgccgacggcgacggcgtggacgtgcgggccaaagacgggctcgccgcggcggcgggcgcgagggtgatgctcgtggcggcgcggccgcacggcgaggcggtggtgcgggacggacccttcgtcatgaacacccgggaggaggtggagcaggcgcgggaggacttccgccgacgccgcaacggcttcgagatggctgacggctggacctccgaccacgctgtgccaccgccgccatgcgctgatactctaggcgtagatggtatctaagatgtggaattttggcccccaaagaaatgcagtgcagcgtagaaagtgtttgcaataaggtatgatcaatttggaatcagtgttcgtgcaagtgggtggctatgatttgtatctggattggcaatttggcattgcagtggagcacgcgatcatcgtt

SEQ ID NO: 30869 - protein, 374 aa, Panicum virgatum
  misc_feature: Ceres CLONE 1902143
  misc_feature (240)..(347): Pfam Name: Pirin_C Pfam Description: Pirin C-terminal cupin domain
  misc_feature (89)..(185): Pfam Name: Pirin Pfam Description: Pirin
MSAATACMPLVPPPPSSPRHGSTGKPAMAAAEVGERRKPGGMETDMTTQSSHGGEERRGEGNGDGEVTMSEPRAVVRTLACERKPYVEGFAHWRSIGRPELPEMDPILSFDEFEFSAPAAFLDHPHRGFENVTYMLEGGVSYHDFSGHKGTINEGDVQWLMAGRGVVHAEVPAGNGVQRGINIWVNLSANDKMVEPRYQDLASHGIPAAATGDGGVFVKVIAGECLGARSPLRPRTPALCLDVALRPGARLRQPVPRGWSACAYVIGGEAVFGDASAGARTLVVFGADGDGVDVRAKDGLAAAAGARVMLVAARPHGEAVVRDGPFVMNTREEVEQAREDFRRRRNGFEMADGWTSDHAVPPPPCADTLGVDGI

SEQ ID NO: 30870 - DNA, 2517 bp, Panicum virgatum
  misc_feature: Ceres CLONE 1902144
  misc_feature: Encodes the peptide sequence at SEQ ID NO. 30871
gtggttcctcccaggccgcgctgctcggcgcgcacctccgcgacgtccgcactcgcgccgagcacgaccttggtctcgtcgacgtcgacagcaccgagggcagtgaccccgccgcccccgcggacctccgcctcctccccacggcgttcctcgccactcgcgacggccgcgccgacgccgccctgctgatctacaaggaggaggcccgcgatgcgccgttcgacccctgctcccgcaccctctcctaccacctgtgccacttcgacgggcgagaggaggagtcggtgtggtggagcgcggcctaccgccgcctcgtctgcgagctctccgcatgtaggcgcgggacgtggctgacggtgttgcagaggcatctcctgtttcatggtaagttaccttgcactcgtctcatcctcagatctgatgcatggatgtggtggattggattattcaagctattgtgtgcaggcctgcagggtagatgtgtagcgttttgatatggttcttctttgatcaatttatctgttaggcaccagtaagatcaccaatcggttagtacaataaatcaaaagactaataagttttgctttgttggtatttatccttcatactgaatccatggacaccatgaactgggttggtagtattatttcagttcaagtgtggatttgtcattttgttggaactgaactgcatgcatgcatacatgctgacataaatttgagtcttcgttaatttgatcaatgcataagtaaggtccagttcattagaacagagcggagcagaatattggtttgctgatacatgacattattgtagaatacatctttttaactaatatatgctttattgtagaatattgttagctacacagtttccttattaaaacaattgtttagttgtttccagattactatccattcatccatgcttgatgcttctactttggaggtgcgtcttctgtagaatacttgtgaagttagaaactctgtgcttctatctttggattgctatattctagagttgttagtgggcaagccttagtggatttctggagattgtgtttttgggtaggaatagaattatggatttatgggatactcagttatgtttgcctttgaaccaaaccaaataatgcctatgtcatctttaggatagaagattttatgatccctatctgtttaagcacttattgtagttgcaggactggcctacttgaaattaagttaaagcatggggctaatgctggtagtgctttgaagctgatccagccgatcaaggataagttttcaggtgtcgcatatgcagatctatttcagctagctagctccacagccattcaggaagcaggtggccccaaaattcccatgatctatggaagggttgactgaataactggtctgaatataagctggatgaactggatccacttgttgtttgttcactggtctttgaactttacctaatcaagctatgcatattctctgaatactgggttaggattttgtgtattccaaatgatctgctgactgaccaaagaattgctctgattgagaacttgcatatggtttgatactcagttgcaaaaacaaggagtgcacgaagcacactgtaaaaggcaatttagcacactgtaaaagctgaaactacagtgccagagctgcaaaggactactcacagtgcccgatcaaggtaagcagcacaagagcagcctgtgctatcgttttatggatttgaattgttgttttgttcctaaggtaagtttggcttgcataactgtctgaacattccacaacagctgttaattttgaatcaaacacacgaatagctcagttatctgagatttcactaagaatatgtaccaattttatatatagctgttgaatgctatttaaagtaattagattacctaatatgattctaaaaaaactaataactgaatctgcttattcttgagtagcttgcttgttaacttggcatatgacgacatgtttctatagctgtttcttttcatgatacttgctgagttacttgatcttgtttgcaccttgatcatggccacaacgttgtatctttacataatgtagtactacattagcatggtatcttacactcttaacttcattcttcaaacctctttaacctttccacggtcatatttgtacagtgttgaatctctacatagtgttgaatctctacatactttctaatctggttctcattagagtatccgagccaccgcagatcatccgctatgtatgctatgcatctctatacttaacaactccctgctattttggtgaaattgagaagaatgtacatttatgtcttcaattaacaatatgctgttttgttgtagccaaggaacagtttgctgaagctgagaggaaagaaagtagctaggaggtatttgtattgccatttattctagagcaaccatcacattttgattggttaggtggatactctatgtaattgcttacaatttaatagactgtaatcaaaatttttgtgtactgt

SEQ ID NO: 30871 - protein, 74 aa, Panicum virgatum
  misc_feature: Ceres CLONE 1902144
  misc_feature: SWISSPROT Homolog: EC 1.11.1.11 L-ascorbate peroxidase
MIPICLSTYCSCRTGLLEIKLKHGANAGSALKLIQPIKDKFSGVAYADLFQLASSTAIQEAGGPKIPMIYGRVD

SEQ ID NO: 30872 - DNA, 1355 bp, Panicum virgatum
  misc_feature: Ceres CLONE 1902161
  misc_feature: Encodes the peptide sequence at SEQ ID NO. 30873
aagcccacgcgccccctccgatcctcgctccaccccgcagcagctcggctcagctagctacccctgtccttctccacctcgccgcgctaacaggccggtgcaccatgagcgccgccgccgccgcccagcagcagccggagccgcccgccgccgggacgagcactccgactccggcggtgatccgcaacgcgcgccaccgcccgagcgcgctcaagctgtgctaccacctcgccgtctccaactccctctacctcctcctggcgcccctcgccgccgccctggccccccgcctctcccgccaccggctcccccacctcgccgccgctgcccgctccgccctcaccgcgaactcgcccctcaccatggcgctccttgccctcgccgccgtcctcgccaccgtctacctcgcgcgccgcccgcgcgccgtctacctgctcgacttcgcgtgctacaagcccgggccggagcacgtggtcacccgggagacgttcatgcggcagtcggcggcggcgggggtgttcaccggcgaaaacctggcgttccagcgcaagatcctggagcggtcggggctcgggcaggggacctacttcccccgcgcggtgctcgcctcgccgccccgcccgtgcatggcggaggcccgcgccgaggcagaggccgtcatgttcggcgctgtcgaccaggtactcgccaagacgggcgtccgggcgcgcgacatcggggtggtcgtcgtcaactgcagcctcttcaacccgacgccgtcgctctccgccatggtcgtcaaccactacaagctccgcgggaacgtcgccagctacaacctcggcggcatgggctgcagcgccggcctcatcgccatcgacctcgccaagcagctgctccaggtgcaccggaacacgtacgcgctggtggtgagcatggagaacatcacgctcaactggtactggggcaacaaccggtcgatgctcatgtccaactgcctcttccggatgggcggcgcggcggtgctgctgacgaaccgcggcggcgcggcgcggcggcgcgccaagtaccagctggtgcacacggtgcggacgcaccagggcgccgacgaccgcgcctaccgctgcgtgttccaggaggaggacaaggccgggcgtgtcggcgtcgcgctctccaaggacctcatggccgtcgccggcgaggcgctcaagaccaacttcaccacgctgggccccctcgtcctccccatgtcggagcagatcctcttcctcgcgtccctcgtcggccgccgcgtgttcggcctccgctcgctccggccctacctgccggacttcaagatgggcgtcgagcacttctgcatccacgccggcggccgc

SEQ ID NO: 30873 - protein, 416 aa, Panicum virgatum
  misc_feature: Ceres CLONE 1902161
  misc_feature (100)..(390): Pfam Name: FAE1_CUT1_RppA Pfam Description: FAE1/Type III polyketide synthase-like protein
  misc_feature: SWISSPROT Homolog: EC 2.3.1.119 Icosanoyl-CoA synthase
  misc_feature: The sequence is a functional homolog of SEQ ID NO 2 in US patent 7038112
MSAAAAAQQQPEPPAAGTSTPTPAVIRNARHRPSALKLCYHLAVSNSLYLLLAPLAAALAPRLSRHRLPHLAAAARSALTANSPLTMALLALAAVLATVYLARRPRAVYLLDFACYKPGPEHVVTRETFMRQSAAAGVFTGENLAFQRKILERSGLGQGTYFPRAVLASPPRPCMAEARAEAEAVMFGAVDQVLAKTGVRARDIGVVVVNCSLFNPTPSLSAMVVNHYKLRGNVASYNLGGMGCSAGLIAIDLAKQLLQVHRNTYALVVSMENITLNWYWGNNRSMLMSNCLFRMGGAAVLLTNRGGAARRRAKYQLVHTVRTHQGADDRAYRCVFQEEDKAGRVGVALSKDLMAVAGEALKTNFTTLGPLVLPMSEQILFLASLVGRRVFGLRSLRPYLPDFKMGVEHFCIHAGG

SEQ ID NO: 30874 - DNA, 532 bp, Panicum virgatum
  misc_feature: Ceres CLONE 1902161-R
  misc_feature: Encodes the peptide sequence at SEQ ID NO. 30875
gccgcgcccgtgctggacaccatcgagaagaacctggggctcagcgcctggcacatggagccgtcgcggatgacgctgtaccggtgggggaacacgtcgagcagctcgctgtggtacgagctcgcgtacacggaggcgcagggccgggtgcggcgcggccaccgcgcgtggcagatcgccttcgggtcagggttcaagtgcaacagcgccgtgtggcgggcgctgcgggacgtcgacccggcggaggaggtcgggaacccctgggtggacgagatccacaggttccctgtcgaggtgcccaaggtcgagagcgtcgtcgtcgcggcggaggcggcgccggcgccggcgccggagccggagacggcggcggcggcgtcgtgagggcggtggtgcgaggcttgtatctgtttgtaactgcttgtttggagaatggtgaagtgtgtgggtcgaagtcaaagtgtgtgggttgagtgaaggtgttgaactgtgtaaacatacaagaaatttggttgttgatgattgattgagatgt

SEQ ID NO: 30875 - protein, 126 aa, Panicum virgatum
  misc_feature: Ceres CLONE 1902161-R
  misc_feature: SWISSPROT Homolog: EC 2.3.1.119 Icosanoyl-CoA synthase
  misc_feature: The sequence is a functional homolog of SEQ ID NO 2 in US patent 7038112
AAPVLDTIEKNLGLSAWHMEPSRMTLYRWGNTSSSSLWYELAYTEAQGRVRRGHRAWQIAFGSGFKCNSAVWRALRDVDPAEEVGNPWVDEIHRFPVEVPKVESVVVAAEAAPAPAPEPETAAAAS

SEQ ID NO: 30876 - DNA, 1147 bp, Panicum virgatum
  misc_feature: Ceres CLONE 1902170
  misc_feature: Encodes the peptide sequence at SEQ ID NO. 30877
aaggttagctagctaggcatcataggatactgcagcgattgcccgatcgaggagcatcggcagcagctcgttcccctctctgattggcgcggagaggcatggcggcgcagcaggtggaggcgagcggcggcgcccaggcggcggcgacgcagcttggcgacctgccggaggcgtgcctggcgcaggcgatcgcgctgacctccccgcgcgacgcctgccgctgcgccgccgtgtccccggccttccgcgccgccgccgactccgaccacgtttggcgcgccttcctcccgccgcagctcgaccgcgccaagccggcgccggtgccggtgctccagccggcgcccgcgagcaggagcaagaaggaggcctacctcggcctctgcgacgccgccggcgcggcggccgtcggcgaggacggcgggtgccggatctggctggagcgcgccaccggcgccaggtgctacgcgctgtccgcgcggaggctcagcctgccctgggacgacggcgagttctgctggatgttcgcgccgcacccgcgctccaggttcgcggaggtggcggagctggtggactgcacgtgcctcgacatctacggggcgctcccggcggcggcgctcacgccggcggcgccgtacgcggcgtacctggtgtacggcacggcgggcgggggccaccgcggcctgagctacccggaccaggagacggcggtggcggtgggcggccgcgtggtggcgcgccacgccgtgtgcctgcgccccgacgccgccgaggcgcgcaagttcaggggcggcggcagccgcggcgaggagccgaggcggccgaggatgcgggaggacgggtggtgggagatggagatggggcggctgggcgaggtggcgggcacggccgccgccgaggaggtggtggccagcttcgaggtgctcgggtggtaccccaagcgcgggctcatcctcgagggcatcgagttcaggcccgtcgtccagagttcttcttcctgatgaaaatgaaagtgaaaatgtacacgtgtctcggttcatcttctcgatgagcaagctgcctcgatgagtgaatggatttgtactttgtaaatgcaacaattgctttgtttttgaaaatcaaatcatatggcacttcgtgctagttgctc

SEQ ID NO: 30877 - protein, 299 aa, Panicum virgatum
  misc_feature: Ceres CLONE 1902170
  misc_feature (17)..(64): Pfam Name: F-box Pfam Description: F-box domain
MAAQQVEASGGAQAAATQLGDLPEACLAQAIALTSPRDACRCAAVSPAFRAAADSDHVWRAFLPPQLDRAKPAPVPVLQPAPASRSKKEAYLGLCDAAGAAAVGEDGGCRIWLERATGARCYALSARRLSLPWDDGEFCWMFAPHPRSRFAEVAELVDCTCLDIYGALPAAALTPAAPYAAYLVYGTAGGGHRGLSYPDQETAVAVGGRVVARHAVCLRPDAAEARKFRGGGSRGEEPRRPRMREDGWWEMEMGRLGEVAGTAAAEEVVASFEVLGWYPKRGLILEGIEFRPVVQSSSS

SEQ ID NO: 30878 - DNA, 751 bp, Panicum virgatum
  misc_feature: Ceres CLONE 1902173
  misc_feature: Encodes the peptide sequence at SEQ ID NO. 30879
gtcgtaagtttaccgagctctcggcgtctcctatcctgttgctagagctcgcggtgcacaggcgcatggcggccgctatctccaatccgcccagcgaaagggttgctgtggtcaccggcgggaacaaagggatcggactggaggtgtgcaggcagctggccagcaatggcatcaccgtcatcttaacagccaggaacgaggagaggggcgccgccgccgtggagaagctcagagacgaagcagggctctccgatgtcatcttccatcagctggaggtcaccgatgctcagagcattgctcgattggctggcttcctgaaggaacgtttcgggaagctagacatcctggtaaataatgccgctatcggcggggttcagatacttcccgtccaagatctgagcgccgaaaagttcagtggcatggatgcgaggcagagggctgaatggatgtgggaaaattgccgggagacatgcgacgctgcaaaggcagggatccagaccaactactacggcacaaagaacgtaaccgaagcactgctgcctctgctgcaagcctcctctgatggaaggattgtcaatgtctcctccgacttcgggctgctaagccatttcagcagcgaggagctgaagcaggagctgaacgacgtcgagaagctcaccgaggagaggctggacgaggtgctggccacgttcctgagcgacttcgacgccggcgaggcggaggcgcgcgggtgggcggcggcgttcgcggc

SEQ ID NO: 30879 - protein, 228 aa, Panicum virgatum
  misc_feature: Ceres CLONE 1902173
  misc_feature (12)..(187): Pfam Name: adh_short Pfam Description: short chain dehydrogenase
  misc_feature: SWISSPROT Homolog: EC 1.1.1.184 Carbonyl reductase (NADPH)
MAAAISNPPSERVAVVTGGNKGIGLEVCRQLASNGITVILTARNEERGAAAVEKLRDEAGLSDVIFHQLEVTDAQSIARLAGFLKERFGKLDILVNNAAIGGVQILPVQDLSAEKFSGMDARQRAEWMWENCRETCDAAKAGIQTNYYGTKNVTEALLPLLQASSDGRIVNVSSDFGLLSHFSSEELKQELNDVEKLTEERLDEVLATFLSDFDAGEAEARGWAAAFA

SEQ ID NO: 30880 - DNA, 566 bp, Panicum virgatum
  misc_feature: Ceres CLONE 1902188
  misc_feature: Encodes the peptide sequence at SEQ ID NO. 30881
gctcaacgccgaggatcgccccccgctagtcccgtaaaaaatggctgacactgacgacttccaactcatcgtctgcgacaaagtaactggggtggtgaaggctgggttctctggagactatacggccaggggcatcttcgccagcatcggggggcgccagcaccacagctgcgtcatggaaaggatggagcataaggacgcctacgtcggtgaccaggcggactcaacgaggggtatcctgacactcacctatcgcgtcgagcacggcatcgtcaacgactgggacgacatggagaataactggcatcacaccttctaccacgagctccgtgtgggcccagaagaacccccactcctcctcactgaaccggcactcagacccaatggtaagcaagagaagatgacccacataatattcaagaccttccacaccatcactatgtacgtcgccatccagaacgtcctctcgctgtatgccaccggtcctaccagaagtattgtgctcgaaacggaagatggggacagacgaactgtctccatctatgaaggacacgccctaccccccc

SEQ ID NO: 30881 - protein, 175 aa, Panicum virgatum
  misc_feature: Ceres CLONE 1902188
  misc_feature (4)..(175): Pfam Name: Actin Pfam Description: Actin
  misc_feature: SWISSPROT Homolog: EC 2.7.10.2 Non-specific protein-tyrosine kinase
  misc_feature: Useful for making plants with modulated biomass
  misc_feature: Useful for making plants with modulated flowering time
MADTDDFQLIVCDKVTGVVKAGFSGDYTARGIFASIGGRQHHSCVMERMEHKDAYVGDQADSTRGILTLTYRVEHGIVNDWDDMENNWHHTFYHELRVGPEEPPLLLTEPALRPNGKQEKMTHIIFKTFHTITMYVAIQNVLSLYATGPTRSIVLETEDGDRRTVSIYEGHALPP

SEQ ID NO: 30882 - DNA, 572 bp, Panicum virgatum
  misc_feature: Ceres CLONE 1902235
  misc_feature: Encodes the peptide sequence at SEQ ID NO. 30883
gtttttgctgctgagtgtctgctgggactattcctattctcttcgactgcgatctcgcggcgggcgggcgagagaacatccctggcaggagtatggcgacggtgccgtccctgtacgggcgggtcctcccgtcgccgccggcggtggacttcccctcgccggacggccaccgcctcttcgcggaggccctcgagggcggcaccctggagggcttcttcagcctcgcctcctgcttccagacgcagtccgagccggccttctgcggcctcgcctccctcgccgtcgtcctcggcgcgctcgccatctaccccggccggagctggaccggcccctggcggcggttcgacgagtccgtgctcgactgctgcccgcccctcgacgaggtcccggaccccggcatccccttcggcgacgtcgcctgcctcacgcactgctccggctcccactttctgcccttccgcgccaaccagatcaccgtcgatgacctcctccgccccctcatccgctgctcctcctgtctggactgtcatctcatcgcttcctatcacaagaagcctttgaagcagaccatg

SEQ ID NO: 30883 - protein, 159 aa, Panicum virgatum
  misc_feature: Ceres CLONE 1902235
  misc_feature (47)..(159): Pfam Name: Phytochelatin Pfam Description: Phytochelatin synthase
  misc_feature: SWISSPROT Homolog: EC 2.3.2.15 Glutathione gamma-glutamylcysteinyltransferase
MATVPSLYGRVLPSPPAVDFPSPDGHRLFAEALEGGTLEGFFSLASCFQTQSEPAFCGLASLAVVLGALAIYPGRSWTGPWRRFDESVLDCCPPLDEVPDPGIPFGDVACLTHCSGSHFLPFRANQITVDDLLRPLIRCSSCLDCHLIASYHKKPLKQT

SEQ ID NO: 30884 - DNA, 720 bp, Panicum virgatum
  misc_feature: Ceres CLONE 1902244
  misc_feature: Encodes the peptide sequence at SEQ ID NO. 30885
aaggaaagccgatagcttgtgtgtgtgtagagagagagagagagcaagagaggtgtgcgcccccaatccccatggcctctgctcctgctgctatataagacccgggggctcctctgcttcccaatccacccatcctggtctcatgcttcggtccacgcaaccgcccagcccctccagcggcagcggcacctcggcggcgccggcatccggctccgacgccaagatggtcggcggcggcgcgccgagcggggccaagctgctgcagatcctcaacgtgcggttggtgggcagcggcgagcgcgtggtggtgctgtcccacggcttcgggacggaccagtcggcgtggagccgcgtgctcccctacctcacccgcgaccaccgcgtggtgctctacgacctcgtctgcgccggcagcgtgaacccggagcacttcgacttccgccgctacgacacgctcgactcgtacgtcgacgacctgctcgccatcctcgacgcgctccgcatcccgccctgcgccttcgtcggccactccgtctccgccatgatcggcatcctcgcctccatccgccgccccgagctcttcgccaagctcatcctcatcggcgcctcgcccaggtacatatatacaccgatcggaatcagcccccactcgatcgaattcgatttcaatcagcctttggagtttcgaggcgatccttgtctgatccgggggggcaggtt

SEQ ID NO: 30885 - protein, 192 aa, Panicum virgatum
  misc_feature: Ceres CLONE 1902244
  misc_feature: SWISSPROT Homolog: EC 3.1.1.1 Carboxylesterase
MLRSTQPPSPSSGSGTSAAPASGSDAKMVGGGAPSGAKLLQILNVRLVGSGERVVVLSHGFGTDQSAWSRVLPYLTRDHRVVLYDLVCAGSVNPEHFDFRRYDTLDSYVDDLLAILDALRIPPCAFVGHSVSAMIGILASIRRPELFAKLILIGASPRYIYTPIGISPHSIEFDFNQPLEFRGDPCLIRGGR

SEQ ID NO: 30886 - DNA, 846 bp, Panicum virgatum
  misc_feature: Ceres CLONE 1902252
  misc_feature: Encodes the peptide sequence at SEQ ID NO. 30887
acacccccatcgcctaatcttcttatcccccgccttcctcccgccgctgctgctcactcccgacccgaggccccgagctccccggcagcaagttccccccatggcgtccaccaccctctcctccgccttcaccctgctctcccgtccctcctcctccccgtgcccctccgcctcgctcccgaggtcctccatcgccgtgccgcacggccgccgcggccgccgcgccgtcgccgtcgcgtccaccgccaccgagtcccccacgattctcgagctcggggacgccatcgccgggcttacgctcgaggaggcccgcagcctcgtcgaccacctgcaggagcgcctcggcgtcaccgccgcggccttcgcgccggccgccgtcgtcgcggcgcccggggctggcggcgcgggggccgccgaggaggaggcccccgtcgagaagaccgagttcgacgtcgtcatcgatgaggtgcccagcagcgcgcgtatcgccaccatcaaggtcgtgcgcgcgctcaccagcctagcgctcaaggaggccaaggacctcatcgagggcctccccaagaagctcaaggagggcgtcagcaaggacgaggccgaggatgccaagaagcagctcgaggaggtcggcgccaaggtgtccatcgtgtgacactagagcgtatatgagtaaacccctttttgcatttgacatggcgtgtatcatcagttggagaataatgtactttccagatgcatatatctacatagggagctgaacggtggagttagttgtggaaattatttgttgtaatcctatattatttcgagagttctatttgtcgaagctgttaatggttgcgggat

SEQ ID NO: 30887 - protein, 183 aa, Panicum virgatum
  misc_feature: Ceres CLONE 1902252
  misc_feature (115)..(183): Pfam Name: Ribosomal_L12 Pfam Description: Ribosomal protein L7/L12 C-terminal domain
MASTTLSSAFTLLSRPSSSPCPSASLPRSSIAVPHGRRGRRAVAVASTATESPTILELGDAIAGLTLEEARSLVDHLQERLGVTAAAFAPAAVVAAPGAGGAGAAEEEAPVEKTEFDVVIDEVPSSARIATIKVVRALTSLALKEAKDLIEGLPKKLKEGVSKDEAEDAKKQLEEVGAKVSIV

SEQ ID NO: 30888 - DNA, 759 bp, Panicum virgatum
  misc_feature: Ceres CLONE 1902265
  misc_feature: Encodes the peptide sequence at SEQ ID NO. 30889
agattcacagtcgcagcgagagagagagagagaggagaagggaggacggagtgatagaggcggcgacggcggcgatgaggaggtggcgagaggaggtggtggcgctgtcgctgcgcgggtacggctacggcaacgaggatgatgaccggccggagaagcctcggcggtacggggtgacggagatgcggagccctttctactccttccgccccgccaaccaggcgctccaggaaatattggattctcttggtcctttcgttgacggtttgaagttttctggtggatgccatagtttgatgggaaaagaactggtcagagagattactgatttagcccataagcatgacatatacgtgagcacaggtgactgggcagagcatcttttacgtcagggaccctcttctttcaagcaatatgtggaggtatgtgggtctgctacggttctatgattttctagcaatgtgccagacatgtatgaagtcacctgagctgcacttgtgcacgacatgagcatttcatttcaggaatgcaaggccttagggtttgacacaattgagctgaatgctggatctctcaagctccctgaagaagctctcctgagattggtccgcctcatcaagagtagcggtctgagggcaaagccactgttttcggtgaggtttgacagttctgatattcctgcatctggtgatagggcgtttggagcgtacatagctccagtcaaagagcggacctcagaaagaatcgaagatgtgggac

SEQ ID NO: 30889 - protein, 124 aa, Panicum virgatum
  misc_feature: Ceres CLONE 1902265
  misc_feature: Useful for making plants with modulated heat sensitivity
MRRWREEVVALSLRGYGYGNEDDDRPEKPRRYGVTEMRSPFYSFRPANQALQEILDSLGPFVDGLKFSGGCHSLMGKELVREITDLAHKHDIYVSTGDWAEHLLRQGPSSFKQYVEVCGSATVL

SEQ ID NO: 30890 - DNA, 722 bp, Panicum virgatum
  misc_feature: Ceres CLONE 1902278
  misc_feature: Encodes the peptide sequence at SEQ ID NO. 30891
agatagcctcgcaagttaggaccaaggaaacgaaaactcgccagccgtgcgcccgtgtacaggatcgacccagcaccatggtgcaccaggctcaggggcagatggtgcaggaggtggccgccggcagcctccccgcgccgccgagccggtacgtgctgagggaggagcaccgcccaatcggcggcagcgtggcggcggagctgctggacttccccaccgtggacctgcagcgtctggccgaacccggcgacgtcgaggaggccgccaagctccggtcggcgctcgagtcctggggcctcttcgcggtgaccggccacggcatgccggagtcgctcctcgccggcgtgcgcgccgcggggttggagttcttccacctgccgccggaggagaagctgcggcacgccaaccggacggacgacggcgagttccagccggatgggtacggcatcgaccgcgtggacaccgacgagcaggtcctcgactggtgcgaccggctctacctcgccgtgcagccggaggagcggcggcgggcgcggttctggcccgcgaacccgccgtcgctcgcggggctcctgcacgagtacgcccagggcagccagcgggtggcccggcgcgtgctcgcggccatggcgacggcgctgggcctcggcgaggagttcttcctccgccgcgtcggtgacagggccgccgcggacgcgcgcttcacctactacccgccgtgc

SEQ ID NO: 30891 - protein, 214 aa, Panicum virgatum
  misc_feature: Ceres CLONE 1902278
  misc_feature: SWISSPROT Homolog: EC 1.14.11.19 Leucocyanidin oxygenase
MVHQAQGQMVQEVAAGSLPAPPSRYVLREEHRPIGGSVAAELLDFPTVDLQRLAEPGDVEEAAKLRSALESWGLFAVTGHGMPESLLAGVRAAGLEFFHLPPEEKLRHANRTDDGEFQPDGYGIDRVDTDEQVLDWCDRLYLAVQPEERRRARFWPANPPSLAGLLHEYAQGSQRVARRVLAAMATALGLGEEFFLRRVGDRAAADARFTYYPP

SEQ ID NO: 30892 - DNA, 697 bp, Panicum virgatum
  misc_feature: Ceres CLONE 1902289
  misc_feature: Encodes the peptide sequence at SEQ ID NO. 30893
catacagcaggtcccagttctactacgccgcaagggagagagtcaatgatatctcacgaataaaaggaaccgtgctggattcaggtggcagccaggccagcttcctgatgcaggcttgcaccctgaccaagcgctcgttcatcaacatgtcacgggactttgggtattactggctcaggcttctcatctatctcctcgtgaccgtctgcatcggcacaatatacctggacgtcggcaccaaatacacatccatcctggcccgggctgcttgttctgcattcgtctttgggttcgttacatttatgtccatcggaggattcccttcatttgtcgaaaaaatgaaggttttccagcgggaacggctgaatgggcactatggtgttgcggcatttgtcatcagcaacaccatctcagcaacaccgttcctgattctgatatgctttttgtcgggaaccatatgctactttatggttcgcctccatcccggtttcgaacactatatcttcttcgtcttgaacttatacgccagtgtcaccgtggtcgagagcttaatgatggtcattgccagtgtaattcccaattttctcatgggtatcatcatacgagctggacttcatggaatatttatgctggtgactggatacttcagacttccgtacgacatcccaaagccattatggagataccccatgcagta

SEQ ID NO: 30893 - protein, 231 aa, Panicum virgatum
  misc_feature: Ceres CLONE 1902289
  misc_feature (36)..(230): Pfam Name: ABC2_membrane Pfam Description: ABC-2 type transporter
YSRSQFYYAARERVNDISRIKGTVLDSGGSQASFLMQACTLTKRSFINMSRDFGYYWLRLLIYLLVTVCIGTIYLDVGTKYTSILARAACSAFVFGFVTFMSIGGFPSFVEKMKVFQRERLNGHYGVAAFVISNTISATPFLILICFLSGTICYFMVRLHPGFEHYIFFVLNLYASVTVVESLMMVIASVIPNFLMGIIIRAGLHGIFMLVTGYFRLPYDIPKPLWRYPMQ

SEQ ID NO: 30894 - DNA, 227 bp, Panicum virgatum
  misc_feature: Ceres CLONE 1902306
  misc_feature: Encodes the peptide sequence at SEQ ID NO. 30895
aggacagccgcgctgctgctgctcgcgctcgcgctggcgctggcgccgcgggcctccggggccgcgggcgcgggcggcggggactgccacttccccgccatcttcaacttcggcgactccaactccgacaccggcggcctctcgtcgctcttcggcgccgcgccgccgcccaacggccgcaccttcttcggcatgcccgccggccgctactgcaacggccgcttctt

SEQ ID NO: 30895 - protein, 75 aa, Panicum virgatum
  misc_feature: Ceres CLONE 1902306
  misc_feature: SWISSPROT Homolog: EC 3.2.1.51 Alpha-L-fucosidase
RTAALLLLALALALAPRASGAAGAGGGDCHFPAIFNFGDSNSDTGGLSSLFGAAPPPNGRTFFGMPAGRYCNGRF

SEQ ID NO: 30896 - DNA, 711 bp, Panicum virgatum
  misc_feature: Ceres CLONE 1902347
  misc_feature: Encodes the peptide sequence at SEQ ID NO. 30897
gaaagctacctattgctctcaaaaaaaaaatctctcctcgtctcccatttgctgccgctgctcgctctgcggcggagaacggcggccgccgccccaaccgcacccgctacccgcgtgatgctggccgcgacgagaatggcgttcgcctcctgcgcccgcctgctcccatcctctccctcggccctcgctttagtgaggccccgcgccggcgccgtttcgttctgggctcccgcacagccgccgtcggcggccgcaagatcctcgcggaacctcgcgctcttctgctcttcctcgacgccttcgccgacggacgctgccgtagcgccgccgcccccgcaggccgcggcggaggaggcgaagccgtcggcgccgggcggggacgagatggcggagccgaccgtggcggagctggcggggctgctggacatccgtgtggggcgggtggtgaaggcgtggaggcacccggaggcggacaccatctacgtcgaggaggtggacgtaggcgaggcggagccccgcaccatctgcagcggcctcgtcaacttcctcccaattgaagagctccaggacagcagtgtgattgttcttgctaacctcaaaccaaggaacatgcgtggcatcaagtcgaatggcatgctcatggctgcttctgatgcttcacatgagaatgttgagctgctcacacctccggaaggatctgttcctggtgaa

SEQ ID NO: 30897 - protein, 191 aa, Panicum virgatum
  misc_feature: Ceres CLONE 1902347
  misc_feature (98)..(191): Pfam Name: tRNA_bind Pfam Description: Putative tRNA binding domain
  misc_feature: SWISSPROT Homolog: EC 6.1.1.1
MAFASCARLLPSSPSALALVRPRAGAVSFWAPAQPPSAAARSSRNLALFCSSSTPSPTDAAVAPPPPQAAAEEAKPSAPGGDEMAEPTVAELAGLLDIRVGRVVKAWRHPEADTIYVEEVDVGEAEPRTICSGLVNFLPIEELQDSSVIVLANLKPRNMRGIKSNGMLMAASDASHENVELLTPPEGSVPG

SEQ ID NO: 30898 - DNA, 672 bp, Panicum virgatum
  misc_feature: Ceres CLONE 1902374
  misc_feature: Encodes the peptide sequence at SEQ ID NO. 30899
gcgaacccttcccctccccttctacatggagagatagagaatagaagatcggctctcctcagctcgcgggcgcgaggtggagatgctgacccctcgaggaggagggcgcgcccgtgagtccgtctacgtgatcgggggcctctcctaccacttcggcgccgagtggccgccccgcgggcgcaccttcttcggcctggcggcgggccgcgactgcgacggccggctcatcatcgacttcgtcgctgaaagcctgggaatacctcacctcagtgcgtacctcaactctatcggaagcatcttcacacagggagccaattttgcgaccgccggctcgtcaatcagacggcagaatacatcgctgctcctctctggtttccgccccatttccttggacgtgcagtcctgggaatttgagcaattcatcaacaaaagcgaatacgtctataacaacgaaggcggtatctactgggagctcctgccaagggcagaatacttctcccaggctctttacaccttcgacattggccacaacgacatcacctcgagctactttgttaacaacagcactgcagaagtcgaagccataatccctgatctgatggagaggctcacatctataatccagtttgtgtacgcacgcggaggaaggtacttctggatccataacacgga

SEQ ID NO: 30899 - protein, 196 aa, Panicum virgatum
  misc_feature: Ceres CLONE 1902374
  misc_feature (14)..(196): Pfam Name: Lipase_GDSL Pfam Description: GDSL-like Lipase/Acylhydrolase
  misc_feature: SWISSPROT Homolog: EC 3.2.1.51 Alpha-L-fucosidase
MLTPRGGGRARESVYVIGGLSYHFGAEWPPRGRTFFGLAAGRDCDGRLIIDFVAESLGIPHLSAYLNSIGSIFTQGANFATAGSSIRRQNTSLLLSGFRPISLDVQSWEFEQFINKSEYVYNNEGGIYWELLPRAEYFSQALYTFDIGHNDITSSYFVNNSTAEVEAIIPDLMERLTSIIQFVYARGGRYFWIHNT

SEQ ID NO: 30900 - DNA, 668 bp, Panicum virgatum
  misc_feature: Ceres CLONE 1902422
  misc_feature: Encodes the peptide sequence at SEQ ID NO. 30901
gaatagaggtgcataggccgtgacgggcgcgcgcataccgacagaggaggtaggctgctcatcttccatccctgttcccccgggcgcccgtgtcgggcggaggcgcggacgcacgcgggatcggaatgggacgccgcggccacgccggctccgccggcgccggcgtgcagcacaagctgcacatgggcctctggtcgcccgaggaggacgaccagctctacatccacatcatccgctacggcgtcggctgctggagctacgtgcccaatctcgcgggcctccagaggtgcggcaggagctgccggctccggtggatcaactacctccgccccgacctcaagcgaggcagcttctcgcatgtggaggaggacgccatcctcagcctgcacgagatcctcggcaacaggtggtcgcagatcgcgtcgcacttgccgggcctgactgacaacgagatcgagaacttctggaacagctgcctcaagaaggaagctgcgccagcgcggcatcgaccccaccacccacgagtccatctccgccgacgccgcggcggcggcggcggcgacattggaccagctggcgtcgcaggaacacaagccggcggccgccgccgcctactcaggccgcttcgcgccgaagcagcagcagcagcaccagcaggtgttcgagtc

SEQ ID NO: 30901 - protein, 180 aa, Panicum virgatum
  misc_feature: Ceres CLONE 1902422
  misc_feature (20)..(67): Pfam Name: Myb_DNA-binding Pfam Description: Myb-like DNA-binding domain
  misc_feature (73)..(118): Pfam Name: Myb_DNA-binding Pfam Description: Myb-like DNA-binding domain
  misc_feature: The sequence is a functional homolog of SEQ ID NO 188 in the 10/412,699 US patent application
  misc_feature: The sequence is a functional homolog of SEQ ID NO 2274 in the 10/374,780 US patent application
  misc_feature: The sequence is a functional homolog of SEQ ID NO 704 in the 10/225,066 US patent application
  misc_feature: The sequence is a functional homolog of SEQ ID NO 168 in the 10/412,699 US patent application
  misc_feature: The sequence is a functional homolog of SEQ ID NO 377 in the 11/479,226 US patent application
  misc_feature: The sequence is a functional homolog of SEQ ID NO 232 in the 10/225,066 US patent application
  misc_feature: The sequence is a functional homolog of SEQ ID NO 264 in the 10/374,780 US patent application
  misc_feature: The sequence is a functional homolog of SEQ ID NO 534 in the 11/435,388 US patent application
  misc_feature: The sequence is a functional homolog of SEQ ID NO 126 in the 10/412,699 US patent application
  misc_feature: Useful for making plants with modulated nitrogen use efficiency
  misc_feature: Useful for making plants with altered cell wall content and/or composition
MGRRGHAGSAGAGVQHKLHMGLWSPEEDDQLYIHIIRYGVGCWSYVPNLAGLQRCGRSCRLRWINYLRPDLKRGSFSHVEEDAILSLHEILGNRWSQIASHLPGLTDNEIENFWNSCLKKEAAPARHRPHHPRVHLRRRRGGGGGDIGPAGVAGTQAGGRRRLLRPLRAEAAAAAPAGVR

SEQ ID NO: 30902 - DNA, 1951 bp, Panicum virgatum
  misc_feature: Ceres CLONE 1902425
  misc_feature: Encodes the peptide sequence at SEQ ID NO. 30903
ccccccccccccccccccccccacctcttggccgcgcgccccccacaccattcgccgccgccgctcccctcctcgtcggcggccgcgccctgctgctttgccgctcgctatctcctgcgagggcgtgcgaaggatcctccgcccatgacctgggccccggcgccgcgtccgcgcgccaagatagggtttgcttcctgcagaccgcggcatcggtgaggcggcaaggcaaggcggcggcccggtcgggaagcgaggggcagggctctagggcgcggctcgccgtctgatggaagccgatgaggccgcggggagcagcaggaggatggatctgaacctttacctcggtctcccccgcgccccgcgcccgcgccgctggtgcgggccagcgaattgctggggtgggaggaccggccttcctcgtcaacggcctcctcatctttcctctcagaaactgccacccagtacaggcggttgctcgagcaaactggaagccgatggcttcgcacgaggcggttcaggtctgaccttccaccactcagctccgaggctcgcccttctgggctggatgccgctatacctataccggcgccccagcatgagcctgcagctgatactgctgaaatgaataaggtggctgccaatggctcagaattaggtgcctcggaagaggccattgaggagcgcggcaagactgccacgttcgagtgtaacatatgctttgagatggcaagtgagcctgtagtcacttcctgtggtcatctattctgctggccgtgcttgtatcagtggttgaatgtttactccaaccacaaggaatgcccagtctgcaaaggcgaggttacggaagcaaatattactcctatatatggtagagggaattcggatggagaaaagactctggaagatggcaagccacaaggtccgacgatcccgccgaggccacatggaaatcgccttgaaagcttcaggcagcaattccaccatatgcgaccaatctcaagaaggcttggtgaggcgcatgggatactgtcatcatggaggcgccttctggaccagcagattatgaatagtgtgagtaggtatgaaggcccgtctgaatcagctgcacaggaaataaatgacagcgctcaacatgctactcgcttaagcagattggcattggccacaaggatgagagcaagacgactgcaaagagaagctgagagccgccctgatggttcttccactagccctgctactggtttaacaggaaacaatgcatcagaatcatcgaggcgtggttcaacaccacgtgtatcagacagatttgaattgctggagcatcttgcctatattggcattgcaaacacagaaagactggccagtgccatgagtgaccttagaagaagtgccataagtgaccttagaagaatagcttcaccaagccaatttggaggatctgcttcatcatcaaatcctcagaataatgagccagcagttgatggaattcatgttgctggagcaccttctgcagaccaagcatcgaattcaagcactgttgcggtgatacagggggatgctggtatctcagagagtgctggagaacctagcaatgcaggttcttcgaggtccctgaggaggagagggaggagcaatgccttagggtcattggatgtggatggtgggggggcccaacggaacaagaggcggagaatgaactgaaccttcttgatatcagtgttgttccaaacctcacttggcctccgccctctgttgcttatttcagttgcatttcatcacttcggttcttatctgctgcattatagcatgttgttgtttcttctttttacctgtttaataggtatcagtgaaacagctccttgctcagtttgctctgtagcctgtacccccctttaatttcagaatcgagttgtttttgccatctatagtggaaatttaactgtgttgtttg

SEQ ID NO: 30903 - protein, 359 aa, Panicum virgatum
  misc_feature: Ceres CLONE 1902425
  misc_feature (29)..(69): Pfam Name: zf-C3HC4 Pfam Description: Zinc finger, C3HC4 type (RING finger)
  misc_feature: The sequence is a functional homolog of SEQ ID NO 766 in the 10/666,642 US patent application
  misc_feature: The sequence is a functional homolog of SEQ ID NO 767 in the 10/666,642 US patent application
MNKVAANGSELGASEEAIEERGKTATFECNICFEMASEPVVTSCGHLFCWPCLYQWLNVYSNHKECPVCKGEVTEANITPIYGRGNSDGEKTLEDGKPQGPTIPPRPHGNRLESFRQQFHHMRPISRRLGEAHGILSSWRRLLDQQIMNSVSRYEGPSESAAQEINDSAQHATRLSRLALATRMRARRLQREAESRPDGSSTSPATGLTGNNASESSRRGSTPRVSDRFELLEHLAYIGIANTERLASAMSDLRRSAISDLRRIASPSQFGGSASSSNPQNNEPAVDGIHVAGAPSADQASNSSTVAVIQGDAGISESAGEPSNAGSSRSLRRRGRSNALGSLDVDGGGAQRNKRRRMN

SEQ ID NO: 30904 - DNA, 1423 bp, Panicum virgatum
  misc_feature: Ceres CLONE 1902428
  misc_feature: Encodes the peptide sequence at SEQ ID NO. 30905
tcgttcctctcattccccttccacctcgctctctctctctctcctcgcactgccctctctctctctcttacgcgcgcgtgacacctccacgggcgcgccgcgcgcgagagcagccgccaccgactgatcaccggctggcgcggggactggggcgatctgatgctggcgcggcggtgatggctgcgccgtccgccggcgcagggggcgggggcggcggcgcgggggagggctcctcctcctcggccgccgcggctgccgcagccgcgacgatcggggcccacggtgtcgaccaagggtcccctttaaacaatttgaccaagttttcgattaatattattcctgaactaatgcctcatatggccgcgaagttgacaccattgattccctgcggtggctcctgtgtttttttggtggggctctcttcagtcactgtagctgttgcagctgacatcatcaggccccatgaggctgatgaagttgcagaagcgatgtggcagatgaacttaggagaagctgttgaactggggccttacccagagcgtgttggtgagccagattgtagttattacatgaggactggcatgtgtaggtttgggatgacctgtaaatttaaccatccagcagataggaagctggctgttgctgctgcaagaatgaagggagaatatcctcaaagaaatggccagcctgaatgtcaatactatctgaagaccggcacatgcaaatttggagcaacttgcaagtttcaccacccccgagaaaaggctgcaatggcaactcgagtgcagttgaatgaattgggctacccattccgcccgagtgaaaaggaatgtgcctattatttaagaacagggcagtgcaagtttggaagcacatgtaaatttcaccatccacaaccatctaccatgatggttgctgtacgtggctctggttattcacctggacagtctgcaacttctcctggccagcatgcgtaccaaggggctgtaacaagctggcccttgtcaagatctacttctttcattgcaagtccaaggtggccaggtcattcaagctatgcgcaagtgcttgttcctccaggccttgttcaggtcccagggtggaatccttacactgcacagattggttcatcatcctcagaggaccaacaacagacacctggagctgcccaatactatactggttcacgccagagtggaacaccttgcatcggagatcaaggaatgttttcatcataccaagctggttcagttcctgttggactttatgcagtacagagggaaaatgtgtttccagagagacctgaccaacctgaatgtcagttctatatgaaaactggagactgtaaatttggtgttgtatgcaagttccatcatcccagggagcgaataattcctgctcccaattgtgcactgagttcatt

SEQ ID NO: 30905 - protein, 415 aa, Panicum virgatum
  misc_feature: Ceres CLONE 1902428
  misc_feature (376)..(402): Pfam Name: zf-CCCH Pfam Description: Zinc finger C-x8-C-x5-C-x3-H type (and similar)
  misc_feature (168)..(194): Pfam Name: zf-CCCH Pfam Description: Zinc finger C-x8-C-x5-C-x3-H type (and similar)
  misc_feature (214)..(240): Pfam Name: zf-CCCH Pfam Description: Zinc finger C-x8-C-x5-C-x3-H type (and similar)
  misc_feature (123)..(149): Pfam Name: zf-CCCH Pfam Description: Zinc finger C-x8-C-x5-C-x3-H type (and similar)
MAAPSAGAGGGGGGAGEGSSSSAAAAAAAATIGAHGVDQGSPLNNLTKFSINIIPELMPHMAAKLTPLIPCGGSCVFLVGLSSVTVAVAADIIRPHEADEVAEAMWQMNLGEAVELGPYPERVGEPDCSYYMRTGMCRFGMTCKFNHPADRKLAVAAARMKGEYPQRNGQPECQYYLKTGTCKFGATCKFHHPREKAAMATRVQLNELGYPFRPSEKECAYYLRTGQCKFGSTCKFHHPQPSTMMVAVRGSGYSPGQSATSPGQHAYQGAVTSWPLSRSTSFIASPRWPGHSSYAQVLVPPGLVQVPGWNPYTAQIGSSSSEDQQQTPGAAQYYTGSRQSGTPCIGDQGMFSSYQAGSVPVGLYAVQRENVFPERPDQPECQFYMKTGDCKFGVVCKFHHPRERIIPAPNCALSS

SEQ ID NO: 30906 - DNA, 451 bp, Panicum virgatum
  misc_feature: Ceres CLONE 1902428-R
catccagaagtattgcctgacaatggctcgggaaggtcacggaggattacccattcagattcccagcaaataccctcaggtgaaaggagcactgagagagaggcgtcctaagccatcctcggttccatgttcatgctgcctcccattcttgactggagtaattatctgcaacaacatttgaggagctgtacaggtcttttgcgcttttacctcaccttcgagctttacataccggagcttgcttcaacatgtattgcattcaggctggaaaaagttcctagcctgttcgggatgcccatttgcccaatggaaacaggaacaaaccttaccttatttaaaacatatgtatggaaccaactcacctttggacattcgaaccgactcgagtgatgtgtgccgtgatggtgttgttgtagctatagaggtgcattgaaatggacacgcttttgcg

SEQ ID NO: 30907 - DNA, 712 bp, Panicum virgatum
  misc_feature: Ceres CLONE 1902435
  misc_feature: Encodes the peptide sequence at SEQ ID NO. 30908
atctctctccgcaatggcggccgccacagcagccgcggccgcagctctccggccccatatcaccctcctctccggcggcggcggcccaatccccagcacaacccttcaaatccagccctctgtttctccccttccctttggccgtcgtggacgcatcgtactcgtccccaacgcctcgtcgtccccgtcttccccgccgacgccggagaaggaggcggttccgttacctaccgcggaatcctgcgtcaacctcggcctcgagctcttatccaagggcagggtgagggatgctcttgagcaatttgagaatgccttggagctgaatccgacacctattgaagcccaggcagccctgtataacaaggcatgctgccatgcttatagagaagaaagcaaaaaggccgcagaatgtttaaggacagctttgcgggactaccatctcaaatttggtaccatacttaatgatccagacttggcgccattcagagcatcgccagaatttaaggaacttcaagaagaggctttacgtggcggagaagatattggttctgggttccgaagagacctgaaactcattagtgaagtacaagcaccattccgtggtgtccgaagattcttctatgtagctttaacagcagcagctggaatttcaacattctttaccattcctcgacttatactagcagttcaaggaggtgatggtgctcctgat

SEQ ID NO: 30908 - protein, 232 aa, Panicum virgatum
  misc_feature: Ceres CLONE 1902435
  misc_feature (74)..(107): Pfam Name: TPR_2 Pfam Description: Tetratricopeptide repeat
MAAATAAAAAALRPHITLLSGGGGPIPSTTLQIQPSVSPLPFGRRGRIVLVPNASSSPSSPPTPEKEAVPLPTAESCVNLGLELLSKGRVRDALEQFENALELNPTPIEAQAALYNKACCHAYREESKKAAECLRTALRDYHLKFGTILNDPDLAPFRASPEFKELQEEALRGGEDIGSGFRRDLKLISEVQAPFRGVRRFFYVALTAAAGISTFFTIPRLILAVQGGDGAP

SEQ ID NO: 30909 - DNA, 684 bp, Panicum virgatum
  misc_feature: Ceres CLONE 1902435-R
  misc_feature: Encodes the peptide sequence at SEQ ID NO. 30910
tgcagtatgttcaaatcggatggtcagttggtgcattgcttggctatgctcagggggcgaacaccaagcgtgtgattgcctgcattggtgacggaagcttccaggttacagcacaggatgtgtcaactatgctgcggtgccagcagaacagcataattttcctgatcaacaatggtgggtacaccattgaggtggaaatccacgacgggccatacaacgtcatcaagaactggaactacacgggccttgtggatgccattcacaatggagagggcaagtgctggacttccaaggtaaagtgcgaggaggagctgacagccgcgatcgagacggcgctgggggagaagaaggactgcctgtgcttcatcgaggtgatcgcgcacaaggatgataccagcaaagagctgctggagtggggctccagggtctctgctgccaactcccgtccaccgaatcctcagtagagcagtcttgcaagctccaagcctcaaagactcggtagtggtggtagaactatggggctcgatcgaataacgtgaacgctttgccctttctgttatgttctcctcgtttagtgcctggttctcattgttcttgatggtcctgtatctatttgtgacaattcccctgtttctcgtgcgtgaatgccgtagagaattatgagaaatttcaggtttcgggacc

SEQ ID NO: 30910 - protein, 153 aa, Panicum virgatum
  misc_feature: Ceres CLONE 1902435-R
  misc_feature (4)..(124): Pfam Name: TPP_enzyme_C Pfam Description: Thiamine pyrophosphate enzyme, C-terminal TPP binding domain
  misc_feature: SWISSPROT Homolog: EC 4.1.1.1 Pyruvate decarboxylase
QYVQIGWSVGALLGYAQGANTKRVIACIGDGSFQVTAQDVSTMLRCQQNSIIFLINNGGYTIEVEIHDGPYNVIKNWNYTGLVDAIHNGEGKCWTSKVKCEEELTAAIETALGEKKDCLCFIEVIAHKDDTSKELLEWGSRVSAANSRPPNPQ

SEQ ID NO: 30911 - DNA, 722 bp, Panicum virgatum
  misc_feature: Ceres CLONE 1902457
  misc_feature: Encodes the peptide sequence at SEQ ID NO. 30912
gacctcccccacaccctccccttcctccccattttccccgcgcgacgaggccgctccatggcgagtcgcggccggcctcggcccggctcgctccaggtcctcgccgccgtcctcctcctggccgccgcgtccggggccgccgccggatcccccgatcggcccgcgccggggccaccgctgttcctcccgctcacgcgctcctaccccaacgctagccagctcgccggctcgttgcggcgcgggctaggcggaggggcgcaccccaacgcgcgcatgcgcctccacgacgatcttctcaccaacgggtactacacgacgaggctgtacatcgggacgcccccgcaggagttcgcgctgatcgttgactccgggagcaccgtcacgtacgtgccctgcgcctcctgcgagcagtgcggcaatcaccaggatccaaaatttcaacctgatctatccagtacatattcaccagtaaaatgcaatgtcgactgtacttgtgacaatgacaaaaatcagtgcacttacgagaggcaatatgctgaaatgagctccagcagtggggtgcttggtgaggacattgtgtcttttggtagagagagtgaacttaagccacagcgtgctgtttttggctgtgaaaattctgaaactggagatttgttcagccagcatgctgatggtataatgggactgggtcgtggtcaacttagcataatggatcagcttgt

SEQ ID NO: 30912 - protein, 221 aa, Panicum virgatum
  misc_feature: Ceres CLONE 1902457
  misc_feature: SWISSPROT Homolog: EC 3.4.23.12 Nepenthesin
MASRGRPRPGSLQVLAAVLLLAAASGAAAGSPDRPAPGPPLFLPLTRSYPNASQLAGSLRRGLGGGAHPNARMRLHDDLLTNGYYTTRLYIGTPPQEFALIVDSGSTVTYVPCASCEQCGNHQDPKFQPDLSSTYSPVKCNVDCTCDNDKNQCTYERQYAEMSSSSGVLGEDIVSFGRESELKPQRAVFGCENSETGDLFSQHADGIMGLGRGQLSIMDQL

SEQ ID NO: 30913 - DNA, 768 bp, Panicum virgatum
  misc_feature: Ceres CLONE 1902485
  misc_feature: Encodes the peptide sequence at SEQ ID NO. 30914
aagaaccccccactccactccaccccaccccgcacccaccgcaagcgagaggcgagagccagcagccaagcagcagcagcagcagcagctatggtggcgcagcgccgggacgccgaggcggagctgaacctgcccccggggttccgcttccaccccaccgacgaggagctggtggcgcactacctctgcgcgcgcgccgccgggcgcggcccgccggtacccatcatcgccgaggtcgacctctaccgcttcgacccctgggacctccccgagcgcgccctcttcggccgccgcgagtggtacttcttcacgcccagggaccgcaagtaccccaacggctcccgccccaaccgcgccgccgggacgggctactggaaggccaccggcgccgacaagcccgtccaccacgccggccgcaccctcgggatcaagaaggcgctcgtcttctaccacggcaagccgccgcgcggggtcaagaccgagtggatcatgcacgagtaccgcctcgccgacgccggcgccaagaagcccggcaacggctcgctcaggctggacgactgggtgctgtgccgcctgtacaacaagaagaacgagtgggagaagatgcagcagcagaaggggaaggcgatggagtcggaggcgtcgctctcccactcccactcccactcccactccgacacgcgcacgccggagtcggagatcgacgacgacacgttcccggtgctgggcttgctgccggagttcgacgacttggggcccgctcccgcc

SEQ ID NO: 30914 - protein, 225 aa, Panicum virgatum
  misc_feature: Ceres CLONE 1902485
  misc_feature (14)..(140): Pfam Name: NAM Pfam Description: No apical meristem (NAM) protein
  misc_feature: The sequence is a functional homolog of SEQ ID NO 891 in the 10/374,780 US patent application
  misc_feature: The sequence is a functional homolog of SEQ ID NO 853 in the 10/374,780 US patent application
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 890 in the 10/374,780 US patent application
  misc_feature: Useful for making plants with altered terpenoid content
  misc_feature: The sequence is a functional homolog of SEQ ID NO 1157 in the 11/479,226 US patent application
  misc_feature: The sequence is a functional homolog of SEQ ID NO 1416 in the 10/666,642 US patent application
  misc_feature: The sequence is a functional homolog of SEQ ID NO 30 in the 10/286,264 US patent application
  misc_feature: The sequence is a functional homolog of SEQ ID NO 430 in the 11/435,388 US patent application
  misc_feature: The sequence is a functional homolog of SEQ ID NO 518 in the 10/412,699 US patent application
  misc_feature: Useful for making plants with modulated water use efficiency
  misc_feature: The sequence is a functional homolog of SEQ ID NO 104 in the 10/225,068 US patent application
  misc_feature: The sequence is a functional homolog of SEQ ID NO 2014 in the 10/374,780 US patent application
  misc_feature: The sequence is a functional homolog of SEQ ID NO 22 in the 10/286,264 US patent application
  misc_feature: The sequence is a functional homolog of SEQ ID NO 314 in the 10/412,699 US patent application
  misc_feature: The sequence is a functional homolog of SEQ ID NO 734 in the 11/479,226 US patent application
  misc_feature: Useful for making plants with modulated light quality response
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: The sequence is a functional homolog of SEQ ID NO 851 in the 10/374,780 US patent application
  misc_feature: Useful for making plants with altered cell wall content and/or composition
  misc_feature: Useful for making plants with altered lignin content
  misc_feature: The sequence is a functional homolog of SEQ ID NO 2110 in the 10/374,780 US patent application
  misc_feature: The sequence is a functional homolog of SEQ ID NO 304 in the 10/225,066 US patent application
  misc_feature: The sequence is a functional homolog of SEQ ID NO 954 in the 11/435,388 US patent application
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: Useful for making plants with modulated oxidative stress sensitivity
MVAQRRDAEAELNLPPGFRFHPTDEELVAHYLCARAAGRGPPVPIIAEVDLYRFDPWDLPERALFGRREWYFFTPRDRKYPNGSRPNRAAGTGYWKATGADKPVHHAGRTLGIKKALVFYHGKPPRGVKTEWIMHEYRLADAGAKKPGNGSLRLDDWVLCRLYNKKNEWEKMQQQKGKAMESEASLSHSHSHSHSDTRTPESEIDDDTFPVLGLLPEFDDLGPAP

SEQ ID NO: 30915 - DNA, 577 bp, Panicum virgatum
  misc_feature: Ceres CLONE 1902492
  misc_feature: Encodes the peptide sequence at SEQ ID NO. 30916
aactctcaccgccccgcccccaagccgcccgggtttcagcagcttcggcacgatcgccttcgcccagtgagggaggagaggacaggaaaaaaaattcccccgtcgcgcccgcccattacgacggcgccggccgagcagacgccgccgccacgatgtcccccgccaccggcgccgtcgcatccgccgcggcgggagaggaatctcccgccgccgcccccacggttctcctcggcaggtacgagctccgcgacctcctcggccgcggcgcgtccgccaaggtgtaccgcgcgcgggacctcctcaccggccgctccgtcgcgatcaagtcattccccaacccccgcgccgccggggccgagaaggggcgccgccccgtggccattgagcgcgaggcggccatcctccgccgcctgcgccaccgccacgtggtgcgcctccacgagatcctagccacgcgcaagaaggtccatttcgtcctcgacctcgccgccggcggcgagctcttctcgctcgtcgacgcctccggccgcatgacggaggacctcgccaagcactacttccggcagctcatctccgc

SEQ ID NO: 30916 - protein, 141 aa, Panicum virgatum
  misc_feature: Ceres CLONE 1902492
  misc_feature (99)..(141): SWISSPROT Homolog: EC 2.7.11.1 Non-specific serine/threonine protein kinase
  misc_feature (29)..(70): SWISSPROT Homolog: EC 2.7.11.25 Mitogen-activated protein kinase kinase kinase
MSPATGAVASAAAGEESPAAAPTVLLGRYELRDLLGRGASAKVYRARDLLTGRSVAIKSFPNPRAAGAEKGRRPVAIEREAAILRRLRHRHVVRLHEILATRKKVHFVLDLAAGGELFSLVDASGRMTEDLAKHYFRQLIS

SEQ ID NO: 30917 - DNA, 739 bp, Panicum virgatum
  misc_feature: Ceres CLONE 1902506
  misc_feature: Encodes the peptide sequence at SEQ ID NO. 30918
gcacaacacaagcaagctaagctcgatcgcccgcccgcccccttcgaccttcgtccagctccaccaccacacatctcggcatctcgcctcttcggccatggcccggcgggtgtccctgctgcagcagctgctgctgggcgcgctggcggcctgctcggcggcggcggcggccagcttcgaccaggagttcgacatcacctggggcgacggccgcggcaagatccaggacggcggccgcctcctcacgctcacgctcgaccgcacctccggctccggcttccagtccaggcacgagtacctcttcggcaagatcgacatgcagctcaagctcgtccccggcaactccgccggcaccgtcaccgcctactacctctcctcccagggcagcgcccacgacgagatcgacttcgagttcctgggcaacgtctccggcgagccctacacgctgcacaccaacgtgttcacgcaggggcagggccagcgcgagcaacagttccgcctctggttcgaccccaccaccgacttccacacctactccatcctctggaatcccaagcacatcatcttcatggtggacgacctgccgatcagggacttccggaacctggagagcaaggggatcgcgttcaccaagagccagcccatgcggctctactccagcctctggaacgccgacgactgggccacgcaggggggccgcgtcaagacggattggtcccacgcgcccttctccgcctcc

SEQ ID NO: 30918 - protein, 213 aa, Panicum virgatum
  misc_feature: Ceres CLONE 1902506
  misc_feature (27)..(208): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
  misc_feature: Useful for making plants with altered carbohydrate content
  misc_feature: Useful for making plants with altered cell wall content and/or composition
  misc_feature: Useful for making plants with altered lignin content
MARRVSLLQQLLLGALAACSAAAAASFDQEFDITWGDGRGKIQDGGRLLTLTLDRTSGSGFQSRHEYLFGKIDMQLKLVPGNSAGTVTAYYLSSQGSAHDEIDFEFLGNVSGEPYTLHTNVFTQGQGQREQQFRLWFDPTTDFHTYSILWNPKHIIFMVDDLPIRDFRNLESKGIAFTKSQPMRLYSSLWNADDWATQGGRVKTDWSHAPFSA

SEQ ID NO: 30919 - DNA, 2106 bp, Panicum virgatum
  misc_feature: Ceres CLONE 1902523
  misc_feature: Encodes the peptide sequence at SEQ ID NO. 30920
aagggacgagagctctccgttccaaatcgaatcgattcgccccccttccccctcctccaaccccaaccctaaccctaaccctacccccgccaccatgtccgcccacatcgacctcaacaactcctcctcctcagaagccctgccgccgcccaagcgcggccgcggccgcccccgcaagaatcccccggcccccgcccgcccgcgccccccggatcccgacgcccccagggtcggcggcttcgcgccgggtgacatggtctggggtaagaagctcacccatgccgcatggcccggcctcgtctactccgccggcggcaacggcaccggccaccacggccagctcctcgtctcctacttcggcgacaaggccttcgcctggtgcgacgccgccgagctcaggccctacgagccctacttcccagtcgccgagctctacgacgacgacggcgacgacttccacgccgccgtcgaggcctccctcgacgagttctcccgccgcgtccaggacgccctcgccacccccgcccgcccctttgtccccgccgatttcctcgcctcgcttcacgacctggccgccgatcgcaccagctttaccaacagggtgcaggcggccatcgctaaggcacatctcagggcattcgatgccttcagggctctgccggacccccccaactacaccatggagctcggcctgctccccctcacgcctaccaaatccaccaccacggatgctaatgacgactccgctaccgccgcgtccaggaggaggggcaggaggaggaagcacgaagctgttagggatgactccgatgaggactgggaccccaggaagaaggggggcactgactctgaatccgacctcggttccgaccgcaagagaggctccaggggcaggagcgctgctgcgcctcgtggaaggccacgagggaggcccaggaaaaccgatgcctgcagggacacgcacctcatggattacgagatggaagacagactcgagtatccgcctgctgctgacatgctgctgcagcttctctctgttgccgctgatcctgtcaacggtagccatggctctgttcctgtcatcgttagcttcttctcaaagcacaaggactccgaagcgcccagtgtttatgaagataaagagctgctccagactttcggttgcaagcagggtaggaaaaactcagctgggagcatgtgcccagctacaaagccagaagccaacaaccatctgatcgctgcggatggtcagaggggccgaaggaagtccgcggggagcttgtactcagctaggaaggctgaggactcatactggtgtgatatcatcatcagcgattttgatgatggagatagtgattatgaagggcgcaagaggaagcgccaccctcacaacactaacaagagtgtcaataagaagatgaagcaggaggaggcacctcaagatgaggcatctacagatcatcctccggcagatgcaaatcatccggcttctgcagattgtccgatggatgtgaaacctgcagatggcccagcagccttgattttacattttagcagtccagaagctatcccttctgtggatgtcgtcaatagcatattccgcatacatggacctatcctggagagtgagactgaggtcactaagaagtcgaagattgcaaaagtagttttctctaggcgtgatgatgcagagcgggcatttagcagttcgggaaagtacagtgcatttggtccatcgcttctcacgtatgaaattcaatacttgccatctgcgcctcaggtttcttaagtgctgcggtctgaacttgatatgctgcaattcagaagaaatgcaccatgaagcctggagcaatggagcattaattggtgtacctgacctagagttaggattgcccactgaccaggtcacattagtcactgagtgggtgagcaaattttaggctttctgcagatacatgcctggtagtgtgcttggtatcagagttagcttttgttgaattattagatgttagagtaaaccatgcgccgcctcgtatgttagcaccttatcctttttgtattgcacagctgtggatctctctattatgtggtctttttagcagacgc

SEQ ID NO: 30920 - protein, 564 aa, Panicum virgatum
  misc_feature: Ceres CLONE 1902523
  misc_feature (48)..(129): Pfam Name: PWWP Pfam Description: PWWP domain
MSAHIDLNNSSSSEALPPPKRGRGRPRKNPPAPARPRPPDPDAPRVGGFAPGDMVWGKKLTHAAWPGLVYSAGGNGTGHHGQLLVSYFGDKAFAWCDAAELRPYEPYFPVAELYDDDGDDFHAAVEASLDEFSRRVQDALATPARPFVPADFLASLHDLAADRTSFTNRVQAAIAKAHLRAFDAFRALPDPPNYTMELGLLPLTPTKSTTTDANDDSATAASRRRGRRRKHEAVRDDSDEDWDPRKKGGTDSESDLGSDRKRGSRGRSAAAPRGRPRGRPRKTDACRDTHLMDYEMEDRLEYPPAADMLLQLLSVAADPVNGSHGSVPVIVSFFSKHKDSEAPSVYEDKELLQTFGCKQGRKNSAGSMCPATKPEANNHLIAADGQRGRRKSAGSLYSARKAEDSYWCDIIISDFDDGDSDYEGRKRKRHPHNTNKSVNKKMKQEEAPQDEASTDHPPADANHPASADCPMDVKPADGPAALILHFSSPEAIPSVDVVNSIFRIHGPILESETEVTKKSKIAKVVFSRRDDAERAFSSSGKYSAFGPSLLTYEIQYLPSAPQVS

SEQ ID NO: 30921 - DNA, 705 bp, Panicum virgatum
  misc_feature: Ceres CLONE 1902528
  misc_feature: Encodes the peptide sequence at SEQ ID NO. 30922
atctccgtccccctccctctctctgcgaaccgcaaaatctcctccacctttccgtcccccacgcctcgtcactgtgccgcccgtgccctcccgtcccaccaataatccatccactcccacccccaccccgctgcggcggcgcctgttcctccggcggcggcgatgtgcggcggcgccatcctctccggcttcatccggccgtccgggccggcggccaagaagcagcagcagcagctgctgctgcagcaccagccccgccgggtcacggccgacttgggggatgacttcgaggccgacttccgcgagttcgtgcgcgggctcggcgagggcgacggcgccggtgacgtcggcgacgacgacgaggtcgtggaggtccccccgccggagccggcgatgttcgccttcgccgccgcggccaaggcggcggcccccgcagtcgatggtgtgatgactccaaagactgctcaacatgatgaacctactgctacctcagcaaagcgcaaccggaagaatcagtacagggggatccgccagcgtccctggggtaaatgggcggctgagatccgagaccctagcaagggtgtccgtgtttggcttggaacttacaacacggctgaggaggccgcaagggcatatgatgctgaagctcgcaagattcgtggcaagaagcaaaggtcaattttcctgatgaagcggcagatgttc

SEQ ID NO: 30922 - protein, 180 aa, Panicum virgatum
  misc_feature: Ceres CLONE 1902528
  misc_feature (117)..(168): Pfam Name: AP2 Pfam Description: AP2 domain
MCGGAILSGFIRPSGPAAKKQQQQLLLQHQPRRVTADLGDDFEADFREFVRGLGEGDGAGDVGDDDEVVEVPPPEPAMFAFAAAAKAAAPAVDGVMTPKTAQHDEPTATSAKRNRKNQYRGIRQRPWGKWAAEIRDPSKGVRVWLGTYNTAEEAARAYDAEARKIRGKKQRSIFLMKRQM

SEQ ID NO: 30923 - DNA, 625 bp, Panicum virgatum
  misc_feature: Ceres CLONE 1902549-R
  misc_feature: Encodes the peptide sequence at SEQ ID NO. 30924
tcttgtgaccgtgactgacgaggagtcgaggcgtattgagcagcagtcggacaaccagaccaaggcagagatcatggaagtgctgaggaagatgttccccggcgaggacgtcccggatgccaccgacatcctcgtcccgagatggtggtctgacaggttctacaagggcacctacgccaactggccagtcggtgtcagccgctacgaagtcgaccagcttagggcaccggttgggagggtgtacttcaccggtgagcacaccagcgacaaatacactggctatgtccatggcgcttatcttgcaggtattgactctgctgaaattctcatcaattgcgcccagaaaaagatgtgcaagtaccttgtcaagggcaagtatgactagaaggcataagctccagcaaacgtctcctcttgttgcaccaatgagaatctacctatggatgtgcatttatttatttataaataagtagatgacagccatgtcttggcatgtctcttttccttgctgtaataaggcggctgatttataaagcttcaatcattgttaccatctatgatttgtgattaagtattctgcttaagtaccgtgttgctctttttatatatatactgatagtgatgg

SEQ ID NO: 30924 - protein, 127 aa, Panicum virgatum
  misc_feature: Ceres CLONE 1902549-R
  misc_feature: SWISSPROT Homolog: EC 1.5.3.11 Polyamine oxidase
LVTVTDEESRRIEQQSDNQTKAEIMEVLRKMFPGEDVPDATDILVPRWWSDRFYKGTYANWPVGVSRYEVDQLRAPVGRVYFTGEHTSDKYTGYVHGAYLAGIDSAEILINCAQKKMCKYLVKGKYD

SEQ ID NO: 30925 - DNA, 684 bp, Panicum virgatum
  misc_feature: Ceres CLONE 1902549
gaggcagcctggcagtccaagctttcccctccccctcccaaatcccggtgccgccgggcctccgccgccgccctctccgcggatcacgtgcgcggcggctttgctcagcttccttgcggcgagtacaggaggaggagggaggtgctgggccggggggctgtcgctggatctcgtggagccgccgtgcgccgagagtgatcatgagctcaagaaacctcgtccgatctccgcaggtgtcctgtagtgctggtaccaatggatgcttcacctccaatacatgctgttcaagaaactactatcagcatactcatggcactaatttgcaaagtttgcaagtagactggaaacttttgccttgcaaattaaggaaatcaactcagcgaaacacttcatttttcacccagaggaagcttgtaccacactgttcatcagaccttagtacttcctgcatagaagaggtgcccaactatttagcagtcaatgttttgcaagaccaatcaaatacaacacaggtagctgctcgtaaagtgcttgtcatcttgaatcctaattctggatttcgaagcactcgggatgttttctacaagaaagtgcagtcgaagttaaggctttcaggcttcatgctggaagtcatcgaaacagcttatgctggccatgcaaagattcttgcttctactgttgacc

SEQ ID NO: 30926 - DNA, 768 bp, Panicum virgatum
  misc_feature: Ceres CLONE 1902554
  misc_feature: Encodes the peptide sequence at SEQ ID NO. 30927
gggctttccctctgctacctcctcgacgatccatcatccatcgccccagaccagacaggccaaccggtgcatgccttgcatttctgcttgtcaagagatgggccatcgaacatgggggccgatctgcatccttctctccgtgctctcggcgtcgacagtgctcgcatcgtcgagcagcgatggcctggtccgcatcccgctgaagaagaggtcgataatggagagcatctacggcgagcttctgcccaagaccggcccgctggcgaacctggccgcagcagcgagagagtttatcgatgatcccgtgcgtgcagccatcgcgcaagctcgcgagcgggagcaccagatgctagctgaggctgcggccatggagcggcggcgccagtacttctggagctacggcggtggcacggggaacggtagcagtttgcgcggcggcgttcggtccgagctcgtcccgctcaagaacttcctgaacgcccagtacttcgggcagattggggtgggctgcccgccgcagaacttcaccgtcgtcttcgacaccgggagcgccaacctttgggtcccttccgccaagtgttatttctcgcttgcgtgtctcttccatcccaagtatgaatcaagtctgtccagcacttacaaaccgaatggaacaccggcttctattcactacggaacaggagcaatcgctggtttttacagccaagatcaggtcacggttggcaatctagtagttcaagatcaggaaattcatgaaagctactcatg

SEQ ID NO: 30927 - protein, 223 aa, Panicum virgatum
  misc_feature: Ceres CLONE 1902554
  misc_feature (129)..(223): Pfam Name: Asp Pfam Description: Eukaryotic aspartyl protease
  misc_feature: SWISSPROT Homolog: EC 3.4.23.40 Phytepsin
MGHRTWGPICILLSVLSASTVLASSSSDGLVRIPLKKRSIMESIYGELLPKTGPLANLAAAAREFIDDPVRAAIAQAREREHQMLAEAAAMERRRQYFWSYGGGTGNGSSLRGGVRSELVPLKNFLNAQYFGQIGVGCPPQNFTVVFDTGSANLWVPSAKCYFSLACLFHPKYESSLSSTYKPNGTPASIHYGTGAIAGFYSQDQVTVGNLVVQDQEIHESYS

SEQ ID NO: 30928 - DNA, 664 bp, Panicum virgatum
  misc_feature: Ceres CLONE 1902554-R
  misc_feature: Encodes the peptide sequence at SEQ ID NO. 30929
tcctccatgatggccaagtgtgaccctcgccatggcaagtacatggcctgctgcctcatgtaccgtggagatgttgtgcccaaggatgtgaatgctgctgtggccaccatcaagaccaagcgcaccatccagtttgtggactggtgcccgactgggttcaagtgcggcatcaactaccagcctcccagtgtggtgcctggtggtgatctggccaaggtgcagcgtgccgtgtgcatgatctccaactccaccagtgtggttgaggtgttctcccgcatcgaccacaagtttgacctcatgtatgccaagcgcgccttcgtgcactggtacgtgggtgagggcatggaggagggtgagttctccgaggcccgtgaggaccttgccgcgctggagaaggactatgaggaggtcggtgctgagtttgacgatggtgaggagggtgacgagggtgatgagtactagacccttcctggtgcatctgtgtcaggcctgcgtgctgctattatccagtgatctgccttagtggctcgtgctatcgtgttatgtgttgtctgtcggtttgaactatcagttgtgttaacgtgtggtttacaacacctgatgttgtaagaactctatgttgaatttcctgctctgctactgggtaatgaatgtcgttatgatc

SEQ ID NO: 30929 - protein, 153 aa, Panicum virgatum
  misc_feature: Ceres CLONE 1902554-R
  misc_feature (1)..(95): Pfam Name: Tubulin_C Pfam Description: Tubulin/FtsZ family, C-terminal domain
  misc_feature: Useful for making plants with altered cell wall content and/or composition
SSMMAKCDPRHGKYMACCLMYRGDVVPKDVNAAVATIKTKRTIQFVDWCPTGFKCGINYQPPSVVPGGDLAKVQRAVCMISNSTSVVEVFSRIDHKFDLMYAKRAFVHWYVGEGMEEGEFSEAREDLAALEKDYEEVGAEFDDGEEGDEGDEY

SEQ ID NO: 30930 - DNA, 695 bp, Panicum virgatum
  misc_feature: Ceres CLONE 1902567
  misc_feature: Encodes the peptide sequence at SEQ ID NO. 30931
ctcctcctcccaaagtcccccactccaccctgccgaggctcgcgacgcctctgcaactgctaccgcagccccacgccccaaaccctagccccctccaccgccaccgccatggccgacttatccgctgccgccgtcaccgccgtggaggtcggggagcccgattcgctgcccccgccggtcgcagaggaggctgatgccgccgcggcggaggaggccgcgaagaagtggccaggttggcccggggacagcgtgttccggctcgtggttccggtgctcaaggtcgggagcatcatcgggcgtaagggcgagctcatcaagcgcctcgtcgaggagactaaggccagggtccgcatcctggaggggcccgtcggagcaaccgagcgcattgtcctggtgtctggaaaagaagatccaagcttggagcttcctccagctatcgatgctctaatgagagtttttaaacgtgtcattggaatagcagatggagctgctgatggcactcaggcagctgctgcacctggtgtatgtgctgcccgactgctggttcctggagctcaagctattaacctaattgggaagcaaggtgccacaatcaagtcaattcaggagagcactggtgctacaatccgggttatatcagtagatgaacgagagcggccattttatgtaactgatgatgaaaggatagttgagga

SEQ ID NO: 30931 - protein, 195 aa, Panicum virgatum
  misc_feature: Ceres CLONE 1902567
  misc_feature (48)..(110): Pfam Name: KH_1 Pfam Description: KH domain
  misc_feature (141)..(193): Pfam Name: KH_1 Pfam Description: KH domain
  misc_feature: Useful for making plants with modulated flowering time
MADLSAAAVTAVEVGEPDSLPPPVAEEADAAAAEEAAKKWPGWPGDSVFRLVVPVLKVGSIIGRKGELIKRLVEETKARVRILEGPVGATERIVLVSGKEDPSLELPPAIDALMRVFKRVIGIADGAADGTQAAAAPGVCAARLLVPGAQAINLIGKQGATIKSIQESTGATIRVISVDERERPFYVTDDERIVE

SEQ ID NO: 30932 - DNA, 650 bp, Panicum virgatum
  misc_feature: Ceres CLONE 1902567-R
tttgatgccaatattccaaatggtgatcttattgctagtgcaattggtgtggcatcagcagttatagacaatgttccacttgttgctgcaacgatgggaatgtatgacctgacttcatatcctcaagattcggacttctggcagcttattgcattctgtgctggtactggagggtcaatgcttatcattggctctgcagcaggagttgcttttatgggaatcgaaaaggtggatttcttctggtattttcgcaaggtgagcggttttgcccttgcaggttatgcagcaggtataatctcgtatctagctactcaaaatctccatctaactcttcccacatcactggctgagatcccatttcttcctggctcataaaaggtgtctggtaacagcactagctgtcattcacatgaatgcggacaggcagcttattcagattgagcacgacagcctgagtagttctcacttctgagaagtttggactgcaacaagtgaggtgtcaacaaaggcatccttcagaaaatcctttttcgtttcctctaaaaatacctgatgttagaaatacagcagcgtgttactaaaagtacctctaacatcactcatgtcggaccctacatgatttccagctgggggatgcgccatcttgctcg

SEQ ID NO: 30933 - DNA, 999 bp, Panicum virgatum
  misc_feature: Ceres CLONE 1902591
  misc_feature: Encodes the peptide sequence at SEQ ID NO. 30934
ggcatcagcgtcgcagccctcagcctgccttcaccgtccccacggccgccgcgccgcctcgccgctttcctcgttcccgcccgacgcccacccctgccgccgggtggcttgatccagcaccgaggcgggagaagtgataagcatcccaactcgcagcggtagggcggtgatgccggaagcggcggcgccgatcggcctgtcatgggcgcccaatctgccttccctagcgacgacgagcgggggcagcaagagcgacccggcgccgaaaccgagcaccgcgcaggggtcgatctggaagcccgcgagcgagctcgtggacgggctgttcgtgccaccgacggaccccaggaaggttaacaagctcgccaggaagagtgtcaaggacaccaccggcaagggctggttcgacatgccggcgccgagcatcactcccgagttgaagaaagatctcgagattttgcagctgaggcatgtaatggacccaaaaaggcacttcaagagggcaggaaaatccaaggcccttcccaggtacttccaagttggtacagttgttgagcctgcatctgagttctactcaggtaggctgacgaagagggagcggaaaacaacattggttgatgagctgttatcggatcaatctcttaagagctacaggaagcgcaaggtacgggaaatccaggagagtcgtacaccaggaggcaaccaaaagtggaagaacaaggggaagcaaacacttaagagggccaaggataggcgaaaatgagtttgctgcgtctgactgcttcggtcgtgagaaagaagagagtggagaagggtctccttcaagtcacactatactctctctcgattttacagtataaattgtgattcaactgtaatgtggtgaacttcagcatgttgactgttgaatacattttcaggtctaaatatttttaaagtagtagtgtagcatcggaattcaaaaatgctggttggtggactcgtttcctcggtcaagcg

SEQ ID NO: 30934 - protein, 197 aa, Panicum virgatum
  misc_feature: Ceres CLONE 1902591
  misc_feature (68)..(165): Pfam Name: Fcf2 Pfam Description: Fcf2 pre-rRNA processing
MPEAAAPIGLSWAPNLPSLATTSGGSKSDPAPKPSTAQGSIWKPASELVDGLFVPPTDPRKVNKLARKSVKDTTGKGWFDMPAPSITPELKKDLEILQLRHVMDPKRHFKRAGKSKALPRYFQVGTVVEPASEFYSGRLTKRERKTTLVDELLSDQSLKSYRKRKVREIQESRTPGGNQKWKNKGKQTLKRAKDRRK

SEQ ID NO: 30935 - DNA, 1989 bp, Panicum virgatum
  misc_feature: Ceres CLONE 1902606
  misc_feature: Encodes the peptide sequence at SEQ ID NO. 30936
cgagatccgcccattaaacccacttccccccctctctctcctctcctcctctctcccccattcaccagccgccgctccccccacgcgccgggcagcggagccacgagcggagaatcacccgagatggcgatggctctgcgccgcctcgcgggcttgcccggctccccgtcggccgccgcggcagcgctgctcttccgcccggcgctgacccgcccgatctccaccggcttccgcgaggagcgcgacaccttcggccccatccaggtccccaacgacaagctgtggggtgcgcagacgcagaggtcgctgcagaacttcgacattggcggcgagcgcgagcggatgcccgtgcccatcatccgcgcctttggtgtcctcaaaaagtgcgctgctaaggtgaatatggagtatggccttgatccaacaataggcaaggcaataatgcaggcagctgaggaggtcgctgagggaaagctggatgatcacttcccacttgttatctggcaaactggtagtggcacacaaagcaacatgaatgccaatgaggtaattgcaaatagggcagctgagattcttggacacaagcgtggtgagaagtttgtgcaccctaatgaccacgtgaataggtcacaatcctccaatgatacatttcccactgttatgcatatagcagctgctgtcgagatcaattcaaaatttatcccaagtttgcaacagttgcatgattcacttcactcaaagtctgttgagtttaatgacataatcaaaatcggacgtacacatacccaagatgccaccccgttaactcttggccaggagttcagtggttacacaacacaggtcaaatatggaattgaccgaattaattgtacattacctcggatgtaccagcttgctcaaggtggaactgcagttggaactgggttgaacactaagaaaggatttgatgtcaaaattgccgctgcagtggctgaggaaacaagtctaccctttgtgacagcagagaacaagttcgaagctttggcagcacatgatgcttttgttgagagcagtggtgccgtaaacacgatatccgcgtcccttatgaaaatagcaaacgacatacgcttgctgggaagtggccctcgctgtggacttggtgaactaatcctgccagaaaatgagcctgggagtagcattatgcctggaaaagttaatccaacacagtgtgaggctctgaccatggtttgcgctcaggttatgggtaatcatgttggtgttacagttggtggtgcgaatgggcattttgaactgaatgttttcaagccaatgattgcagccgggttacttcgatcattgagattgttgggggatgcttctgtgtcctttgagaaaaattgtgtcaggggaattcaagcaaaccataagagaatttcacagcttttgcatgagtctctgatgttggtgacatctttgaaccctaaaattagctatgacaatgctgcagctgtagctaagaaagctcacaaagaaggaaccacattaaagaaagctgcactagaccttggtgtcttaacggaagacgaattccatgagcttgtcgttccagagaaaatgattggcccttctgattgataaccccatgctagctatgtttcttgaagcattcaggcggccacatctgagttttattggttgcctgtgatgtcagaattcatgatcctggcccatccgtaaataaagcaaatcaatttcatatcatcattagctcctcaccccattggagacatgattttgtacggcccatggtgcctgagaaaataacattcattcctgttgaaatagggagcagtgtactttggttaaccggaagagatgccttttttttcctcttggatatcattatgcacaagtttttcccccatatggcgagtgttatgtaataaatgatatggcaaccctgtctctggaaataattatcatgcatcttaagtgaaagaagcaaaatac

SEQ ID NO: 30936 - protein, 496 aa, Panicum virgatum
  misc_feature: Ceres CLONE 1902606
  misc_feature (44)..(374): Pfam Name: Lyase_1 Pfam Description: Lyase
  misc_feature: SWISSPROT Homolog: EC 4.2.1.2 Fumarate hydratase
MAMALRRLAGLPGSPSAAAAALLFRPALTRPISTGFREERDTFGPIQVPNDKLWGAQTQRSLQNFDIGGERERMPVPIIRAFGVLKKCAAKVNMEYGLDPTIGKAIMQAAEEVAEGKLDDHFPLVIWQTGSGTQSNMNANEVIANRAAEILGHKRGEKFVHPNDHVNRSQSSNDTFPTVMHIAAAVEINSKFIPSLQQLHDSLHSKSVEFNDIIKIGRTHTQDATPLTLGQEFSGYTTQVKYGIDRINCTLPRMYQLAQGGTAVGTGLNTKKGFDVKIAAAVAEETSLPFVTAENKFEALAAHDAFVESSGAVNTISASLMKIANDIRLLGSGPRCGLGELILPENEPGSSIMPGKVNPTQCEALTMVCAQVMGNHVGVTVGGANGHFELNVFKPMIAAGLLRSLRLLGDASVSFEKNCVRGIQANHKRISQLLHESLMLVTSLNPKISYDNAAAVAKKAHKEGTTLKKAALDLGVLTEDEFHELVVPEKMIGPSD

SEQ ID NO: 30937 - DNA, 658 bp, Panicum virgatum
  misc_feature: Ceres CLONE 1902607
  misc_feature: Encodes the peptide sequence at SEQ ID NO. 30938
ccacccacctcccacccctcaccaccgcgtcactgatccaaggatcttatcctatccccctattctgcctcgcctctgaacgaaatgacgtgttgctgtgattcatatcctatgtgctccggggatagatggcctccgagcacgacgctgcgggcgccgacggggaaggactcggggatgacggggggcctgcgcctggacttggcgactccagatcaactactgccgtcccctgcagccgtgcaggatgagcaagatgggggatggggcggggcgtgcctgtgtgatcgaccggcagaccggcgcgtcctacacctactcgaacgtggagtccctgtcgcggcgcgccgcgtctgggctccgccggatgggcgtgggcaggggcgacgtggtgatgaacctgctccgcaactgccccgagttcgccttctcgttcctgggcgcggcgcggctgggcgccgccaccaccacggcgaacccgttctacaccccgcacgagatccaccggcaggcggaggcggcgggcgccaggctcatcgtcaccgaggcctgcgccgtggagaaggtgcgcgagttcgcggccgcgaggggcatccccgtggtcaccgtggacagccgcttcgacgggtgcgcctagttcgccgaggtcatcgcgggc

SEQ ID NO: 30938 - protein, 129 aa, Panicum virgatum
  misc_feature: Ceres CLONE 1902607
  misc_feature: SWISSPROT Homolog: EC 6.2.1.12 4-coumarate--CoA ligase
  misc_feature: Useful for making plants with altered carbohydrate content
  misc_feature: Useful for making plants with altered cell wall content and/or composition
MSKMGDGAGRACVIDRQTGASYTYSNVESLSRRAASGLRRMGVGRGDVVMNLLRNCPEFAFSFLGAARLGAATTTANPFYTPHEIHRQAEAAGARLIVTEACAVEKVREFAAARGIPVVTVDSRFDGCA

SEQ ID NO: 30939 - DNA, 720 bp, Panicum virgatum
  misc_feature: Ceres CLONE 1902628
  misc_feature: Encodes the peptide sequence at SEQ ID NO. 30940
agcgcgagtccaccccggccggctcccccagaggcccattcctgcacagagccgccgaatcgggaccaatcccgtcgatccttctggccgccgccgccgccgacgccgcgggactctccggaggcggcctccgattcggccggggcctgggtggacatggggctcggggcggcggcggggcggctcctgccggaggtggactgggagcgcgaggcctacccggcgtacgacgacttcctcgcgctcccggccttcgtcctcttcttccccaccgtccgtttcttcctcgaccgcttcgtcttcgagagggttgcaaggaggcttatacttgggaagggacatcagagagctaataatgaaacagaagaaacaataaagaagataagaaaattcaagaaatcggcatggaaatgtgtttatttcctatctggagagcttttatctctgtcagtcacatataatgagccttggttcaccaataccaaatatttttgggtagggcctggacaacaggtttggcctgatcaaaagataaaattgaaacttaaggcggtatacgtgtatgcggctggattctacacatattccatatttgcacttatgttttgggaaactaggcgttcagactttggcgtgtcgatgtcacatcatgttgctactgtagtcctgatcgttctatcttatgtgttcagatttgctagagttggctctatagtattg

SEQ ID NO: 30940 - protein, 187 aa, Panicum virgatum
  misc_feature: Ceres CLONE 1902628
  misc_feature (97)..(187): Pfam Name: LAG1 Pfam Description: Longevity-assurance protein (LAG1)
  misc_feature: SWISSPROT Homolog: EC 2.3.1.24 Sphingosine N-acyltransferase
MGLGAAAGRLLPEVDWEREAYPAYDDFLALPAFVLFFPTVRFFLDRFVFERVARRLILGKGHQRANNETEETIKKIRKFKKSAWKCVYFLSGELLSLSVTYNEPWFTNTKYFWVGPGQQVWPDQKIKLKLKAVYVYAAGFYTYSIFALMFWETRRSDFGVSMSHHVATVVLIVLSYVFRFARVGSIV

SEQ ID NO: 30941 - DNA, 703 bp, Panicum virgatum
  misc_feature: Ceres CLONE 1902630
  misc_feature: Encodes the peptide sequence at SEQ ID NO. 30942
gtcctgcacaaacccccaaaaccctaccgccgccgccgccgccgccgccaccatgtcctcggcgccgtctccggcgagccgccggcccctgggcccgctggcgctggggctggagtcctcggccaacaagatcggcatcggcgtggtctccctctctggcgagatcctctccaacccgcgccacacctacgtgaccccgccgggccacggcttccttccccgcgagaccgcgcagcaccacctggtgcacctcctcccgctcctccgcgccgcgctcgccgacgccggcgtcgcccccgccgacctcgcctgcgtctgctacactaaaggccccggcatgggcggcccgctccaggtggccgccgcggccgcccgcgcgctctccctcctctggaggaagccgctcgtggcggtcaaccactgcgtcgcgcacatcgagatggggcgcgcggtcacgggggccgtggaccccgtcgtgctctacgtctccggggggaacacgcaggtcatcgcctacagcgaagggaggtacaggatcttcggagagactatcgatatcgcagttgggaactgcctcgaccgctttgccagggtccttgagctctccaatgaccctaactcagggtataacatcgagcagcttgcaaagaagggggaaaaattcattgatctcccatatgttggaaaggggatggatgtgtca

SEQ ID NO: 30942 - protein, 216 aa, Panicum virgatum
  misc_feature: Ceres CLONE 1902630
  misc_feature (37)..(202): Pfam Name: Peptidase_M22 Pfam Description: Glycoprotease family
  misc_feature: SWISSPROT Homolog: EC 3.4.24.57 O-sialoglycoprotein endopeptidase
MSSAPSPASRRPLGPLALGLESSANKIGIGVVSLSGEILSNPRHTYVTPPGHGFLPRETAQHHLVHLLPLLRAALADAGVAPADLACVCYTKGPGMGGPLQVAAAAARALSLLWRKPLVAVNHCVAHIEMGRAVTGAVDPVVLYVSGGNTQVIAYSEGRYRIFGETIDIAVGNCLDRFARVLELSNDPNSGYNIEQLAKKGEKFIDLPYVGKGMDV

SEQ ID NO: 30943 - DNA, 1771 bp, Panicum virgatum
  misc_feature: Ceres CLONE 1902642
  misc_feature: Encodes the peptide sequence at SEQ ID NO. 30944
agggagcagccgctgcggagcagagtgtgtcgcgctgccgccgcggtaaaaaacaggggagggcgaggcgcggccgcacatgctttaagtcccactccccaccgccccagatctccgcccccctcccactccggcactcccccccacattccccggcgcgccacctctgcccgcggccgccgccgccgccgtccggagcgagatcggcgtgggtgcacgggcgcggctcctgtatctgtcggtgggagaccccgcgtgtcggtgggagcgggtggggaccaagcgaaggatggcgccgggcggcagatccgtcgcgtgctgcgccgccgtgctgctcgcggccgcgctgctcctctccgcgccgactgctacagaggcttatgattccttggatccgaacggcaacatcactataaaatgggatattatgcagtggactcctgatggatatgtcgctgttgtcacaatgttcaactatcaacaattccggcacattggggcacctgggtggcagcttgggtggacatgggcaaagaaagaggtcatatggtcaatggttggggcacagactactgagcagggtgactgctcgaaattcaaaggcaacactccccactgctgcaagaaagatcccacgctcgtcgatttacttccgggcactccgtacaacatgcaaattgccaattgctgcaaagcaggagttataaatacatttaatcaggacccagcaaatgctgcttcctccttccagattagtgtaggtcttgctgggaccaccaataagactgttaaggtgccgaagaacttcactcttaagactccaggtcctgggtacacatgtgggcgtgccattgttggcaggccgacaaagtttttcacatcagatggacgcagggcaacccaagctctaatgacatggaatgtgacttgcacatattcccaatttctagcccagaagactccgtcctgctgtgtatctctctcatcattttacaatgacacaattgtgaactgcccaacatgctcttgtggctgccaaaatccaactggctcaaactgtgtgaatgaggattcaccgaatctacaatcagcaattgatggccctgggaaatggactggtcagcctcttgtacaatgcacctcccacatgtgcccgataagaatccactggcatgtgaagctcaattacaaggaatactggagagtgaaaataactatcaccaacttcaacttccgcatgaattacacgcaatggaacttagttgttcagcatccaaactttgataatatcactcagctgttcagtttcaactacaaaccacttaccccatatggtggtggcataaatgatacggcaatgttctggggtgtaaaattctacaatgatttgctgatgcaagctggtaaacttgggaatgtgcaatcagaactacttcttcgaaaggattctcaggctttcaccttcgaaaagggatgggccttcccacgtcgagtgtacttcaatggtgataactgtgtcatgccgtcccctgaaaattatccatggctgcccaatgcaagccctctaacaaaacaaccattgacactcccactctttgtattctgggttgtgttggctactctgttggcttatgcatgatgagtgggatcaagagatttagcgagcttcaagttgatgtcagattccatgaggtgcactgcaacaggccatttgttcattcaattccatggttgcacttcttaatgaaaaacgtgctcaggcacggtcgcg

SEQ ID NO: 30944 - protein, 449 aa, Panicum virgatum
  misc_feature: Ceres CLONE 1902642
  misc_feature (54)..(218): Pfam Name: Phytochel_synth Pfam Description: Phytochelatin synthetase-like conserved region
  misc_feature: Useful for making plants with altered carbohydrate content
  misc_feature: The sequence is a functional homolog of SEQ ID NO 4 in US patent 7109001
  misc_feature: Useful for making plants with altered cell wall content and/or composition
  misc_feature: Useful for making plants with altered lignin content
MAPGGRSVACCAAVLLAAALLLSAPTATEAYDSLDPNGNITIKWDIMQWTPDGYVAVVTMFNYQQFRHIGAPGWQLGWTWAKKEVIWSMVGAQTTEQGDCSKFKGNTPHCCKKDPTLVDLLPGTPYNMQIANCCKAGVINTFNQDPANAASSFQISVGLAGTTNKTVKVPKNFTLKTPGPGYTCGRAIVGRPTKFFTSDGRRATQALMTWNVTCTYSQFLAQKTPSCCVSLSSFYNDTIVNCPTCSCGCQNPTGSNCVNEDSPNLQSAIDGPGKWTGQPLVQCTSHMCPIRIHWHVKLNYKEYWRVKITITNFNFRMNYTQWNLVVQHPNFDNITQLFSFNYKPLTPYGGGINDTAMFWGVKFYNDLLMQAGKLGNVQSELLLRKDSQAFTFEKGWAFPRRVYFNGDNCVMPSPENYPWLPNASPLTKQPLTLPLFVFWVVLATLLAYA

SEQ ID NO: 30945 - DNA, 577 bp, Panicum virgatum
  misc_feature: Ceres CLONE 1902645
  misc_feature: Encodes the peptide sequence at SEQ ID NO. 30946
aaaacgacgccagcgacccgcagattctagcactaaccacctagccatggccacgcgaggcgcactgttcgctgggtttgcttaactccccactccccaccgcccccgatctcgccccccctcccactccggcactcccccccacattccccggtccgccacctctgcccgcggccgccgccgccgccgtccggagcgagatcggcgtgggtgcacgggcgcggctcctgtatctgtcggagggagaccccgcgtgtcggtgggagcgggtgggagaccaaacgaacgatggcgccgggcggcagatccgtcgcgtgctgcgccgccgtgctgctcgcggccgcgctgctcctctccgcgccgactgctacagaggcttatgattccttggatccgaacggcaacatcactataaaatgggatattatgcagtggactcctgatggatatgtcgctgttgtcacactgttcaactatcaacaattccggcacattgccgcacctgtgtggcagcttgggtggacatgggcaaagaaagaggtcatatggtcaatggttggggcacacactactgagc

SEQ ID NO: 30946 - protein, 96 aa, Panicum virgatum
  misc_feature: Ceres CLONE 1902645
  misc_feature: Useful for making plants with altered carbohydrate content
  misc_feature: The sequence is a functional homolog of SEQ ID NO 4 in US patent 7109001
  misc_feature: Useful for making plants with altered cell wall content and/or composition
  misc_feature: Useful for making plants with altered lignin content
MAPGGRSVACCAAVLLAAALLLSAPTATEAYDSLDPNGNITIKWDIMQWTPDGYVAVVTLFNYQQFRHIAAPVWQLGWTWAKKEVIWSMVGAHTTE

SEQ ID NO: 30947 - DNA, 635 bp, Panicum virgatum
  misc_feature: Ceres CLONE 1902651
  misc_feature: Encodes the peptide sequence at SEQ ID NO. 30948
aggcttctctcaccatcctaacataagaaaggtacggaaacactctatcgctcactcttgtgaacctgatcccagtggcacagccctagctagctcctgcctcggggtggtagctagctggccgagcaagagaggaggaggagaggaataagattcgatggcctctgctgctaccctgctcaagtcctccttccttcccaagaagtccaaatggggcgccagcaggcaggtcgcggcgcccatgccggtcaccgtgtcaatggtggtcgtccgcgccagcgcctacgcccatgagctcgtcaagactgcgaaaacggtggcgtcgcccgggcggggcatccttgccatggacgagacgaacgcgacgtgcgggaagcggctggcgtccatcaggctggagaacactgaggcgaaccggcacgcctaccggacgctgctggtgaccgcgccggggctgggccagtacatctccagcgccatcctcttcgaggagacgctctaccagtccgccgacgacagcgacaagatcgtctacatcctgtcagatcatgtcatcggccccgggatcaaagtcgacaagggcctcgtcccgctcgccggctcccacaactagtcgtggtgccggggccctcgac

SEQ ID NO: 30948 - protein, 151 aa, Panicum virgatum
  misc_feature: Ceres CLONE 1902651
  misc_feature (46)..(151): Pfam Name: Glycolytic Pfam Description: Fructose-bisphosphate aldolase class-I
  misc_feature: SWISSPROT Homolog: EC 4.1.2.13 Fructose-bisphosphate aldolase
  misc_feature: Useful for making plants with modulated biomass
  misc_feature: Useful for making plants with modulated phosphate use efficiency
MASAATLLKSSFLPKKSKWGASRQVAAPMPVTVSMVVVRASAYAHELVKTAKTVASPGRGILAMDETNATCGKRLASIRLENTEANRHAYRTLLVTAPGLGQYISSAILFEETLYQSADDSDKIVYILSDHVIGPGIKVDKGLVPLAGSHN

SEQ ID NO: 30949 - DNA, 710 bp, Panicum virgatum
  misc_feature: Ceres CLONE 1902656
  misc_feature: Encodes the peptide sequence at SEQ ID NO. 30950
attttcctcctccactcgcatcgcgacatcgcgtccacccgacggcacctcccctcgctctccgccctccgccgtctctgcccgccgcggcggcggctgctgctcccccggctgtcaccggacgcgcccccgttacagacaactatgaggagatacagccccccatatcgcagcccccccaggaggggatatggtggcagaggaagaagccccccacctaggaggggatatggaggacggaaggagggtactggaagtcttttagtccgcaatatcccattaagcgtcagagcggaggatcttcgagttccttttgaaaggtttggtcctgtccgggatgtttacattccaaaggactattatagtggggagcctcgaggatttgcatttgtggagtttgttgatccttatgatgcctcagaggcccagtatcacatgaatcgccaggttttctttggtcgggagataactgttgttcttgctgctgagtcacgaaaaaggccagatgaaatgcgcagcagagctagagtcaggggttactctggtcatgaaggccgacgctcttcttattatgggcggtctcgttcccgttcccgctctccacgctttcggggccgtcctcggtcaagatcatactcacctgctccaaggaggcgagatgattactccctttctccaggagaaaggaggcacatcacgcgtctcctcct

SEQ ID NO: 30950 - protein, 188 aa, Panicum virgatum
  misc_feature: Ceres CLONE 1902656
  misc_feature (39)..(110): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with altered terpenoid content
MRRYSPPYRSPPRRGYGGRGRSPPPRRGYGGRKEGTGSLLVRNIPLSVRAEDLRVPFERFGPVRDVYIPKDYYSGEPRGFAFVEFVDPYDASEAQYHMNRQVFFGREITVVLAAESRKRPDEMRSRARVRGYSGHEGRRSSYYGRSRSRSRSPRFRGRPRSRSYSPAPRRRDDYSLSPGERRHITRLL

SEQ ID NO: 30951 - DNA, 696 bp, Panicum virgatum
  misc_feature: Ceres CLONE 1902661
  misc_feature: Encodes the peptide sequence at SEQ ID NO. 30952
acccgagcagatctcatccccgcttccctcgcccacctccgaggctcggacctccccgccccagcatttcgccaccaacgaaggggagcgctctgtggccatggcctcgtcggctgctgcctcctctgcttccgcgctcctccgccttcagggcccggcccacctgcgcgcaccgccacgaagccggtggcgggaccacaggcggccccgccgcacgaccgcccggtgctcgttcgcgccggtggagacggcgaggataaaggtggtgggcgtcggaggcggcggcaacaacgccgtcaaccgcatgatcggcagcggcctccagggtattgaattttatgctataaacacggattcccaggctcttattacttcacaagcgcaatatcctctgcaaattggagagcagttgactcgtggactaggtactggtggaaatccaaatttgggagagcaagctgctgaggaatcaagagaagccatagccactgccctgaaggattcagatcttgtctttataacagctggaatgggagggggtactggatctggtgctgctccagttgttgcccagatatcagaggaagctggttatcttacggtcggtgttgtcacctatccattcagctttgaaggccgtaagcgctctctacaggcactagaagcactagtgaagctagaaaagagtgtagacac

SEQ ID NO: 30952 - protein, 198 aa, Panicum virgatum
  misc_feature: Ceres CLONE 1902661
  misc_feature (51)..(198): Pfam Name: Tubulin Pfam Description: Tubulin/FtsZ family, GTPase domain
MASSAAASSASALLRLQGPAHLRAPPRSRWRDHRRPRRTTARCSFAPVETARIKVVGVGGGGNNAVNRMIGSGLQGIEFYAINTDSQALITSQAQYPLQIGEQLTRGLGTGGNPNLGEQAAEESREAIATALKDSDLVFITAGMGGGTGSGAAPVVAQISEEAGYLTVGVVTYPFSFEGRKRSLQALEALVKLEKSVD

SEQ ID NO: 30953 - DNA, 649 bp, Panicum virgatum
  misc_feature: Ceres CLONE 1902661-R
aagttaatggtgagagaagataaaatatgaagaagccagggtctcgtgcaagaaatcatgtctacacgaaaaccaaagacaaaaggagagaggattggagaggaataggagagagaagagatatgattggatagcaatttattttgaagaaactatccattgaagatatagtttctatgagtagtgtctggccctgtcaatgttcttatggcgtcgcctaggcgacaaggcgctcccctattttggcccgcctaggcgtcgccttagcccgcctaggcggctaggcggtggtgactcgccacaactcgccttaacgccgtaagaacattaggccttaaggccggggaggaggtggccggccagcggccgcgggcaggggctgcaagggagcgggcccgaggcggcgctggggcagggtggcggccatggggaggaggaggtcgcaggccggggaggaggtgactggccggccgcggggaggaggtggacggccccggctgcggcggggacgggggcagcgcgaggaggggcggcgatggcggcgcctcggggacccggtggtggagagatgcttcgatgaggccggcggcgctacctgggaaggaggaagaagctgcggatggagataaggaggggagagaaagaaagg

SEQ ID NO: 30954 - DNA, 1900 bp, Panicum virgatum
  misc_feature: Ceres CLONE 1902716
  misc_feature: Encodes the peptide sequence at SEQ ID NO. 30955
cccccccaaacacagcagcagcagcacggccgtcgtcctccgtttcctcctctcctcgccgcagtgccgcacctgggggcagcccgcgagccattctctcctcctcgatccccctcgtcgcgggatcgccggatctctctcgcacaccgcggccggagaagaggaggagagaggcagtcttgttcatcggatcggcgcgcctgtgttgtctggtttcgatttccctttttttttcagggtcaataggatttgggggcggtcgccatgggattcgggatgggaaatgacggggcgagctcgtcgtcgtcgcggctggaccccgcgccgctcctgccgcaccacggcagcgcgggcggcgagatcggcctgtcgtcgcagcccaagacgttcgccaacgtcttcatcgcggtggtcggcgccggcgtgctggggctgccgtacaccttctcgcacaccgggtgggcggcggggtcgctgctgctcttcgccgtcgccgtgctcaccttctactgcatgatgctgctcgtggcctgccgccgccgcctcgccgacgagcgcccgaagatcgcctcgttcggggacctcggggacgccgtgttcggcgcgcacgggcggttcgccgtcgacgtcatgctggtgctcagccaagcgagcttctgcatcgggtacctcatcttcatctccaacaccatggcgcacctctacccgatattcgcgccgtcgtcctccgccctcctctcccccaaggcgctcttcatctgggcgatgctgccgttccagctcgggctcaattccattaagacgctcacgctgctcgcgccgctcagcatcttcgccgacgtcgtcgacctcggcgccatgggggttgtccttggccaggacgtcgccgcctggctcgccatgcccccacccgtggtcgcgttcggcggcccggccgcgctcctctacgggctcggcgtctccgtgtacgcgttcgagggagtcggcatggtgctgccgctggaggcggaggcggcgaacaagaggaagttcggcgtcacgctcgggctgtccatggcgttcatcgccgtcatgtacgggctgttcggcgtgatggggtacgtcgcgttcggcgacgccacgcgggacatcatcaccaccaacctcggcgccgggtggctgtcggccgccgtgcagctggggctctgcatcaacctcttcttcacgatgccagtgatgatgaaccccgtgtacgaggtcgccgagcgcctgctccacggcaagcgctactgctggtggctccgctggctgctcgtcgtcgtcgtcgggctcgccgccatgtacgtgcccaacttcaccgacttcctggcgctcgtcggaagcagcgtctgcgtcctcctcgggttcgtgctgccggcctcgttccacctcaaggtgttcggcgccgagatggcctggcccggggtgctctccgacgccctcctggtcgtgctcggcctcgcgctcgccgtgttcgggacgtacacgtcgctgctgcaaatcttccactcgtccagcgcttgatctccccaccatggcaccatttgctatgtgccgagtaaattcatactctggcggattagtttcaggtgttggtcgcgcctctgttcagagaagtggaacaggggaggaacggccgcccgtctcaggtgatttgggcgtggatttgcatcagtcgtcgcgttcttccagggcagattacgtttcagatgttgttcgtgattgggttgtatagcatggtaactagatctgtctgcttttgccttggcagatttcagttactccaggtagcaatgtactacgaatgtttgcgtcctagatgaccctcctgctgtgcatgatggattcgatgaaagggcaacatttttaggtcgtggaagct

SEQ ID NO: 30955 - protein, 425 aa, Panicum virgatum
  misc_feature: Ceres CLONE 1902716
  misc_feature (34)..(417): Pfam Name: Aa_trans Pfam Description: Transmembrane amino acid transporter protein
  misc_feature: Useful for making plants with modulated nitrogen use efficiency
MGFGMGNDGASSSSSRLDPAPLLPHHGSAGGEIGLSSQPKTFANVFIAVVGAGVLGLPYTFSHTGWAAGSLLLFAVAVLTFYCMMLLVACRRRLADERPKIASFGDLGDAVFGAHGRFAVDVMLVLSQASFCIGYLIFISNTMAHLYPIFAPSSSALLSPKALFIWAMLPFQLGLNSIKTLTLLAPLSIFADVVDLGAMGVVLGQDVAAWLAMPPPVVAFGGPAALLYGLGVSVYAFEGVGMVLPLEAEAANKRKFGVTLGLSMAFIAVMYGLFGVMGYVAFGDATRDIITTNLGAGWLSAAVQLGLCINLFFTMPVMMNPVYEVAERLLHGKRYCWWLRWLLVVVVGLAAMYVPNFTDFLALVGSSVCVLLGFVLPASFHLKVFGAEMAWPGVLSDALLVVLGLALAVFGTYTSLLQIFHSSSA

SEQ ID NO: 30956 - DNA, 589 bp, Panicum virgatum
  misc_feature: Ceres CLONE 1902725
  misc_feature: Encodes the peptide sequence at SEQ ID NO. 30957
atccgcaaacgcaagcttcacgcacagcctctctccccgcagcttctccgccgggcttcacctgcgaacccgcctcgatcgatcagcgttcctcgcggagcaggcagatggccgccacgatgaagctccggatcctcgccgtcgccgccgcgtcgtgcctggtcgcgaccgccgccgcgggcgagggcccggcgcccgccccgacgtccggcgcgccttccatggccgcgccggccgttgccgccgcgtccctgaccgcgctcgtcttcggctacctcttctaagaagtgccatggacggcgttgcctgtagtgcccaatcgttttcctgctcagagatttcttcttctcgttgctgtctttgctcgtgttggtgtggatgatgggtatgtaattaactgttcttttttttatatgaatcatgaaatctcagtacaacgacatagtaaatctagagagctgcagcttggttcaaatcagttacaagcctacgccaaccagcccaccgaccggccggtacccgaggccgctgcatagaatatccagggccgccacgaccggaccggccaccaagctagagaggacgaggc

SEQ ID NO: 30957 - protein, 58 aa, Panicum virgatum
  misc_feature: Ceres CLONE 1902725
  misc_feature: Useful for making plants with altered carbohydrate content
  misc_feature: Useful for making plants with altered cell wall content and/or composition
MAATMKLRILAVAAASCLVATAAAGEGPAPAPTSGAPSMAAPAVAAASLTALVFGYLF

SEQ ID NO: 30958 - DNA, 732 bp, Panicum virgatum
  misc_feature: Ceres CLONE 1902728
  misc_feature: Encodes the peptide sequence at SEQ ID NO. 30959
gttccagccttccaggaatcgcacggtctctctcctcgtcctcctctcttctcgctcgctcccagtcccagcagctaatacagcggtggctgctgctgctgctgctgccatggcggaggcgaggcggctgctgtggctggcggcggtggcgtgctgggcggcagcgggggcgcgggccgacccgcaggtgccgtgctacttcatcttcggcgactcgctcgtggacaacggcaacaacaactacatcgtgtcgctgacgcgcgccaactacccgccctacggcatcgacttcgccggcgggccctcgggccgcttcaccaacgggctcaccaccgtcgacgtcatcgctcaactgctgggtttcgactacttcatcccgccgttcgcggcgacgagcggcgacaagctcctcggcggcgccaacttcgcgtccgccgcggcggggatccgcgccgagaccgggcagcagctgggcgggcggatcccgttcgcggggcaggtgcagaactaccagacggcggtggcgacgctggtgagcatcctgggcgaccaggacacggcgtcggagcacctgagccgctgcatcttcagcatcggcatgggcagcaacgactacctcaacaactacttcatgccggccttctacaacacgggcagccgcttcacgccggagcagttcgccgacgcgctcatcgccgactaccgccggtacctgcaggtgctctacagcta

SEQ ID NO: 30959 - protein, 207 aa, Panicum virgatum
  misc_feature: Ceres CLONE 1902728
  misc_feature (30)..(205): Pfam Name: Lipase_GDSL Pfam Description: GDSL-like Lipase/Acylhydrolase
  misc_feature: SWISSPROT Homolog: EC 3.2.1.51 Alpha-L-fucosidase
  misc_feature: Useful for making plants with modulated phosphate use efficiency
MAEARRLLWLAAVACWAAAGARADPQVPCYFIFGDSLVDNGNNNYIVSLTRANYPPYGIDFAGGPSGRFTNGLTTVDVIAQLLGFDYFIPPFAATSGDKLLGGANFASAAAGIRAETGQQLGGRIPFAGQVQNYQTAVATLVSILGDQDTASEHLSRCIFSIGMGSNDYLNNYFMPAFYNTGSRFTPEQFADALIADYRRYLQVLYS

SEQ ID NO: 30960 - DNA, 672 bp, Panicum virgatum
  misc_feature: Ceres CLONE 1902732
  misc_feature: Encodes the peptide sequence at SEQ ID NO. 30961
atcatccgccggcccaccacctccgcctccgcctcctccgcccctccgccgcatcgttcctgccccagccccggccccgcaaaccctaaccctaatggccgcctacgtcgggaccaccagctccttcccatacctagtcgccggttcctccccggcgaccctccgccatggggccgcacaacggatccgcgcctcggcattggggacgacaggggacgcggcgatggacgtggtgtcggaggcggagctgcgggagaaggggttcatggggatgcggaagacgaagctggtttgcacggtggggcccgcctgcgtggaggcgctgccggcgctggcgcgcggcgggatgggcgtggcgcgggtcaacctctgccacggcggccgcgagtggcaccgggccgccatgcgcgccgtgcggaggctcaacgacgaggaagggttctgcgtctcgctcatggtcgacaccgagggctcccagcttctcgtcgcggaccacggaggcgccacctccgtcaaggccgaggatgactcagagtggctatttacaaacaaaaagactgatgaagcccatccattcacaatgcatgtcaattttgagaagttttctgatggcattctagttggtgatgagcttgtgatagacggtggaatggcaacatttgaagttactga

SEQ ID NO: 30961 - protein, 192 aa, Panicum virgatum
  misc_feature: Ceres CLONE 1902732
  misc_feature: SWISSPROT Homolog: EC 2.7.1.40 Pyruvate kinase
MAAYVGTTSSFPYLVAGSSPATLRHGAAQRIRASALGTTGDAAMDVVSEAELREKGFMGMRKTKLVCTVGPACVEALPALARGGMGVARVNLCHGGREWHRAAMRAVRRLNDEEGFCVSLMVDTEGSQLLVADHGGATSVKAEDDSEWLFTNKKTDEAHPFTMHVNFEKFSDGILVGDELVIDGGMATFEVT

SEQ ID NO: 30962 - DNA, 308 bp, Panicum virgatum
  misc_feature: Ceres CLONE 1902732-R
aggagtcccattgatgttatgctccatctgcataattttgattgttggatcgtcgactcatggagtacaatagcctttatttgcctgcctgagagagtacctgtgattatgcttcagcggcgattatgcacctgggattcattagtctcaaattattatttttttcctttcaagactgccgacgaaaggttcatcttttacttttgattattagccaatttgagtttatgtactcacgaacgtcgcaacagctgcaacatttcacccatttttgaacatttcggttgatttgtactgtgcaagttgtg

SEQ ID NO: 30963 - DNA, 738 bp, Panicum virgatum
  misc_feature: Ceres CLONE 1902736
  misc_feature: Encodes the peptide sequence at SEQ ID NO. 30964
gttaactcagtacttaatctggcgccagctaatagtaagctgatcgatggggaggcagccctgctgtgacaagcagggggtgaagagggggccgtggacagcagaggaggacaagaagctcatcagtttcatcctgacacatggccgatgctgctggcgagcagtgcctaaactggcagggctgctgcgctgcggaaagagctgccggttgcggtggactaactacctctgccctgatctcaagcgtggcctcctcagcactgcggaggagcagctcgtcattgatctccatgccaagctcggcaatagatggtccaagattgctgccaagttacctgggagaacagacaacaagatcaagaaccactggaacacacacattaagaagaagctcatcaagatgggcatcgacccagccacgcaccagcctctggccaactgcaaggcgtctacttcacaatccactgatacagctgaatcgacaaaatccagtgacaccagagacgagcagggcgtgaaggaaggtagacgtagggacatggcactgcccattgactcgtcggagcagtccaactggcttgagtcaggaaacaaagccagtggtcaggaccatgaacagctggtgaattggctgtcagagacggacctgcccatggatgagccgtggctgaattttacgagcaccaacgatgatgcgctttgcaccgtggaggagccatgccttgggacggagcacag

SEQ ID NO: 30964 - protein, 230 aa, Panicum virgatum
  misc_feature: Ceres CLONE 1902736
  misc_feature (14)..(61): Pfam Name: Myb_DNA-binding Pfam Description: Myb-like DNA-binding domain
  misc_feature (67)..(112): Pfam Name: Myb_DNA-binding Pfam Description: Myb-like DNA-binding domain
  misc_feature: Useful for making plants with altered carbohydrate content
  misc_feature: Useful for making plants with altered alkaloid content
  misc_feature: Useful for making plants with modulated nitrogen use efficiency
  misc_feature: Useful for making plants with altered cell wall content and/or composition
  misc_feature: The sequence is a functional homolog of SEQ ID NO 442 in the 10/412,699 US patent application
  misc_feature: The sequence is a functional homolog of SEQ ID NO 1118 in the 10/225,066 US patent application
  misc_feature: The sequence is a functional homolog of SEQ ID NO 1396 in the 11/479,226 US patent application
  misc_feature: The sequence is a functional homolog of SEQ ID NO 2488 in the 10/374,780 US patent application
  misc_feature: The sequence is a functional homolog of SEQ ID NO 658 in the 10/412,699 US patent application
  misc_feature: The sequence is a functional homolog of SEQ ID NO 836 in the 10/412,699 US patent application
  misc_feature: The sequence is a functional homolog of SEQ ID NO 112 in the 10/412,699 US patent application
  misc_feature: The sequence is a functional homolog of SEQ ID NO 267 in the 11/479,226 US patent application
  misc_feature: Useful for making plants with altered lignin content
  misc_feature: The sequence is a functional homolog of SEQ ID NO 1660 in the 11/479,226 US patent application
  misc_feature: The sequence is a functional homolog of SEQ ID NO 840 in the 10/412,699 US patent application
  misc_feature: The sequence is a functional homolog of SEQ ID NO 271 in the 11/479,226 US patent application
  misc_feature: The sequence is a functional homolog of SEQ ID NO 1041 in the 11/479,226 US patent application
  misc_feature: The sequence is a functional homolog of SEQ ID NO 112 in the 10/225,066 US patent application
  misc_feature: The sequence is a functional homolog of SEQ ID NO 20 in the 11/375,241 US patent application
  misc_feature: The sequence is a functional homolog of SEQ ID NO 2052 in the 10/374,780 US patent application
  misc_feature: The sequence is a functional homolog of SEQ ID NO 450 in the 10/412,699 US patent application
  misc_feature: The sequence is a functional homolog of SEQ ID NO 263 in the 11/479,226 US patent application
  misc_feature: The sequence is a functional homolog of SEQ ID NO 478 in the 11/435,388 US patent application
  misc_feature: The sequence is a functional homolog of SEQ ID NO 54 in the 10/666,642 US patent application
  misc_feature: The sequence is a functional homolog of SEQ ID NO 126 in the 10/412,699 US patent application
MGRQPCCDKQGVKRGPWTAEEDKKLISFILTHGRCCWRAVPKLAGLLRCGKSCRLRWTNYLCPDLKRGLLSTAEEQLVIDLHAKLGNRWSKIAAKLPGRTDNKIKNHWNTHIKKKLIKMGIDPATHQPLANCKASTSQSTDTAESTKSSDTRDEQGVKEGRRRDMALPIDSSEQSNWLESGNKASGQDHEQLVNWLSETDLPMDEPWLNFTSTNDDALCTVEEPCLGTEH

SEQ ID NO: 30965 - DNA, 461 bp, Panicum virgatum
  misc_feature: Ceres CLONE 1902761
  misc_feature: Encodes the peptide sequence at SEQ ID NO. 30966
ctagagacacccagcgccgcagcccgcagccactccacctcccgagcccccaggcggccaggcaccaggtgcggcggcggcggcggcggcaagatggcggtgggcaagaacaagcggatcagcaaagggaagaagggcggcaagaagaagaccgtccatccattcgcgaagaaggattggtatgatatcaaggcgccctctatcttctccgtgcgcaacattggaaagacactcgtgtccaggacacagggtactaagattgcttctgagggtctgaagcaccgtgtcttcgaggtctccctagctgatcttcagagtgatgaagaccaaccccaccccacacaaaagctccctgctgaatacgtccagggtcgtaatgtccttaccaacttctggggaatggattttacaacagacaagctccggtcgcttgtcaggaagtggcagactttgattgacgc

SEQ ID NO: 30966 - protein, 122 aa, Panicum virgatum
  misc_feature: Ceres CLONE 1902761
  misc_feature (11)..(122): Pfam Name: Ribosomal_S3Ae Pfam Description: Ribosomal S3Ae family
MAVGKNKRISKGKKGGKKKTVHPFAKKDWYDIKAPSIFSVRNIGKTLVSRTQGTKIASEGLKHRVFEVSLADLQSDEDQPHPTQKLPAEYVQGRNVLTNFWGMDFTTDKLRSLVRKWQTLID

SEQ ID NO: 30967 - DNA, 741 bp, Panicum virgatum
  misc_feature: Ceres CLONE 1902774
  misc_feature: Encodes the peptide sequence at SEQ ID NO. 30968
attcctcccattagcgccgccactcccagacacatagcccgagccctctcctcctccccttcgggccaccaccaaacccttgcatacccatccaccatggcggcggcggcaggcggaggcgcgccgcgggcgttgtcccagaaggagcaggacatccagatgatgctcgccgccgacgtccaactgggcaccaagaactgcgacttccagatggagcgctacgtcttcaagcgccgcactgacggcatctacatcatcaaccttggcaagacatgggagaagctccagctggcggcgagggtaatcgttgccattgagaaccctcaggacatcattgtccagtccgcccgcccctacggccagcgcgccgtcctcaagttcgcgcagtacactggtgcccatgctattgccgggaggcacacccctggaaccttcaccaatcagctgcagacgtccttcagtgagcctcggctgctcatccttaccgacccaaggactgaccaccagccgatcaaggagtctgctctggggaacatccccaccattgccttctgtgatactgactcccccatgcggtatgtcgatatcggcatcccagccaacaacaagggaaggaacagcattggatgcctgttctggctcttggcaaggatggttctgcagatgaggggcactatcctccctgggcacaagtgggaagtcatggttgattttgtcttctacagagaccctgaggaagca

SEQ ID NO: 30968 - protein, 214 aa, Panicum virgatum
  misc_feature: Ceres CLONE 1902774
  misc_feature (23)..(191): Pfam Name: Ribosomal_S2 Pfam Description: Ribosomal protein S2
MAAAAGGGAPRALSQKEQDIQMMLAADVQLGTKNCDFQMERYVFKRRTDGIYIINLGKTWEKLQLAARVIVAIENPQDIIVQSARPYGQRAVLKFAQYTGAHAIAGRHTPGTFTNQLQTSFSEPRLLILTDPRTDHQPIKESALGNIPTIAFCDTDSPMRYVDIGIPANNKGRNSIGCLFWLLARMVLQMRGTILPGHKWEVMVDFVFYRDPEE

SEQ ID NO: 30969 - DNA, 1703 bp, Panicum virgatum
  misc_feature: Ceres CLONE 1902786
  misc_feature: Encodes the peptide sequence at SEQ ID NO. 30970
tcgtttggttccttaaacctcacctttcccttctctcgaactccctcctccctgctcttccttccctggcggcgacgaccgggcgagcagcggcgccatttgtcctgtcttcgtccagccctgccggcgacgactgggcgagcggcggcgccatttctcctttcttcgcccagccctttgccggcgacgagcgcatcctccaggaccatcatgcctgctggtgataacccacactcaatctcagagaaaaaggcagcattgcgggactctccaaaacagagtaagattgttgttaacgagcaacccagggcttccttttctgaagataaagttgctgctacagttagcctcaagagaccacaaccttatggccccctaagtcccaccaaccaccacacgttgggcaatccaggggcaaatggccatcttgtgtacgtgcgcaggaggcctgacactgatcaaagcaaaggaggcacttctactcgtgctggaagtgtcagttctatgagcacaaagaaacctattgcaggcggattgcagtcacaggaacaaagtctgaagcgtcaggacaatgtagctcacacccagttcgctcctcgattttcatctcctgctgcagttactgcctcccctgttttgcaatccacagttttgccttctcgacgttcttttgagaagcaatctcctgggaaggttgctgttcagccaactaatgatgtgattactagtttgccacaaagcaacgtggcatcagctactccagtgtttcaaagtgctgcaacagctaatttggcgactagcagtgttttggctactagtgtagaagctaccctagcacctgatcgagctgatcaaccgagatcaagcaatcaagattggagtgatagatttattcagctgcaggcattcttgaggaataatgaacaatcaggcaaggaagaatatatccgcagtaagcaatctccaggaaagattgctgctcaaccaactaaggatgtgacgactagtccgccacctcgcaatttgatgttctctactccagtgcttcaaagctctttggctgctaatttagcacctagtggtgtttcagctactaacacagcatccccagctgctatatctgctgctaatttagtatctagcagcatttcgcctactcatacagcatctactgatgctatatctactacaactcaagcacctaatagagctcatccaccaagatcaagcaatcaagatccaagtgatagatttcttcggctgcaagcattcttgagaaataatgagcagtcggggcaggaagaatatatccgcatgcttcggtctttgtcatctgttggacgaagtaagcatgccattgaactggagaaacgggcagccaatctattgatcgaggaagggaaggagctgcagaagacgaaagttctgaatgtactgggcaagctttcgcccactgacgctccacgatttccagctcagcctgctactgtcaagcatctgccattcccagctcatcgatgaagggagtgggagatttgcttatgttgccgcataaataggcattcgccataaataggcattcggtgatttctgaactcttgccacttgaatgccgtgctatggtcataattgccgtgttgtctgtgagaacaagccttatatctcaattcagatgagttaagagtagattgactgacgtgcct

SEQ ID NO: 30970 - protein, 436 aa, Panicum virgatum
  misc_feature: Ceres CLONE 1902786
  misc_feature: SWISSPROT Homolog: EC 3.2.1.14 Chitinase
MPAGDNPHSISEKKAALRDSPKQSKIVVNEQPRASFSEDKVAATVSLKRPQPYGPLSPTNHHTLGNPGANGHLVYVRRRPDTDQSKGGTSTRAGSVSSMSTKKPIAGGLQSQEQSLKRQDNVAHTQFAPRFSSPAAVTASPVLQSTVLPSRRSFEKQSPGKVAVQPTNDVITSLPQSNVASATPVFQSAATANLATSSVLATSVEATLAPDRADQPRSSNQDWSDRFIQLQAFLRNNEQSGKEEYIRSKQSPGKIAAQPTKDVTTSPPPRNLMFSTPVLQSSLAANLAPSGVSATNTASPAAISAANLVSSSISPTHTASTDAISTTTQAPNRAHPPRSSNQDPSDRFLRLQAFLRNNEQSGQEEYIRMLRSLSSVGRSKHAIELEKRAANLLIEEGKELQKTKVLNVLGKLSPTDAPRFPAQPATVKHLPFPAHR

SEQ ID NO: 30971 - DNA, 325 bp, Panicum virgatum
  misc_feature: Ceres CLONE 1902796
  misc_feature: Encodes the peptide sequence at SEQ ID NO. 30972
agcaaacagccttttgtcgttgcaaaaatatagtgtagcggcggcacacacgatggcacgtacaacaattgtgttgagcctcatccttggcttgctggctgctgccaatgccgtgccctttgatttctattaccttatcctcatgtggcctggagcgtactgcgaggacagcgacaacggctgctgcgtgcccaagtacggctacccggcggaggatttcttcgtcgagagcttccagaccttccacctgtccatcaacaatcccatcggcaggtgcaacaaccgcaaacccctccaaccctaccaagctgaacaaaatcaaaaa

SEQ ID NO: 30972 - protein, 90 aa, Panicum virgatum
  misc_feature: Ceres CLONE 1902796
  misc_feature: SWISSPROT Homolog: EC 3.1.27.1 Ribonuclease T(2)
MARTTIVLSLILGLLAAANAVPFDFYYLILMWPGAYCEDSDNGCCVPKYGYPAEDFFVESFQTFHLSINNPIGRCNNRKPLQPYQAEQNQ

SEQ ID NO: 30973 - DNA, 636 bp, Panicum virgatum
  misc_feature: Ceres CLONE 1902840
  misc_feature: Encodes the peptide sequence at SEQ ID NO. 30974
aactcgtctccctcccctcgccaaatcctccttgtcctctgcaatcgccaggcccgccgcgcaggcagactggactgactggtcactggtaggtggtagctcgatcgatcggatcatcggaggcaggtaggcatggcgtccgggaagcacttcaagtacgtcatcctcggcggcggcgtcgcggcggggtacgcggcccgggagttcgccaagcagggagttcagccaggggagctcgccatcatctcccaggaggcggtggctccgtacgagcgtcctgccctcagcaaaggttacctcttccctcagaatgctgcaaggctcccaggatttcatgtgtgtgtcggaagtggtggagaaaggctattgcctgaatggtactcggagaaaggtattgagctgatcctcagcactgaaattgtgaaagctgatctttccaccaagactctgactagtgcagctggagcaacctttacatatgacatcctgctcattgcaactggatcctcggtcatcaagctcactgattttggcacacaaggagctgattctaacaacattctatatctaagggaaattgatgatgctgacaagctggttgcagctatccaggcaaagaagggtgggaaggcagtg

SEQ ID NO: 30974 - protein, 167 aa, Panicum virgatum
  misc_feature: Ceres CLONE 1902840
  misc_feature (8)..(166): Pfam Name: Pyr_redox_2 Pfam Description: Pyridine nucleotide-disulphide oxidoreductase
  misc_feature: SWISSPROT Homolog: EC 1.6.5.4 Monodehydroascorbate reductase (NADH)
MASGKHFKYVILGGGVAAGYAAREFAKQGVQPGELAIISQEAVAPYERPALSKGYLFPQNAARLPGFHVCVGSGGERLLPEWYSEKGIELILSTEIVKADLSTKTLTSAAGATFTYDILLIATGSSVIKLTDFGTQGADSNNILYLREIDDADKLVAAIQAKKGGKA

SEQ ID NO: 30975 - DNA, 745 bp, Panicum virgatum
  misc_feature: Ceres CLONE 1902845
  misc_feature: Encodes the peptide sequence at SEQ ID NO. 30976
  misc_feature (642)..(642): n is a, c, t, g, unknown, or other
agcaaatgctctcgagccctctctaaaatccatacccgccatcgcagattcgctgcgcagcacagcaaatcagcagaggcggcttcgccctgcccctgcccgacgccttggtgccgcacgccatggccggcaccaagagcaggtcgaccggctcgcctctgctcggcaagtacgagctcggcggcctcctgggccgcggcaccttcgccaaggtctaccacgcgcgctgccttgcggggggcgaccccgtggccgtcaaggtgctcgacaagcccgggctggccgccacgggcatggcggcgcgcgtcctgcgcgaggtctccgccatgcgccgcctccgccaccccaacgtgctccgcctccacgaggtgctcgccacgcgctccaacgtgtacctcgtcatggagctcgcccccggcggggacctcctgtcccgcctcgccgccctgcccgcgcgccggctccccgagcacgccgcgcgccgcgtcttcctgcagctcgtgtccgcgctcatctacagccacgcgcgcggggtcttccaccgcgacgtcaagccgcagaacgtgctcctcgacgccgacggcaacctcaaggtctccgacttcggcctcgccgcgctcccggactcgctccgcgacgacngccgcctgcacaccgcctgcggcaccccggccttcgccgcacccgaggtgctccgtcgcaggggctacgacggcgccaaggccgatgcctggtcctgcggcgt

SEQ ID NO: 30976 - protein, 207 aa, Panicum virgatum
  misc_feature: Ceres CLONE 1902845
  misc_feature (17)..(207): Pfam Name: Pkinase Pfam Description: Protein kinase domain
  misc_feature: SWISSPROT Homolog: EC 2.7.11.1 Non-specific serine/threonine protein kinase
  misc_feature: Useful for making plants with modulated biomass
  misc_feature: Useful for making plants with modulated salt sensitivity
  misc_feature (174)..(174): Xaa is any aa, unknown, or other
MAGTKSRSTGSPLLGKYELGGLLGRGTFAKVYHARCLAGGDPVAVKVLDKPGLAATGMAARVLREVSAMRRLRHPNVLRLHEVLATRSNVYLVMELAPGGDLLSRLAALPARRLPEHAARRVFLQLVSALIYSHARGVFHRDVKPQNVLLDADGNLKVSDFGLAALPDSLRDDXRLHTACGTPAFAAPEVLRRRGYDGAKADAWSCG

SEQ ID NO: 30977 - DNA, 1897 bp, Panicum virgatum
  misc_feature: Ceres CLONE 1902864
  misc_feature: Encodes the peptide sequence at SEQ ID NO. 30978
aactctgccctctctctctctctctctctctctctctcttccttctcggctcgccgttctcgctccggagctgcctcggcgcgtcgcggagagggagagcacagcgcgccacctacctccctctcgtccattcccggatccaaactgcgtaaatatcaggcttttgcatctgattgggcgctgtacctgcgcgagaaagatagtttggttgcacagacaaaaaggggagtatttttcagagtttaaaataggggaatatctgttttgagaactgaagtgggagaaaggcaggaagctttaccagcggcagtgttttggtcaatggacccgcaggtgaccttccatggcgactgggtgtcggccgtggcgccgctgatgaagctgctgtgcctgacggtcatcggcctgctcctcgccaacccgcgggtccaggtcgtgcccagggccaccttcaagctcctgagcaagctcgtcttcgcgctcctcctcccctgcctgatcttcgtccacctcggcaagtcagtcaccattcataacgtcctgcgctggtggttcatcccggtcaacgtgctcatcagcactgtgatcgggtgctttcttgggtacatagtggccctgatctgccgcccgccgccacacttgttccggttcacggtgatcatgactgggtttggtaacacagggaatctcccaattgcgattattggatccgtctgccataccagcgatcacccgtttggtcctgcatgtgacaccaagggcatcgcttatgtctcatttgcacagtgggttgcagttattcttgtctacactttggtctaccacatgatggagccacctatgcagttctatgagattgttggtgagggtaatgagatacaggaaaaacctgagcagattagcaactacagcaggtctctacttcatgaggctgaatggccagggatggttgataaagtaacagagcactcaaagacaccgttcatcgccagagttttcatgagcatttcaggttcctcgcagaacacgtttcctgatattgattttactgaagagggaacttctggtgctgggccgagcagtcctaagtcgctcagatgtttggcagagccaagagtggtcagaaggatcagggttgtagctgaaaagactccaattcagcacgtccttcagccaccgacaattgcctctttacttgccattatcatcggcatggttcctgtcttgaaaaattttgtttttggggttgatgcaccactctcgttcttcactgatagtttggatatcctagctgctgcagttgttccctcagtgatgttaattctaggaggcatgcttgcggaaggcccaaaggataatgccttgggcatcaggactatcgtcggtataattgtggcaaggcttttggtgctcccatgcattggcattggtgttgtgacgctagcagacaaattgaatctacttgttgagcaagaccgtatgtaccgctttgttctttcgcttcagtactccatgcctagcgctatcctgcttggagcaattgccagcctcagaggatatggtgttaaggaagcatctgctcttctgttctggcagcatatttgtgcagtgttctctctttctctctacctgatcgtatacttcaagttgatgtctttcatttgaagtcaatggccatccatcctaatctggcatatatatagcaaccatcttgggggcaattatggcttggaaaaggagtactagaagatttttttttccagccttgtctcgtatcagtgaaaagtgtttatagtttggtagttatctatatttcaattacatgtattatttgagaacaggatatacatttattgtctgttcattttggtcaatatattgctgtgagtttcatgat

SEQ ID NO: 30978 - protein, 447 aa, Panicum virgatum
  misc_feature: Ceres CLONE 1902864
  misc_feature (13)..(437): Pfam Name: Mem_trans Pfam Description: Membrane transport protein
MDPQVTFHGDWVSAVAPLMKLLCLTVIGLLLANPRVQVVPRATFKLLSKLVFALLLPCLIFVHLGKSVTIHNVLRWWFIPVNVLISTVIGCFLGYIVALICRPPPHLFRFTVIMTGFGNTGNLPIAIIGSVCHTSDHPFGPACDTKGIAYVSFAQWVAVILVYTLVYHMMEPPMQFYEIVGEGNEIQEKPEQISNYSRSLLHEAEWPGMVDKVTEHSKTPFIARVFMSISGSSQNTFPDIDFTEEGTSGAGPSSPKSLRCLAEPRVVRRIRVVAEKTPIQHVLQPPTIASLLAIIIGMVPVLKNFVFGVDAPLSFFTDSLDILAAAVVPSVMLILGGMLAEGPKDNALGIRTIVGIIVARLLVLPCIGIGVVTLADKLNLLVEQDRMYRFVLSLQYSMPSAILLGAIASLRGYGVKEASALLFWQHICAVFSLSLYLIVYFKLMSFI

SEQ ID NO: 30979 - DNA, 694 bp, Panicum virgatum
  misc_feature: Ceres CLONE 1902876
  misc_feature: Encodes the peptide sequence at SEQ ID NO. 30980
acagccgccgccgccgccgcatctcccaccctccgcgcctccgtcgccgccgcttcctcagccatgggtaaggtgcacggatcgctggcccgtgccgggaaggtccggggccagacgcccaaggtggcgaagcaggacaagaagaagaagccccgcggccgcgcgcacaagaggatgcagtacaaccgccgattcgtcaccgccgtcgtcggcttcggcaagaagcgcgggcccaactcatccgagaagtaagcgccgcgccgcgcagccgccggctcgacccgccccggttcctctattccgttctcagtatgcttatgctcttgtcggtagtagtttcgttgtgcaagcaaaggaagaaccttttgtagtttcagtttcgttgttcgtgtgatgagatgggaacttgagatggtatctgtaccccgtttaagattttgagatatgatgatatgatcccataactttatggtgctgcgcgttttggtatgtgccactccgccttgtcatgtttctttatgaatcatcaatttaattctatatgctgttagttttgtaaaaaaaaaaaaaaattgttctctctcccccacctcgcccacacccacacgaacccggagccctcgcccgcccaactgaagcctcagatctccgtcccctgcgccgccgcttcgttcgtgtggaggcgagaggagag

SEQ ID NO: 30980 - protein, 62 aa, Panicum virgatum
  misc_feature: Ceres CLONE 1902876
  misc_feature (3)..(61): Pfam Name: Ribosomal_S30 Pfam Description: Ribosomal protein S30
MGKVHGSLARAGKVRGQTPKVAKQDKKKKPRGRAHKRMQYNRRFVTAVVGFGKKRGPNSSEK

SEQ ID NO: 30981 - DNA, 381 bp, Panicum virgatum
  misc_feature: Ceres CLONE 1902902
  misc_feature: Encodes the peptide sequence at SEQ ID NO. 30982
gggggcaggtctcttcctccctggcagctagctagagcgccaccatgcagctcgcggagctctgcaccgaccccgtcgtgctctcctgcgccctcctctgcctcctcctccacctcgcgctccgctcctcctccggccgcggcggcggccgccgcctcccgccggggcctcctggcctcccgatcctcggcgcgctcccgctcgtcggcccggccccgcacgccgggctcgccgcgctggcgcgccggtacggccctatcatgtacctgaagatgggcccggccggcgtggtggtggcggcgtcccccaccgtggcgaacacgttcctcgtcgaggtcgacacgaggtacaccaaccgccccgacgtggtcaccgccgcgc

SEQ ID NO: 30982 - protein, 112 aa, Panicum virgatum
  misc_feature: Ceres CLONE 1902902
  misc_feature: SWISSPROT Homolog: EC 1.14.13.88 Flavonoid 3',5'-hydroxylase
MQLAELCTDPVVLSCALLCLLLHLALRSSSGRGGGRRLPPGPPGLPILGALPLVGPAPHAGLAALARRYGPIMYLKMGPAGVVVAASPTVANTFLVEVDTRYTNRPDVVTAA

SEQ ID NO: 30983 - DNA, 770 bp, Panicum virgatum
  misc_feature: Ceres CLONE 1902926
  misc_feature: Encodes the peptide sequence at SEQ ID NO. 30984
agaaccgcgtgtttggccaaaacccacgggaagcgcttgtctttgctgagctgctcgcgcgcggagctctggctacttgacttcgggtttgttcccccatctgaagccaagattcggagcgtcgccgagggaaggcgatgaaggggaagagcggcgcgatggaccggaggtcctccaccaggtggaggatgctggtgctctgcgcattcagcttcggcctcggcatgctcttcacggaccggttctggacagcaccagataccaacaaccatatcatgtctcaacgccggaggcaagatcaagagctgcagctcgtatcagaggattgcaatacaaagaggcgtggggaagacaaagatataatgggagaggtaaccaagacccatgaagctatacaatcattggataagtccatctcaactctgcagatggagcttgcagcaaagaggagcacactggagctgctccgttctagtggttcgccagtaacctctgaaactagccaaccaaggaaaaaggcatttgttgtcattggtgtcaacaccgctttcagcagccggaaacgccgtgattcagtgcgggagacatggatgcctcaaggtgaaaagctgcaacaattagaggaacagaagggaatagttatccgcttcactattgggcacagtgctacatccaatagtatactggacaaggctatagactcagaggatgccccacaccatgactttcttagactgaatcatggtggagggatatcatgaactatcagc

SEQ ID NO: 30984 - protein, 207 aa, Panicum virgatum
  misc_feature: Ceres CLONE 1902926
  misc_feature: Useful for making plants with altered carbohydrate content
MKGKSGAMDRRSSTRWRMLVLCAFSFGLGMLFTDRFWTAPDTNNHIMSQRRRQDQELQLVSEDCNTKRRGEDKDIMGEVTKTHEAIQSLDKSISTLQMELAAKRSTLELLRSSGSPVTSETSQPRKKAFVVIGVNTAFSSRKRRDSVRETWMPQGEKLQQLEEQKGIVIRFTIGHSATSNSILDKAIDSEDAPHHDFLRLNHGGGIS

SEQ ID NO: 30985 - DNA, 716 bp, Panicum virgatum
  misc_feature: Ceres CLONE 1902935
  misc_feature: Encodes the peptide sequence at SEQ ID NO. 30986
ccccccgcccgtgcccacctcacctcgatttgcccaatccaaggtcgcggtcgcgcgcatcgatctcgctcggggggagttcgggatctcacctgcgccccgtcgatttggaccccgtccatccaccccgcgtagcgcgagagagcggcggcggcggagatgtccaaggtctacaccctcgaggaggtcgccaagcacaactccaaggacgactgctggctcatcatcggcggcaaggtgtacgatgtgacaaagtttttggaagaccacccaggaggtgacgatgttctgctttcctcaactgccaaggacgcaactgatgatttcgaagatgtcgggcacagcaccactgcccgtgcgatgatggatgagtacttgttgggtgaaatcgactcatcaacgatccctgctaggacgaagtatgttccccccaagcaaccgcactacaaccaggacaagaccccagagttcattatcaagatcctccagttcttggttcccctggcaatcctgggcttggctgttgctgttaggatctacaccaagtcagagtctgcttagctttgctgccctcgcccccttggagattataagagtccaaacttgttgaataagttagcaacttgttgctgttaggatctacaccaagtcatgaattcgtcgaatgatctgagctattgtgggttatgtggtcctggagtgcttaaagtaggatt

SEQ ID NO: 30986 - protein, 133 aa, Panicum virgatum; identical to SEQ ID NO: 14686
  misc_feature: Ceres CLONE 1902935
  misc_feature: SWISSPROT Homolog: EC 1.7.1.1 Nitrate reductase (NADH)

SEQ ID NO: 30987 - DNA, 716 bp, Panicum virgatum
  misc_feature: Ceres CLONE 1902941
  misc_feature: Encodes the peptide sequence at SEQ ID NO. 30988
actcgactcctctcctcccactccactgccctcagcagcctctgcgcccactccgccttctagaacatctagggagcatcccactccgcatggtcgccccatagcgcccccaagctccctcgagacaccgtaccacccccaccgacgcaccggcggcaatggcgttcggcggcggcctggccatgtaccacgtcctcggcgtggccacctgcgtggcgctgctctacttcaccttcggcgcggtggacctccaccacatctcgctcccgtcgctgcccggctccggcgcctccgcccgcgcggccgccgtggcggcgcccttcgtggagcggcgcggcgcgcagctattcctggagggcgagccgttctacccgaacgggtggaactcgtactggctcatggaccaggccgtggagccgaggtcccgggaccgcgtgtcccgcatgttccgcgccgccgccgagatgggcctcaccgtgtgccgctcctgggcattcaacgacggcgcctacaacgccctccaggtctccccaggccacttcgacgagcgcgtcttcaaggcgctggaccgggtgctggtggaggccgggcggcacggcgtgcggctgatcctgagcctggcgaacaacctggaggcgtacggcgggaagacgcagtacgtgcggtgggcgtgggaggagggcgtcggcctctccgcctccaacgactccttcttc

SEQ ID NO: 30988 - protein, 185 aa, Panicum virgatum
  misc_feature: Ceres CLONE 1902941
  misc_feature: SWISSPROT Homolog: EC 3.2.1.78 Mannan endo-1,4-beta-mannosidase
MAFGGGLAMYHVLGVATCVALLYFTFGAVDLHHISLPSLPGSGASARAAAVAAPFVERRGAQLFLEGEPFYPNGWNSYWLMDQAVEPRSRDRVSRMFRAAAEMGLTVCRSWAFNDGAYNALQVSPGHFDERVFKALDRVLVEAGRHGVRLILSLANNLEAYGGKTQYVRWAWEEGVGLSASNDSF

SEQ ID NO: 30989 - DNA, 688 bp, Panicum virgatum
  misc_feature: Ceres CLONE 1902944
  misc_feature: Encodes the peptide sequence at SEQ ID NO. 30990
accaccatcagcggtagggagacactgacgagacgagcgagggactcggcggcttggggtgggacgggagtcagccggtgtggagagactgtgatcgcaggagaggagagcagctctctcaggacccaccggccggccggccggcctgccctgcctccgtccgccccagggagacgtgtggcctgaggtctctctctctctctctctctctctctctctctctctctcacacacacacacacacacacacacgagtcaaagaggagaagagcagatctacatctgctccaccgatgagcgcttctcggttcatcaagtgcgtcaccgtgggggacggcgccgtcggcaagacctgcatgcttatctcctacacctccaacactttccccaccgattatgttccaactgtgttcgacaacttcagtgccaatgttgtggttgacagaagcaccatcaacttgggtctgtgggacacagcaggacaagaggactacaatagactgcgcccgttgagctatcgtggtgctgatgtttttctgctcgccttttctcttatcagcaaagcaagctacgagaatgtatcaaagaaggcaaaaacctcacgatgctcacttactttgccccctcacttgatggaatcttattttatttagctttgcatttcttgcaatgacctgtgcatgtctcc

SEQ ID NO: 30990 - protein, 119 aa, Panicum virgatum
  misc_feature: Ceres CLONE 1902944
  misc_feature (8)..(118): Pfam Name: Ras Pfam Description: Ras family
  misc_feature: Useful for making plants with modulated nitrogen use efficiency
MSASRFIKCVTVGDGAVGKTCMLISYTSNTFPTDYVPTVFDNFSANVVVDRSTINLGLWDTAGQEDYNRLRPLSYRGADVFLLAFSLISKASYENVSKKAKTSRCSLTLPPHLMESYFI

SEQ ID NO: 30991 - DNA, 694 bp, Panicum virgatum
  misc_feature: Ceres CLONE 1902964
  misc_feature: Encodes the peptide sequence at SEQ ID NO. 30992
tgagtactttgcggatcaagcagaagccttggacaaaaggcaaaattccccagtttctcttccaatggagaattttaaatgccatcttcggagagagcctatcggagttgttgggcttatcagcccttggaactatcctctcctaatggctacatggaaggtagctcctgctctggctgctggttgtacagctgtgctgaaaccatctgaattggcatctgtaacttgcttagagctcgctgatgtctgtaaagaagtcggtcttcctgctggtgtcttgaacattgtgactggattaggtcctgttgctggtgctcctttggcagcacacccagatgttaacaaggtctcttttactgggagtttcgaaactggtaagaaggttatggcggctgcagctcctatggtcaagcctgttacactggaacttggtggaaaaagtcctatagtagtatttgatgatgttgacattgaaacagctgttgaatggactctgtttgggtgcttttggaccaatggtcagatttgcagtgcaacatctcgtcttcttatccattcaaaaattgccgaagagtttaaggagaggatggttgcatgggcgaaaaatattaaggtttcagatccacttgaagagggttgcaggcttggaccagttgttagcaaaggacagtatgagaagattaagaagttcata

SEQ ID NO: 30992 - protein, 230 aa, Panicum virgatum
  misc_feature: Ceres CLONE 1902964
  misc_feature (3)..(230): Pfam Name: Aldedh Pfam Description: Aldehyde dehydrogenase family
  misc_feature: SWISSPROT Homolog: EC 1.2.1.8 Betaine-aldehyde dehydrogenase
EYFADQAEALDKRQNSPVSLPMENFKCHLRREPIGVVGLISPWNYPLLMATWKVAPALAAGCTAVLKPSELASVTCLELADVCKEVGLPAGVLNIVTGLGPVAGAPLAAHPDVNKVSFTGSFETGKKVMAAAAPMVKPVTLELGGKSPIVVFDDVDIETAVEWTLFGCFWTNGQICSATSRLLIHSKIAEEFKERMVAWAKNIKVSDPLEEGCRLGPVVSKGQYEKIKKF

SEQ ID NO: 30993 - DNA, 342 bp, Panicum virgatum
  misc_feature: Ceres CLONE 1902977
  misc_feature: Encodes the peptide sequence at SEQ ID NO. 30994
gacggtcaacaagcctcccgatactgggtggaccgctgcaccctctccttactttacaaactatactattgcacaatttaaacgtatgcttgaaatgacgcccacaccacatattgtgctgactgatgttcctaccacaacttattcaagatcactgaaacttccaaaggagttcgacgccgaatctaagtggtctcgatgcagcacaattgggaacatacttgatcaaggtcagtgtggctcctgttgggcttttcgttctctggactgccttcaagatcgttgttgcattcatatgaacacaagcatttcactatcagtcaataacctactggcatgctg

SEQ ID NO: 30994 - protein, 113 aa, Panicum virgatum
  misc_feature: Ceres CLONE 1902977
  misc_feature: SWISSPROT Homolog: EC 3.4.22.1 Cathepsin B
TVNKPPDTGWTAAPSPYFTNYTIAQFKRMLEMTPTPHIVLTDVPTTTYSRSLKLPKEFDAESKWSRCSTIGNILDQGQCGSCWAFRSLDCLQDRCCIHMNTSISLSVNNLLAC

SEQ ID NO: 30995 - DNA, 1934 bp, Panicum virgatum
  misc_feature: Ceres CLONE 1902978
  misc_feature: Encodes the peptide sequence at SEQ ID NO. 30996
acgtccccgcctccgatatcagctcgtcaatcaatcgacaccttccctcctcctcccttcttccttgccaaccctagcgccgcacctgcacccccgatccgcccgagctgcagcgcggcccttccccccatcgccttcctcccaatccgcaagccgcatcgccgacccagcttgccacccatggacggattggctgcggagctggaggcggcggcggagcaggtggtgatgcggtggggttcggcctcccctccgaggcttctcttccccatcccctccaacgaaacgattgggtctcaagcggcggtagcggcggcgggcggcccgaggtactgaggaagatttggcgggcgggccgagaactacgagaagcggctgcagaacctgtccaaggaggaggccgccgtgctcgcccgcatgcgccgtcaggcgctcttctcccgacgaggcgtctggcagtttgcttctcttcgcgctacttctgatgctcggaggcgtttgcctgggatgcgttgcttcgtcttcctctccaccttcgctgctcaagaggaagtcggggatggaggcgcccacattgcttccgctgctgctgctcctggcggtgaagatggggcgcttcttggagtccttgggcaacttcttcaccggcggcgacaacatcccctggcgcgaccgcgacatcatcgcctttggtggttcatatctagctgattatagcatgataggacctgaagaagagggggcaagaggtgcaagcaagggaagtagaattgaagaagtcggaagctttgtctttgggccagatttgagaactgagtgtcattttgaattaccttgctaattatctggttcttagtgtcacttttgtgcaatagtgtagcaccctttcacgcaatcattagttaatcatttaataattttttagcttggtttttggagctccattttattcaggttcaaggaaataaagttgtgtgtttcatgttcagtctaggacgataggttcagtctacatatgctgttctatgttcatattctgctgttgttcctttcagcaccaaggacccaaggtcagcagccattcagtttcaacattggtctgggttcagtgatcaaaggatgggatgagggagttatgaccatgcaagtgggtgaagttgctcgtatccagggcaccctggactatgcttatggagccagcggatttccagcctggggaattcaaccaaacttggtgctggtgttcgagattgaggtcctcagtgcccagtaattcgtgttgcaattctggaaggagccttgcctcttaagtactgaaataaatccattgtcacctcatgctacatacagcagactgttgttcatagtaacctatttccttctaattgggagcccttctaattacttccatatgcacctaggagaaagtaaccactgtgatagatacataaggcctccctttcgcaattccctcctgattttgtcctttcacttccagtttgtcttggatttttaatttccagctgcccggcattgtagtgccatgatttgagatatgttctgagattgtgaacatcatcatcctgggtgatagtgtctgcaatagttaaattggatgattggagatgatcaggattaattatgaaatttaactcagcattgcaaggaagcgtctggacatcatggaaagcatagaggggtgacattctacttggaataatgttcttttctacaaattttttgtttcgatgcattgaaatcgtttctttgcctattgaatggttgggctaaaaagagtgtttgcactctacattgagatataccgtggaaagatgatctcaatcatgtaatatgtgattatttgaactgagagcttggaagtattgataagattgtacactgacaagctattagtgttggtatttttggtgtgc

SEQ ID NO: 30996 - protein, 85 aa, Panicum virgatum
  misc_feature: Ceres CLONE 1902978
  misc_feature (12)..(82): Pfam Name: FKBP_C Pfam Description: FKBP-type peptidyl-prolyl cis-trans isomerase
  misc_feature: SWISSPROT Homolog: EC 5.2.1.8 Peptidylprolyl isomerase
MLFYVHILLLFLSAPRTQGQQPFSFNIGLGSVIKGWDEGVMTMQVGEVARIQGTLDYAYGASGFPAWGIQPNLVLVFEIEVLSAQ

SEQ ID NO: 30997 - DNA, 1886 bp, Panicum virgatum
  misc_feature: Ceres CLONE 1902990
  misc_feature: Encodes the peptide sequence at SEQ ID NO. 30998
agagagagagaatggataggttaggagtagagaggagaggggagagagggtgcggtgaaggggagagccggagaggggtacgctgctgctagcttctgagttctgaatctcttacgctctagaactcgtcatcttgcgcttcattgtcaggcttggaggaagcagtcctcattcctcaatgtcttctgttcagtggtgaatgaccaaagacaccaacaacctcaaggcgccatgagcacacagagcattatcgctgtgaagcaattcgctggccctgacagtatggctcaaacatgcactactccacagccttcagctcatagtctgttcagtgctaaatccgatcactgtggttcagcgtatgatctgcaatcatcttgtgcttctgctcaatcctcgagcgttaagtcagagatgattggctcgttgagtctgacaaagatccttccgcttgaccttcataaacggagtcctgagtccaatcctgaacgttctgcttctcgcgcatcacaaacccaattgtcggatccagtttcatctagttcttcctccacattccacacaagtatgttctcctcgttcaggacaagctccgaatcgtgccggcaaaaaggcgctctgcctttcctaccccatcctcctaaatgtgagcagcagcagcagatttcggctcagcagtcatccagttcttcttcactgctctttggtgctgacctcagcaatggtagtcatgatgatgctgaacattcaggtgatctcaaggactttcttaacctttctggagatgtttcagaaggtagtttccatggagaaagcgatgccatggctttcagtgagcagatggagtttcagttcttgtctgaacagctcggaatggccatcaccaacaacgaagaaagccctcgattagatgacatctacgacagaccaccacaaacctcttcttgtacagtaccatcttactctaaccaagaaaacctcccgagcccagtatctgttgtcaaagttcagctgagttcatcccgagctgaagcatgtaacaaaccaagactgagatggacactggaactccatgagcgttttgtagaagctgtcaacaagcttggaggaccagaaaaggcaactccaaagggtgtgctaaagcttatgaaggtagaaggtttgaccatctatcatgtgaagagccatttgcagaaatatcgtttcgccaagtatcttccagagacaaaagaagataagaagtcctcttcagaaggcaagaaatctcaattggtaataccaggaaatgattctgacaaaaagaagagcttacaagtagcagaagctcttcggatgcaaatggaggttcagaaacaacttcatgaacaattagaggtgcaaaggcaactacagctgcacatagaagaacatgcaagatatttgcagaagatattagaacaacaacaaaaggcaagggactccttatccactacgagaaattcaacaaaagagaaagaggaagcgccagaatccacagagaaagaggaaaccaagatgaaagacgacacctcttcagatccactgtcaggacgcaaaatttcagatcctaacctggaatgtgcaactcgtgagtcacaagtggataacaaaagtacaaacgtttaggatcttgagaaggaggcactatgttcatatctgcgatgaacatggtgattggttgaatgtttgcttctttttccttgtagaattttagcacttgcgcctagatactgatctttcttctatgtttcttatgaccatgaccaactagtactgcggtgagtttaccgttgtatatgattaagtttcagatgaaaatggaacaacaattgttcgtacaaaaattcaagagtctttctacttcctat

SEQ ID NO: 30998 - protein, 470 aa, Panicum virgatum
  misc_feature: Ceres CLONE 1902990
  misc_feature (273)..(324): Pfam Name: Myb_DNA-binding Pfam Description: Myb-like DNA-binding domain
  misc_feature: The sequence is a functional homolog of SEQ ID NO 2000 in the 11/479,226 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 1999 in the 11/479,226 US patent application
MSTQSIIAVKQFAGPDSMAQTCTTPQPSAHSLFSAKSDHCGSAYDLQSSCASAQSSSVKSEMIGSLSLTKILPLDLHKRSPESNPERSASRASQTQLSDPVSSSSSSTFHTSMFSSFRTSSESCRQKGALPFLPHPPKCEQQQQISAQQSSSSSSLLFGADLSNGSHDDAEHSGDLKDFLNLSGDVSEGSFHGESDAMAFSEQMEFQFLSEQLGMAITNNEESPRLDDIYDRPPQTSSCTVPSYSNQENLPSPVSVVKVQLSSSRAEACNKPRLRWTLELHERFVEAVNKLGGPEKATPKGVLKLMKVEGLTIYHVKSHLQKYRFAKYLPETKEDKKSSSEGKKSQLVIPGNDSDKKKSLQVAEALRMQMEVQKQLHEQLEVQRQLQLHIEEHARYLQKILEQQQKARDSLSTTRNSTKEKEEAPESTEKEETKMKDDTSSDPLSGRKISDPNLECATRESQVDNKSTNV

SEQ ID NO: 30999 - DNA, 1295 bp, Panicum virgatum
  misc_feature: Ceres CLONE 1902999
  misc_feature: Encodes the peptide sequence at SEQ ID NO. 31000
aatcgctgagctgcttttcgattgttattaaattaaatagctcgtcgcgcactccacgccaagcgagctgccacggcgactctctcatggtctcatctgctctgcttctccactcgaccactccgccggcagcgcgggccatggcgacgccctcgcgccgactcctcctcctgctgctgccgctgctcgccgtcgccgtcgcggcgtctcatccggcgcacgagttctgcacggcggggggtgacgccggctgcggcggaggggacggggcgaggatcctgatcaagggcggcacggtggtgaacgcgcaccgggcggaggaggccgacgtctacatcgaggacggcgtcgtcgccgccgtccggcccaacatcccggtcggtgatgataatgtaagggtgatcgacgcaactggaaaatatgtcatgccaggtggaattgaccctcacacgcacttggcaatggagttcatgggcaccgtgaccatagatgacttcttcagtgggcatgctgctgcactggctggtgggacgactatgcacattgacttcgtcattcctgtgaacggcaacttgactgcaggcttggagtcctacaagcagaaagcagcaaatgctgccatggattatggctttcacatggccattaccaagtggaatgacgaggttgcaagggaaatggaagtcatggttaaggaacatgggatcaattctttcaagttcttcatggcatataagggttccctgatggtcactgatgacctcctcctgcaaggcctacagaaatgcaagtcgcttggtgccctggctatggttcatgcagagaatggggatgctgttgccgaaggacaacagcggatgatcgaccttgggataactggtccagaagggcatgctctctcaaggcctccaattttggaaggagaaacaactgcacgggctatccgcttagcaaagttcatcaatacgccactgtacgttgttcatgttatgagcattgatgcaatggaggagattgccaaggctaaaagagaagggcagagagttattggtgaaccagtggtttctggactagtccttgatgattcttggctttggaatcctgacttcacaattgcttcaaagtatgtgatgagtcctccaatccgggaagcagggcacagtaaagcactccaagctgctctttcatcgggaattttacagcttgtaggtactgatcactgcacattcaattccacacagaaagcatttggctctgatgattttcggaagattcccaatggtgtaaatggtctg

SEQ ID NO: 31000 - protein, 384 aa, Panicum virgatum
  misc_feature: Ceres CLONE 1902999
  misc_feature: SWISSPROT Homolog: EC 3.5.2.2 Dihydropyrimidinase
MATPSRRLLLLLLPLLAVAVAASHPAHEFCTAGGDAGCGGGDGARILIKGGTVVNAHRAEEADVYIEDGVVAAVRPNIPVGDDNVRVIDATGKYVMPGGIDPHTHLAMEFMGTVTIDDFFSGHAAALAGGTTMHIDFVIPVNGNLTAGLESYKQKAANAAMDYGFHMAITKWNDEVAREMEVMVKEHGINSFKFFMAYKGSLMVTDDLLLQGLQKCKSLGALAMVHAENGDAVAEGQQRMIDLGITGPEGHALSRPPILEGETTARAIRLAKFINTPLYVVHVMSIDAMEEIAKAKREGQRVIGEPVVSGLVLDDSWLWNPDFTIASKYVMSPPIREAGHSKALQAALSSGILQLVGTDHCTFNSTQKAFGSDDFRKIPNGVNG

SEQ ID NO: 31001 - DNA, 687 bp, Panicum virgatum
  misc_feature: Ceres CLONE 1902999-R
  misc_feature: Encodes the peptide sequence at SEQ ID NO. 31002
agcatataatttgggatagcatggtggagaccggcaagatttctgtcaccgattatgtcagagtgacaagcacagaatgtgccaagatcttcaacatataccctcggaaaggagcaatcctggaaggttctgacgcagatatcatcatcctaaaccctgaacggagctttgtgatgggtgcccacacacaccattcaaggtccaacacaaatgtatatgaaggcaggaaaggaaagggaatggtggaagtcacgatatcaaggggccgagtggtatgggaggatggtgtgctgaatatagctcctggttcaggaagatacgtcaggatgctgccttttggctacgtctttgatggcattgagaagtcagatgccgcctacagagcttccctccgagctcctgtacagcgtggtaaagcttctgcttaacgatgccctgctccatctagttcgagactgctgcttaacgatgcctcgctccatctagttcgaggagctgctccaatgtgaacgccgttcgttccatgtgtatatacaaaaaagaacaatttactgaagttcagattcagcataggtaaaggccttaacttgcctatgtacatcgaacacatttaccagttccggtcagtttgtacaactagaaacttgctattctaataaatgaaaggaaaaactggtttctaccacc

SEQ ID NO: 31002 - protein, 141 aa, Panicum virgatum
  misc_feature: Ceres CLONE 1902999-R
  misc_feature: SWISSPROT Homolog: EC 3.5.2.2 Dihydropyrimidinase
HIIWDSMVETGKISVTDYVRVTSTECAKIFNIYPRKGAILEGSDADIIILNPERSFVMGAHTHHSRSNTNVYEGRKGKGMVEVTISRGRVVWEDGVLNIAPGSGRYVRMLPFGYVFDGIEKSDAAYRASLRAPVQRGKASA

SEQ ID NO: 31003 - DNA, 1682 bp, Panicum virgatum
  misc_feature: Ceres CLONE 1903007
  misc_feature: Encodes the peptide sequence at SEQ ID NO. 31004
attccatctccctcccccggcccccgtcttccccgccagcacgctttgacccatctccgagcgcgcgattggacacgcgatcccattcccgttcgctcgtccagttccagtgctaccctcctggaagccccgcgccgccaagcccaatcaccaaggagcagagcacgcaacagagggagccgggaatggggcggcacggcgtggcccggatcggcgccgcggcggcgcccgcctgggccaccctcctcctgccgctgctgctgcttgcgggcgccgcttgcccgggcgcccgcgccggccagaccagcgagtaccgccgccacctcggctccgccatcgacatgccgctcgacgccgacgtcttccgcccgccgcccggccacagtgcgcccgagcaggttcacatcacacaagggaaccatgatggtacagccatgataatctcatgggtgacaagtgagcctggctcgagcactgtggtgtacgggacttcagaggacagcctcaactatactgcaaacggaaagcacacacagtatacgttctacaactatacctcaggatacattcatcattgcacaataaaaaagctggagtttgacacaaagtattactatgctgttggaattggacaaacagtgaggaagttttggttcatgacccctccaaaaagtggcccagatgttccatatacatttggtcttataggtgacctcggtcagagcttcgactcaaatgttacacttgctcattatgagtccaattcaaaagcacaggccgtgctatttgttggagacctgtcatatgcagataactacccatatcatgataatgtgaggtgggatacgtgggcaagatttgtggagaggaatgtcgcataccagccatagatctggacagctggaaatcacgagatagattttgctcctgatcttggtgaaacagagccattcaagccatacagcaacaggtaccccacaccttacgaggcttctggtagcacggcaccttactggtattccatcaagagggcctctacttacattattgtcttggcatcatattcatcatatggaaagtacactcctcaatacaagtggcttgaagctgagtttcccaaggtcaacaggagtgaaacaccatggttgatcgtcctcatgcacgctccatggtacaatagctacaactatcactacatggaaggtgaaaccatgagggtgatgtatgagccgtggttcgtcaagtacaaagtcgatctcgtatttgcaggacatgtgcatgcctatgagcggacacacaggatatcaaatgtggcatacaacgttgtgaacggcctgtgcactccagttcctgatcaatctgccccagtctacatcactattggcgacggagggaaccaggagggactcgccaccaacatgtcggagccgcagccgaggtactcggccttcagggaggcgagcttcgggcacgccgtcctggacatcaagaaccggacgcacgcgtactacacgtggcaccgcaaccaggacggcagcgcggtggccgccgacgccgtgtggttcaccaaccgctactggcagccgacggacgactccgctgcctcctcccagtgaggacgacgcgccgccgtccccgtggtgcctcgcgatcaattaagcaagcatcccctcctccgttgg

SEQ ID NO: 31004 - protein, 234 aa, Panicum virgatum
  misc_feature: Ceres CLONE 1903007
  misc_feature: SWISSPROT Homolog: EC 3.1.3.2 Acid phosphatase
MGRHGVARIGAAAAPAWATLLLPLLLLAGAACPGARAGQTSEYRRHLGSAIDMPLDADVFRPPPGHSAPEQVHITQGNHDGTAMIISWVTSEPGSSTVVYGTSEDSLNYTANGKHTQYTFYNYTSGYIHHCTIKKLEFDTKYYYAVGIGQTVRKFWFMTPPKSGPDVPYTFGLIGDLGQSFDSNVTLAHYESNSKAQAVLFVGDLSYADNYPYHDNVRWDTWARFVERNVAYQP

SEQ ID NO: 31005 - DNA, 717 bp, Panicum virgatum
  misc_feature: Ceres CLONE 1903019
  misc_feature: Encodes the peptide sequence at SEQ ID NO. 31006
gctcttcgctctagcttgcttccgtgctgatctttactagtagtggttgcctggtgtcgagaggaagcccccggagcacgggaggccggggagcttctcgaggagcgaggggggcggccatgaggatccagtgcgacgcgtgcgagggcgcggcggccacagtggtgtgctgcgcggacgaggcggcgctgtgcgcgcgctgcgacgtcgagatccacgccgccaacaagctcgccggcaagcaccagcgcctcccgctcggcgccggcgccggcgccggcggggacgtcccgcgctgcgacgtctgccaggagaagccggccttcatcttctgcgtcgaggacagggcgctcttctgccgcgactgcgacgagcccatccacgtccccggcacgctctcggggaaccaccagcgctacctcgccaccggcatccgcgtcggcttcagctccgtctggcggcgccggcgccggcgccgggcgccgacgtccttccgccgcctaagggcagctcaaagcccgcggctgccgccgggtccgctaaggcgccggccagtaagcccgcgcagccgcaggaggtgccgtcgtcgccgttcctgccgccggtccgggtgggccgtcgaggacctcctgcagctctccgactacgaatccagcgacaagaaggactcgcctctcgagttcagggagctggagtggttcgcggacatcgacctgt

SEQ ID NO: 31006 - protein, 199 aa, Panicum virgatum
  misc_feature: Ceres CLONE 1903019
  misc_feature (1)..(47): Pfam Name: zf-B_box Pfam Description: B-box zinc finger
  misc_feature (55)..(102): Pfam Name: zf-B_box Pfam Description: B-box zinc finger
  misc_feature: The sequence is a functional homolog of SEQ ID NO 465 in the 11/479,226 US patent application
MRIQCDACEGAAATVVCCADEAALCARCDVEIHAANKLAGKHQRLPLGAGAGAGGDVPRCDVCQEKPAFIFCVEDRALFCRDCDEPIHVPGTLSGNHQRYLATGIRVGFSSVWRRRRRRRAPTSFRRLRAAQSPRLPPGPLRRRPVSPRSRRRCRRRRSCRRSGWAVEDLLQLSDYESSDKKDSPLEFRELEWFADIDL

SEQ ID NO: 31007 - DNA, 1633 bp, Panicum virgatum
  misc_feature: Ceres CLONE 1903032
  misc_feature: Encodes the peptide sequence at SEQ ID NO. 31008
gcacgcgccgaccgctcgctcgccttcgccggccacgctgcccgcccgtgcccgtgtgctgcctcggcgctcggcagccgtcaccctcgcttcgccaccgccgcgagcgacgcgcgagcaggccgcggtttcgctcgccctcggggctccgtgcctcgtgtgcgtcggtatcttctgctgcaaagcctgtgttccctttctgtcaaaacaagaatatctgaggcaggaaccttgctaataatagtggataaccatgtgccccccaaatcctgagctgaaactggcagcacttaacatcagtatcagggattcctggagtgaggaggaacttgtcagattcttggccgagaggaaagctgaggatccccttccgcaggacgtgcttgtgggtctggacttctccctcgttgatccacggatcttcactgtagacacatggtacttgagctggtcagatgatgaacaacctaataacagtgctgaaaacagtatcagaaaggcaaaaaatggatactggaaacatgcggagtcatgcaaagtaccaacaagtataggtatcatgggcgtgaaaattattttggagttttatgaaggtcaagaaccatgtggcaagagaactgggtgggtgatgcatgaatatcaagtggaacagaatgacgaagctaatctaccacaggactacaagtctttgtgtagagtattctttcagggtgacaaaaagctagatgcaaaaagtcaaaaaaattctatgaatgtagatgctcctaatgatagcttggagacttaccttcagtatcttgcaaaactagaagagccaaaggtgacagcagatgcaaatgaggatgtttgttctagcaaagtacagtttgagcaaaaacctcagaattctctagatgatattgatgttattgctactggggactacatagagctgaatgacctactaacctcagaagcctctgcatcaacttcagaaaactcaagcaagcgatctatggtttctgaggattattttgatagtgatgcattcctgcgtgaaatcttgaaaggtggtaacacaactgatggacaaaatcaagaccacaagtttagcatagctgcacctactaaatcagctaatgtggtactcagcccttcagaacaagggctagttcagttccatgataacaatggcatggtgcctggaacttcacatcagaagccagtgccagaaggtgatagaggtgaacattcaagccaagggtttcagcagcagagtccttctgtgtcttcctatttcccaagcagccatgtgaagggaagccattccaacagttctagcagctcgcagagcagcattaagtctcataaagagcagtctacccgtaaatttggaaagatacgaaagaagtactgctgctttggatccttctagtacaatgcatagcttctgttctatttttgtacaggatggagcatagggaaggatcagtttttccacttcatcattaggcacatgatactgtgcaaattgctatagtgacattggctgattgacgcaacaagtagttgccatatgttgtgaaattgaaactagatggtagctagtttgaagctacctgaaacaacaatacgagctgtggaaagttttccg

SEQ ID NO: 31008 - protein, 386 aa, Panicum virgatum
  misc_feature: Ceres CLONE 1903032
  misc_feature (22)..(132): Pfam Name: NAM Pfam Description: No apical meristem (NAM) protein
MCPPNPELKLAALNISIRDSWSEEELVRFLAERKAEDPLPQDVLVGLDFSLVDPRIFTVDTWYLSWSDDEQPNNSAENSIRKAKNGYWKHAESCKVPTSIGIMGVKIILEFYEGQEPCGKRTGWVMHEYQVEQNDEANLPQDYKSLCRVFFQGDKKLDAKSQKNSMNVDAPNDSLETYLQYLAKLEEPKVTADANEDVCSSKVQFEQKPQNSLDDIDVIATGDYIELNDLLTSEASASTSENSSKRSMVSEDYFDSDAFLREILKGGNTTDGQNQDHKFSIAAPTKSANVVLSPSEQGLVQFHDNNGMVPGTSHQKPVPEGDRGEHSSQGFQQQSPSVSSYFPSSHVKGSHSNSSSSSQSSIKSHKEQSTRKFGKIRKKYCCFGSF

SEQ ID NO: 31009 - DNA, 749 bp, Panicum virgatum
  misc_feature: Ceres CLONE 1903064
  misc_feature: Encodes the peptide sequence at SEQ ID NO. 31010
cttctctaatcagcttctatccatctggccattgaataatctccgatatcctgtcaaaaaaaaaactccgatagctagcagcttgcctgattgatcatcccggaagatcaagcactgaaactccaatttcagttcagttatcaccgaggacactgactgaagtagagatggcggagcgttcagagaacgcggcgggggacatgatgagcaacatcatggacgccatcgccgagaacctcccgaacaagaagtccgtcaggttcgacgacggcgagggctccatctccgaccaggccaggaagctgttcggcggcggcgggcagggcggcaagaagtccgtccaccacgtcctgggcggcggcaagtccgccgacgtgctgctgtggcggaacaagaagatctcgtcgagcgtgctgggcgcagcgacgctgtcctgggtcttcttcgagtggctcgactaccacttgctcaccatcgccagcttggcgctggtgctcggcatggccgtgcagctcgcctggtccgcgctcgcctcgaacgtgccccgcctcgaggtgccggaggaggtgttggccgacgctggcagggccgccggcgcgcaggtgaaccgggccctgggcgcgctccaggacatctcctgcgggagggacctgaggcggttcctcatcgtgatcgccgtggttcttcgcggtcgcggtcgtcgggagctcctgcaacttgctgacggtcatctacatcggggtcgtgtg

SEQ ID NO: 31010 - protein, 193 aa, Panicum virgatum
  misc_feature: Ceres CLONE 1903064
  misc_feature (67)..(192): Pfam Name: Reticulon Pfam Description: Reticulon
MAERSENAAGDMMSNIMDAIAENLPNKKSVRFDDGEGSISDQARKLFGGGGQGGKKSVHHVLGGGKSADVLLWRNKKISSSVLGAATLSWVFFEWLDYHLLTIASLALVLGMAVQLAWSALASNVPRLEVPEEVLADAGRAAGAQVNRALGALQDISCGRDLRRFLIVIAVVLRGRGRRELLQLADGHLHRGR

SEQ ID NO: 31011 - DNA, 713 bp, Panicum virgatum
  misc_feature: Ceres CLONE 1903069
  misc_feature: Encodes the peptide sequence at SEQ ID NO. 31012
acacagacctacctccctgctttcagtctcctctacaactcttcctctctgcagctgcttgtagcatcctcctcctcatcctcctagtcaggtacaagaaaacgagcagagaacacagcagggagttcagatcagctctcttgtttcctccatggcggtggccacagagaccccgttccatgtcctggccgtggatgacagcctcccggacaggaagctcatcgagaggctcctcaagacctcttccttccaagtcaccactgtcgattccgggagcaaggctctcgagttcctggggatccatggcgaggacagcagcccaccagtttcggttcacgcagaccagctggaggttgcggtgaatctgatcatcacagactactgcatgcctggcatgacaggatatgatctgcttaagaagatcaaggaatcaacatctctaagagacatcccagtggtgatcatgtcatccgagaacattccttcaaggatcaatagatgcctggaggaaggagcggatgagtttttcctaaaaccagtgcggctatcagacatgagcaagctgaagccccacatactgaaaagcagatgcaaggagcactaccaccaggaacggaaccagcaaagcgacagcaacagcaacgaacgcagtaaccccacgaacaacagcaacagccgcaagagaaaggcagaggaaaacgaagaagttttgc

SEQ ID NO: 31012 - protein, 187 aa, Panicum virgatum
  misc_feature: Ceres CLONE 1903069
  misc_feature (9)..(139): Pfam Name: Response_reg Pfam Description: Response regulator receiver domain
  misc_feature: SWISSPROT Homolog: EC 3.1.4.17 3',5'-cyclic-nucleotide phosphodiesterase
  misc_feature: Useful for making plants with modulated low light sensitivity
  misc_feature: Useful for making plants with modulated nitrogen use efficiency
  misc_feature: Useful for making plants with altered carotene content
  misc_feature: Useful for making plants with altered lignin content
  misc_feature: Useful for making plants with altered terpenoid content
  misc_feature: The sequence is a functional homolog of SEQ ID NO 932 in the 10/666,642 US patent application
MAVATETPFHVLAVDDSLPDRKLIERLLKTSSFQVTTVDSGSKALEFLGIHGEDSSPPVSVHADQLEVAVNLIITDYCMPGMTGYDLLKKIKESTSLRDIPVVIMSSENIPSRINRCLEEGADEFFLKPVRLSDMSKLKPHILKSRCKEHYHQERNQQSDSNSNERSNPTNNSNSRKRKAEENEEVL

SEQ ID NO: 31013 - DNA, 249 bp, Panicum virgatum
  misc_feature: Ceres CLONE 1903074
  misc_feature: Encodes the peptide sequence at SEQ ID NO. 31014
ccaagatacctagtgattcatatcttcatgtaacagaaatacaattgtttaagatgaatctttccggaactttggcaccagaggtcggccttctatcccagctgaaaacattagacttcatgtggaacaatttaactggtaacatccccagagaagttggaaaaatcacaacgctgaagctcataactttgaatggtaatcagctatctggttctttacctgatgagatcggctatctggtgaacttaa

SEQ ID NO: 31014 - protein, 82 aa, Panicum virgatum
  misc_feature: Ceres CLONE 1903074
  misc_feature: SWISSPROT Homolog: EC 2.7.11.1 Non-specific serine/threonine protein kinase
KIPSDSYLHVTEIQLFKMNLSGTLAPEVGLLSQLKTLDFMWNNLTGNIPREVGKITTLKLITLNGNQLSGSLPDEIGYLVNL

SEQ ID NO: 31015 - DNA, 1878 bp, Panicum virgatum
  misc_feature: Ceres CLONE 1903088
  misc_feature: Encodes the peptide sequence at SEQ ID NO. 31016
cctcaacaacccatctccaagaaaccacctcccctcgcccccaatcccaatccaaatcctccgccacgaaccgaccctgcccaatccgatcagagcccccccacgcattctcgtgctccatctcctcccgccgatcaggatccgatccgagtgtccggcggctgattcgccggagttggggatgaagctcgacagggagatggagatgctgctcaacgagatccccctcctccaccacggcggcctcctcggcggcgacgacgcgggcggcgccgacgacgacgccgacctctcgttcctcatccacgagcttgccgccatgggcgtcgtcgacggcgacgacgagccgccggcgccgcccgccgccgccggcctcggcttctccggcttcatctaccccacgaaaggcgatagtcccgtggcctcgcacccgttctccatcgcgaattactgcgcgcacatgccgtccctgttcgatcccgtccccttcgacgccggcgccggcgccggcgccgacggctgggacgtccggtgctccccgccgcctcccgcgccgcctgctgccacgccgagtgcccggtgcaagagcggcaggaggaagaacggcggctgcggcgcgacggcggcgagccccaagaagtgcggggtcgcggcggcggcggcggcggcggccaagccgcacggcgagagcctggccggcctgcgcgggttcatgtaccacgtcgcgcgggaccagcacgggtgccggttcctgcagcagcggctcgacgacggcaagcgcgaggtcgaccttatcttcgccggcgtgtcgcgccacgccgcgcagctcatggtggacccgttcggcaactacctcatgcagaagctgctcgccgtctgcgacgccgggcagaggatggcgctcgtgctcaccctcaccgccgaccccttcgtgctcgtcaggatatccctcaacgtccatgggacacgggcagtgcagaagctgattgagagcctcaggacgagggaagagattagtctcgtcgtcgacgctctgcgccctgggttcttggagctcatcaaggaccccaatggcaaccatgtcgtgcaaaagtgcttgcagtcatttgagtccgatgataacaaggcgatctttgatgctgcttctgttcactgtctcgacattggaatgcaatgccacggttgctgcgtcctgcagcgctgcattgcacgttcacgaggtgagcacagagagaagctggttgctgccatcgcttgcaatggatttgaactcgcgcaggatgcctatgggaactatgttgtccagtacgtgatggacctgaagatcccaaatgcgaattcaagtcttgcacagaagtttgaaggcaagtacatccatctttccatgcagaagttcagtagcaatgtggttgagaaatgcctcaaagtcttcaaggagactgacaaggcgaagatcatactcgaactcctcgccatgccacacttggagcagttgcttcagcacccatatgcaaactatgtcatatactctgctcttcagaactccaaggggtcactccattctgcactcaccaacgcaatccgacctcatgtggaattacttaggaccagtccatactgcaagaggatatactctcgagctttgctgaagaagtgatgaactgatgacagtttgtcagcctgtaacaagaacgattgctgtcttgcgctgttttccagtttcagaaggcataaagattatcacaagatagatctgtataaattagtattcttttgtcatgtacttctacgtgtacctgtacttgatgcactgcttgtgcctggcgtcgcgtaagccatctgcgatggaataagttcaattgaacaagccctcgccgc

SEQ ID NO: 31016 - protein, 491 aa, Panicum virgatum
  misc_feature: Ceres CLONE 1903088
  misc_feature (284)..(318): Pfam Name: PUF Pfam Description: Pumilio-family RNA binding repeat
  misc_feature (208)..(242): Pfam Name: PUF Pfam Description: Pumilio-family RNA binding repeat
MKLDREMEMLLNEIPLLHHGGLLGGDDAGGADDDADLSFLIHELAAMGVVDGDDEPPAPPAAAGLGFSGFIYPTKGDSPVASHPFSIANYCAHMPSLFDPVPFDAGAGAGADGWDVRCSPPPPAPPAATPSARCKSGRRKNGGCGATAASPKKCGVAAAAAAAAKPHGESLAGLRGFMYHVARDQHGCRFLQQRLDDGKREVDLIFAGVSRHAAQLMVDPFGNYLMQKLLAVCDAGQRMALVLTLTADPFVLVRISLNVHGTRAVQKLIESLRTREEISLVVDALRPGFLELIKDPNGNHVVQKCLQSFESDDNKAIFDAASVHCLDIGMQCHGCCVLQRCIARSRGEHREKLVAAIACNGFELAQDAYGNYVVQYVMDLKIPNANSSLAQKFEGKYIHLSMQKFSSNVVEKCLKVFKETDKAKIILELLAMPHLEQLLQHPYANYVIYSALQNSKGSLHSALTNAIRPHVELLRTSPYCKRIYSRALLKK

SEQ ID NO: 31017 - DNA, 673 bp, Panicum virgatum
  misc_feature: Ceres CLONE 1903098
  misc_feature: Encodes the peptide sequence at SEQ ID NO. 31018
aaatttagcagagcaaagcatcagaggcggcttcgccctgcccctgcccgaagccttggtgccgcgggcaatggccggaaccaagagcagctcctccgccgaggccggcatcaactctgctcaggcaagtacaagctcggcggcctcctgggccgcgacaccttcggcaaggtctaccaagatcgctgcctcgcggggggagaccccgggggcgtcgaagtgcacgacaaggccgggctgggcaccacgggcatggcggcgcaagtcctgcgcgaggtctccgccatgcgccgcctccgccaccacaacgtgctccgcctccacgaagtgctcgacacgcgctccaaggtgtacctcgtcatggaggtggccgccggcgggaacctactgtcccgcctcaccgcccggaccgctcgtgggctccccgagcccgccgcgagccgcgtcttcctggatgtggcgtctgcgctaatctacccccacgcgggcggggtggtccaccgagacatcaagcctcaaaatgcgctcctcgacgctgaccgcgacgtcaatgtctccgacgtcagactcgccgcactcgatgactctctgcaagacgacggccgcttgcacattgtctgcggcacccctgccttcgacactatcgaagtgattcttgacatgactacgactg

SEQ ID NO: 31018 - protein, 224 aa, Panicum virgatum
  misc_feature: Ceres CLONE 1903098
  misc_feature (44)..(219): Pfam Name: Pkinase_Tyr Pfam Description: Protein tyrosine kinase
  misc_feature: SWISSPROT Homolog: EC 2.7.11.1 Non-specific serine/threonine protein kinase
KFSRAKHQRRLRPAPARSLGAAGNGRNQEQLLRRGRHQLCSGKYKLGGLLGRDTFGKVYQDRCLAGGDPGGVEVHDKAGLGTTGMAAQVLREVSAMRRLRHHNVLRLHEVLDTRSKVYLVMEVAAGGNLLSRLTARTARGLPEPAASRVFLDVASALIYPHAGGVVHRDIKPQNALLDADRDVNVSDVRLAALDDSLQDDGRLHIVCGTPAFDTIEVILDMTTT

SEQ ID NO: 31019 - DNA, 751 bp, Panicum virgatum
  misc_feature: Ceres CLONE 1903099
  misc_feature: Encodes the peptide sequence at SEQ ID NO. 31020
  misc_feature (581)..(581): n is a, c, t, g, unknown, or other
ctttcgctcctctcgccgctttgggttggggtttaagcgagtgtgcgggaggccggaggcgacgacgacggcgccggcgtcggagaagaagaagcagccagctctcgtgtatatgtcttcttgccccttctccgatctggtggtcgttgtgctcatcgtcgccgtcgtcgccgtcctcctccgcgccctcgcctgctccagccgatctatgcgccaggggctcaacggctggaacaaatcctcgtcgatgctcagggacgggttcggggtgaagtattccggattcctccacataaggccgtgtggcttctgtcgaggagactgacggattcggtcgattcgcgcccggctccgtccaatttttgcacccgcctgagaaattttcatcttttctagagtttttttccccttcagttttagcaattttggtgtcaagtttgggagtcctctccggcacaagagatagaagagagatggctccgttgaaccgccagcagattctcatcaggaaggccctggcgaagaagcccaagagcaagaggatctccgggtttggccttaaaccctccgctgctctcctncaggccaggccgcagcagcagcagccggcgcctgtccagcagaggcgccgcgtccgcgtcctctttgaggaccctgacgcgacggactcggactccgacgacgaggaggaggccggcactgccaggtccaagcgcttctcttttgagatgttcgtcggcaaggcccctgc

SEQ ID NO: 31020 - protein, 92 aa, Panicum virgatum
  misc_feature: Ceres CLONE 1903099
  misc_feature: The sequence is a functional homolog of SEQ ID NO 1191 in the 10/374,780 US patent application
  misc_feature: The sequence is a functional homolog of SEQ ID NO 1383 in the 10/412,699 US patent application
MAPLNRQQILIRKALAKKPKSKRISGFGLKPSAALLQARPQQQQPAPVQQRRRVRVLFEDPDATDSDSDDEEEAGTARSKRFSFEMFVGKAP

SEQ ID NO: 31021 - DNA, 660 bp, Panicum virgatum
  misc_feature: Ceres CLONE 1903107
  misc_feature: Encodes the peptide sequence at SEQ ID NO. 31022
atcaccacctttaatccccccatagaaaaacaaactttccaggcaccatcacacgaaccggcacgcgtgtgtgggggttgttcgcgcatggagatggaggcagcagacgggcgcggtgggaggaggacgatggggctcgccgccgctctcgccgcggccgtcgtgctcgcggcgtgcgcccgggcgtgccatggcatgacggacagccaggacacctccgtgctccgggcgttggtggatcagtggcagaacgcgccgccgacctggggacagtccgacgacccctgcggcgattcgccatgggagggagtaacgtgcgccaacaacaaagtgatctccataaagctgtccaccatgggcatcaaaggactgctagctgctgacatagggcaactcagtgacctgcaatccctggacctatcattcaacaaggacctcagcggcgtgctcactccgaacatcggaagcttgaggcagctcaccaccttgattcttgccggttgcagtttccatggcaccatcccggatgaactaggaagtctgccaaagctgtcctacatggcactgaattcaaatcagttctctggaaaaataccagcgtcgctgggcaatctctccagcctctactggtttgatatcgctgaacaatcactgagcggt

SEQ ID NO: 31022 - protein, 190 aa, Panicum virgatum
  misc_feature: Ceres CLONE 1903107
  misc_feature: SWISSPROT Homolog: EC 2.7.11.1 Non-specific serine/threonine protein kinase
MEMEAADGRGGRRTMGLAAALAAAVVLAACARACHGMTDSQDTSVLRALVDQWQNAPPTWGQSDDPCGDSPWEGVTCANNKVISIKLSTMGIKGLLAADIGQLSDLQSLDLSFNKDLSGVLTPNIGSLRQLTTLILAGCSFHGTIPDELGSLPKLSYMALNSNQFSGKIPASLGNLSSLYWFDIAEQSLS

SEQ ID NO: 31023 - DNA, 1473 bp, Panicum virgatum
  misc_feature: Ceres CLONE 1903111
  misc_feature: Encodes the peptide sequence at SEQ ID NO. 31024
ggctctttcccgttccgtcacggcttgccttgctcgtcgccaaaccgattgccaacgcagcggcagcgccgcccagaacgacccgccggggacgttccctccacccgcggctccggggcgcgctgccgccgcggctgccgctctccgtcgtacggtgcggagatccatccgctcattcattcatccggcgccaattggtctcctcaggctgagtcatcaacattatcctaaatcaatgaagggctggagtttgctggtgttttctctacatgttatatcatgcctagttagtggtgtcgcctctggtcgcacgagctcttacgtgcgtacagagttcccgtctagggatataccactagaaagtgaatggtttgcaattccaaagggatacaatgctccgcagcaggttcatataactcaaggtgattatgattgaaaggcagttatagtatcttgggttactccagaagaacccggaccaagtgaagtgttttatggcaagaaggagaagcaatatgaccagaaagcagaaggcacaacaacaaattatacgttttacgactacaaatctggatacatacaccactgtcttgttgatggccttgagtataacactaaatattattataagattggaagtggagattcagctcgagaattttggtttgaaacacctccagcaattgatccagatgcatcatacacatttggcatcataggtgatctggggcaaacgtttaattctctctcaactcttcaacattatgagaaaacaggagggcaaactgttctatttgttggggacttgtcatatgctgatcgatatgaacatgatgatggcattcgttgggattcttggggtcgacttgtcgaacgcagtactgcataccagccatggatttggaattctggaaaccatgaaatagaatacaggcctgatctgggagaaacttctacatttaagccatatctgcatagatatatgactccatatttggcatcaaagagcagttctcctatgtggtatgctgtcaggcgtgcatctgctcacatcatcgtgctgtctagctactcaccatttgtaaaatacactcctcaatggtggtggctgaagaatgaattcaagcgcgtggacagggagaagacaccttggcttatagttctcatgcattctcccatgtacaacagcaatgaggcacattatatggagggtgagagtatgagggctgcttttgagaaatggtttgtgaagtacaaggtcgacttggtatttgcaggtcatgttcatgcttatgagagatcataccgcatttcgaatgtcaactacaacataacatcggggaatcgatatccagtgccagacaaatctgctcctgtttacataactgttggtgatggaggcaaccaggaaggacttgcttcaaggtttaacgacccccagccggactactctgcattcagggaggccagtta

SEQ ID NO: 31024 - protein, 66 aa, Panicum virgatum
  misc_feature: Ceres CLONE 1903111
  misc_feature: SWISSPROT Homolog: EC 3.1.3.2 Acid phosphatase
MKGWSLLVFSLHVISCLVSGVASGRTSSYVRTEFPSRDIPLESEWFAIPKGYNAPQQVHITQGDYD

SEQ ID NO: 31025 - DNA, 302 bp, Panicum virgatum
  misc_feature: Ceres CLONE 1903111-R
cagcctcgcaagacgttgcgcagcacgacctttgttttgtggagcaatggcagaatagcaccgttgctagtgtccggtgctcttcggagcaacaggagaccagttatcagactggccattgcaagttcagctacccgatttcatcccaaaatgagtcatgatggctccctgtggatccgaatgccggactgtatgcatatagcgaaaaataatatagcgaaaaataatacaatgttcgtcgttgtacagatgtgatcattttacatacaatgaacatcatttcccacccttatcccagaacc

SEQ ID NO: 31026 - DNA, 747 bp, Panicum virgatum
  misc_feature: Ceres CLONE 1903130
  misc_feature: Encodes the peptide sequence at SEQ ID NO. 31027
ccccctttccctctcctcctcctcctcgcccgcctcccctacaagaagcccccgcccgaccgccggtagctacctagctaccaccccccgactcccacccttccccgttccgttccgttccgttccggccgccggagatccaggaacctagccccggggggacgggcggcgatgggagcaaggggcgcgatgctcgcggtcctggcggtggttcttgctgcggcgtcgcccgccggggtcgcggcggcggccaaggggaagtaccacgcgctcttcaacttcggggactcgctggccgacgccggcaacctcatccagaacggcacgccggagttcctcgccaccgcgcgcctgccctacggccagacctacttcggcagggccaccggccgctgctccgacggccgcctcgtcatcgaccacctcgcggaagagttcggcctgccgttgctgccgccgtccaaggccaagaacgccagcttcgcgcacggcgccaacttcgccatcaccggcgccaccgcgctcgacacgccctacttcgtggccaaggggctcggcgacgtcatctggaactccggcgcgctcatgacccaaatccagtggttccgcgatctcaagcccttcttctgcaacaccacccaggaatgcaagaagttctttgccaaggcgctgtttgtggtcggtgagttcggtggcaacgactacaatgcacccctctttgcaggggagggcattccggaagtctac

SEQ ID NO: 31027 - protein, 191 aa, Panicum virgatum
  misc_feature: Ceres CLONE 1903130
  misc_feature: SWISSPROT Homolog: EC 3.2.1.51 Alpha-L-fucosidase
MGARGAMLAVLAVVLAAASPAGVAAAAKGKYHALFNFGDSLADAGNLIQNGTPEFLATARLPYGQTYFGRATGRCSDGRLVIDHLAEEFGLPLLPPSKAKNASFAHGANFAITGATALDTPYFVAKGLGDVIWNSGALMTQIQWFRDLKPFFCNTTQECKKFFAKALFVVGEFGGNDYNAPLFAGEGIPEV

SEQ ID NO: 31028 - DNA, 734 bp, Panicum virgatum
  misc_feature: Ceres CLONE 1903145
  misc_feature: Encodes the peptide sequence at SEQ ID NO. 31029
atccatccatcaccaatccatcgcggtctcaagcaaattctgcactccgcgcgcttgtaatttccgaccgagcgaaatggcggcctacgagaagcagcagcagtcgccgctgaacgccgggttctacggcccgccgatccctccgccgcagccggcgtactacccgccgccgtcccgcccgcaccgtggctgcggcgggccgcgctgcctgctgtgcttcctcttcaaggtcgtggcgctggccgtcatcgtgctcggcgcggccaccctggtgctctggctcatcttccgcccggacacccccaaggcgtacgccgactccgccgcgctctcccgcttcgacctcggcgccggcgccggcagcggcggcggggacctcctccagtacaacctcacggtgaccatccgcctgaggaaccccaaccggttctggatccggtacgagtacgccgaggcgcaggcgctctacgacggcgagcggttcggcttcagcccgctgcagccgttctacgtgggcagcaagagcgacgcccggatcacggccgcgttcagcggctcggcggcggtggacggcgacgacgacgtgcggcgcacgtaccggagggagaacggggaggggttctactacatcaaggtgagggtgtactcggacctgagcttcaaggtcagggtcttccgcgtgcacgattacaagagcaagatcacctgcgtgctgcggctgccggtgccgcccg

SEQ ID NO: 31029 - protein, 219 aa, Panicum virgatum
  misc_feature: Ceres CLONE 1903145
  misc_feature (68)..(211): Pfam Name: Hin1 Pfam Description: Harpin-induced protein 1 (Hin1)
MAAYEKQQQSPLNAGFYGPPIPPPQPAYYPPPSRPHRGCGGPRCLLCFLFKVVALAVIVLGAATLVLWLIFRPDTPKAYADSAALSRFDLGAGAGSGGGDLLQYNLTVTIRLRNPNRFWIRYEYAEAQALYDGERFGFSPLQPFYVGSKSDARITAAFSGSAAVDGDDDVRRTYRRENGEGFYYIKVRVYSDLSFKVRVFRVHDYKSKITCVLRLPVPP

SEQ ID NO: 31030 - DNA, 555 bp, Panicum virgatum
  misc_feature: Ceres CLONE 1903151
  misc_feature: Encodes the peptide sequence at SEQ ID NO. 31031
atcgctctccccacaccaccacctcctcctccacagcaggctagccaggctttttctggggtttgcgaggggggcgctccggtccggcgagaggggggagatggcggcggagcgggcgcaggggacggtcaagtggttcaacgggagcaaggggttcggcttcatcagccccgacgacggcagccaggacctcttcgtccaccactcctccgtcaaggccgacggcttccccaacctcaaggacggcgaagccgtcgagttcaccgtcggcgccgacagcgacggccgcgccaaggccatcgacgtctccgcgcccggcggcggcacgctcgccggcggggaacgcccggacagcggctacggcgggcgcggcggcggcggctacggcgggggaggcgaccgcggctacggaggcggcggcggcgaccgcggttacggcggaggcggctacggcggaggcggctacggtggaggcggcgaccgcggctacggcggaggcggcgaccgcgggtacgggggaggcggcgaccgcgggtacgggggaggcggcggcta

SEQ ID NO: 31031 - protein, 151 aa, Panicum virgatum
  misc_feature: Ceres CLONE 1903151
  misc_feature (5)..(72): Pfam Name: CSD Pfam Description: 'Cold-shock' DNA-binding domain
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
  misc_feature: The sequence is a functional homolog of SEQ ID NO 110 in the 10/225,066 US patent application
  misc_feature: The sequence is a functional homolog of SEQ ID NO 128 in the 10/666,642 US patent application
  misc_feature: The sequence is a functional homolog of SEQ ID NO 136 in the 10/374,780 US patent application
  misc_feature: The sequence is a functional homolog of SEQ ID NO 44 in the 11/375,241 US patent application
  misc_feature: The sequence is a functional homolog of SEQ ID NO 850 in the 11/435,388 US patent application
  misc_feature: Useful for making plants with altered alkaloid content
MAAERAQGTVKWFNGSKGFGFISPDDGSQDLFVHHSSVKADGFPNLKDGEAVEFTVGADSDGRAKAIDVSAPGGGTLAGGERPDSGYGGRGGGGYGGGGDRGYGGGGGDRGYGGGGYGGGGYGGGGDRGYGGGGDRGYGGGGDRGYGGGGG

SEQ ID NO: 31032 - DNA, 495 bp, Panicum virgatum
  misc_feature: Ceres CLONE 1903154
  misc_feature: Encodes the peptide sequence at SEQ ID NO. 31033
attgcaaaacctctccagcacaccggaagaggctctccagagctatgcgttccatcgacggccgatccagaacaagatgtgtcagatgaagatggagatgggcgccgagccgtcgggctcgccctcgacctcggagcacgagcgccgccggagggggtggacgtcgccgccgaagcggccggcggggcggaccggtgccgggagacgcggcaccccgggtcccgcggcttgcagggcctgaggcccgcctcatgcatgggggtgctacgcatgggggacagaccgccatggccgactactgcccctacgcgccctctctccgctgcgagcggtggcgctccatccccaccctcggctgcccccccacacgcggccatgtgcctgcctgaggacactggagtgttgtggtgtgctggctcgcgctccgttccccgaccagctagaccaggtgggggagtcaccccccccgacccatgtgcatgtgcccttcctctc

SEQ ID NO: 31033 - protein, 54 aa, Panicum virgatum
  misc_feature: Ceres CLONE 1903154
  misc_feature: The sequence is a functional homolog of SEQ ID NO 2 in US patent 7138277
  misc_feature: The sequence is a functional homolog of SEQ ID NO 1230 in the 10/374,780 US patent application
  misc_feature: The sequence is a functional homolog of SEQ ID NO 724 in the 11/435,388 US patent application
MCQMKMEMGAEPSGSPSTSEHERRRRGWTSPPKRPAGRTGAGRRGTPGPAACRA

SEQ ID NO: 31034 - DNA, 1173 bp, Panicum virgatum
  misc_feature: Ceres CLONE 1903155
  misc_feature: Encodes the peptide sequence at SEQ ID NO. 31035
ggtgacatctccgacgaaccttcgcacgtcctccacctccggagcagccacggggaacgcgctggtttcccgccgccgccgcccagggccgcgttcgaccccttcgacgtcgatgccgatccgccgccgcgactggagttgacgcctgagcaggtcgggcactgccgcgacgcactcgcgcacttcgaggagaagaggaagaggctgagtgacttgtcagaagatttcggaagcctcgaggacatgagactgacgaaaaagattactgtggctcattatcctgttaatagggaaaagaaccgctatattgatatcttaccatttgatgataccagggtacagctgaaatcctcgacagccagtcagacttcaaacaatggttacatcaatgcaagcttcataaaggctactgaggacaacagagttgcaacatttatttctactcaaggtcccctggtgaagacatttgaggatttttgggaaatggtctatcaatatcagtgtcctgcaattgtcatggtcactcaattcgatagttttaagtgtgataagtatctcccattgcgcaatgggcgaagggcatatggaaaatatgatgttcagattgtgaagacaagattagataaccatcaattatggctgcgcaaagtgcaggtggaaaacaaggagtcaggcaaggttcattctgtactccatatagaatatcctgattggcccgaccatggagtgccaactaatactgatgctgtacggcaaatctggaagcgactacatcacattccaacagaacatccaatagttgtacattgcagtgcaggtattggaagaactggtacttacatcaccatccatactacaattgagagaatcctccttggtgacaaaaggtcttatgatattgttgaaacggtaaagaatttcagatctcaacgacctggaatggtccaaactgagcaacaatacaaattctgctatcgggtgattgctgatgagctgaaagatctgctaaactcaggccattgaggaagaaccacgcacagaagcgctgtctgtgtttcatccttgaacctttgattactctgatgccagatttgtgcatgcgccattttgttgaatgccctgcattgcttcttgcgaatggagccattgcaaaaagaccacaattcaaacgag

SEQ ID NO: 31035 - protein, 340 aa, Panicum virgatum
  misc_feature: Ceres CLONE 1903155
  misc_feature (96)..(330): Pfam Name: Y_phosphatase Pfam Description: Protein-tyrosine phosphatase
  misc_feature: SWISSPROT Homolog: EC 3.1.3.48 Protein-tyrosine-phosphatase
GDISDEPSHVLHLRSSHGERAGFPPPPPRAAFDPFDVDADPPPRLELTPEQVGHCRDALAHFEEKRKRLSDLSEDFGSLEDMRLTKKITVAHYPVNREKNRYIDILPFDDTRVQLKSSTASQTSNNGYINASFIKATEDNRVATFISTQGPLVKTFEDFWEMVYQYQCPAIVMVTQFDSFKCDKYLPLRNGRRAYGKYDVQIVKTRLDNHQLWLRKVQVENKESGKVHSVLHIEYPDWPDHGVPTNTDAVRQIWKRLHHIPTEHPIVVHCSAGIGRTGTYITIHTTIERILLGDKRSYDIVETVKNFRSQRPGMVQTEQQYKFCYRVIADELKDLLNSGH

SEQ ID NO: 31036 - DNA, 691 bp, Panicum virgatum
  misc_feature: Ceres CLONE 1903207
  misc_feature: Encodes the peptide sequence at SEQ ID NO. 31037
ataagtttgagctcctccttggctggagtacagtagccatgggtgagcggagttgcggccgcgacggcgtccgatgcgatgtcaggtcgagaaaggaacggcgaggtggaggccggcttgtgtcgttgccgctggtgatcctcctgctgctgctggcggcggcgccggcgcgagggcagcgctcggacggcgtggtgatcgcgcaggcggacctgcaggggctgcaggccatccgccaggcgctggtggacccgcgcgggttcctggcagggtggaacggcacgggcctcgacgcctgctccggcggctgggccggggtcaagtgcgcggggggcaaggtcgtggccatccagctccccttcaagggcctcgccggcacgctctccgacaaggtcggccagctcaccgcgctgcgccggctcagcttccacgacaacatcatcaggggccaggtgcccgccgcgatcggcttcctccgcgagctccgcggggtgtacctccacaacaaccggttcgccggcgccgtgcccccggcgctcggcggctgcgcgctcctgcagacgctcgacctcagcggcaactacctctcggggagtatcccttccgctctcgccaacgccactcgcctctttaggatccacctcgcgtacaacaacctctccggcgtcgtgccgagcagcctcacttcgct

SEQ ID NO: 31037 - protein, 217 aa, Panicum virgatum
  misc_feature: Ceres CLONE 1903207
  misc_feature (55)..(97): Pfam Name: LRRNT_2 Pfam Description: Leucine rich repeat N-terminal domain
  misc_feature: SWISSPROT Homolog: EC 2.7.11.1 Non-specific serine/threonine protein kinase
MGERSCGRDGVRCDVRSRKERRGGGRLVSLPLVILLLLLAAAPARGQRSDGVVIAQADLQGLQAIRQALVDPRGFLAGWNGTGLDACSGGWAGVKCAGGKVVAIQLPFKGLAGTLSDKVGQLTALRRLSFHDNIIRGQVPAAIGFLRELRGVYLHNNRFAGAVPPALGGCALLQTLDLSGNYLSGSIPSALANATRLFRIHLAYNNLSGVVPSSLTS

SEQ ID NO: 31038 - DNA, 432 bp, Panicum virgatum
  misc_feature: Ceres CLONE 1903220
  misc_feature: Encodes the peptide sequence at SEQ ID NO. 31039
aaacccagctagcattccccgttccggcgccgccggcgaacacgtgccccaccagcgatggccgccgccgccgccgacgacgacgtcgccccgcccaccgcctccggctacctcgacccctcctactgggacgagcggttcgggaaggaggagcactacgagtggttcaaggacttctcccacttccgccacctcctcgcgccgctcctctccccgtccctctcggtcctcgaggtcgggtgcggcaactcgcggctcggggaggagctcctgcgggagggcgtcgccggcggcatcacctgcgtcgacctctcccccgtcgccgtccagcggatgcgcgaccgcctcgccgcgcagggcacccaaggcgtggatgttgtggtggcggacatgcttgacctgccgtttgagccagatagctttgaccttgtc

SEQ ID NO: 31039 - protein, 124 aa, Panicum virgatum
  misc_feature: Ceres CLONE 1903220
  misc_feature: SWISSPROT Homolog: EC 3.4.24.71 Endothelin-converting enzyme 1
MAAAAADDDVAPPTASGYLDPSYWDERFGKEEHYEWFKDFSHFRHLLAPLLSPSLSVLEVGCGNSRLGEELLREGVAGGITCVDLSPVAVQRMRDRLAAQGTQGVDVVVADMLDLPFEPDSFDL

SEQ ID NO: 31040 - DNA, 1228 bp, Panicum virgatum
  misc_feature: Ceres CLONE 1903225-R
  misc_feature: Encodes the peptide sequence at SEQ ID NO. 31041
tcgaggccgaggtgcaggcggtggcggcgtgagggaggccgtgcgcgggcacgtcgtcggcgtcatgcacctcacggccaacgcgctcggcatcgtcaacgccatggccaagaagatgccctaaccaaaggtggtgttgttggttgttgccctcgtgtatataggcatgtactgatgtacatgccgtgtgccttgtgcatacgtacgtatagcaactcccgcgccacaagctttcgctgccatggcactcgtctcggcctcctcctcctcctccaccgccgtcgcggcgctccccaggaatgggcagcgggcgccgtccttcctcggcggcaagacgctgctgaggcaggccgaggcggcgcggccatcgttcgccgtgcgagccgcggcggaccccgacaggcccatctggttccccggcagcaccccgccgccgtggctcgacggcagcctccccggcgacttcggctttgatccctggggcctcggatctgacccggagagcttgcggtggaacgtgcaggcggagctggtgcactgccggtgggcgatgctcggcgcggcgggcatcttcatcccggagttcctgaccaagatcggcatcctcaacacgcccttctggtacaccgccggcgagcagcagtacttcaccgacaccaccaccctcttcatcatcgagctcatcctcatcggctgggccgagggccgccgctgggccgacatcatcaagcccgggagcgtcaacaccgaccccatcttccccaacaacaagctcaccggcaccgacgtcgggtaccctggtggcctgtggtttgacccgctcggctggggcagcggctcgccggagaagatcaaggagctgcgcaccaaggagatcaagaacggccgcctcgccatgctcgccgtcatgggcgcctggttccaggccgagtacaccggcaccggccccatcgacaacctcttcgcccacctcgccgaccccggccacgccaccatcttccaggccttcacccccaaatgaggagttggagttagcgatttgagattgcgaccaagcatgcatgggggtggagattgttaggttgatggtcgatcgatgcgacttttttctgtttgtggggcggaagactgtccatgcatgatgattgaatggtttgtggagcgatgcatgcctgttgatcgtgcacttgtactgtgttgtaaccaatgtaaaaatgcaatactcgtt

SEQ ID NO: 31041 - protein, 259 aa, Panicum virgatum; identical to SEQ ID NO: 19254
  misc_feature: Ceres CLONE 1903225-R
  misc_feature (62)..(230): Pfam Name: Chloroa_b-bind Pfam Description: Chlorophyll A-B binding protein
  misc_feature: Useful for making plants with modulated oxidative stress sensitivity
  misc_feature: Useful for making plants with modulated nitrogen use efficiency

SEQ ID NO: 31042 - DNA, 465 bp, Panicum virgatum
  misc_feature: Ceres CLONE 1903225
cgctccctccacgcaaactctgaaacccgtgcgccactcgccgctcggccatggcactgcaccgacgtggcggcgtcgtgtcgatgctgccgccgctttttctcctggtgctctcgatgatgagctggtgctgcggcgggggcgccgcggcgcggccagcacctccgtcgccgtccccggaccctgtgccgggcttcgtgaggtcgtggtgcgcggggacggagtacccggcgctgtgcgacgcgacgctggcgccgtacgcggcggcagtcgggtccagcccggcgcgcctgtcgtgggcggcgctgacggcggcgcggggcggcgcgacgggcagttacgtgcaacgtcaagacttcggatctggtccgacctcctcttcgggctccttgaccgcgacaccctccttgtttacaccaccaactccctcaccatttacaaacattagtcatgtataggccatga

SEQ ID NO: 31043 - DNA, 1374 bp, Panicum virgatum
  misc_feature: Ceres CLONE 1903233
  misc_feature: Encodes the peptide sequence at SEQ ID NO. 31044
gcgttgcagactctttctttcctctcctttctgttccttgttgagcgagtcaagatcgttgttgggggcgagccgcgagcgacaaggaagcacgcaggggagccctgccttcctgcctgccggtgccagagacggcatgttgggcggtcgccggtgcctgggcctggcggcgttcgtggccgcgctcttcctcgtcgccgacgccggggtgacgagccggtaccggcggaagctggaggcgacggcggacatgccgctggacgccgacgtcttccgcgtgccgccgggctacaatgcgccgcagcaggtgcacatcacgcttggcgaccaggacggcacggcgatgatcgtgtcgtgggtgacccccaacgagctgggcaacagcacggtcatgtacggcggcgcgccggacaagctggagctccgggcggagggcgtccacacgcgctacgactacttcaactacacctccggcttcatccaccactgcgtcctccggaacctcaagcacagcaccaagtactactacgccatggggttcggccacacggtgaggaccttctggttcaccacgccgcccaagccggggccggatgtgccctacaagttcggcctcataggcgaccttggtcagactttcgactccaacatcacgttgtcgcactacgagcagaacggcggcgacgccgtgctgtacgtcggcgacctctcgtacgccgacaaccacccgctgcacgacaacaaccggtgggacacgtggggccgcttcgccgagcgcagcgccgcctaccagccgtggatctggactgccggcaaccacgagctggacttcgcgccggagctgggcgagacgacgcccttcaagcccttcgcccaccgctacccgacgccgcaccgcgccgccggcagcaccgagcccttctggtactcggtgcgcctggcctcggcgcacgtcatcgtgctcgcctcctactccgcctacggcaagtacacgccgcagtgggcgtggctgcaggcggagctccgccgcgtcgaccgcaaggtgaccccatggctggtcgtgctcatgcactcgccctggtacaacagcaacggctaccactacatggagggcgagacgatgcgggtgcagttcgagcgctggctcgtcgacgcccgggccgacctcgtcctcgccggccacgtccacgcgtacgagcgcagccaccgcgtgtccaacgtcgcctacgacgtcgtcaacggcaagtccacgccggcgagggacgcggcggcgcccgtgtacgtgaccatcggcgacggcggcaacatcgagggcatcgccgacaacttcacgcagccgcagccgagctactcggcgttccgggaggccagctt

SEQ ID NO: 31044 - protein, 412 aa, Panicum virgatum
  misc_feature: Ceres CLONE 1903233
  misc_feature (156)..(353): Pfam Name: Metallophos Pfam Description: Calcineurin-like phosphoesterase
  misc_feature: SWISSPROT Homolog: EC 3.1.3.2 Acid phosphatase
MLGGRRCLGLAAFVAALFLVADAGVTSRYRRKLEATADMPLDADVFRVPPGYNAPQQVHITLGDQDGTAMIVSWVTPNELGNSTVMYGGAPDKLELRAEGVHTRYDYFNYTSGFIHHCVLRNLKHSTKYYYAMGFGHTVRTFWFTTPPKPGPDVPYKFGLIGDLGQTFDSNITLSHYEQNGGDAVLYVGDLSYADNHPLHDNNRWDTWGRFAERSAAYQPWIWTAGNHELDFAPELGETTPFKPFAHRYPTPHRAAGSTEPFWYSVRLASAHVIVLASYSAYGKYTPQWAWLQAELRRVDRKVTPWLVVLMHSPWYNSNGYHYMEGETMRVQFERWLVDARADLVLAGHVHAYERSHRVSNVAYDVVNGKSTPARDAAAPVYVTIGDGGNIEGIADNFTQPQPSYSAFREAS

SEQ ID NO: 31045 - DNA, 589 bp, Panicum virgatum
  misc_feature: Ceres CLONE 1903233-R
  misc_feature: Encodes the peptide sequence at SEQ ID NO. 31046
atgatcgacggcgccgagagcttcgacggcgccaaggcgtacaaggacagcaagatctgcaacatgctcaccatgcaggagctgcaccggcggtaccasgaggagacgggcatcaccttcgtgtcgctctaccccggctgcatggccaccacggggctgttccgsgagcacatcccgctgttccggctgctcttcccgccattccagaagttcatcaccaagggcttcgtgtcggaggcggagtccggcaagaggctggcgcaggtggtcagcgaccccagcctcaccaagtcgggggtctactggagctggaacaaggactcggcgtccttsgagaaccagctctcgcaggaggccagcgacccggagaaggcaaggaagctctgggagatcagcgagaagctcgtcggcctggcctgagcagaggagcttttatttgcttcgttgtttcatgtgtaccattagcaaccattttgttttattgtttaggagctggtgatgatggcagtcagagaagcctgtaagtgatcgatcatgcactatgcacaattttttttcacacaaagtatggaataaaacaacaggcttt

SEQ ID NO: 31046 - protein, 139 aa, Panicum virgatum
  misc_feature: Ceres CLONE 1903233-R
  misc_feature: SWISSPROT Homolog: EC 1.3.1.33 Protochlorophyllide reductase
  misc_feature (33)..(33): Xaa is any aa, unknown, or other
  misc_feature (111)..(111): Xaa is any aa, unknown, or other
MIDGAESFDGAKAYKDSKICNMLTMQELHRRYXEETGITFVSLYPGCMATTGLFREHIPLFRLLFPPFQKFITKGFVSEAESGKRLAQVVSDPSLTKSGVYWSWNKDSASXENQLSQEASDPEKARKLWEISEKLVGLA

SEQ ID NO: 31047 - DNA, 733 bp, Panicum virgatum
  misc_feature: Ceres CLONE 1903236
  misc_feature: Encodes the peptide sequence at SEQ ID NO. 31048
ctagccaactcggcgtttcttcctctccgcggctccgggcgctttgttcctctcggcggccggcttcggcgatggcggccgtcggctccgcagtgcggcggatctacctggctgtctacaattggatcgtcttcaccggatgggtgcaggtgctgtgctacgcgattttggcgctgtgggagagcggccatgaggctgtctacggcgctgtcgagcggccgctgcagttcgcgcaaacagctgccatcatggagattctacatggacttgtaggtcttgtgaggtctccaatctctgcaactcttccacaaattggatcaaggttgttccttacatggggcatcttgtggagttttcctgagactcgctctaatattcttgttacttcattggtcataagttggtccattactgagatcattcgatactctttctttggtatgaaggagacatttggattcgcaccttcatggctattgtggctaaggtatagcacttttatggtattataccctactggtatctcgagcgaggtgggtctaatttttgctgctctacctcatatgatgaaatattgtctaaggttgccaaacaaatggaatttctcttacgattacttgtatacatctattcttgctctcgcggtttacattccaggaagtccgcatatgtttaaatatatgcttttccagcgtaagaaggcattgtcgaagtcaaaaaccgtgtaatgttg

SEQ ID NO: 31048 - protein, 218 aa, Panicum virgatum
  misc_feature: Ceres CLONE 1903236
  misc_feature (55)..(216): Pfam Name: PTPLA Pfam Description: Protein tyrosine phosphatase-like protein, PTPLA
  misc_feature: Useful for making plants with modulated drought sensitivity
MAAVGSAVRRIYLAVYNWIVFTGWVQVLCYAILALWESGHEAVYGAVERPLQFAQTAAIMEILHGLVGLVRSPISATLPQIGSRLFLTWGILWSFPETRSNILVTSLVISWSITEIIRYSFFGMKETFGFAPSWLLWLRYSTFMVLYPTGISSEVGLIFAALPHMMKYCLRLPNKWNFSYDYLYTSILALAVYIPGSPHMFKYMLFQRKKALSKSKTV

SEQ ID NO: 31049 - DNA, 666 bp, Panicum virgatum
  misc_feature: Ceres CLONE 1903263
  misc_feature: Encodes the peptide sequence at SEQ ID NO. 31050
agaggaaccaagccaaagcacagaagggaggactctgctagccaaattcataatcctaagatcttgaagatcatcaagccagtgcgctattttgccactattttggatggtgtgcaggaagttgcaataacgttcaaggcactcaggtctgatggaacagaagtattagtagatgacaagcagttgaaagctaaggagcccttagtgcttatagaatactatgagcagcatcttcgatataaccccacctcgacacattgaagctactgtgttcagttgcctgtgctgcccctatgcttggaacggatggagattgtatttaatgtagcatttttttgtgctagatagatatatctgtacctcgattcggtttgcgctgagtgcgcgtaaacttcgatgttatggtatgctactatgccaaattaacccggacgtttttgtgtgtattggatccactgcgtagttaatcggatcctctgcgcaattgcgcttgctaaaaaaaaaaaaattaacaaccagagcgctcatcagcaaaaatctgaacaagatccgccaccgatttggggagcaccaggcgaaagtgcggccgacgcggcgagttgaagcaagattcgccatgggccggagcaggaacgattccagcgatctggcggaggctctaaggaa

SEQ ID NO: 31050 - protein, 86 aa, Panicum virgatum
  misc_feature: Ceres CLONE 1903263
  misc_feature: Useful for making plants with modulated flowering time
RGTKPKHRREDSASQIHNPKILKIIKPVRYFATILDGVQEVAITFKALRSDGTEVLVDDKQLKAKEPLVLIEYYEQHLRYNPTSTH

SEQ ID NO: 31051 - DNA, 721 bp, Panicum virgatum
  misc_feature: Ceres CLONE 1903267
  misc_feature: Encodes the peptide sequence at SEQ ID NO. 31052
ggcaaccacaccgagctccactccgcgtctctccctctctctcgccatcgcaccgccgccgcgtcgtgatcgatcgagcctgcggtggggtgagcgaggccggaaatgcagatggactccgacttctacgccggcttcttccacgacgaggccccgttgtacccgcacggcgccgtgccgccctccccggagctgcccttcggcctcattgcctcgccgggggagcccgagccgcccttcccggcgccggaggcgccgaggcccgccgcgttccaagactactccgtggccgggccggagctgctgccgccggccgtgggcgccggagagccacattacgggagcacgggcgcgagcgtgcacatgcgggtggtcgacgcgctgggcgggatgggcggggaccctgtgcatgatcagacaatgggggaggagtggaaggaggagccgcggcggcaggggcagcagcagccggcgggcgccgccgtggagagcagccgcgggttccggcacatgatgcgggagcggcagcggcgtgagaagctgagccagagctacgccgacctatacgccatggtcgccgcccggtccaagggcgacaagaactccatcgtgcaatccgcagcgatctacatccacgagctcaagggcgcgcgggagcagctgctgcggcggaacgaggagctcaaggcgcagatcctgggccacgacgcgcggcagcagt

SEQ ID NO: 31052 - protein, 205 aa, Panicum virgatum
  misc_feature: Ceres CLONE 1903267
  misc_feature (134)..(180): Pfam Name: HLH Pfam Description: Helix-loop-helix DNA-binding domain
MQMDSDFYAGFFHDEAPLYPHGAVPPSPELPFGLIASPGEPEPPFPAPEAPRPAAFQDYSVAGPELLPPAVGAGEPHYGSTGASVHMRVVDALGGMGGDPVHDQTMGEEWKEEPRRQGQQQPAGAAVESSRGFRHMMRERQRREKLSQSYADLYAMVAARSKGDKNSIVQSAAIYIHELKGAREQLLRRNEELKAQILGHDARQQ

SEQ ID NO: 31053 - DNA, 725 bp, Panicum virgatum
  misc_feature: Ceres CLONE 1903272
  misc_feature: Encodes the peptide sequence at SEQ ID NO. 31054
gttctgcattcgcacccatcgcctcaccacccaccgcttcaccaacacaagaaggaagccgcttcttctggagttgctcctcctcccatggccgactacaaccgctacggccacagctacgccggcgggtacagcagccacgcgccgccgccgacggcgccgcccgcgcccgcgcccaccacctccgcgccgccgcccccctcatacggctacggcggttacccgtcagcctacccgccgccgccccctcagacggcggggggattcggtttcggctacggctccgtccccgtcgccttcccaccggggacgcacccggacatcgagcgtgccttccgcgccgccgaccgggactgcagcggcgccatcgacgagcacgagctgcagggcgcgctctccaccgcctaccaccgcttcagcatccgcaccgtccgcctgctcatgttcctctttaacgacccggcctcctcctccccgtcacggatggggccagcacaatttgtatccctctggaattgccttgggcaatggcggggtatttttgatagatacgatagggatcggagtggaaaaattgactcccgtgagttgacggaagctcttcgcagccttggatatgccgttccaccttctgttatagagcttcttatagcgaactacaacaatggtgtgccctcgcatggtgcactagactttgacaactttgtggaatgtggtatgattgt

SEQ ID NO: 31054 - protein, 212 aa, Panicum virgatum
  misc_feature: Ceres CLONE 1903272
  misc_feature (147)..(175): Pfam Name: efhand Pfam Description: EF hand
  misc_feature (78)..(106): Pfam Name: efhand Pfam Description: EF hand
  misc_feature: SWISSPROT Homolog: EC 3.4.22.52 Calpain-1
MADYNRYGHSYAGGYSSHAPPPTAPPAPAPTTSAPPPPSYGYGGYPSAYPPPPPQTAGGFGFGYGSVPVAFPPGTHPDIERAFRAADRDCSGAIDEHELQGALSTAYHRFSIRTVRLLMFLFNDPASSSPSRMGPAQFVSLWNCLGQWRGIFDRYDRDRSGKIDSRELTEALRSLGYAVPPSVIELLIANYNNGVPSHGALDFDNFVECGMI

SEQ ID NO: 31055 - DNA, 1312 bp, Panicum virgatum
  misc_feature: Ceres CLONE 1903280
  misc_feature: Encodes the peptide sequence at SEQ ID NO. 31056
attctcctcttcgtcgccacttcaatttcaacgctgctctcgcgatcgcccaaatccttcccacctcctccctcctgcttactcgccgcgaatccggagggtccccgcaccgccggcccccgatgccggccgccgtcgcggcggcggccgccgcagcgtcgggcggcgcgctcctgctgtacctgctgctcacctgccggccgcagccggcgccggaggccgagaggggaagagaggagaacgagacgtcgccgctgctgtccgggtccggggcggcgcgggggagggggtcggagagcgaccgcgaggaggagccgtggccgcacagggagcccgtgacctgctgcgaggcggccgcggtggccgtccgcacggcgcggcgcacgtgggagctcaccgtcgggcgatggggcctgcacggcctcgccttcgggattaggcgccacatgaaacgtcagggtaatttgcagcatgagtatagtggaaacgattgccgtcaacttagaggccatcaggcacatgctgaagtttcttctctccttgagtacttgaagctttgcatgttcttctcaaagaaatccttttctgcatttctgaagtttggtgggtacaaacaagaagacattctcattcacaaggctaggtcgaggctcatgcagccttctttcgcactggtgtgtgacaaaaggaccaagtgttttctgcttttcattcggggtgctatcagtactaaagagcggctgacggcagcaactgctgctgaagttccttttcaccatataattctaagtgaaggacagatcagcaatgtagttttaggttacgcacactgtgggatgcttgctggagctcgttggattgcaagactaactattccccatcttcgtaataaaatacaagaatttcctgggtaccaaataaaggtcattggacattcaatgggagctggcattggagcaattctgacatatattcttcgtgagcactatgagttctcatcctgcagttgtctggcatttgctcctcctgcctgtatgacatgggagctggcggagtctggcaaagaattcatcacttctcttgtcaatagaaatgatgtggtgccatcattttcgaaagtttctaccgagagcctgcgatctgaggtattggtatcatcaaagctggatgatgtgcaggaccactttcaccatggtttattttccagtataagtcagcgtgttgccttcttcaggtcccatatgctttccatctcacattcaacagggaagattacagatcatgactctagtatttctgagcctttgctcaa

SEQ ID NO: 31056 - protein, 396 aa, Panicum virgatum
  misc_feature: Ceres CLONE 1903280
  misc_feature (194)..(335): Pfam Name: Lipase_3 Pfam Description: Lipase (class 3)
MPAAVAAAAAAASGGALLLYLLLTCRPQPAPEAERGREENETSPLLSGSGAARGRGSESDREEEPWPHREPVTCCEAAAVAVRTARRTWELTVGRWGLHGLAFGIRRHMKRQGNLQHEYSGNDCRQLRGHQAHAEVSSLLEYLKLCMFFSKKSFSAFLKFGGYKQEDILIHKARSRLMQPSFALVCDKRTKCFLLFIRGAISTKERLTAATAAEVPFHHIILSEGQISNVVLGYAHCGMLAGARWIARLTIPHLRNKIQEFPGYQIKVIGHSMGAGIGAILTYILREHYEFSSCSCLAFAPPACMTWELAESGKEFITSLVNRNDVVPSFSKVSTESLRSEVLVSSKLDDVQDHFHHGLFSSISQRVAFFRSHMLSISHSTGKITDHDSSISEPLL

SEQ ID NO: 31057 - DNA, 350 bp, Panicum virgatum
  misc_feature: Ceres CLONE 1903280-R
gaaatgataaacagaaggaaccgatttccgccagcggttcacgccaattcttccctcctgggaggatcattcacatggttggacagcccccgccggactcaactcctgatgagggcaccatcagcaacgaggtcatcggaatttacgagacgccgagagatttgtattgcaaaataaggctcgcgccaaatatgattaaagagcattacatgcctagttatataagtacaatggaatcgttgttggaacagcttcagaaggacgatgacaatagcgtttgtgccgcatcaaatgacctgtgaagtatattgtaacaaaactcagttgtgattaatcccattctttttttc

SEQ ID NO: 31058 - DNA, 664 bp, Panicum virgatum
  misc_feature: Ceres CLONE 1903291
  misc_feature: Encodes the peptide sequence at SEQ ID NO. 31059
cgacccggcgattcgacgcgccccagccatggacgcgccccagctcctcctcggggcgctcctcttcctcgtccccgccgcgctcctcctcctcggcctccaccgcgcggggggcaagcgcccgcgcctcccgccgggcccgccgtccctgccgctcctcggcagcgtggtgtggctcaccaactcgcccgccgagatcgagcccctgctgcggcgcctcttcgagcggcacggccccgtcgtggtgctccgcgtcggggcgcgcctctccgtcttcgtcgccgaccgccgcctcgcgcacgcggcgctcgtcgagcgcggcgccacgctggcggaccgcccggcgctcgtgtcggccaggctcctcggcgagaacgacaacaccatcacccgcgccagctacgggcccgtgtggcgcctcctccgccgcaacctcgtcgccgagacgctgcacccgtcgcgggtgaggctcttcgcgccggcccgcgcctgggtgcgccgcgtgctcgctgacaagctcggggaggcagcgcccggcgcgccgccgccccgcgtcgtcgagacgttccagtacgccatgttctgcctcctcgtgctcatgtgcttcggcgagcgcctcgacgagcccgcggtgcgcgcgatcgccgccgcgcaccgggagtcg

SEQ ID NO: 31059 - protein, 211 aa, Panicum virgatum
  misc_feature: Ceres CLONE 1903291
  misc_feature: SWISSPROT Homolog: EC 1.14.13.88 Flavonoid 3',5'-hydroxylase
MDAPQLLLGALLFLVPAALLLLGLHRAGGKRPRLPPGPPSLPLLGSVVWLTNSPAEIEPLLRRLFERHGPVVVLRVGARLSVFVADRRLAHAALVERGATLADRPALVSARLLGENDNTITRASYGPVWRLLRRNLVAETLHPSRVRLFAPARAWVRRVLADKLGEAAPGAPPPRVVETFQYAMFCLLVLMCFGERLDEPAVRAIAAAHRE

SEQ ID NO: 31060 - DNA, 1825 bp, Panicum virgatum
  misc_feature: Ceres CLONE 1903292
  misc_feature: Encodes the peptide sequence at SEQ ID NO. 31061
ctccccctctctcgctttccggcctccccttccgtctctgatccactgatcactccccgcgttccgctctccctgatccggcgatcggcggggagcctcctctcccggcgcgtagatcggcgacgacgcacgccctccgccgccgccccgcgccggcagaacgccactcgatccagatccagcggaactttctgctaccatcttgttttcttcaaagtaatcccagaaacgttgcttccatatgtcaactgcaaaagtgctagatcctgctttccaaggagttggccagaaagttgggacagaaatatggcgtattgaagattttaaaccagttgcattgccaaaatctgattatggtaaattctactgtggagattcatacatagttctgcagacatcctgtaccaaaggcggcgcgtatctgtatgatatccacttctggattgggaaagattcaagtcaagatgaagctgggactgcggccatcaagacagttgaactggatgccgtccttggaggtcgtgcaatccaacatagggaactccaaggttatgaatctgacaaattcttgtcatacttcaagccttgcattatacctttggagggcggttttgcttctgggttcaaaaagcctgaagaggagaagtttgaaacacggctgtatatttgcagagggaagagagctatacgagttaaagaggttcccttcgcccggtcatcgttaaatcacgatgacgtgtttgtcttagatactgaaaataagttataccaatttaatggtgctaactccaatatccaagaaagggccaaagcattgaaagtgatccaatatttaaaggagaaatatcatggtggtgtgtgtgatgttgcaattgtagatgatgggaagttacaagcagaatcagactctggtgaattctgggtcctttttggaggttttgcaccaatagggaaaaaacctgtgagtgatgacgatgttgttcttgaaactacggcaccaaagctctacagcatcaatgatggtcaaatgaagctggaagaggcagctcttacaaaagctatgcttgaaaataccaaatgtttcttacttgattgtggtgctgaaatatatgtatgggtcggccgggtaactcaaatggaggatagaaaatctgccactaaagcagttgaggaattccttattaatcaaaagcgtccaaagacaacaagagttacacaagtcattcaaggttatgagagtcatgctttcaagtccaagtttgaatcatggccaatgggcaatgctgctgggagccctggcgtagaggaagggaggggaaaagttgcagctttgttgaaacaacaaggtgtaaagggagctgcaaaaaacaccgctccagtaaatgaggaagttcctcctttgcttgaaggcggtggaaagctcgaggtatggtgtgttgatggcaacgctaagactgctctgccgaaagaggacatcggaaagttttacagtggagactgttatatcattctctatgcatatcattcaggcgacaagaaagaagaatactatctcagttactggattgggaaggatagtttggcggatgatcaagcgatggcatctcagtcagctaatacaatgtggactctcgaacagaaaagagaccagaaagaggaaaatattgtaatcgtcattcttatctgcttagtgtaattgacactcttcactacatggttgccagagctgttaactgcatgtctctgaatttaagctttagtggcatccacttcagcgggtcaaacctctagaaatttgaacagatgaatgcatatcgattgactt

SEQ ID NO: 31061 - protein, 484 aa, Panicum virgatum
  misc_feature: Ceres CLONE 1903292
  misc_feature (27)..(110): Pfam Name: Gelsolin Pfam Description: Gelsolin repeat
  misc_feature (147)..(227): Pfam Name: Gelsolin Pfam Description: Gelsolin repeat
  misc_feature (261)..(337): Pfam Name: Gelsolin Pfam Description: Gelsolin repeat
MSTAKVLDPAFQGVGQKVGTEIWRIEDFKPVALPKSDYGKFYCGDSYIVLQTSCTKGGAYLYDIHFWIGKDSSQDEAGTAAIKTVELDAVLGGRAIQHRELQGYESDKFLSYFKPCIIPLEGGFASGFKKPEEEKFETRLYICRGKRAIRVKEVPFARSSLNHDDVFVLDTENKLYQFNGANSNIQERAKALKVIQYLKEKYHGGVCDVAIVDDGKLQAESDSGEFWVLFGGFAPIGKKPVSDDDVVLETTAPKLYSINDGQMKLEEAALTKAMLENTKCFLLDCGAEIYVWVGRVTQMEDRKSATKAVEEFLINQKRPKTTRVTQVIQGYESHAFKSKFESWPMGNAAGSPGVEEGRGKVAALLKQQGVKGAAKNTAPVNEEVPPLLEGGGKLEVWCVDGNAKTALPKEDIGKFYSGDCYIILYAYHSGDKKEEYYLSYWIGKDSLADDQAMASQSANTMWTLEQKRDQKEENIVIVILICLV

SEQ ID NO: 31062 - DNA, 547 bp, Panicum virgatum
  misc_feature: Ceres CLONE 1903303
  misc_feature: Encodes the peptide sequence at SEQ ID NO. 31063
attgctcactctccaactctcgtcgcacactgccagcgacagctacctaccaaagacaacgacgcatatgccacccttacccaagagacccgggcctctccttgtcctcctcgttgtcgcgattcgcggccgccactgccgccgccgccgcctccgacgccgccaacgcgaccgtccccttctacccctccgcggaggccgccgcggccgcgcgctgcgacggcccgctctaccctgacgtccgcctgtcagagctggccgacatcccggacctgcaccagaagcccctccaggacgtcgtctgcgccgccgtgaaccgcaccgatgacgtcgtggcggccaccgcctccaactgctcctcctacctccgggagaggtccctgaccgcacgcgaccgcctcgccctcaacgactgcctggagctcctgtcaaccagaatggacgaactccaaggcacgcggcgcatacctggagtcccccgccgccaccagcggtggtggctcggcgtcatcctcgtcagcggtgggcgccaggcgcgtgacgatgg

SEQ ID NO: 31063 - protein, 181 aa, Panicum virgatum
  misc_feature: Ceres CLONE 1903303
  misc_feature: SWISSPROT Homolog: EC 3.1.1.11 Pectinesterase
  misc_feature: Useful for making plants with altered carbohydrate content
CSLSNSRRTLPATATYQRQRRICHPYPRDPGLSLSSSLSRFAAATAAAAASDAANATVPFYPSAEAAAAARCDGPLYPDVRLSELADIPDLHQKPLQDVVCAAVNRTDDVVAATASNCSSYLRERSLTARDRLALNDCLELLSTRMDELQGTRRIPGVPRRHQRWWLGVILVSGGRQARDD

SEQ ID NO: 31064 - DNA, 698 bp, Panicum virgatum
  misc_feature: Ceres CLONE 1903306
  misc_feature: Encodes the peptide sequence at SEQ ID NO. 31065
gcggccggccagctcacctaatcttcctcgcacttctgacttcccgttccctttacctgggccggcggcgaggtacaaaccaacgccgccctcttcctccggcgggatccgggctcgccgcccttgcttgtccagctgggcacgtgcgcccctcccccccccccccacggacttcgattgacgcccccttccttgatccgtgcgtcgaagccttctcctgcgcttgcgtggggtcgagatccaacctggcacggactgattccttcctctgtcggagacagcgaagacttggatattttgcatacacacagaatcttctaatcctgcatctggaggtgtcaaggatattccatttccttcagttcttggataggaatggacactgaatttcctgatgaagttctcaagtctgttttcccgttattggatgggaaagatctagtattttgcatgcttgtgtgccgtcagtggcgcgaaatcgcgaaggatgattacttctggaaatgcatttgctcgcggaagtggccatccatttgcaaacagcctccttctgacgcaaactatcagaggctttatttaaccttctcccagccacagaagatgcataaccttcctgtaccaaagctcatatttgaggatcttgttttttatattgatatgtggcttggaggatccctcatcttttctcaagcaatttc

SEQ ID NO: 31065 - protein, 107 aa, Panicum virgatum
  misc_feature: Ceres CLONE 1903306
  misc_feature (3)..(47): Pfam Name: F-box Pfam Description: F-box domain
MDTEFPDEVLKSVFPLLDGKDLVFCMLVCRQWREIAKDDYFWKCICSRKWPSICKQPPSDANYQRLYLTFSQPQKMHNLPVPKLIFEDLVFYIDMWLGGSLIFSQAI

SEQ ID NO: 31066 - DNA, 699 bp, Panicum virgatum
  misc_feature: Ceres CLONE 1903309
  misc_feature: Encodes the peptide sequence at SEQ ID NO. 31067
gccatcgtcgtccgtcgtactcgcccacaaggtacttaacacgggtcggcggccagcggttggaggagccgaggaggttggaggccggcttggagcagcagcagcagccggcaatggagaagccccggcaggtggtgcgcaagttcctggcgcggccgcagcacgagggcgccggcgccgtcgtccgccgcagcatcggcaggtttgagctgaggtacttcgacccgttcctggtcctcgacgagttctccgtttctgctccggcggggttccccgaccacccgcacagaggattcgagaccgtcacctacatgctcgagggcgccgtgacgcacgaggacttcgagggccaccgcggcacgatcaaggccggcgacgtgcagtggatgacggccggccgcggcatcgtgcactccgagatgcccgccgaccccggcacgtccaagggcctgcagctctgggtcaacctctcctccgccaacaaaatgtaaaaactcccctccctccatgcctgtttaacacgtgggtgcctggcggctgtggccgacactcgaaaacgacgttcgtgcagggtcgagcccgggtgccaggagatccagagcaaggacatcgcgtgcacgtccgccgacggcgtcacggtgcgcgtgatcgccgggcacgcctgggggggcccggtcgccggtgcgcacgcggacgccg

SEQ ID NO: 31067 - protein, 125 aa, Panicum virgatum
  misc_feature: Ceres CLONE 1903309
  misc_feature (21)..(117): Pfam Name: Pirin Pfam Description: Pirin
MEKPRQVVRKFLARPQHEGAGAVVRRSIGRFELRYFDPFLVLDEFSVSAPAGFPDHPHRGFETVTYMLEGAVTHEDFEGHRGTIKAGDVQWMTAGRGIVHSEMPADPGTSKGLQLWVNLSSANKM

SEQ ID NO: 31068 - DNA, 1382 bp, Panicum virgatum
  misc_feature: Ceres CLONE 1903318
  misc_feature: Encodes the peptide sequence at SEQ ID NO. 31069
accccggcggccgccgcccctgctctcttcctcccatatgctagtttgcctccggcgaggcctctcgctcgtcaggcggcgcgcaccccgcttccttccctcgccgcctccccgtcccacccgccgcttcctccaccacctccccgccgcccacgggatgggtgagggctccgctgccggaaaggacgccaaggggaaggccaagcccaaggcccccaccgcggcttccgccccggtcgtcgcgcgcgatgaatcctacctggaggccgtcacgaacaagagggtccgcatgttcgaggagatccaggcaaggcaggccctccaccggctcaacatcggcggcgaggccatcaaagtaactctgcccgatggcgctgtcaaggaagggaagaagtggataacaaccccaatggatatcgccaaggaaatatccagcggattggcagctagctgtttgatagctcaagtggacgaaacgctctgggatatggggaggccactggaaggtgactgtaaattgcagttgttcaagtttgatagcaacgaagggcgtgacaccttctggcactcaagtgctcatattcttggagagtctcttgagagagcatatggctgcaagctgtgtattgggccttgcactacaagaggggagggtttctactatgatgcttactacaatgatctgacattgaatgaggagcactttagtatcatagaaaaccaagctcaaaaggctgtcacggaaaaacagccatttgaacgaattgaggtcagcagagcagaggctcttgaaatgtttgctgaaaataaattcaaggttgaaatcattaatgagttgcccgaagacaagaccattacagtatacaggtgtggtcctttagtggacctatgccgtgggccgcacatcccgaatacttcctttgtcaaagctttcgcttgtctgaaggcgtcatcatcatattggagaggaaaagcagaccgcgaaagcctgcagagagtgtacggaatttcattccctgattctaaacgtctcaaggaatataaacattttttagaggaggctaaaaaacgtgatcataggttactaggacaggcacaggaactcttctttttccatccgcttagccctggaagctgcttcttccttccacatggtgctaggatatataataaactgatggactttttgcgacagcaatatagagatagaggataccaagaggtgttgagcccaaatatttacaatatgcaactttgggaaacttctggacatgcggcaaactacaaggagaacatgttcgtttttgagattgagaagcaggaatttggattgaagccgatgaattgccctggccactgtctaatgtttgataatagagttc

SEQ ID NO: 31069 - protein, 448 aa, Panicum virgatum
  misc_feature: Ceres CLONE 1903318
  misc_feature (273)..(322): Pfam Name: tRNA_SAD Pfam Description: Threonyl and Alanyl tRNA synthetase second additional domain
  misc_feature (105)..(165): Pfam Name: TGS Pfam Description: TGS domain
  misc_feature: SWISSPROT Homolog: EC 6.1.1.3 Threonine--tRNA ligase
MLVCLRRGLSLVRRRAPRFLPSPPPRPTRRFLHHLPAAHGMGEGSAAGKDAKGKAKPKAPTAASAPVVARDESYLEAVTNKRVRMFEEIQARQALHRLNIGGEAIKVTLPDGAVKEGKKWITTPMDIAKEISSGLAASCLIAQVDETLWDMGRPLEGDCKLQLFKFDSNEGRDTFWHSSAHILGESLERAYGCKLCIGPCTTRGEGFYYDAYYNDLTLNEEHFSIIENQAQKAVTEKQPFERIEVSRAEALEMFAENKFKVEIINELPEDKTITVYRCGPLVDLCRGPHIPNTSFVKAFACLKASSSYWRGKADRESLQRVYGISFPDSKRLKEYKHFLEEAKKRDHRLLGQAQELFFFHPLSPGSCFFLPHGARIYNKLMDFLRQQYRDRGYQEVLSPNIYNMQLWETSGHAANYKENMFVFEIEKQEFGLKPMNCPGHCLMFDNRV

SEQ ID NO: 31070 - DNA, 917 bp, Panicum virgatum
  misc_feature: Ceres CLONE 1903333
  misc_feature: Encodes the peptide sequence at SEQ ID NO. 31071
cctccttccacagcccttgagaagcttctacccctcccgcgccgcctccgccgccgccgccacagcagcgcaaaccctaaccgccgtcctccgcgtctctccgcccaccggcgcccccgtcgtcgtctccaccgccgccgccgccgccgaagcgatcggatctcgggacccgtcgagccacgatggaggactgggatgctgaagattttcaaccagccgcacctgttgttaaagcagagccacttaaaaatcagtgggttgatgaagatgttgaagaagaggacgtaaaagattcatgggaagaagaggaggaggagaacctaagccaccacctgtagaaaagcccacggcgaaacctagcagtaaggctcctgcgaaaaagggaaaacagcaggcatctactagtgctgaagaaccagatgaacctcctcttagtcccacttcagagaaaattcgccagcaaaggcttgtggaagaagctgatttcaagtcaaccacggaactttttgcaaagaagggtggcgaccaaaagtcactagatacatttatcccaaagtctgagagtgactttgcggaatatgcagagcttattgcaaataaactacgcccctacgagaaaagctttcactacatgggtctacttaagaatgtcatgagactttccatgacaccgttgaaaggtgtggatgcaaaagatatatcttcatcggtcacagcaattgctaatgagaagatcaaggctgagaaggaagctgcagcaggcaaaaagaaacaaggagccaaaaagaagcagctccacatcgagaaaggagatgatgacttcatccctggccggggtggtggctatgatgatccggatgagtatgacttcatgtgattcggctgggggcgaaagtaggtttctgtcatgtatacct

SEQ ID NO: 31071 - protein, 193 aa, Panicum virgatum
  misc_feature: Ceres CLONE 1903333
  misc_feature (1)..(193): Pfam Name: eIF3_subunit Pfam Description: Translation initiation factor eIF3 subunit
MGRRGGGEPKPPPVEKPTAKPSSKAPAKKGKQQASTSAEEPDEPPLSPTSEKIRQQRLVEEADFKSTTELFAKKGGDQKSLDTFIPKSESDFAEYAELIANKLRPYEKSFHYMGLLKNVMRLSMTPLKGVDAKDISSSVTAIANEKIKAEKEAAAGKKKQGAKKKQLHIEKGDDDFIPGRGGGYDDPDEYDFM

SEQ ID NO: 31072 - DNA, 502 bp, Panicum virgatum
  misc_feature: Ceres CLONE 1903349
  misc_feature: Encodes the peptide sequence at SEQ ID NO. 31073
cgacccccccccgagataattccggccaaagcctcccccactgctaccgctcccctccccctgtccgctggtaccccggatccctgacccccccggcctgagcccccccgggaagaagccccccgcgcggggatggcgtccctctcgcggaatctccggcgatccctcgcccccgaccgcctgcgccgcctcctcctcctctcccagcacccgcgggagtacgtgacggcggagtgccaccgccccgtcgtcctccacaagcgcgggcccgacatcctccacgacccctggttcaaccggggtaccgcgttctcgatgacggagagggaccgcctcggcgtccgcggcctgctcccgcccaacgtcgtctcctcgcagcagcagatcgacagattcatgcttgatctgatacggctgcagacatatgcgagagatgggccatctgatacatatccattagcaaaatggcgcatcctaaacagattacatgacagaaatgaaa

SEQ ID NO: 31073 - protein, 123 aa, Panicum virgatum
  misc_feature: Ceres CLONE 1903349
  misc_feature: SWISSPROT Homolog: EC 1.1.1.39 Malate dehydrogenase (decarboxylating)
MASLSRNLRRSLAPDRLRRLLLLSQHPREYVTAECHRPVVLHKRGPDILHDPWFNRGTAFSMTERDRLGVRGLLPPNVVSSQQQIDRFMLDLIRLQTYARDGPSDTYPLAKWRILNRLHDRNE

SEQ ID NO: 31074 - DNA, 2549 bp, Panicum virgatum
  misc_feature: Ceres CLONE 1903354
  misc_feature: Encodes the peptide sequence at SEQ ID NO. 31075
aacaatccccgtgtgccttcctgccttgcctgcctcggccccccgttctccgccgcccctccctcccaccacctcctcgtcccccacgcgcgcgcggcgcccgaggcgacgaatccggcctccgcgctccgtccccgtccccgccgccggccgccgatattgaaaggagctcggagggctgggacgctgacccgagttttatggggagaggatgccaaagctgcgaagcagtactcgtcaagcacgcctgaggtctaagaagctcgaagacgcgcagccaggagagcagcctgtgaaaccggcgccacctgctccacagagagcaggaaagcgtgctcctactcgtgctgccaggggcagaaaggttacttctgggagaagagcgccccaggcaccaaagcctaaaagaaagggggttgagattgttgacttagaagctgatcccgcttgcgaagatccccctaaagctgtagctaggctggaagttgctggtgcagttataaagaaccttggtttgaacaaggttgctgaggttggtgctaataaaggtctgaaaatggaaggggaaagtggggagaagattgttggggctgacgatgaatttgcagctacacctgtcccagagagggttcaagtaggtaactcgccagagtatgtaactgagaggaaattaggtaaaggtggttttggtcaagtctatgttggacgacgggtatctggtggaactgctcgcactggccctgaggcctatgaggttgcattgaaatttgagcatcggaacagtaaaggatgcagttatggcccaccatatgagtggcaagtttatagtgctctcaatggttgctatggcataccatcggtccactacaagggtcgtcagggtgactactatattctcgtaatggatatgcttggtcccagcctttgggacgtgtggaattcaatggggcaggcgatgtctgcgaatatggctgcctgcattgccgtagagagcatatcaattcttgagaagctccattctaaagggtttgtgcatggtgatgtgaaaccagagaattttctgcttggtcaggctggatcgcctgatgataagaagctttaccttatcgatcttggtttagcatcaaagtggagggaggcaaatgggaatcatgttgagtatgatcaaagacctgatgtctttaggggcacagttagatatgccagtgtccatgcccatttggggcgtacaggtagtaggagagatgatttggagtcactggcatacacccttattttcctaataagaggaagattgccttggcaaggttatcagggagataccaagagttttcttgtttgcaagaaaaaaatggctacttctccagagatgctttgctgtttctgtccagctccattcaaacagtttcttgagattgtcacaaatatgaaatttgacgaagagccaaattatgccaagctgatttcactttttgatggtttgattgaatcacctgcctcgagaccaattagaattgatggggctctcaaggttggtcagaaacgtggaaggttgcttgtaaatctggaagaagatgagcaacctaaaaagaaggttagattagggagcccagcagctcaatggatttcagtttataatgccaggcgacccatgaagcagaggtaccattataacgtggctgactcaaggttaagtcaacatatagaaaagggcaatgaggatggcctgtacattagttgtgtggcttcctcagcaaacctctgggctctcattatggatgcaggaactggtttctgttctcaagtttatgagctctcaccagtttttctgcacaaggactggataatggagcagtgggagaaaagttattacataacagcaattgctggattaaccaatggaagttcattagttgtcatgtccaaaggaactccttacactcagcaatcatacaaggttagcgaatcattcccttacaagtggatcaataaaaagtggaaagaaggtttccatgtaacatctatggccaccgctggaaatcgctggggtgtggtcatgtcaaggaactcaggatattctaatcaggttgtagagttggatttcttgtacccaagcgaaggcatccatcggcgatgggagactggttacaggataacttccacagcggccaccaatgaccaagctgctttcatcttgagcatgccaaagcggaagccgatggatgagacacaggaaacccttcggacctcagccttccccagtggccatgtgaaggagaaatgggcgaagaatctctacatagcttcggtctgctacggacgtactgtgtgctgaccgctcatgtggaggttgaagcgtcggtcatttgttcagcatggtggcatgagctccaagagatgtgagatgttcgtggaaccccaatccccatggtagagaattagtagatgtgaagacgcggtatggtatcctgccgcaattgtaaagaaatgctgtacccgatgccggccgtgagacctttcctcgcatgaagctaacgtatttcggcatg

SEQ ID NO: 31075 - protein, 707 aa, Panicum virgatum
  misc_feature: Ceres CLONE 1903354
  misc_feature (148)..(421): Pfam Name: Pkinase Pfam Description: Protein kinase domain
  misc_feature: SWISSPROT Homolog: EC 2.7.11.1 Non-specific serine/threonine protein kinase
MPKLRSSTRQARLRSKKLEDAQPGEQPVKPAPPAPQRAGKRAPTRAARGRKVTSGRRAPQAPKPKRKGVEIVDLEADPACEDPPKAVARLEVAGAVIKNLGLNKVAEVGANKGLKMEGESGEKIVGADDEFAATPVPERVQVGNSPEYVTERKLGKGGFGQVYVGRRVSGGTARTGPEAYEVALKFEHRNSKGCSYGPPYEWQVYSALNGCYGIPSVHYKGRQGDYYILVMDMLGPSLWDVWNSMGQAMSANMAACIAVESISILEKLHSKGFVHGDVKPENFLLGQAGSPDDKKLYLIDLGLASKWREANGNHVEYDQRPDVFRGTVRYASVHAHLGRTGSRRDDLESLAYTLIFLIRGRLPWQGYQGDTKSFLVCKKKMATSPEMLCCFCPAPFKQFLEIVTNMKFDEEPNYAKLISLFDGLIESPASRPIRIDGALKVGQKRGRLLVNLEEDEQPKKKVRLGSPAAQWISVYNARRPMKQRYHYNVADSRLSQHIEKGNEDGLYISCVASSANLWALIMDAGTGFCSQVYELSPVFLHKDWIMEQWEKSYYITAIAGLTNGSSLVVMSKGTPYTQQSYKVSESFPYKWINKKWKEGFHVTSMATAGNRWGVVMSRNSGYSNQVVELDFLYPSEGIHRRWETGYRITSTAATNDQAAFILSMPKRKPMDETQETLRTSAFPSGHVKEKWAKNLYIASVCYGRTVC

SEQ ID NO: 31076 - DNA, 697 bp, Panicum virgatum
  misc_feature: Ceres CLONE 1903372
  misc_feature: Encodes the peptide sequence at SEQ ID NO. 31077
ctccgccgccccactccccaagccgccaaaccctagcgccgccgccgcaaccatggctgccgtgctcacccgcccggccgcgggcaccgtccagtgcttcggccgcaagaagacggccgtggccgtggcctacaccaagcccgggcgcgggctgatcaaggtgaacggtgtccccatcgagctcatccgcccggagatcctccgcctcaaggccttcgagcccatcatgctcgccgggcgctcccggttcaaggacatcgacatgaggatccgcgtccgcggcggagggaagacgtcgcagatctacgccatccgccaggccgtcgccaaggcgctcgtcgcctacttccagaagtacgtcgacgaggccgccaagaaggaggtcaaggacatcttcggccgctacgaccgcaccctcctcgtcgccgaccccaggcgctgcgagcccaagaagttcggtggtcgcggtgcccgcgccaggttccagaaatcgtaccgttaagcagcgattgcttgacgcgtcacaatctgccatatcactctgggtgtgtgttcttggcttcgtgttcaatcagtggatcaacttatctggttctatatctagctgctgctttaccttcatgtctagacttttaagcctagtgttgaacttttttttttgacattgtgatgtgaaatgtgagagatattcaagaag

SEQ ID NO: 31077 - protein, 149 aa, Panicum virgatum; identical to SEQ ID NO: 25949
  misc_feature: Ceres CLONE 1903372
  misc_feature (17)..(149): Pfam Name: Ribosomal_S9 Pfam Description: Ribosomal protein S9/S16

SEQ ID NO: 31078 - DNA, 574 bp, Panicum virgatum
  misc_feature: Ceres CLONE 1903404
  misc_feature: Encodes the peptide sequence at SEQ ID NO. 31079
gcaaacccttcccctcccccttctagatggagagatagagaagaaaagataagctcagctcagctcgcaagcaagaggtggagatgcggagcccacgaggaggaaggcgcgcccatgagcacgtcgacctgatcccgggcatccccgacgacgtcgccggcgactgcctggcgcgcgtgcccctcgcgccccaccgcgcgctgcgccgtggctgccgcggctggcgggtcgccgccgccgcgccggcctccgcgtccgtggtggtcgtccgcgccagcgcctacgccgatgagctcggcaagactgcgaaaacggtggcgtcgccggggcggggcatccctgccatggacgagtcggacgcgacctgcaggacgcggccggcgtccgtcgggctggagaacacggaagcgaaccggccggcgtaccggacgctgctggtgaccgcgccggggctgggccagtacatcgccggcgccatcctcttcgaggagacgctctaccagtccgccgtcgacggccgcaagatcgtcgacatcctggcggagcacggcatcgtccccgggatcaaggtcga

SEQ ID NO: 31079 - protein, 163 aa, Panicum virgatum
  misc_feature: Ceres CLONE 1903404
  misc_feature: SWISSPROT Homolog: EC 4.1.2.13 Fructose-bisphosphate aldolase
MRSPRGGRRAHEHVDLIPGIPDDVAGDCLARVPLAPHRALRRGCRGWRVAAAAPASASVVVVRASAYADELGKTAKTVASPGRGIPAMDESDATCRTRPASVGLENTEANRPAYRTLLVTAPGLGQYIAGAILFEETLYQSAVDGRKIVDILAEHGIVPGIKV

SEQ ID NO: 31080 - DNA, 710 bp, Panicum virgatum
  misc_feature: Ceres CLONE 1903406
  misc_feature: Encodes the peptide sequence at SEQ ID NO. 31081
aactcgcaggattggatcagtagactctaccgaccactaccagagcaagacagctcccatcctgctgctcgagctcgcagcgcacgctcatggaggacgccatctcccatcctcgcaacacaagagttgccgtggtcaccggcgggaacagaggcatcgggctagaagtgtgccggcagctggctagcaaaggcgtcgccgtcgtcctgacggcggtggacgagaagatgggcgcggaagccgtcgagaagctcaaagggttggcgctgtccgaagtcctttcccaccagctggatatcacggatgcttccagcatcgctcgactggccgatttcttgaagacccggttcgggaagctggatatcctggtgaataatgccgccgtcagtggggttgtgtatcttcaacatcatgctgatggttcagtaactagcggtgaaatggtgagctttacatcttcagctagtcacaccttcatggacgtgttctgctcttctatctgttgttgtgtgcgacagttcaaaggcatggatcgggacgagaggattgaatggatgtggggaaattgccgggagacgtacgacgctgccaaggaaggcctgcagacaaactactacggcacgaagcacgtgaccgaggcgctgctgcctctgctgcaagcctcttccgacggaagaatcgtgaatgtctcctccgactttgggctacta

SEQ ID NO: 31081 - protein, 206 aa, Panicum virgatum
  misc_feature: Ceres CLONE 1903406
  misc_feature (12)..(142): Pfam Name: adh_short Pfam Description: short chain dehydrogenase
  misc_feature: SWISSPROT Homolog: EC 1.1.1.184 Carbonyl reductase (NADPH)
MEDAISHPRNTRVAVVTGGNRGIGLEVCRQLASKGVAVVLTAVDEKMGAEAVEKLKGLALSEVLSHQLDITDASSIARLADFLKTRFGKLDILVNNAAVSGVVYLQHHADGSVTSGEMVSFTSSASHTFMDVFCSSICCCVRQFKGMDRDERIEWMWGNCRETYDAAKEGLQTNYYGTKHVTEALLPLLQASSDGRIVNVSSDFGL

SEQ ID NO: 31082 - DNA, 1809 bp, Panicum virgatum
  misc_feature: Ceres CLONE 1903407
  misc_feature: Encodes the peptide sequence at SEQ ID NO. 31083
acaagaagctatcctccattaaagccgtgtcccaagctcccccttgccccaaatttgcaagaaacccgccgccaccattgcaagaacctcgtaatacctacaatcaaatatttcgcaattccttcacgctggcgttcgaaatggagctccgaatccggctttaatcagagccatcaagcctcccaaaatagggttgaaataggggaagggagcgagaagccatcccatttttagccgttgccgcagctgatcgccgtcgtcgctgctcccaatctgcggccgtcggtgttgtcttcgcctccaatccaccagagcgagcagcaccgaccgagccgatccgctcctcttcttggttcatggtcaacaaatcagctcagcaggaaagatcctcgagtgttcttgcagtcggcagttgcaggggtcaagaattaggaaggaaaccaagaacgcaaggagcagcaggtttgaggacctgtacgggtttatggtggagggcaatgtggatgatgtcaatgtgctaaacgaggtgcgggagaggatcagggaacaagggagggtgtggtgggctctggaggcaaacaagggtgcaaattggtacctacagccaaagatatcctcgaatgagggggtgattagtgtcacatcgctcaagctgtcggtgctcacaaatacaattacattgaggaggttgatcaggaagggtgtgccgccggtgctgaggccaaaggtgtggttatctgtgtcaggagcagccaagaagcggtcaacagtaccagaaacatactatgatgagctgatccgggccacggaagggaagaccacgccagcaacaaggcaaatcgaccatgatcttcctcgtactttcccttgccatccgtggttgaacagtgaggaaggccaggcatctcttcgacgagtacttgtagggtactcattccgtgattcagaagttggatattgccagggcctaaattatgtagctgcactcttgttgctcgttatgaagacagaggaagatgcattttggatgcttgctgtactcctggagaatgtacttgtcagtgattgctatactgacactctttctggatgccatgttgagcagagggtgttcaaagatctcctggctaagaaatgtccaaggattgctgctcatcttgaagcaatggggtttgatgtttcacttgttactacagaatggttcttgtgcctcttttcaaagagcctgccttcagagacaacccttcgagtgtgggatgttttattcaatgaaggagcaaagtttttgttccatgttgctctggcaattttcaagatgagagaagatgatctactacgtatccaacatataggtgatgtgattgatattttgcaaactaccactcatcatctatatgaccctgatgaacttctcacgtttgcatttgacaagattggttcaatgactacaaacacaatcacaaaggagaggaaaaaacaggagacagttgttatggccgagcttgatcaaagaataagacgactgagttcactaaagatggatggatagtgtgtaaaatatgagtttgtgagagtttttagccttgtaggttttgcaaaggtgaatagcacagtcaggatttgacacctggtcagagtgctttgctccagtgagtgaagatcatggacacccgaaactgttggagatgatgcaaaactgcaatgtgggtttgtacacgagttcagacttcatattgtgtgctttttgtgtgctcttgttgtctgccattcatatttcaaagataggggccatggtgttgattttcctcc

SEQ ID NO: 31083 - protein, 354 aa, Panicum virgatum
  misc_feature: Ceres CLONE 1903407
  misc_feature (70)..(286): Pfam Name: TBC Pfam Description: TBC domain
  misc_feature: SWISSPROT Homolog: EC 3.1.2.15 Ubiquitin thiolesterase
MVEGNVDDVNVLNEVRERIREQGRVWWALEANKGANWYLQPKISSNEGVISVTSLKLSVLTNTITLRRLIRKGVPPVLRPKVWLSVSGAAKKRSTVPETYYDELIRATEGKTTPATRQIDHDLPRTFPCHPWLNSEEGQASLRRVLVGYSFRDSEVGYCQGLNYVAALLLLVMKTEEDAFWMLAVLLENVLVSDCYTDTLSGCHVEQRVFKDLLAKKCPRIAAHLEAMGFDVSLVTTEWFLCLFSKSLPSETTLRVWDVLFNEGAKFLFHVALAIFKMREDDLLRIQHIGDVIDILQTTTHHLYDPDELLTFAFDKIGSMTTNTITKERKKQETVVMAELDQRIRRLSSLKMDG

SEQ ID NO: 31084 - DNA, 2041 bp, Panicum virgatum
  misc_feature: Ceres CLONE 1903414
  misc_feature: Encodes the peptide sequence at SEQ ID NO. 31085
agggttgcgcccctgctcagcctcgcctcgcacgcaggctcgcagcctcgcccccgcgatccgacaccgccgacgccccacgcctctaccgccgccgaggcccaccgtctccgccgcctcccctccggcaaagcttaccccggtttgttcgccctgccttgatgcgcgcatcagcaacccccctgtgagaggagggctcgtatcgacatctcagcttgaagcttagggtttagggtgacaagagggtgccacaaaagctaaaagagcagagaagaggcagatcctacatggatgtcatgcagacaagtgactcttcacatcatggaattgtagaaaatagcccatatagaattccgtatagcagaaatgcagaaggcggcaaacttggtaattcgtggtattttagtagaaaagaaatagaagaaaattccctttccaggaaagatggcattgatctgaagaaggagtctcatcttcgcaagacgtactgcgtttttctgcaggatttgggaatgaggcttcaagtgcctcaagttacgattgctacagctatagtgttctgtcatcgttttttccttcgtcaatctcatgcaaaaaatgataggcggacaattgcaacagtttgtatgttcttggcgggaaaagttgaagaaacccccagacctcttagggatgtcatactcctttcttatgagatcattcacaaaaaggatcctgctgcggttcagcgaatcaagcaaaaggaagtatatgaacaacagaaggaacttattttacttggggagcgtgttgttcttgtaacacttggttttgatttgaatatccaccatccgtataagcccttggttgaagcaataaagaaattcaagattgctcaaaatgcacttgctcaagttgcctggaactttgtcaatgatgggctccgcacttcgctttgcctgcaatttaagccccaccatattgcggccggtgcaatcttcctggctgcgaaatttctcaaagtcaagcttccatcagatggcgagaaagtctggtggcaagagtttgatgttaccccacggcatttggaagagattagcaaccaaattttggagctctacgagcaaagtaatgttgcgccaccaccatcgcaaggaaatgatacggataggagccccactagtgttgctaatcaccgtgcgtctgggaaagctccaggaagtgttggtgcacctactgcccatgaacaccatcaagcatccagacagggccagcaaaacatgccaggccaccgtggctatgaccaccctgatccagagaagcaaaactcaaaccagaggacaccacagaatgacgcaagggatggtgctgttaatagcaacgacggtcccaaaatgtcatcctcaatgatggacgcgatgaagaagatagacaaggataaggtgaaagcagccctggagaagcggaggaaatctaaaggtgatgtttctagaaaggttgacatgatggatgatgatgaccttattgagagggagctggagcatggtgtggagttggctgctgagggtgaaaaggtcaagcaggagagaaggcagagttggtcccatccttctgcacaccgggaggaccagcagaaggccgcccgcgtgatgggaactactgaagagggcgagctgtccactgatagccaagaacaccattccccaacccttgacaatcggaggaggaatgacgtccatgagcaccggaactacgaccgtggtgaaagggacattaaaaggctaaggccgtgagacttggaccctccccttcgggggaatttgttgtttgtagtgtattgcacgtggcttcaggctatatatgatgtctgatgtagaacctatttttctgtcacgggcgtcgaataagcatcaagctcattcggtatgctgggagatttgaaatgtggtacatgatgtaagagattgatgtaagagctccccgagggggtagtctatatagcaaacagattgttgtatgtttggagacatccgataacaaaccagatgctccctattactgc

SEQ ID NO: 31085 - protein, 494 aa, Panicum virgatum
  misc_feature: Ceres CLONE 1903414
  misc_feature (35)..(178): Pfam Name: Cyclin_N Pfam Description: Cyclin, N-terminal domain
MDVMQTSDSSHHGIVENSPYRIPYSRNAEGGKLGNSWYFSRKEIEENSLSRKDGIDLKKESHLRKTYCVFLQDLGMRLQVPQVTIATAIVFCHRFFLRQSHAKNDRRTIATVCMFLAGKVEETPRPLRDVILLSYEIIHKKDPAAVQRIKQKEVYEQQKELILLGERVVLVTLGFDLNIHHPYKPLVEAIKKFKIAQNALAQVAWNFVNDGLRTSLCLQFKPHHIAAGAIFLAAKFLKVKLPSDGEKVWWQEFDVTPRHLEEISNQILELYEQSNVAPPPSQGNDTDRSPTSVANHRASGKAPGSVGAPTAHEHHQASRQGQQNMPGHRGYDHPDPEKQNSNQRTPQNDARDGAVNSNDGPKMSSSMMDAMKKIDKDKVKAALEKRRKSKGDVSRKVDMMDDDDLIERELEHGVELAAEGEKVKQERRQSWSHPSAHREDQQKAARVMGTTEEGELSTDSQEHHSPTLDNRRRNDVHEHRNYDRGERDIKRLRP

SEQ ID NO: 31086 - DNA, 719 bp, Panicum virgatum
  misc_feature: Ceres CLONE 1903417
  misc_feature: Encodes the peptide sequence at SEQ ID NO. 31087
tcgctgcgattctctccgctcttcccactcgttagatcccaccgcctcccgctgctcgccgccgccgacgaaccgccgcagcctgacgcagagccgcgtggcggaccatcgcgtgcggcctcgcccaggatggcgaccatggggagcctgatcgggctggtgaaccggatccagcgcgcgtgcaccgtcctcggagatcacggcggcggcggcgagggctcgctctgggaggcgctcccctccgtcgctgtcgtcggtgggcagagttccgggaagtcgtcggtgctcgagagcatagtggggagggacttcctgcctcgtggatctggtattgtgacgaggcggcctctagtgctgcagctgcacaagaccgatggtgggcaggagtatgctgagttcctccacgccccgaggaagcggttcactgactttgctgctgtgaggaaagagattgctgatgaaacagatcgcataactgggaaaactaaggctatttcaaatgttcccatccaattgagtatatattcaccacatgttgttaacttgacactaattgatctccctggactgacaaaggtcgctgtagaggggcaagcagagtctattgttcaagatattgaagacatggttcgatcttatgttgacaagccaaattgcatcatcttggccatctccccagctaaccaagatatagcaacatcagacgccatcaagcttgc

SEQ ID NO: 31087 - protein, 196 aa, Panicum virgatum
  misc_feature: Ceres CLONE 1903417
  misc_feature (39)..(196): Pfam Name: Dynamin_N Pfam Description: Dynamin family
  misc_feature: SWISSPROT Homolog: EC 3.6.5.5 Dynamin GTPase
MATMGSLIGLVNRIQRACTVLGDHGGGGEGSLWEALPSVAVVGGQSSGKSSVLESIVGRDFLPRGSGIVTRRPLVLQLHKTDGGQEYAEFLHAPRKRFTDFAAVRKEIADETDRITGKTKAISNVPIQLSIYSPHVVNLTLIDLPGLTKVAVEGQAESIVQDIEDMVRSYVDKPNCIILAISPANQDIATSDAIKL

SEQ ID NO: 31088 - DNA, 312 bp, Panicum virgatum
  misc_feature: Ceres CLONE 1903420
  misc_feature: Encodes the peptide sequence at SEQ ID NO. 31089
gagcgagcgaccggccgattcgagcagcagcagcagccagctagccatggcgacgcaggccgctctgttcgctgggttctcgcagctcgccgcgcagccggcccgcgaccgcgctgggacgggggcgccggcgcgggtgggcgtggcggcgatcgggggcgccagggcgggcggcgtgaaggcggggggcgccgggcgggtggcgagcgagcaagacctcgctgtgcagtgcccggcccgcctgaccgacccctaccggagccatctggaggccctggcggcgccccatcacggccgcccgcgcccggcgct

SEQ ID NO: 31089 - protein, 88 aa, Panicum virgatum
  misc_feature: Ceres CLONE 1903420
  misc_feature: The sequence is a functional homolog of SEQ ID NO 4 in US patent 7038109
MATQAALFAGFSQLAAQPARDRAGTGAPARVGVAAIGGARAGGVKAGGAGRVASEQDLAVQCPARLTDPYRSHLEALAAPHHGRPRPA

SEQ ID NO: 31090 - DNA, 638 bp, Panicum virgatum
  misc_feature: Ceres CLONE 1903439
  misc_feature: Encodes the peptide sequence at SEQ ID NO. 31091
cccatcttcttccacggcttcttggactcgctgctgttccttggttggtctccttggatctctgactccagccttcatccccccccccccccccacaatctccagttcttagttcttctgcttggaagtggggtgcaggggagaggagaggaggaagcatgggtagcttcgcgaggctggcgaggagggcggtggagacggacgcgccagtcatggtgaagatacaagaactgcttcgaggggctacggacgtgatgtcgcttgcccagggagttgtttactggcaacctcctgagtcagctatgaataagattgaaaaaatcatcagggaaccagcagtcagtagatatggttctgatgatggaattcctgaacttcgtgaagcacttcttgaaaagctacgcagagagaataagcttaccaagtcattagttatggtcactgctggtgcaaatcaggcttttgtgaacttggtcctcactctttgtgatgctggtgattccgttgtcatgtttgcaccatattatttcaacgcctacatgtcattccagatgacaggtgttactgacatattagttggtgcttgcgaccccaagacacttcatcctgatgttgattggttggagaaggttctgaaa

SEQ ID NO: 31091 - protein, 159 aa, Panicum virgatum
  misc_feature: Ceres CLONE 1903439
  misc_feature: SWISSPROT Homolog: EC 2.6.1.1 Aspartate transaminase
  misc_feature: Useful for making plants with modulated nitrogen use efficiency
MGSFARLARRAVETDAPVMVKIQELLRGATDVMSLAQGVVYWQPPESAMNKIEKIIREPAVSRYGSDDGIPELREALLEKLRRENKLTKSLVMVTAGANQAFVNLVLTLCDAGDSVVMFAPYYFNAYMSFQMTGVTDILVGACDPKTLHPDVDWLEKVL

SEQ ID NO: 31092 - DNA, 1151 bp, Panicum virgatum
  misc_feature: Ceres CLONE 1903440
  misc_feature: Encodes the peptide sequence at SEQ ID NO. 31093
cctgtaatttgtcattgttattagaaaaggcagcccaatattcaagtgaagctactatggctgtaatacctgcttcaaactgagagagtgctgctaaatgtagatttgactcttcttatatgacttgctaataaggtgcttgtgtcattagtggtaagcaagaaacatatcataatgtgggttcagaggaagttgcataccttgaagtcagggtcaaatggaatacactgcagatagcggactgaggtggcacttgaaattgccggctcaagtgctagttgctcaatttcattctacagctaatgacacatacctaattgttaactgcttctccaccccatcagaaaaacaggctataaagggctaatcttttttctggctggcaacgtggtaatcgctgtgttcgcttggcttgtcagccaaccagccagcagtattgttctctcatactaaatcagcaccagctaccagccagtcagcagtactgttctctcacaacaaatcagtaccaaccaccagccacagccaagcgaacacagcgaatacaaaaaatggacagcacaaaagatgtttgtgtcatttgataatatttattatcatagcgcatagtgaggttataaaactactacatcttcgattttgatttttgaggcctggttattgtgttaaggtgcaaaagggaggaagcaaaaatcactgcttgggaaaatctacagaaagcaaaagctgaggctgctatacggaagttggagatgaagattgaaaagaaaagatcatcatcaatggacaaaattttaggcaaactccgctctgctcagaagaaagcagaagacatgcgaagtgcggtttcttcaagtcaagatcagtgtggtgtgagggcaaaaaagaaggcatcctcctttgtgaagactggcaagcccttcagctgctgctttacctaccgtgcttgctagttcctagttccagtctagtttttgtggctgtgggtgcagcaatggaatttgatctatttggtgagtttcctcagcattcatataatttaacatctaaaacttccacttagtttcctagttgcatgtagtttatgaatattatccactaaattgttgttttcttgaactaattgctaatgttagaagtgtgtgtctctt

SEQ ID NO: 31093 - protein, 66 aa, Panicum virgatum
  misc_feature: Ceres CLONE 1903440
  misc_feature: The sequence is a functional homolog of SEQ ID NO 933 in the 11/479,226 US patent application
MKIEKKRSSSMDKILGKLRSAQKKAEDMRSAVSSSQDQCGVRAKKKASSFVKTGKPFSCCFTYRAC

SEQ ID NO: 31094 - DNA, 556 bp, Panicum virgatum
  misc_feature: Ceres CLONE 1903444
  misc_feature: Encodes the peptide sequence at SEQ ID NO. 31095
ttactgcttcctcctcaccactaaagagctcccaatcgtctcgccatggccgtatggtaacctccatggatgccatatcagctttctcggccccaagaagcctccagcaggccccggccccgttgcagctccgcccgaacgtcgtgtccttcgtcgcacacccggttcccgcgcacctccatgctggtggccgtggcggccacctcgccggccacgccgccggacctcgccaacaaggtgtccgacaccatcaagccggcgcatgagacgtgcgcggactaccatgagatcggcgagtgtgtggcggcgtgggacgaggtggaggagctcatcacggccgccaaccacgcgcgggaccggaagaaaggcgccgacccgctcaaggagttctgcaagtgacaaccccaagaccgacgagtgccgcatgtatgacgactgagccgcgcgaggctgctcgtcgtgccctccgccgatcgccgtcagactgtcacctgatcaagctggcttagatagagtgacatgaaggaaacatgcgtgaatgtctgatggacctgct

SEQ ID NO: 31095 - protein, 72 aa, Panicum virgatum
  misc_feature: Ceres CLONE 1903444
  misc_feature (16)..(72): Pfam Name: CP12 Pfam Description: CP12 domain
MLVAVAATSPATPPDLANKVSDTIKPAHETCADYHEIGECVAAWDEVEELITAANHARDRKKGADPLKEFCK

SEQ ID NO: 31096 - DNA, 748 bp, Panicum virgatum
  misc_feature: Ceres CLONE 1903457
  misc_feature: Encodes the peptide sequence at SEQ ID NO. 31097
aaaaacctaaaccaaatcctcccccatcgatcccaactcccaccccgagccgcctgctaaccagattcctcgcgcccccctctcgagtcgaggccgcccaatcccagagcccgccgccgcgcttccgccggcgacgaacccggtattttgagtttcggtcgcgagcgcagctatgtccatgttcaacaggatcttcgggaagcccaaggagcaggctaactccaatgcgttggccactctggacaagttaaatgagactcttgatatgctggagaagaaagaaaaggtgctggagaaaaaagcggctgctgagcttgacagggcgaaggagttctcaagagcaaaaaataaaagagcggctattcagtccttgaagaggaaaaaactttatgaacaacaaatcgagcagcttggaaatttccagttgagaatccatgatcagatgatcatgttagaagcagctaaagcgacaacagagactgttgatgcattgaggactggagctgcagctatgaaagcaatgcaaaaagcaacaaatattgatgatgtcgacaagactatggatgaaattaacgaacagactgaaaacatgaaacaaattcaagatgctttatcagctcctcttggagcttctgctgatttcgatgaggatgaactggaagcggaactttgagaactggagggagcagagttggaatctcagcttctggagcctgttgcagctcctccagtgcatccagtgcatgtc

SEQ ID NO: 31097 - protein, 166 aa, Panicum virgatum
  misc_feature: Ceres CLONE 1903457
  misc_feature (21)..(166): Pfam Name: Snf7 Pfam Description: Snf7
MSMFNRIFGKPKEQANSNALATLDKLNETLDMLEKKEKVLEKKAAAELDRAKEFSRAKNKRAAIQSLKRKKLYEQQIEQLGNFQLRIHDQMIMLEAAKATTETVDALRTGAAAMKAMQKATNIDDVDKTMDEINEQTENMKQIQDALSAPLGASADFDEDELEAEL

SEQ ID NO: 31098 - DNA, 1584 bp, Panicum virgatum
  misc_feature: Ceres CLONE 1903472
  misc_feature: Encodes the peptide sequence at SEQ ID NO. 31099
aagtcgtcaaagctgcgtgctcacctcgccttccccttcctcggagcaggaggagcaccgaatccaaggtcgaggcgaaggaaggcccaaacaaaatcagaaaatcgtttcgaaattcccctttgcagcaagttgcggctcgtgctcttgctccctcgaggcgtcttaaccccgttctgcccctgttcgccgtctcgccctcctggcctcctcgggaggcggcggcgagatctgcccgctcccgcgcctgtgagggtttttgtcccgcgatggcgtcgtctgcgaaaatggaggggccatcggccccggcggtccgccgggacccctacgaggtgctcagcgtgccccgggactcctccgaccaggagatcaagtccgcctaccgcaagctcgcactcaagtaccatcctgataagaatgcgagcaatccagaagcatcagaactcttcaaagaagttgcatattcttatagcatcttgtcagatcctgataaaaggaggcaatatgatactgctggttttgaggcgttagaaaatgaaggaatggatatggagattgatttgtccaatcttggaactgtcaacacaatgtttgcagcactttttagcaagcttggagttcctatcaagaccacaatatctcccaccgtgctggaagaggctatgaatggcacagttacagtgagaccactccctgttggaacatcagctactggcaaggttgataagcaatgtgctcatttttttggtgtaacgataattgaagaacaagctcattctggaatagtcgtcagagtcacttcacctgcacaaagtaaatttaagcttctttactttgagcaagaagttaatggaggttatggactcgctttacaggaagatagtcagaagactggcaaggtgacatctgcaggcatgtatttcttgcatttccaggtgtaccgtatggactcaacagtgaatgcgttggcaatggccaaagatcctgaggccgccttctttaaaagattggaaggtctccaaccctgcgaagtgtcggctctcaaacctggaactcatatatttgctgtatatggtgataattttttcaagccagcaagctatatgattgaagcaatgtgtgcaaaaagttatgaagagacaacagagagactgaaggaaatagaatccaaaattctagcaaaaagaaatgatctgcgtcaatttgaaactgagtacagaaaagctttggcacgatttcaagaagtcaccaacagatatacacaagagagagaagcggttgatgatatgctgagagagagggataatatccactgctcattcacaactgaacgaactttggtaaaccctgttggccctggtagtagcagcagtaggtataccacagagcatagcatccctgagagccctgagaatggtagcgtagatggcagagacaaatctggcaaaaagaagtggtttaatctaaaccttaatagatctgacaagaaagcctgaagagtcttgctggaaattgcatgtgtttcacttctttgtgcatttcagaaccttattgtattcatgccttatgagctgtttggttgcc

SEQ ID NO: 31099 - protein, 408 aa, Panicum virgatum
  misc_feature: Ceres CLONE 1903472
  misc_feature (18)..(80): Pfam Name: DnaJ Pfam Description: DnaJ domain
MASSAKMEGPSAPAVRRDPYEVLSVPRDSSDQEIKSAYRKLALKYHPDKNASNPEASELFKEVAYSYSILSDPDKRRQYDTAGFEALENEGMDMEIDLSNLGTVNTMFAALFSKLGVPIKTTISPTVLEEAMNGTVTVRPLPVGTSATGKVDKQCAHFFGVTIIEEQAHSGIVVRVTSPAQSKFKLLYFEQEVNGGYGLALQEDSQKTGKVTSAGMYFLHFQVYRMDSTVNALAMAKDPEAAFFKRLEGLQPCEVSALKPGTHIFAVYGDNFFKPASYMIEAMCAKSYEETTERLKEIESKILAKRNDLRQFETEYRKALARFQEVTNRYTQEREAVDDMLRERDNIHCSFTTERTLVNPVGPGSSSSRYTTEHSIPESPENGSVDGRDKSGKKKWFNLNLNRSDKKA

SEQ ID NO: 31100 - DNA, 1961 bp, Panicum virgatum
  misc_feature: Ceres CLONE 1903479
  misc_feature: Encodes the peptide sequence at SEQ ID NO. 31101
actcactgctgctcctccgtccccaccccagatctagcttgctacctggagagagcgagaggaacgccggccggccggagccatgccggcaatggcagcgctactggtgctgctgctcgccgttgcggcgcccctcgccggcgccgacgacccctaccgctacttcacctggaccgtcacctacggccccatcagcccgctcggcaccacccagcagggcatcctgatcaacggccagttcccgggcccgcgcatcgactgcgtcaccaacgacaacctcctcgtcaccgtcgtcaacaacctcgacgagcccttcctcctcacctggaacggcatcaagcagcgcaagaactcgtggcaggacggcgtggccgggaccaactgccccatcccgcccgccgccaactacacctacaagttccaggccaaggaccagatcggcaccttcacctacttcccctccctcgcgctccaccgcgccgccggcggcttcggcgcgctcaacgtctaccagcgcccccgcatccccgtcccctacccgccgcccgcgggggacttcacgctcctcgtcggggactggtacagggccggccaccgccagctcaggcagagcctcgatgccggcgccccgctcccgccgcccgacggcctgctcatcaatggcgccagctcgccgccggcgttcgtcggcgcccgcggcgggacctacctcttccgcgtctccaacgtcgggctcagggcctccgtcaacgtccggatccagggccaccggctccggctggtggaggtggagggcacccaccccgtgcagaacgcgtacgactccctcgacgtccacgccggccagtcgctcgcgttcctcgtcgcgctcgaccagccgccgctcgactacgccgtcgtcgtgtccacgcgcttcgcccccgccaacctcacggcggtggccacgctgcactacgccggcgccaccgccagggcgccgggcccgctgccgcccggcccgccggggcagtacgactggtccgtcaaccaggcgcgctcgttccggtggaacctcacggccagcgcggcgcgccccaacccgcagggctccttccactacggcgccatcccgacgtccaggacgctggtgctcgcgagctcgtcgccggccctcgccggccggaggcgctgcgcggtcaacggcgtgtccttcgtcgtccccgacacgccgctcaagctcgcggacaactacaacatcgccaacgtcatcgagtgggacagcctcccgccgaggcccgccggcggggcgccgccgcgctccgggacgcccgtcgtcaggctcaacctgcacgagttcgtcgaggtcgtgtyccagaacaccgagaacgagctgcagtcgtggcacctcgacggatacgacttctgggttgttggctacggcgatggccagtggactgagatgcagcggcgaacctacaacttggtcgatgcgcaagcaagacatacggttcaggtgtacccgaacggatggtcggcgatcctggtgtcgctggacaaccaggggatgtggaacctgaggtcggcgatctgggaccggcagtacctcggccagcagctctacctcagggtctggacgccgcagcagagcttctccaacgagtacagcatcccgaccaacgccatactctgtggcagggccgctggcctcccacactgatgagcgagatgcagagagcatacacggtcgattcgtggtactacttataatgtctcataggataaatcattctacttatatagctgaaatcaagatgatagttgagagagtgttttgttgtagccaaaagcttagatgaacttgctattctttgatggcgatgtcagtaatttatttctacttgtgatttgcctgagaggaagaaaggaagtatcaggctgaatctgtccaatgatcttttccctaattaatgcattgttgattc

SEQ ID NO: 31101 - protein, 537 aa, Panicum virgatum
  misc_feature: Ceres CLONE 1903479
  misc_feature (31)..(147): Pfam Name: Cu-oxidase_3 Pfam Description: Multicopper oxidase
  misc_feature (374)..(515): Pfam Name: Cu-oxidase_2 Pfam Description: Multicopper oxidase
  misc_feature (157)..(294): Pfam Name: Cu-oxidase Pfam Description: Multicopper oxidase
  misc_feature: SWISSPROT Homolog: EC 1.10.3.3 L-ascorbate oxidase
  misc_feature (423)..(423): Xaa is any aa, unknown, or other
MPAMAALLVLLLAVAAPLAGADDPYRYFTWTVTYGPISPLGTTQQGILINGQFPGPRIDCVTNDNLLVTVVNNLDEPFLLTWNGIKQRKNSWQDGVAGTNCPIPPAANYTYKFQAKDQIGTFTYFPSLALHRAAGGFGALNVYQRPRIPVPYPPPAGDFTLLVGDWYRAGHRQLRQSLDAGAPLPPPDGLLINGASSPPAFVGARGGTYLFRVSNVGLRASVNVRIQGHRLRLVEVEGTHPVQNAYDSLDVHAGQSLAFLVALDQPPLDYAVVVSTRFAPANLTAVATLHYAGATARAPGPLPPGPPGQYDWSVNQARSFRWNLTASAARPNPQGSFHYGAIPTSRTLVLASSSPALAGRRRCAVNGVSFVVPDTPLKLADNYNIANVIEWDSLPPRPAGGAPPRSGTPVVRLNLHEFVEVVXQNTENELQSWHLDGYDFWVVGYGDGQWTEMQRRTYNLVDAQARHTVQVYPNGWSAILVSLDNQGMWNLRSAIWDRQYLGQQLYLRVWTPQQSFSNEYSIPTNAILCGRAAGLPH

SEQ ID NO: 31102 - DNA, 1024 bp, Panicum virgatum
  misc_feature: Ceres CLONE 1903482
  misc_feature: Encodes the peptide sequence at SEQ ID NO. 31103
gcttctctcgcttcccccacatccgatccggccatcatcctcgtcgacgtcccccatggccacggccgtgcgcgccgtctccctcccgctccctcgccgcgcatcgtcctcagctcccgtggccgccgcccgccgtcccgggtccccgttgctgcgcaggcggcattgcgccgtcgcgcccgtcgcagccacctgcagccctgcgccgccgcggcagctcgacaacgaggagggagggtccgggcccgggcggcggctggtgctcgtggcgggtgctgccgcggccgccgcgtttatttcccggcccaatccagcggcattcgcagcagagtctaagaaggggttcctgcctgtcgtcgacaagaaggctggttactccttcctctacccgttcggctggcaggaagtggccgtgcaagggcaagataaggtgtacaaagatgtgatagaacctctggagagtgtaagcatcaactctattcccacaagcaaggaggacatccgtgaccttggtcctccggataaggttgctgaggccttgataaagaaggtcttagcgccaccaacgcagaagacgaagttaatcgaggcaaaagagaatgatgttgatgggagagcttactatacttttgagttcacagctcaggctccgaactacaccagacatgcactcggtgccatcgtaattgcaaatggcaaattttacacattgaccactggagcaaacgagaggagatgggaaaagatgaaggataggctgcacacagttgtcgattccttcaaaattgaaaatagaatatgaggaatgtctgggttcttgtgctgattttttcttttttgtattgttctcttttggagctgcaatggtgagacctaaatagtaaatgtcgggaatgtgaattgcacctatcagttttttatttctgaatgttttgttcttgaaacacttgtttgtacttggcatgtatatgttttcactatctgtactgtggtcgttggaataaggagatccatacacttgtgg

SEQ ID NO: 31103 - protein, 248 aa, Panicum virgatum
  misc_feature: Ceres CLONE 1903482
  misc_feature (70)..(245): Pfam Name: PsbP Pfam Description: PsbP
MATAVRAVSLPLPRRASSSAPVAAARRPGSPLLRRRHCAVAPVAATCSPAPPRQLDNEEGGSGPGRRLVLVAGAAAAAAFISRPNPAAFAAESKKGFLPVVDKKAGYSFLYPFGWQEVAVQGQDKVYKDVIEPLESVSINSIPTSKEDIRDLGPPDKVAEALIKKVLAPPTQKTKLIEAKENDVDGRAYYTFEFTAQAPNYTRHALGAIVIANGKFYTLTTGANERRWEKMKDRLHTVVDSFKIENRI

SEQ ID NO: 31104 - DNA, 1372 bp, Panicum virgatum
  misc_feature: Ceres CLONE 1903485
  misc_feature: Encodes the peptide sequence at SEQ ID NO. 31105
atacagcgcgcagcagcggccgcgccaccacagcgaacagcgaggcacacctcgactcgagtcgcgagaggcttccctgctcgtcgcccccctccgcctcgcttcgcgttgctctatcgcgcgcgcacccgtccgctccaggtagcttagatcccccgcgggcagccgatcggtggggttccgggcggcggtggtggtggcggcggaggagagggaagcggcgggggccgggagggcggcggggatggctctgctgcgccggcgccggcgcggccggtgacgcccgccgtggcggtcgcctgagaccgccgtgtgtcggggtggacgggggagcgaggcggcgaggacggtgaggttggattggattggattagattgcgcgccgtctgctgaggagagaattgaggttgggagttgtttgtcggtggtgtgggcttgataacttcacggggggagagagctacttgatctgattccttcagcagtagagttgaggtcgttacacaaagggacttcttagggcggtatttgattattttggagctgtgagattctgcactaaacagtccactcttcgatctgggtccatctaagcaaagtatcggaacttcaagctcacttaaactcaggttatagtaagtgtttggccttagcagagttgaagataaggacgggagctaaggtttaaactctgctgacttggtttttgcatacaacagatcaactccagttttcagtagagtaacgacaattggatcaattcaagtaggtgagtggaattgatccttctgaagattctgatccaagttcaattcacgagtagattcgtgaattatataggttttctcgtggaaattgaacactaatttggctgctcttttggggccgggtgcataaatttgaaatattgggagtgctggtgtgatatagaggtctaggaggagatatgaggtactatttgcgttaggtccagcgtttggttggagatatggaaggaggagctctcttgtttatagatgacctcaactccaagtgaccaagcgagcagctgttgaacaatttccttttatttctgtttctttttcctggatttggagatggaggtgaattcctctggtgaggaaatggtggtaaaggtaagaaagccgtacacaataacaaagcaacgcgagcggtggactgaggcagagcacaaacgcttccttgaagccttgaaactttatggcagagcatggcagcgcatagaagagcatgttgggacaaagacggctgtgcagattagaagtcacgctcaaaagttcttcaccaagttggaaaaggaagctatgaacaattggtacttctccggggcaagctcatgacattgacatac

SEQ ID NO: 31105 - protein, 87 aa, Panicum virgatum
  misc_feature: Ceres CLONE 1903485
  misc_feature (24)..(69): Pfam Name: Myb_DNA-binding Pfam Description: Myb-like DNA-binding domain
  misc_feature: Useful for making plants with modulated light response
  misc_feature: The sequence is a functional homolog of SEQ ID NO 1067 in the 11/479,226 US patent application
  misc_feature: The sequence is a functional homolog of SEQ ID NO 146 in the 10/374,780 US patent application
  misc_feature: The sequence is a functional homolog of SEQ ID NO 1806 in the 10/412,699 US patent application
  misc_feature: The sequence is a functional homolog of SEQ ID NO 254 in the 11/375,241 US patent application
  misc_feature: The sequence is a functional homolog of SEQ ID NO 464 in the 10/412,699 US patent application
  misc_feature: The sequence is a functional homolog of SEQ ID NO 794 in the 10/225,066 US patent application
  misc_feature: The sequence is a functional homolog of SEQ ID NO 1096 in the 10/225,066 US patent application
  misc_feature: The sequence is a functional homolog of SEQ ID NO 128 in the 10/412,699 US patent application
  misc_feature: The sequence is a functional homolog of SEQ ID NO 1744 in the 10/412,699 US patent application
  misc_feature: The sequence is a functional homolog of SEQ ID NO 303 in the 11/479,226 US patent application
  misc_feature: The sequence is a functional homolog of SEQ ID NO 34 in the 11/375,241 US patent application
  misc_feature: The sequence is a functional homolog of SEQ ID NO 36 in the 10/374,780 US patent application
  misc_feature: Useful for making plants with modulated flowering time
  misc_feature: The sequence is a functional homolog of SEQ ID NO 156 in the 10/225,066 US patent application
  misc_feature: The sequence is a functional homolog of SEQ ID NO 1636 in the 11/479,226 US patent application
  misc_feature: The sequence is a functional homolog of SEQ ID NO 2560 in the 10/374,780 US patent application
  misc_feature: The sequence is a functional homolog of SEQ ID NO 804 in the 10/412,699 US patent application
  misc_feature: The sequence is a functional homolog of SEQ ID NO 12 in the 10/225,066 US patent application
  misc_feature: The sequence is a functional homolog of SEQ ID NO 1889 in the 11/479,226 US patent application
  misc_feature: The sequence is a functional homolog of SEQ ID NO 2676 in the 10/374,780 US patent application
  misc_feature: The sequence is a functional homolog of SEQ ID NO 390 in the 10/666,642 US patent application
  misc_feature: The sequence is a functional homolog of SEQ ID NO 392 in the 10/666,642 US patent application
  misc_feature: Useful for biocontainment applications
  misc_feature: The sequence is a functional homolog of SEQ ID NO 1049 in the 11/479,226 US patent application
  misc_feature: The sequence is a functional homolog of SEQ ID NO 454 in the 10/412,699 US patent application
  misc_feature: The sequence is a functional homolog of SEQ ID NO 1752 in the 10/412,699 US patent application
  misc_feature: The sequence is a functional homolog of SEQ ID NO 1974 in the 10/374,780 US patent application
  misc_feature: The sequence is a functional homolog of SEQ ID NO 337 in the 11/479,226 US patent application
  misc_feature: The sequence is a functional homolog of SEQ ID NO 146 in the 10/412,699 US patent application
MEVNSSGEEMVVKVRKPYTITKQRERWTEAEHKRFLEALKLYGRAWQRIEEHVGTKTAVQIRSHAQKFFTKLEKEAMNNWYFSGASS

SEQ ID NO: 31106 - DNA, 571 bp, Panicum virgatum
  misc_feature: Ceres CLONE 1903485-R
cagataaaaggccagtctgaagctttgagagttgttgtatcttcagagtctgatgagagtagaaaaggcaacatgtctatccatactgaatttaagatatctcctgtccagaatgctgaagccacacctaccacaggagctgacacaagtgatgcattgaggaataagaaaaagcaggatcgctcttcatgcggctccaacacgccttcaagtagtgatgtagaggcagaaaatgttcctgagaaagaagacaagtctaacgacaaggcaaagcaagcctcctgcagtaactcttcagctggtgacactaatcaccgcaggtttagaagcagtggaagcacaagtgattcatggactttgtgtcaaaagtcatatttacacctaagctattataggacttcagaccttgcaatgcaatgcaatgcttcactaaactccaatttattgtgtgttgtattttaatgcttgcgaagcagcccgtgtagactgcttttaaaccttatcccgtagactctgaattaagcattaggcgactcttgaacttcttggtcaaaaggtatttttccccctt

SEQ ID NO: 31107 - DNA, 1393 bp, Panicum virgatum
  misc_feature: Ceres CLONE 1903488
  misc_feature: Encodes the peptide sequence at SEQ ID NO. 31108
ggcctcacagaaaaatttcggaacttgggcacgcggcgccttcagtttccttccaggcgaagcgaggcgggcacggcggcggtcggcggccgtgtaatccccgacccttctccttccccatccaaatttctcgctcttcttcgtatcctgtcatcggagttcagccagttcgcgaggtcacggtccacgccccacgacgattcgttcaccggcggttctgcacaccccggccgccaacacggtgggaagcggcgcggccgtcgacctctgccgcgggagcagagcggcccaaggcacgcacgccgtcgccggttagcacggtcgtctgatcccgggacaagcttgtgaccatggcggatgagcccaccgccgccgcaggcagcgccggggactcgcacgactaccccaccatcgaccccacatcgttcgacgtcgtgctctgcggcacggggctcccggagtccgtgctcgccgccgcctgcgccgccgccgggaagacggtcctccacgtcgaccccagtccgttctacggctccctctactcctcgatcccgctcccgtccctccagtccctcctctcccccgaccctcccccgtcttcatcgaccgcggcggccgccgccggctccgattcgcgctccgtcgtcgatctctgccgccgcggagtgtactcggaggtcgagacctcggggaccgtccccgagccggcgaggcggttcaccgtcgatctcgtgggcccccgggtgctgtactgcgctgaccaggccgtggacctcctcctgcgctcggggggcagccaccatgtggaattcaagagcgtggacgggggcagcctcctctactgggagggctgcctctaccctgtgccagactcgaagggggccatcttcagggacaccacactcaagctcttggagaagaacgccctctacaagttcttcaatcttgtcaaggcgcacattgctgccacatcagctcctgctgatgagatgggagagggggatgtggctgccatgatgtccgaggagcacctgaaccgcccctttgttgagttccttacgcaacagggcctttctcccaagatgagagcggttgtgctttatgcgattgccatggctgattatgatcaagatggtcctgacccaagtgataaattaattacgacgagggagggaatccagaccattgctctgtactccgcatctattgggaggttttctaatgcagaaggtgctttcatttatcccatgtatgggcatggtgagctacctcaagctttctgtcgctgtgctgcggttaagggtgccctatatgtgttgcggatgccagtggctgcacttcttatggatgaggaaaagaagcattttctaggtgctagattggcatctggtca

SEQ ID NO: 31108 - protein, 347 aa, Panicum virgatum
  misc_feature: Ceres CLONE 1903488
  misc_feature (23)..(347): Pfam Name: GDI Pfam Description: GDP dissociation inhibitor
MADEPTAAAGSAGDSHDYPTIDPTSFDVVLCGTGLPESVLAAACAAAGKTVLHVDPSPFYGSLYSSIPLPSLQSLLSPDPPPSSSTAAAAAGSDSRSVVDLCRRGVYSEVETSGTVPEPARRFTVDLVGPRVLYCADQAVDLLLRSGGSHHVEFKSVDGGSLLYWEGCLYPVPDSKGAIFRDTTLKLLEKNALYKFFNLVKAHIAATSAPADEMGEGDVAAMMSEEHLNRPFVEFLTQQGLSPKMRAVVLYAIAMADYDQDGPDPSDKLITTREGIQTIALYSASIGRFSNAEGAFIYPMYGHGELPQAFCRCAAVKGALYVLRMPVAALLMDEEKKHFLGARLASG

SEQ ID NO: 31109 - DNA, 535 bp, Panicum virgatum
  misc_feature: Ceres CLONE 1903488-R
  misc_feature (99)..(99): n is a, c, t, g, unknown, or other
tagcactgatgatgtgaaaccaacactaatctggagctgtgtgtatgttcaagagatcacacaggaaacgtctgatcctttactatcatgccccatgcntgatgaaaatctggactacaggaacatactggaatcaacaaaaaagttattcgctggtatatatcctgatgaagaattcttgcctaaaaagtcagctcctgtatatactgatgatgactctgattctgcggagtaaaaccatctttagaggcaaaaaatttggctggagaacactgtcacggaatatgcatgaaggcgtcgacctctatcacggtgttccagtgtgtgtcgcaagggttgcacagttgtgttgggattcttgcaaccctcgttgtatacaggatggtgtacgggatacatgccgaacgcttgatatgtcgttgtactagcgcgggggagcaaatctagtacttcttttcccctgagatagttaaacacttgcactgctcagctcatacatacatgatgcagtcagtgtgcaggcttgtgcattccc

SEQ ID NO: 31110 - DNA, 379 bp, Panicum virgatum
  misc_feature: Ceres CLONE 1903501
  misc_feature: Encodes the peptide sequence at SEQ ID NO. 31111
ccaagtcccaaccagccgcgaatccgcgatcgcccccccccaaaacctatggcgatggcgaccgtgaagctgagcccccccgcccgcggcttgctccctggcggccgcccccgcccatccccgcccccccgccgcgccacggtgatccgcgcccccgccggctcctactccgatgagctcgtctcccccgcaaaatctgttgcttcccctgggcgtggtattctggcaattgatgagtcaaatgccacatgcggaaagagattatcatccattggtttggagaacacagaagctaaccgccaggcttacaggcagcttttactgacaactgctggccttggtgaatatatttctggagctatactttttgaggagactc

SEQ ID NO: 31111 - protein, 110 aa, Panicum virgatum
  misc_feature: Ceres CLONE 1903501
  misc_feature: SWISSPROT Homolog: EC 4.1.2.13 Fructose-bisphosphate aldolase
  misc_feature: Useful for making plants with modulated biomass
MAMATVKLSPPARGLLPGGRPRPSPPPRRATVIRAPAGSYSDELVSPAKSVASPGRGILAIDESNATCGKRLSSIGLENTEANRQAYRQLLLTTAGLGEYISGAILFEET

SEQ ID NO: 31112 - DNA, 728 bp, Panicum virgatum
  misc_feature: Ceres CLONE 1903502
  misc_feature: Encodes the peptide sequence at SEQ ID NO. 31113
ttttgctgtccccaaagaatcacagggcaaagttgcagagttttcattccatgggactcctgcaaagataaagcatggcgatgttgtaattgcagctataactagttgcaccaacacgtcaaatcctaatgtaatgctgggagctgctttggttgcgaaaaaggcttgtgaattaggcctagaggtaaagccgtggatcaagacaagccttgcacctggttctggtgttgtgaagaagtacttggataagagtggtctgcagaaatatcttgaccagcttggcttccatattgttggctatggttgcacaacctgcatcggaaattctggagaacttgatgaatctgtgtcagctgcaatttctgaaaatgatattgttgctgctgctgtcttgtctggtaacaggaattttgaaggacgtgtacatccattgaccagagcaaattaccttgcttctcctccactagttgtggcttatgccttggctggcacggttaatattgattttgagaaagaacctattggcatctcgaaagatgggaaagaggtttacttcagggacgtttggccttccacagaagagatagccgaggttgtcaagagcagtgtgctccctgacatgttcaagagcacatatgaggcaatcacaaaaggaaatcctatgtggaatgagctgtcagtctcagcaagcactctctacccatgggatccctcatctacttacatcc

SEQ ID NO: 31113 - protein, 242 aa, Panicum virgatum
  misc_feature: Ceres CLONE 1903502
  misc_feature (1)..(163): Pfam Name: Aconitase Pfam Description: Aconitase family (aconitate hydratase)
  misc_feature: SWISSPROT Homolog: EC 4.2.1.3 Aconitate hydratase
FAVPKESQGKVAEFSFHGTPAKIKHGDVVIAAITSCTNTSNPNVMLGAALVAKKACELGLEVKPWIKTSLAPGSGVVKKYLDKSGLQKYLDQLGFHIVGYGCTTCIGNSGELDESVSAAISENDIVAAAVLSGNRNFEGRVHPLTRANYLASPPLVVAYALAGTVNIDFEKEPIGISKDGKEVYFRDVWPSTEEIAEVVKSSVLPDMFKSTYEAITKGNPMWNELSVSASTLYPWDPSSTYI

SEQ ID NO: 31114 - DNA, 755 bp, Panicum virgatum
  misc_feature: Ceres CLONE 1903525
  misc_feature: Encodes the peptide sequence at SEQ ID NO. 31115
gacttattcctcgccgtcgcttcctatcctaactccaaagtccaaacaagcagcgaatcagcgatcgcacgcaccaaaaacatatggcgatggcgacggtgaagctgagctccccggccgcaggcttgctcgctggcggccgcccccgccgatccgcgcccgcccgccgcgccacggtgatccgcgccgccgccggctcctactccgatgagctcgtctccaccgcaaaatctgttgcttcccctgggcgtggtattctggcaattgatgagtcaaatgcaacatgcggaaagagattatcatccattggtttggagaacacagaagctaaccgccaggcttacaggcagcttttactgacaactgctggccttggtgaatatatttctggagctatactttttgaggagactctttatcaatcaactacagatggcaagaagtttgttgactgcttgaaggatcagaatatcatgcctggcatcaaggttgacaagggtttggttccattgcctggatccaacaatgaatcatggtgccaaggtcttgatggtttggcttcaaggtgtgctgagtactacaagcagggggcacgcttcaccaagtggaggactgttgttagcatcccttgtggtccatctgcattagcagtcaaggaagcagcatgaggacttgctagatatgctgctattgctcaggacaatgggttagtgcctattgtggaaccagagatccttcttgatggagaccatggg

SEQ ID NO: 31115 - protein, 194 aa, Panicum virgatum
  misc_feature: Ceres CLONE 1903525
  misc_feature (43)..(194): Pfam Name: Glycolytic Pfam Description: Fructose-bisphosphate aldolase class-I
  misc_feature: SWISSPROT Homolog: EC 4.1.2.13 Fructose-bisphosphate aldolase
  misc_feature: Useful for making plants with modulated biomass
  misc_feature: Useful for making plants with modulated phosphate use efficiency
MAMATVKLSSPAAGLLAGGRPRRSAPARRATVIRAAAGSYSDELVSTAKSVASPGRGILAIDESNATCGKRLSSIGLENTEANRQAYRQLLLTTAGLGEYISGAILFEETLYQSTTDGKKFVDCLKDQNIMPGIKVDKGLVPLPGSNNESWCQGLDGLASRCAEYYKQGARFTKWRTVVSIPCGPSALAVKEAA

SEQ ID NO: 31116 - DNA, 538 bp, Panicum virgatum
  misc_feature: Ceres CLONE 1903529
  misc_feature: Encodes the peptide sequence at SEQ ID NO. 31117
atcgagcaccgtacagaaaggcgtcttcgcactcgcctctctccgcgactcatagcttccccccctcctcccattcacgaccgacggcgccgccccacccttctaacgactacatgagggagcgcactctcactccttgtcgaataggacggtatccacgtcggagacgcgtgctgggaggtctactgactagagcatggcattcaggctgatggccagatgcccggtgacacgaccgttggaggaggcgatgatgcttacgctcccttcttcagtgagactggggatgggaggcgtggcccccgtgctgtgtttgttgaccgtgaccccactgtgattgatgaggagaggactggcatttaccgcctcctcttccaccttgaccaccgcatcatcggcgaggaggatgctgccaacatctttgaccgtggtcactacaccgttggcaaggagattgttgactggtggctagaccacatcatgaagcttgtcgaccactgtagtggtctcctcggcttccttgtcttccaggctgttg

SEQ ID NO: 31117 - protein, 106 aa, Panicum virgatum
  misc_feature: Ceres CLONE 1903529
  misc_feature: Useful for making plants with altered cell wall content and/or composition
MPGDTTVGGGDDAYAPFFSETGDGRRGPRAVFVDRDPTVIDEERTGIYRLLFHLDHRIIGEEDAANIFDRGHYTVGKEIVDWWLDHIMKLVDHCSGLLGFLVFQAV

SEQ ID NO: 31118 - DNA, 1449 bp, Panicum virgatum
  misc_feature: Ceres CLONE 1903535
  misc_feature: Encodes the peptide sequence at SEQ ID NO. 31119
agggcaccgcggggctgctcactgagtcgctgatcgcttctgcaacaaccgcgacgagcaaccgtgaccggggatcgatggaggtacgcgcccgcgcgcccggcaagatcatcctcgcgggcgagcacgccgtcgtacacggctccgccgccgtcgccgccgccatcgacctctacaccacctcttccctccgcctaggagaggatggcggcgcaggcgccgtggagctggacctcagggactcgggcctcaccttctcttggccgtgctcgcgcgtccgcgcggcgctgggggaggtggccggcaaggccggggcgccgacgccttgctcccccgatgagctggccgcctttgccaagctcttggagggccaagagatccccgaggccaagatctggctctcggccggcctctccgccttccttttcctctacaccgccattttgggctgcaggcctgggaaggcggtggtgacctcggacctgcccattggcgcgggccttggctcgtccgcagcgttctgcgtgtccatgtcaggtgctctattgacggctgctggcgcagttggtgttgcaggaggcagcagtgctgaggagtgggagtcgtttggaaaggatgatcttgagctggtcaaccaatgggcgttccaaggggagaagatcattcatggcaagccttctggcatcgacaattctgtcagcactttcggaagcatgatcaaattcaagaagggggaattgacaaacctcaagtccaggaacccagtcaaaatgctcattaccgatacaagagttggtaggaacacaaaggccctgcttgctggtgtatctgaaagagcatctaggcatccggatgctatggcttctgtcttcaatgcagtgaactctgttagtgaggagctttcaagcgttattgaattagcagctgaggatgaaatagccatcacctcaagggaggacaagctagcagagcttatggagatgaatcaaggtttgcttcagtgcatgggagtcagacattcttctatagaaacagtgttgcgaaccactctgaaatatagcctggtctcaaagctaactggagctggtggtggaggatgtgtgttaactctaataccgacgctattggccaacacagttttggagaaagtcgccacagagcttgaatctcatggttttcgttgctttaaagtcgaggttggtggacgtggtctccaagtaagccgagcataactttcatcctgttccaaggagatgtaccatacttttagaaaatggctcagaagtttagaagattcacaatttgttccaagattaggatattcttctgccttccttaggatattcttgtattcagtattcactacttgaattcccagatgaggatattgtttcactctcttagcattttcttgtatcggataaacactcagctgcatgattgctggtg

SEQ ID NO: 31119 - protein, 384 aa, Panicum virgatum
  misc_feature: Ceres CLONE 1903535
  misc_feature (129)..(212): Pfam Name: GHMP_kinases_N Pfam Description: GHMP kinases N terminal domain
  misc_feature (285)..(364): Pfam Name: GHMP_kinases_C Pfam Description: GHMP kinases C terminal
  misc_feature: SWISSPROT Homolog: EC 2.7.1.36 Mevalonate kinase
MEVRARAPGKIILAGEHAVVHGSAAVAAAIDLYTTSSLRLGEDGGAGAVELDLRDSGLTFSWPCSRVRAALGEVAGKAGAPTPCSPDELAAFAKLLEGQEIPEAKIWLSAGLSAFLFLYTAILGCRPGKAVVTSDLPIGAGLGSSAAFCVSMSGALLTAAGAVGVAGGSSAEEWESFGKDDLELVNQWAFQGEKIIHGKPSGIDNSVSTFGSMIKFKKGELTNLKSRNPVKMLITDTRVGRNTKALLAGVSERASRHPDAMASVFNAVNSVSEELSSVIELAAEDEIAITSREDKLAELMEMNQGLLQCMGVRHSSIETVLRTTLKYSLVSKLTGAGGGGCVLTLIPTLLANTVLEKVATELESHGFRCFKVEVGGRGLQVSRA

SEQ ID NO: 31120 - DNA, 804 bp, Panicum virgatum
  misc_feature: Ceres CLONE 1903540
  misc_feature: Encodes the peptide sequence at SEQ ID NO. 31121
accactagtccactgctccatccggccaccaccgagctccgagcgaagtatccctgccaagtgccgctgcccccccgcgccacctccgcgcccgagggcatgtccgtcgcctcctcccaccacctacgcccggcgccggccggcgcggcgcggcgccctggctgcacggccgccgtggcgctccggcccggcggtgcctggcccccgtcacacggccgctgcgccgtcgcggcggcggcggcctcgggcttckrgtggcsmsgstcccccktccccgccgrcgckgcagcgcggtggcggcggccgcccccagggacagggtgcggggccacacgatttcgatgttcgtcggggacgagagcgtcatgatcaacctgatcgccggggtgttcgccatgagagggtacaacatcgagtcgctcgccgtggggctcaacaaggacaaggcgcttttcaccatcgtcgtctcggggaccgacaaggtgctaaaccaagtcatcgagcagctcaacaagcttgtcaacgtcctcagtgtcgaagatctatctaaacaacctcaggttgaaagagagctgatgcttataaaactaaatgttaaacctgatcagcaccctgaggtcatggttttagttgatattttcagagcaaaaattgttgatatatctgatagcacacttaccatggaggtagctggagatcctggaaaaattgctgcagtggagaggaaccttaagaaatttggaatcaaagaaatttgccgaacggcaaaaattgctttgacacgtgagaagattggcgcgactg

SEQ ID NO: 31121 - protein, 154 aa, Panicum virgatum
  misc_feature: Ceres CLONE 1903540
  misc_feature: SWISSPROT Homolog: EC 2.2.1.6 Acetolactate synthase
MFVGDESVMINLIAGVFAMRGYNIESLAVGLNKDKALFTIVVSGTDKVLNQVIEQLNKLVNVLSVEDLSKQPQVERELMLIKLNVKPDQHPEVMVLVDIFRAKIVDISDSTLTMEVAGDPGKIAAVERNLKKFGIKEICRTAKIALTREKIGAT

SEQ ID NO: 31122 - DNA, 808 bp, Panicum virgatum
  misc_feature: Ceres CLONE 1903540-R
  misc_feature: Encodes the peptide sequence at SEQ ID NO. 31123
gatgaaccaagtacttgatgcccattggggtgttcttgatgatgattcaactggacttcgctcacatacgctctccatccttgtgaatgattgtcctggtgtcctcaacatagtaacaggggtatttgctcgcaggggctacaatatacagagccttgctgttggcccagctgagaaggaaggcatttcacgtattacaacagttgtccctggtactgatgaatccattgagaagttagttcagcagctttacaagcttattgatgtgcatgaggttcatgacattactcactcaccttttgctgaaagggagctgatgcttattaaggtttctgtaaacaccgctgctcggagggagatcctagatattgctgaaatcttccgagcaaaacctgtcgatgtttctgaccacacagttacactgcagctcactggggatcttgacaagatggttgcattgcaaaggttattggagccttatggcatctgtgaggtcgccagaacaggccgtgtggcgctggtccgcgaatccagagtggactccaagtacctccgtggctactctcttccgttgtagcctctggcgtttgtgatgatggcccaggaaatcgcatacctggttgctagagcagaatgtgtaggactcctttgttaggttgtgtgtatctgcaagagttgtttcctccatctcgtcaactccttgactgtcttgcttaattaataatatgctccttggtggatgtaagctgaagttgcatatgtatcccgttgacagtcataataagatacatgtgcatcctcttagttc

SEQ ID NO: 31123 - protein, 191 aa, Panicum virgatum
  misc_feature: Ceres CLONE 1903540-R
  misc_feature (22)..(88): Pfam Name: ACT Pfam Description: ACT domain
  misc_feature: SWISSPROT Homolog: EC 2.2.1.6 Acetolactate synthase
MNQVLDAHWGVLDDDSTGLRSHTLSILVNDCPGVLNIVTGVFARRGYNIQSLAVGPAEKEGISRITTVVPGTDESIEKLVQQLYKLIDVHEVHDITHSPFAERELMLIKVSVNTAARREILDIAEIFRAKPVDVSDHTVTLQLTGDLDKMVALQRLLEPYGICEVARTGRVALVRESRVDSKYLRGYSLPL

SEQ ID NO: 31124 - DNA, 728 bp, Panicum virgatum
  misc_feature: Ceres CLONE 1903572
  misc_feature: Encodes the peptide sequence at SEQ ID NO. 31125
aagctccgctccctccgcctcaattcctccctcctcccctcgcctccttccccatcgcgctcggtccccacctcccgccgcctccgccgccgccgccatgcccccctccactgccgcctcaccgcctcatcctccccatccacttccaccaccaccactacggaagaggcggatgcgaaaagccaggacctttcctccctcctctcctcatcctcctcggacccctccgccgccggcaagaagaagcggccgggcggcagcagcggcgcgtcgagcatcccgtcgggggtgcggctggagggcatctccaagtcctacaagggcgccacggtgctcaaggacgtgtcctgggaggtgcagcgcggcgagaaggtggggctcgtcggcgtgaacggcgccggcaagacgacgcagcttcgcatcatcgcggggctcgaggagcccgacggcggcaccgtcatcaaggccaaggagaacatgaagatcgcgttcctcagccaggagttcgaggtctccgcctcccgcaccgtccgggaggagttcttcagcgccttcgaggaggagatgaaggtcaagcggcggctcgagcaggtgcaggccgcgcttgagggcgccaccgaggacatggacctcatgggccggctcctcgacgagctcgacctcctgcagcggcggtcacaggacgtggacctcgacatggtggacgtcaaggtgcagatgctcatgcc

SEQ ID NO: 31125 - protein, 242 aa, Panicum virgatum
  misc_feature: Ceres CLONE 1903572
  misc_feature (122)..(240): Pfam Name: ABC_tran Pfam Description: ABC transporter
  misc_feature: SWISSPROT Homolog: EC 3.6.3.30 Fe(3+)-transporting ATPase
KLRSLRLNSSLLPSPPSPSRSVPTSRRLRRRRHAPLHCRLTASSSPSTSTTTTTEEADAKSQDLSSLLSSSSSDPSAAGKKKRPGGSSGASSIPSGVRLEGISKSYKGATVLKDVSWEVQRGEKVGLVGVNGAGKTTQLRIIAGLEEPDGGTVIKAKENMKIAFLSQEFEVSASRTVREEFFSAFEEEMKVKRRLEQVQAALEGATEDMDLMGRLLDELDLLQRRSQDVDLDMVDVKVQMLM

SEQ ID NO: 31126 - DNA, 1640 bp, Panicum virgatum
  misc_feature: Ceres CLONE 1903587
  misc_feature: Encodes the peptide sequence at SEQ ID NO. 31127
atgcagctgtcatcccccgcccgaaccctctcttccagcggagcgcgtcccctcctcggctgggctggctggctgctgccttgcttgccatctctcccctctcccctccttccttaacataatcctttgctcttgctgctctctcctgaggttgagagaccggagggagggaggttatggaaagggagaggtataccaggaagccagaggggagggggcaagcgcaggaggtcaggtctctcggcgaagcaatcccactagcagagtccgtgtaggtttagtttcctctcccggcctttccttcgcgcccccccaccctccaaagatacagaacaagatcgatcggggcgctagtagtagtcgaggggagggcagatacgcacggtacgtgcgagcgtgcatcgtcaacataagatggcggcttcgtcgtcgtcctccggcgtcggcgggtccccggcgcaggcgtcgtcctccggcggcggcgggtccccgggccacgcgccccggggcggcggcggcggcggaggcggggggtccggggccccgtaccaccaccaccggtcgcggttcggcgacacgacgctgaccaaggtgttcgtggggggcctggcgtgggagacgccgtccgaggggctgcgccagcacttcgaggcatacggcgagatactcgaggccgtcgtcatcaccgatcgcgagaccggccggtccaagggctacggcttcgtggtcttccgggaccccgactcggcggcgcgggcggtgcagaacccgaacccggtgatcgccgggcggcgcgccaactgcaacattgcggcgttcggcccgccgcggcccgcgcaggcgagaggtagaggaggtggaggaggaggccgcggggcccccgcgcaggatcagccaccgcttgtcgtgccctacaggttgccgtcgcagatgaccccgccgccgcacggccctgccccggtgttctaccatccccagtacgggtactggtacccacctgattatccataccaacaggcattgtacaatcctcaagtgctgcagcagtactacctgcagatgtatggtgcaacctctccttcaggaccaccctaccaatacatggggatgggatacatgcctggtgccccaagtccaaggactagcttctcgccgatgcagcaacctgcacggccaccattcattcagcagacaacagcactgatggagggttctgttccaccagggccttcacttccgcctaatttcagactccagcttccccctcatgcagtatcaagggaatctgataatgcatccggatctcaaccagctccgccaaccgcttctgatgcagctacaagcacaaacaaccaggaagcttcagggcctgtaacgtcaaattcagatccaaacacctcaaactgacttgctgaaaatcctggcaaaacgatctgatgtcaaactgctgcagactattggtggtctgacagagtccatgatactcacatcttgactgaaaaaacatccaaagatttattctttcattatttctgattcttttcgaattcttgcaacgcatttcttcgctgaatccattgtatggccaactgaatttcaagttcaaaattcagaaattcgtcagaatatgttccagtagc

SEQ ID NO: 31127 - protein, 330 aa, Panicum virgatum
  misc_feature: Ceres CLONE 1903587
  misc_feature (60)..(130): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASSSSSGVGGSPAQASSSGGGGSPGHAPRGGGGGGGGGSGAPYHHHRSRFGDTTLTKVFVGGLAWETPSEGLRQHFEAYGEILEAVVITDRETGRSKGYGFVVFRDPDSAARAVQNPNPVIAGRRANCNIAAFGPPRPAQARGRGGGGGGRGAPAQDQPPLVVPYRLPSQMTPPPHGPAPVFYHPQYGYWYPPDYPYQQALYNPQVLQQYYLQMYGATSPSGPPYQYMGMGYMPGAPSPRTSFSPMQQPARPPFIQQTTALMEGSVPPGPSLPPNFRLQLPPHAVSRESDNASGSQPAPPTASDAATSTNNQEASGPVTSNSDPNTSN

SEQ ID NO: 31128 - DNA, 569 bp, Panicum virgatum
  misc_feature: Ceres CLONE 1903603
  misc_feature: Encodes the peptide sequence at SEQ ID NO. 31129
attcggagcgagacccgatcgggggggcaccgggcgtagaatgcgagtacccccaaatccccaccccctcccctccgccgtagaccaccggcggccgccgttcttcgccggagcaccccggcctcagctccgtcccttgtcccctccggcactcgatcccttctgaggccgccgctcgggaccgcccgcatgctcgcatccaaggcactgtggccggcgcggggtggagatccgtccggggtcgaatcaatttcttcgttcgctggtacctaggctctaactatttgtacaaaagctatggaaagttctaaatctcctcaatcatcaaagaagagtcgggttgttatgccttcagatactaatggctctcgagttgacaatgatgacttttcttctgagagtgcatcaaatcaaatggtcgttttccacccagaagcatgagataaagagctagacgaactgggtgaaaaccgctcaaagaaatcatgcataacgagggggatatcaccatccattggggcattcactgtccgatgtgctgaatgtttcacatggagacttattccaac

SEQ ID NO: 31129 - protein, 47 aa, Panicum virgatum
  misc_feature: Ceres CLONE 1903603
  misc_feature: Useful for making plants with altered terpenoid content
MESSKSPQSSKKSRVVMPSDTNGSRVDNDDFSSESASNQMVVFHPEA

SEQ ID NO: 31130 - DNA, 675 bp, Panicum virgatum
  misc_feature: Ceres CLONE 1903633
  misc_feature: Encodes the peptide sequence at SEQ ID NO. 31131
cgcgctgtgaagaaactcaagttcaaaccgaaagtgccaccgcagaagccaaagaaattgaccacggaaacgccacaacaggaagaaccaaaaccaatcgatgaacagttgatgaagatactgaggactcgtcaggtgcctgcaaacagtgcgccaaatacaaaagacaagcgcttgacacagaaacccccctcgacgccaccttctgcagatgttgtcagcttgttgccagctcaatcagcagtgcacaagcaaaatcaatctaagccactccaagtccccggatcctttcctgttactgttaattcaggaaagtttgacaacgaagagagcgattacgatgatgatgacaacgataatgaagatgttgagtttcaggagactcagccaagttcaattgaatgcgaagcttcaacacgtccagcagaggagcttcgtttgcttcaagaacacgatagcaaagaaaggatgttcctcttccagctcccaaaatctcttcctttgcccaggtcctccaatatagttgaaaggaaaggaagggccactggcaaggaggtgaaggaaggatccaaccttcagcagctgcctcagggttatttgggcaaaatgctggtgtacaaaagtggcaaggtcaaaatgaagttaggagatgtcatgtttgatgtgaatccagga

SEQ ID NO: 31131 - protein, 224 aa, Panicum virgatum
  misc_feature: Ceres CLONE 1903633
  misc_feature (153)..(223): Pfam Name: RNA_pol_Rpc4 Pfam Description: RNA polymerase III RPC4
RAVKKLKFKPKVPPQKPKKLTTETPQQEEPKPIDEQLMKILRTRQVPANSAPNTKDKRLTQKPPSTPPSADVVSLLPAQSAVHKQNQSKPLQVPGSFPVTVNSGKFDNEESDYDDDDNDNEDVEFQETQPSSIECEASTRPAEELRLLQEHDSKERMFLFQLPKSLPLPRSSNIVERKGRATGKEVKEGSNLQQLPQGYLGKMLVYKSGKVKMKLGDVMFDVNP

SEQ ID NO: 31132 - DNA, 524 bp, Panicum virgatum
  misc_feature: Ceres CLONE 1903646
  misc_feature: Encodes the peptide sequence at SEQ ID NO. 31133
aacccctgagccgagggggcggaggatatggtagcacttgccgaccacctccaccaccgcctcctctccttctcccccgcagccgctccaacagctcgccgccgcctctcctcgctccccttctccccgcggccttcgtcccatggcggtttccgctccagcacgcgcgcctggggcggcggcggcaccagcagcgcggcggccccactcgccgcggcggccacgtcggcgtcgctgtccctggaggagctgcgccggggctgccccacctggacgaggcgcgggatgcgcgcgaactacctcggccggggacagggcccgcccggccggctcgtccacggcttcggcgcctccgtcgcgcactggcgcaggaacattggggagctgtctgaatcccacaccgtctacgcgatcgacttgctggggttccgcgcctcggacaaacctgctggattttcgtacacgatggagagctgggctgaggtgatactggacctcgtgaacgaggacgtgaacaggcccac

SEQ ID NO: 31133 - protein, 165 aa, Panicum virgatum
  misc_feature: Ceres CLONE 1903646
  misc_feature: SWISSPROT Homolog: EC 3.8.1.3 Haloacetate dehalogenase
MVALADHLHHRLLSFSPAAAPTARRRLSSLPFSPRPSSHGGFRSSTRAWGGGGTSSAAAPLAAAATSASLSLEELRRGCPTWTRRGMRANYLGRGQGPPGRLVHGFGASVAHWRRNIGELSESHTVYAIDLLGFRASDKPAGFSYTMESWAEVILDLVNEDVNRP

SEQ ID NO: 31134 - DNA, 699 bp, Panicum virgatum
  misc_feature: Ceres CLONE 1903658
  misc_feature: Encodes the peptide sequence at SEQ ID NO. 31135
ggagtctcggagagatgcggggaatcggaggtccgctcctcaccatcggggatctcctcagcgacctcgccgtcgacggcggcgataatcccctcgccgctggcggagatgcgtccgttccctcctctccctcggcggcacaacaggcgggggaagccgacccgtccgacctcagccggctcttcgaggttaggtcttggttccgtttttctccccatgttctcgatccggtttgtcatccatgatccatcgtatgctgctacttgtatactcctcgatttttggaataaatcatcccaatttggcccggaaggtcgtgggttcgatccggggggggggccgcctccggttaaaaaaaaacccctcgcctgtctcatgtccaaatcactgtggagcctggcctatcccacaacgcgacgagcccccgtgtacgggtggggtaggggttcgggggttttcttggcctgctgtgagaatgtcattctacctctcaaacaatgccgtggggcggtcttagccccgcaggtcaagttttttttttaaatcatcccaatttggagctgaacaagtgacaagtgattcgtatcttttagttttcgattaggcacccggcttcccccacgaatgtggcagcgacaattttagtttacttgatttcatggggattaaaaaaatatacggcttagaagagaacggctc

SEQ ID NO: 31135 - protein, 76 aa, Panicum virgatum
  misc_feature: Ceres CLONE 1903658
  misc_feature: Useful for biocontainment applications
MRGIGGPLLTIGDLLSDLAVDGGDNPLAAGGDASVPSSPSAAQQAGEADPSDLSRLFEVRSWFRFSPHVLDPVCHP

SEQ ID NO: 31136 - DNA, 1555 bp, Panicum virgatum
  misc_feature: Ceres CLONE 1903663
  misc_feature: Encodes the peptide sequence at SEQ ID NO. 31137
gcctcagcctcgctgcctcgctttccccaaatccgccgcggactccagagctcggaggagagacgagacgacccaagcaagacttcgccgcgcctttgcttcctgcgcaattcttgcggcgtgccgcgccttttttcctttttctttccatggacagcgactacgttgccagcctgctcatgggccactctgccgccccggggctcgacttcgccgcgctggacggcggcttcctcgacgctctctgcggcgccggcgccggcctgttcggggcgcccggggtcgcggcaggggccggcggcggcgggtccccggaggggtcctcggtgtcggacccggcgtgggcgcgcgccagggacagcggcatgccaggaaacggaaggcgcctccagccggtaccgccaacgggaaagaagcctgcttgggcaaggtgtgggaaacgaccagcgcggctggagagcccaagggtccggacgggaagaaggccagagtgggcgccggcgggagccccgtgaagccgaaggtagaggaggcgacggcgagcgacggctctgttgaagacaaagggcagaaaaagggcaagggaaagagcgccaagccgccggtcgagccgcccaaggactacgtccatgtccgggcgcggcgagggcaggcgactgacagccacagccttgccgagagggttcgaagagagaagattagccagaggatgaaatttcttcaggacctcgtgccagggtgcaacaaggtggttggcaaggcactcatgcttgacgagatcataaactatgtgcaatcacttcagcagcaagttgagttcctgtccatgaagcttgcgaccgtgaatccacaacttgacttcagcaacctttctacactcctacacaaagacatgtaccaagcatgtggcccttcagtgaattccgtctttccactggaaagtgccggtgcagcttttccattttgcaaccaggcagatcttttccagtcgtttggttcgggtgctatggaggatcagtgctccctaagtctgttagacacggctctaccccacacaaccaacccacagtttgcttttcaaaagcagcaaagggacttctgggaggatggcctacagaacgctttgcctattgtgagtgagcaaggccaggagaatgtggtttcagcaccgagttttgatggtcagttacaagctgatcagacaaagatcgagttctaggctcttgtgatcttcaaggttgatatttttgtatatagggagtatgaagacctgtggcaagtgaaactctcctaagctgaccatcattagagtttaggcctgtgaactgattcattccatgatatgctggatgtacggcaactcagattcttctcgtaaggatcatatgatctcgcatgattaaagtagatcgtgtaatagatatggtgcaaatattacatgcaccatcttctaaaatttctactaatatgtaagaacgctggctggtattgggatgataccatgtactgttgcattttatcttaagacgaaaaatcaacgaattggatctctctc

SEQ ID NO: 31137 - protein, 405 aa, Panicum virgatum
  misc_feature: Ceres CLONE 1903663
  misc_feature (218)..(268): Pfam Name: HLH Pfam Description: Helix-loop-helix DNA-binding domain
  misc_feature: Useful for making plants with altered lignin content
  misc_feature: The sequence is a functional homolog of SEQ ID NO 1930 in the 10/374,780 US patent application
  misc_feature: Useful for making plants with modulated biomass
  misc_feature: The sequence is a functional homolog of SEQ ID NO 186 in the 10/714,887 US patent application
  misc_feature: The sequence is a functional homolog of SEQ ID NO 186 in the 11/435,388 US patent application
PQPRCLAFPKSAADSRARRRDETTQARLRRAFASCAILAACRAFFPFSFHGQRLRCQPAHGPLCRPGARLRRAGRRLPRRSLRRRRRPVRGARGRGRGRRRRVPGGVLGVGPGVGARQGQRHARKRKAPPAGTANGKEACLGKVWETTSAAGEPKGPDGKKARVGAGGSPVKPKVEEATASDGSVEDKGQKKGKGKSAKPPVEPPKDYVHVRARRGQATDSHSLAERVRREKISQRMKFLQDLVPGCNKVVGKALMLDEIINYVQSLQQQVEFLSMKLATVNPQLDFSNLSTLLHKDMYQACGPSVNSVFPLESAGAAFPFCNQADLFQSFGSGAMEDQCSLSLLDTALPHTTNPQFAFQKQQRDFWEDGLQNALPIVSEQGQENVVSAPSFDGQLQADQTKIEF

SEQ ID NO: 31138 - DNA, 505 bp, Panicum virgatum
  misc_feature: Ceres CLONE 1903671
  misc_feature: Encodes the peptide sequence at SEQ ID NO. 31139
accgaccgaaccccatcgtacccaccagcacgagagaagcatgagcaccggcggcgcggacaagcccggcagcgccggcgccggcggcggcgccgtgaagacgccgtccgacttcctcaagtccatccggggccgccccgtcgtcgtcaagctcaactccggcgtggactacagaggtattctggcttgcctggacggttatatgaacattgcgatggagcagaccgaggaatacgtaaatggtcagctgaagaacaagtatggcgacgccttcataagaggcaacaacgttttatacatcagcacatcaaagcggacagtcactgatggcgcatagacccaagtgaagccctcccgtttctatcgtgtaactccaaagccattaacttggttgcactctgactcgatcctacctttcaatctctgtatttgctgtctgcagtctgggaaagggaagatatatcagatgctattcttgatgtaactggcatttagccttcaccgg

SEQ ID NO: 31139 - protein, 98 aa, Panicum virgatum
  misc_feature: Ceres CLONE 1903671
  misc_feature (24)..(89): Pfam Name: LSM Pfam Description: LSM domain
MSTGGADKPGSAGAGGGAVKTPSDFLKSIRGRPVVVKLNSGVDYRGILACLDGYMNIAMEQTEEYVNGQLKNKYGDAFIRGNNVLYISTSKRTVTDGA

SEQ ID NO: 31140 - DNA, 1789 bp, Panicum virgatum
  misc_feature: Ceres CLONE 1903675
  misc_feature: Encodes the peptide sequence at SEQ ID NO. 31141
actcctccagtaacttcgtcaatgaccatctcaaaaaaaaaacttcgtcaatgacagagagaggggggaaacgaggagccgagcaccggcgcagccaaggcgaaggcgtcagtagcttcttccggttgcctccgtcccggcggcgtcttctccggtcgggctttttgtccggcgagcctctccgccaggaagaggccgtggcgctcgagggagtgctccaggcactagatggagctcgacgtgaaaggaaagcgggcccgtgcaagaagcagcagcagcagcggcggcggcggcttgaccggcggcgaccggctgagctccctgccggattgcctcatccaccacatcatgtccttcatgaaggcccgccaggtggtgcagacctgcgtgctgtccaccaggtggaagcacctctggcgctccgtcccctgcctcgacatcgaccaagaggagttcaagactggtgaagactcggaccacgagtgggagaaatttgaggacttcaccgaccacctgcttatccctaataatatttccattgcgctcttggatacattccgtctacatgttaaatcttattgggctcgtcatgcagccagatggatccgtcatggcataaagtacagcacccgggaacctggcatgcagcaccagggattgagctcgaactcctggcgcctaagaaggctatatcttaacaacttatatttggattacaatttcacagagcatgtcagttcggggtgccaaaatttggagaatttggagctgaaaagttgcaggtgtacattttatgagatcagctcccactcactagagaacttgattctgaaaaattgcgagttcagtgaactttctgcaattacatcaccggcgctgaagagcttggtttttgagagctgcaacagcttctgctatgaacgactttactctctgctggttatcactgcccctgctgttgcttatctgctcctggacgtggacgcttacctgcttgacggtggtgtctcattagaggatatgccatctcttggcaaggcctcgatcaaaataaggagtaataaggaagaaagtaaactcagccaggatcaaatcaagcttctttgcagtgtgtctaatgtcacaagtttggtgttgttgggtttcgagacaatggtgcatggtgaggatcaggttgcattcccgaacttcaggaatcttaggaccttatttctggacaactgtgatctttgtgataacttcaagacattagaacattttctgaagaattcaccagatctggagaagctaacccttcgctgctgtaagttttcaaaagatcttaagaagaaaaaggccaagtcaaagagggcatcttcttcccagtgtctcaacttggtggatatccactgtgagaatctcaagcacactgaaatcatatataaagatgatgatgtccgccagctggttgagcttttgttgagcatttcagcaaacctgccgaacaataatataaaacttaccaaagtggactagtattatcatcagttcagatcttcacgttctaggctcactgaattttgtatgcttgccctgctgtaatagcctagtggtggtaccatgtaccttttgacctgttccaagatgatttatgggctaaggcttttgctctatggactatggtattgatttttagccgtttctcttgacacatgtatcctttgtttaggacttaaggtgatgtactgcttcttgctcttaaagttttgaaactaaaatccttagttcacattatcagcttttctatctc

SEQ ID NO: 31141 - protein, 428 aa, Panicum virgatum
  misc_feature: Ceres CLONE 1903675
  misc_feature (27)..(74): Pfam Name: F-box Pfam Description: F-box domain
MELDVKGKRARARSSSSSGGGGLTGGDRLSSLPDCLIHHIMSFMKARQVVQTCVLSTRWKHLWRSVPCLDIDQEEFKTGEDSDHEWEKFEDFTDHLLIPNNISIALLDTFRLHVKSYWARHAARWIRHGIKYSTREPGMQHQGLSSNSWRLRRLYLNNLYLDYNFTEHVSSGCQNLENLELKSCRCTFYEISSHSLENLILKNCEFSELSAITSPALKSLVFESCNSFCYERLYSLLVITAPAVAYLLLDVDAYLLDGGVSLEDMPSLGKASIKIRSNKEESKLSQDQIKLLCSVSNVTSLVLLGFETMVHGEDQVAFPNFRNLRTLFLDNCDLCDNFKTLEHFLKNSPDLEKLTLRCCKFSKDLKKKKAKSKRASSSQCLNLVDIHCENLKHTEIIYKDDDVRQLVELLLSISANLPNNNIKLTKVD

SEQ ID NO: 31142 - DNA, 1976 bp, Panicum virgatum
  misc_feature: Ceres CLONE 1903695
  misc_feature: Encodes the peptide sequence at SEQ ID NO. 31143
aggggacgcacgtcttgctaaacacgaagaagcgccgctctcccctagcttcccccaaaccccaaccatggcagccgccgccgaccgcgccgccgaccaaaaccctaagcctagggacgccgagacccacgtgcccgccgccgaaaccgagcctgagttcgcggaggggtacgaagaggatggagaggaggagtacgaagaggatggggaggagtacgaggacgacgaggaggagctggacgggcccgcggccgcggcggcggagcgggagcgggtgcagtccgtgtttaagcggctctcgtcggaccccgtggccattcgcgtccacgacgtggtcatcaagggcaacaccaagacgcgggacgagctcatcgaggcggaggtcgccgacctgctccgcgccgcgcccaccgtgcaggaactgctccgcgccgccagcgtcgccacctcgcggctgcacaggctcgacgtcttcgatgccgtcaagatcacgctcgacgcggggccgcccgagctgcccggcaccaccaacgtcgtaatcgaggtcgtcgaggccgccaatcccctcaccggtagcgccggcgtctactcgaagcccgaggcaagatcttggtcgttggaagggtcacttaagttgaagaatttgttcggctatggtgacatctgggatgcatcaggttcatatggttgggaccaaactacagaggttggagttggagtctacctaccaaggtttaaatctgtaccaacaccattgatggcccgggcatctttgtcatcacaagattggctgaagttttcatcatacaaggagcgtctacttggcctttcattcggtttgctttcgacaatgaaccatgacttgtcttacaaccttacatggcgtgccttaactgatccttcgcgcgcttcatcaaaggccataagaaggcagttagggcataaccttctttctgcactgaagtacacatacaagatcgatcagagggattcacttctcaggccaacaaaaggatacgcatttcagtcaacttctcaagttggtggtctatgggataacaagggcttgaaattttttcggcaggagtttgatgtccgtggtgctgtgcctttgggattttataatgctgctctaaatgttggcataggagcgggtgtcattttaccacttggacgggggttcatgaattcgtcttcacctgtgcctgataggtttttccttggaggtcattcttctccagtttgcagcctgggtgggctgtcatccctgctgggttttaggacaagaggagttggccccacagaagcacggaggcttgtccccagtgaatcagacagtgactctgctgcctctccaggaagggattacttgggaggtgatctggctgtgtctgcctttgctgacctttcttttgatctgcctctcaagttattcagagatgctggaatccatggtcatgcatttctcactgctgggaaccttgcaaagttgtcggagggggagtacaagaatttctcagtttctgaatttcagcgcacatttaggagctctgctggtgttggcattattttgcctactaaacttttccgggtggaggtgaactattgttacattctaaagcaagctgagcatgacagtggaaagactggaatccagttcagcttctcgtcccccatgtagagacctgccatgaaatgttttgcagccaaagtagcttctctttcccctgtagacttgtgttcgtccattgttcttgtcttactgaagcgattgcaaaacaaccgtagtcgcatgtcgtcggcttttcttttcttttgacgcttgtttggcatgaggagcctgagcctagatttgctcattctttttggtgtctgcaaagttacttccctattctgacacgaaggatttgtccttcacaacccaaatactgcaaatggtggaatgaataaaattttgggccaagaatgtttacacc

SEQ ID NO: 31143 - protein, 537 aa, Panicum virgatum
  misc_feature: Ceres CLONE 1903695
  misc_feature (192)..(537): Pfam Name: Bac_surface_Ag Pfam Description: Surface antigen
MAAAADRAADQNPKPRDAETHVPAAETEPEFAEGYEEDGEEEYEEDGEEYEDDEEELDGPAAAAAERERVQSVFKRLSSDPVAIRVHDVVIKGNTKTRDELIEAEVADLLRAAPTVQELLRAASVATSRLHRLDVFDAVKITLDAGPPELPGTTNVVIEVVEAANPLTGSAGVYSKPEARSWSLEGSLKLKNLFGYGDIWDASGSYGWDQTTEVGVGVYLPRFKSVPTPLMARASLSSQDWLKFSSYKERLLGLSFGLLSTMNHDLSYNLTWRALTDPSRASSKAIRRQLGHNLLSALKYTYKIDQRDSLLRPTKGYAFQSTSQVGGLWDNKGLKFFRQEFDVRGAVPLGFYNAALNVGIGAGVILPLGRGFMNSSSPVPDRFFLGGHSSPVCSLGGLSSLLGFRTRGVGPTEARRLVPSESDSDSAASPGRDYLGGDLAVSAFADLSFDLPLKLFRDAGIHGHAFLTAGNLAKLSEGEYKNFSVSEFQRTFRSSAGVGIILPTKLFRVEVNYCYILKQAEHDSGKTGIQFSFSSPM

SEQ ID NO: 31144 - DNA, 572 bp, Panicum virgatum
  misc_feature: Ceres CLONE 1903703
  misc_feature: Encodes the peptide sequence at SEQ ID NO. 31145
aagaaccgaaatccccccctagtctcccaggctccaaatcccgagctagcagccctggcagagcgcgcccaaggcctcccagccctcctcctctgcctctgcctcctgctactgtcctccgagcacctggcgatgagcatggacctagacggcgacggcttctttcacgtccgcctcgacgacgacggcagcttctccgacgaggtggcagctgcaccggcccggcacctcagcggcgacagcttcagcgtcctgagcagcaacacctcctccaacaagtccggttcggccttctgcaggctactgtcgctgcagatactggacctatccaacaacctgctcaccggggagctgccgggctgctggtgggagatgcaggccttgcagttcatggacctgtccaacaactctttctcaggtgtgatccctgaagccccaccgtcccacagctgttcgcttgaatcactccatctcgccggcaatggcttcacggggtccttcccatcggtcgtcaaggggtgtgaatctctggccactctagatatcgggaacaaccagttctttggtaggat

SEQ ID NO: 31145 - protein, 190 aa, Panicum virgatum
  misc_feature: Ceres CLONE 1903703
  misc_feature: SWISSPROT Homolog: EC 2.7.11.1 Non-specific serine/threonine protein kinase
KNRNPPLVSQAPNPELAALAERAQGLPALLLCLCLLLLSSEHLAMSMDLDGDGFFHVRLDDDGSFSDEVAAAPARHLSGDSFSVLSSNTSSNKSGSAFCRLLSLQILDLSNNLLTGELPGCWWEMQALQFMDLSNNSFSGVIPEAPPSHSCSLESLHLAGNGFTGSFPSVVKGCESLATLDIGNNQFFGR

SEQ ID NO: 31146 - DNA, 408 bp, Panicum virgatum
  misc_feature: Ceres CLONE 1903704
  misc_feature: Encodes the peptide sequence at SEQ ID NO. 31147
atcgccacaagttcgcgatctctcgatttcacaaatcgccgagaagacccgagcagagaagttccctccgatcgccttgccaagatgcagatctttgtgaagaacctccctggcaacaccatcaccctgtggagtggagtctctctcgagacaattgtgaatgtgcagggccagagctccaggacagggaggggtattcctcaccaccagcagcgccttatcttcgctggccagccgcttgaggatggccgtacacttgcagattacaacattcagaaggagtccacactgcaccttgtcctcaggctgcgtggaggcatgcagattttcgtgaagaccctcactggcaagacgatcaccctggaggtggagtcatctgacaccctcgacgatgtgaaggcaaagatc

SEQ ID NO: 31147 - protein, 135 aa, Panicum virgatum
  misc_feature: Ceres CLONE 1903704
  misc_feature (34)..(104): Pfam Name: ubiquitin Pfam Description: Ubiquitin family
  misc_feature: Useful for making plants with modulated nitrogen use efficiency
  misc_feature: Useful for making plants with modulated cold sensitivity
IATSSRSLDFTNRREDPSREVPSDRLAKMQIFVKNLPGNTITLWSGVSLETIVNVQGQSSRTGRGIPHHQQRLIFAGQPLEDGRTLADYNIQKESTLHLVLRLRGGMQIFVKTLTGKTITLEVESSDTLDDVKAK

SEQ ID NO: 31148 - DNA, 737 bp, Panicum virgatum
  misc_feature: Ceres CLONE 1903715
  misc_feature: Encodes the peptide sequence at SEQ ID NO. 31149
aaggcgctgcccgagcccgaccaggcgcccgccctcacgagcgccgccgctggccgtcaccggcaacgcgccgccacccgtcggcaaggaggagcgccggctgcaatctccgcagagttgctgcgtgctctgggtggcgtgaaagcttcagcgtcacttttaggggtccctcttggtcacaactcatcctttctacaaggccctgcatttgctcctccccgcataagggaggccatttggtgtggaagcacaaactctagcacagaagaaggcaaagaattgaatgatcctcgggtgctaactgatgttggtgatgtccccattcaagagatccgtgactgtggtgtcgaagatgacagattgatgcatgtaattagtgagtctgtcaaaacagtgatggaggaggagcctcttcgaccgttggtgttaggaggcgatcactcaatatcctatccagtggttagagctgtgtctgaaaagcttggaggacctgttgacattcttcatcttgacgcacatccagatatctatgattgttttgaaggaaacacttattcacatgcctcttcatttgctagaataatggaaggtggttatgccaggagacttctacaggttggattaagatcgattacgaaagaaggacgtgaccaagggaagagatttggcgtggaacagtatgagatgcggaccttctcaaggaccgcgagaagcttgagatctgaaacttggggaaa

SEQ ID NO: 31149 - protein, 245 aa, Panicum virgatum
  misc_feature: Ceres CLONE 1903715
  misc_feature (47)..(244): Pfam Name: Arginase Pfam Description: Arginase family
  misc_feature: SWISSPROT Homolog: EC 3.5.3.1 Arginase
KALPEPDQAPALTSAAAGRHRQRAATRRQGGAPAAISAELLRALGGVKASASLLGVPLGHNSSFLQGPAFAPPRIREAIWCGSTNSSTEEGKELNDPRVLTDVGDVPIQEIRDCGVEDDRLMHVISESVKTVMEEEPLRPLVLGGDHSISYPVVRAVSEKLGGPVDILHLDAHPDIYDCFEGNTYSHASSFARIMEGGYARRLLQVGLRSITKEGRDQGKRFGVEQYEMRTFSRTARSLRSETWG

SEQ ID NO: 31150 - DNA, 753 bp, Panicum virgatum
  misc_feature: Ceres CLONE 1903718
  misc_feature: Encodes the peptide sequence at SEQ ID NO. 31151
agatgccgagcgggtggagctcttgccgcgctcccgcgtcctcggcaaacgcacacccactaagctgagggctgaagctgagccagggcggatatcctagctagcacgtcgtcgcagagaccaacacaacacccgcttgccgccagcatgcaggagttccagtccatcccgggcctggcggggcggctgttcggcggggccgcggcggcggacctccggcgcgcgcaggcgcagcagggccccggggcgcggtgcggcggcggggtgtcgccggcggccgaggcggtcaagtgcccgcggtgcgagtccaccaacaccaagttctgctactacaacaactacaacctgtcgcagccgcgccacttctgcaagagctgccgccggtactggaccaagggcggcgtcctccgcaacgtccccgtcggtggcggctgccgcaaggccaagcgctcgtcgtcgtcgtcgtcctcgaccgcctcctccgggccgtccacccccacgtcggccgcggacgccaagaacccgcgccgcgcctcggcgtcctcgccgcgctccaacagcggcagcggcagcgccagccccacggccgccgcgacgccggccccgacaccgaccccgaccacgccgtcgtccaacaacgccgcctccctcacgagccacaacgcgaaccccttctcgacggtcgacgtggcgccgccggagccgatattcgccgaacaggctgccgcgctggcgtccctcttcgcgccgccc

SEQ ID NO: 31151 - protein, 201 aa, Panicum virgatum
  misc_feature: Ceres CLONE 1903718
  misc_feature (42)..(104): Pfam Name: zf-Dof Pfam Description: Dof domain, zinc finger
  misc_feature: Useful for making plants with modulated nitrogen use efficiency
MQEFQSIPGLAGRLFGGAAAADLRRAQAQQGPGARCGGGVSPAAEAVKCPRCESTNTKFCYYNNYNLSQPRHFCKSCRRYWTKGGVLRNVPVGGGCRKAKRSSSSSSSTASSGPSTPTSAADAKNPRRASASSPRSNSGSGSASPTAAATPAPTPTPTTPSSNNAASLTSHNANPFSTVDVAPPEPIFAEQAAALASLFAP

SEQ ID NO: 31152 - DNA, 767 bp, Panicum virgatum
  misc_feature: Ceres CLONE 1903735
  misc_feature: Encodes the peptide sequence at SEQ ID NO. 31153
gaatcgcactgcgtcacttctgattcgtttggcgatttgggccgttgtttgctaggatttttgtcagtttttcttattgcgtcgttttcgcgatgtagccgggtgaagatgagagagatcttgcacatccagggtgggcaatgtggcaaccagattggtgccaagttctgggaagtggtgtgcgatgagcacggcattgaccctaccgggcggtacactggcaactctgacctgcagttggagcgtgtcaatgtctactacaatgaggcctcctgtggccgctttgtgccccgtgctgttctcatggaccttgagcctgggacaatggacagtgtccgcactggaccctatgggcagatcttccgccctgacaactttgtgtttgggcaatctggagctggtaacaactgggctaagggccattacactgaaggtgctgagctcatcgactctgttctggatgttgtgaggaaggaagctgagaactgtgactgcttgcaaggattccaagtatgccactctcttggtggtggtactggatctggtatgggtacactgttgatctcaaagatcagggaggagtaccctgaccgcatgatgctgacgttctcagttttcccctcaccgaaagtatctgataccgtggttgagccatacaatgccactctttcagtcccacagttggttgagaatgccgacgagtgcatggttcttgacaatgaggccctctatgacattttgctcaggactctcaggctgaccacact

SEQ ID NO: 31153 - protein, 219 aa, Panicum virgatum
  misc_feature: Ceres CLONE 1903735
  misc_feature (45)..(219): Pfam Name: Tubulin Pfam Description: Tubulin/FtsZ family, GTPase domain
  misc_feature: Useful for making plants with modulated flowering time
MREILHIQGGQCGNQIGAKFWEVVCDEHGIDPTGRYTGNSDLQLERVNVYYNEASCGRFVPRAVLMDLEPGTMDSVRTGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVPQLVENADECMVLDNEALYDILLRTLRLTT

SEQ ID NO: 31154 - DNA, 1945 bp, Panicum virgatum
  misc_feature: Ceres CLONE 1903739
  misc_feature: Encodes the peptide sequence at SEQ ID NO. 31155
tccaatcgatccatcgtctctccccaggggcccaagcatggatccgttgctcctgttcgtagagctgctccctgtcctctgcttcctcatcctgtactaccaccacctgcaatccaagaaaacgagccccctggagccgaccgaatggccgatggtggggcatctccccggcctgatcgccaacatccaccacttccacgactgggccaccggcatcctcaccggcacgagccacaacttcgaagcccgcggggggctcaccagcttgcgctacttcatcacctgcgacccctccaacgtgcgccacatcttcacgtccaacttcgccaactaccctaagggcgacgagttcgccgtgatcttcgacgtgctcggcggcggcatcttcaacgccgacggggagtcgtggcgccgccagcgggtgaaggcccagatgctcatggccgtcccacgcttccgggccttcacggcgcggtgcagccgcgacaaggtggagaggagcctcctgcctttcctcgcccacgccgccgacgagggagctccgtgcgacctgcacgacgtgttcctgaggctcaccttcgacatgacgtgcaccctcgtgttcggcgtcgaccctgggtacctggcgatcggcctgcccgtggttcccttcgcgcgcgccatggacgacgcgctggagacgcttttcctccggcacatcacgcccatggcgtgctggaagctgatgagcaggctggaggtgggccaggagaagaagatgaccgccgctcggaggacgatcgaccgcttcgtcgccggcaccgtcgcgaaacgccgggccgacaagctcgagcaaggcatcatcgactcggccgacctgctgtcgtccttcatctgcaacgaggatgactcgagcgacaacgatgacgtgttcctgcgtgacacgacggtgaacctcttgctcgccggccgcgacacgacgggcgcggcgctgtcgtggttcttctacctcatctccaagaaccctcgcgtcgaacagaaactactggacgagctcgcgcccgtcgccgcctcgcggaaggacgcggccagcggcggcggcatggtgagcttcgacgcgagcgagctgggcaacctggtgtacctgcacgccgccctgtgcgagtgcctgaggctgtacccgtcggtcccgttcgagcacaaggcggtggtcgccgacgacgtgctgccgagcgggaaggagatgaaggcgggcgacaaggtgctggtgttcagctactccatgggcaggatggagggcgtgtggggcaaggactgcgccgagttccggcccgagaggtggctcgtcaccagcggcgaggcggcggggacgacgacgacgaagaggaggctgcggtacgagccgtcgtacaagttcatctccttcaacgccgggccgcggacgtgcctgggcaaggagatggcgttcgcgcagatgaagaccgcggcggcggccgtgctgtggaacttcgccgtcgagctcgtgccggggcacgtcgtggagcccaagctgtccatcatactgcacatgaagaatgggctcgccgtcagggtcaggagaagggacggcgtcgcgcgcgcgtcacacggctagctagctagccgctcatcacgaagcacgtcgtcgatctcctcggccatgtgagcactagtatagtatgtcactagccggctggaatccaatctacccaccagctagcacgtgttgcgtgacacggatcatcatcagtacgcacgtgtccctatcagggcgtgattagtgcccctcgaactcctaacacacgctcacagcggtccgctccagttcagcgtattcagcctgcgccgacatgagcgcggtgttgacagcctccttcgccgcagcctcgtccgccgctttctgcctcagctctgataagaggaaccaagataagctgcgataaattag

SEQ ID NO: 31155 - protein, 524 aa, Panicum virgatum
  misc_feature: Ceres CLONE 1903739
  misc_feature (31)..(511): Pfam Name: p450 Pfam Description: Cytochrome P450
  misc_feature: SWISSPROT Homolog: EC 1.14.14.1 Unspecific monooxygenase
MDPLLLFVELLPVLCFLILYYHHLQSKKTSPLEPTEWPMVGHLPGLIANIHHFHDWATGILTGTSHNFEARGGLTSLRYFITCDPSNVRHIFTSNFANYPKGDEFAVIFDVLGGGIFNADGESWRRQRVKAQMLMAVPRFRAFTARCSRDKVERSLLPFLAHAADEGAPCDLHDVFLRLTFDMTCTLVFGVDPGYLAIGLPVVPFARAMDDALETLFLRHITPMACWKLMSRLEVGQEKKMTAARRTIDRFVAGTVAKRRADKLEQGIIDSADLLSSFICNEDDSSDNDDVFLRDTTVNLLLAGRDTTGAALSWFFYLISKNPRVEQKLLDELAPVAASRKDAASGGGMVSFDASELGNLVYLHAALCECLRLYPSVPFEHKAVVADDVLPSGKEMKAGDKVLVFSYSMGRMEGVWGKDCAEFRPERWLVTSGEAAGTTTTKRRLRYEPSYKFISFNAGPRTCLGKEMAFAQMKTAAAAVLWNFAVELVPGHVVEPKLSIILHMKNGLAVRVRRRDGVARASHG

SEQ ID NO: 31156 - DNA, 746 bp, Panicum virgatum
  misc_feature: Ceres CLONE 1903755
  misc_feature: Encodes the peptide sequence at SEQ ID NO. 31157
gtataataactcccgccgccgccgccgcttctctttccccgcgccgaaccctaaccaagggagtcgagttgagttgagtcaccggttgcagccatgagtaagttgcaatccgaggctctcaaggatgccatcacccagatcgttggggatgccaaggagaagaataggaagttcaccgagaccgttgagcttcagattggtctgaagaactacgacccgcagaaggacaagcgtttcagcggctctgttaagctgcctcacatcccccgcccaaagatgagagtgtgcatgcttggtgatgcccagcacgttgaggaggctgagaagattggacttgactacatggatgtcgaggcgctcaagaaaatgaacaagaacaagaagcttgtcaagaagcttgccaagaagtaccatgctttcttagcatcagaggctatcatcaagcagattccccgtctccttggtcctggtctcaacaaggcaggcaagttccctacactggttacccaccaggagtctcttgaatccaaagtgaacgagacaaaagctacagtcaagttccagttgaagaaagttctttgcatgggtgttgctgtgggtaacctgtccatggaggagaagcagatccagcagaacatccagatgagcgtcaacttccttgtgtcccttctgaagaaaaactggcagagtgtgagatgcctatacatcaagagcaccatgggggaaccatacagggtgttctaagt

SEQ ID NO: 31157 - protein, 216 aa, Panicum virgatum
  misc_feature: Ceres CLONE 1903755
  misc_feature (10)..(212): Pfam Name: Ribosomal_L1 Pfam Description: Ribosomal protein L1p/L10e family
MSKLQSEALKDAITQIVGDAKEKNRKFTETVELQIGLKNYDPQKDKRFSGSVKLPHIPRPKMRVCMLGDAQHVEEAEKIGLDYMDVEALKKMNKNKKLVKKLAKKYHAFLASEAIIKQIPRLLGPGLNKAGKFPTLVTHQESLESKVNETKATVKFQLKKVLCMGVAVGNLSMEEKQIQQNIQMSVNFLVSLLKKNWQSVRCLYIKSTMGEPYRVF

SEQ ID NO: 31158 - DNA, 1800 bp, Panicum virgatum
  misc_feature: Ceres CLONE 1903771
  misc_feature: Encodes the peptide sequence at SEQ ID NO. 31159
gactttcattctgactgactgactgattcttgagactgtctccaacagccctcacctaaatccgagacccattcctccctttgggtcatgcaggaaacaagggtcacgcccccaaaccttccgttctccaacagcggacccaaaaatatccccgcagagcagatcaccgcatgcaccgcctgctttcctccctgccgagcactgagcctccctccctccctccccgccgagcgccgagccgcggggccgcaagaagcgcgaacggcgccgtgggaggcgcggactacgccgcgggaggacgaggcggcgggcgacgcaggaccgcaggacggggcggcgcagcagagggcctggatgctcctctgtcgcctacggcgccgcccaggagctgggtccgttcctcgtcaggagctacggcgccaacctcacccgcaacgcctacgcgtggaacaaagccgtgaacctgctcttcctggaggcgccggtgggcgtggggttctcctacacgaaccggacggcggacctgcggcatctcggcgaccgcgtgacggcgcaggactcgtacggcttcctcctcaactggctcgacaggttccccgagttcaagagccacgacttctacatcgccggggagagctacgccgggcattatgtcccgcagctcgcggagctcatctacgacgggaacaaaggggccagccgggacaaagtcatcaacatcaaaggtttcatgatcgggaacgcggtgctgaacgacgcgacggaccagctaggcatggtggagtacgcgtggagccacgccatcatctccgacgagctctactcggcggtgcgccgcgagtgcgactccttcaaggaggaggcggacggcgggcgccccggcaagggctgctccccggcgctccgcgccttcctgggcgcctacgacgacatcgacatctacagcatctacacgccgacgtgcctcctgcccgcgggcgccggcgccgccacccgtcggcgcccggccgcgaggctcgtcgccgcgccgcgcctcttctccaagcacgaggcgtggcacaggctgaagcgtgtgccggcggggtacgacccgtgcacggaggcgtacgtgaccaggtacttcaaccgcgaggacgtgcagcgcgcgctccacgccaaccggacaggcctgccctacccgtactcgacctgcagcgaggtgatcaggaaatggaacgactcgccggcaaccatcctgcccatcctcaagaagctcatggccgccgggctgcgcgtctgggtctacagcggcgacacggacgggcgggtgccggtgacgtcgacgcggtacagcatcaacgccatggggctgcggccgcggcagagggcggccaaccggaccgccgccgcggccgacgtgtagacggagcggtggggcgggtggcgggcgtggtactaccggcagcaggtcgccgggtgggcggtggagtacggggaggggctcacgctggtgacggtgcgcggcgcgggccaccaggtgccgctcttcgcgccggggcgctcgctcgccatgctctaccacttcctccggggccaagccctgccggccgagcgctccagctagccggccgagctcccctcgctcgctgctgaagtaattgatcgttttgcttgcttgcttagctaaaagctagagcttgactgggtaggtggtgctacactgctacggcgctgtgttgcgcgaatgtactcactgcaatggggaggcagatgtaaacgttccgtggaattgcgtccacctcaatacatgcaacaagcccc

SEQ ID NO: 31159 - protein, 223 aa, Panicum virgatum
  misc_feature: Ceres CLONE 1903771
  misc_feature (1)..(222): Pfam Name: Peptidase_S10 Pfam Description: Serine carboxypeptidase
  misc_feature (119)..(207): SWISSPROT Homolog: EC 3.4.16.6 Carboxypeptidase D
  misc_feature (1)..(78): SWISSPROT Homolog: EC 2.3.1.92 Sinapoylglucose--malate O-sinapoyltransferase
MIGNAVLNDATDQLGMVEYAWSHAIISDELYSAVRRECDSFKEEADGGRPGKGCSPALRAFLGAYDDIDIYSIYTPTCLLPAGAGAATRRRPAARLVAAPRLFSKHEAWHRLKRVPAGYDPCTEAYVTRYFNREDVQRALHANRTGLPYPYSTCSEVIRKWNDSPATILPILKKLMAAGLRVWVYSGDTDGRVPVTSTRYSINAMGLRPRQRAANRTAAAADV

SEQ ID NO: 31160 - DNA, 650 bp, Panicum virgatum
  misc_feature: Ceres CLONE 1903772
  misc_feature: Encodes the peptide sequence at SEQ ID NO. 31161
atcgccgtggagcacgaaactttccatcctctccatcgtaccagctatttgacgcgtcaagggctgcagcggggagcatctgcctctgccaagccatggataagggactctttgccaacgacggctccttcatggagaggttcaagcagatgcagcaggagcaggagaaggccgcctccgccgcagcctcatcggcggcgcccaagcctgccaaccccaagcagggctttgccgtggcggcgaacaagaggccgttcgagctgaagaaggctgggccggtcgccacgggcggaaagctggccttcagcctcaagaaggccaaggtcgcaatagcgcctgttttcgctcccgaagatgatgaggaagaggatgcggcagatgttgacagagacgaacctgccaagcgccagaaatctgtgaaagctgatactcctgcggtggctgccccgaccggggctgttgccccaccaccaccaaatgatatgacagtgaggcaagtggctgacaaattagcaagctttgttgccaaaaatgggagacagtttgagaatattacacgacaaaggaatcctagagatacaccatttaagtttctatttgacaagcactgtccagactacaaatattatgagtttcgccttgctgaagag

SEQ ID NO: 31161 - protein, 184 aa, Panicum virgatum
  misc_feature: Ceres CLONE 1903772
  misc_feature (136)..(181): Pfam Name: Surp Pfam Description: Surp module
MDKGLFANDGSFMERFKQMQQEQEKAASAAASSAAPKPANPKQGFAVAANKRPFELKKAGPVATGGKLAFSLKKAKVAIAPVFAPEDDEEEDAADVDRDEPAKRQKSVKADTPAVAAPTGAVAPPPPNDMTVRQVADKLASFVAKNGRQFENITRQRNPRDTPFKFLFDKHCPDYKYYEFRLAE

SEQ ID NO: 31162 - DNA, 581 bp, Panicum virgatum
  misc_feature: Ceres CLONE 1903777
  misc_feature: Encodes the peptide sequence at SEQ ID NO. 31163
gcacatcagcctcagcagcagtgcaagcggcagcgccaacaacagcaagaggctcatccacgttgctgtcgccgcgcctcgcatccccacaggaagccggctgcacaacagggcggcgtccaggcagagggtggacttcgccgacttctccggggtgaggccgggatcatgctccgtcagcaccgccgccagggaggcgtcattctccgacgtgctcggtgcgcagctcgtcgccagggccacaggagagaacgcggtgagggcgcccgctgaggccaagctcaaggtggcgatcaacgggttcggccgcatcggccggaacttcctccggtgctggcacggccgcaaggactccccgctcgatgtcgtcgtcgtcaacgacagcggaggcgtcaagaacgcgtctcagctcctcaagtacgactcgatgctcggcaccttcaaggccgacatcaagatcgtcgacgacaccaccatcagcgtcgacggcaagctcatcaccgtcgtctccaacaaggacccgctcaagctctcatgggccgagctcggtatcgacattgtcatcgagggtaccggagtct

SEQ ID NO: 31163 - protein, 193 aa, Panicum virgatum
  misc_feature: Ceres CLONE 1903777
  misc_feature (94)..(193): Pfam Name: Gp_dh_N Pfam Description: Glyceraldehyde 3-phosphate dehydrogenase, NAD binding domain
  misc_feature: SWISSPROT Homolog: EC 1.2.1.13 Glyceraldehyde-3-phosphate dehydrogenase (NADP(+)) (phosphorylating)
HISLSSSASGSANNSKRLIHVAVAAPRIPTGSRLHNRAASRQRVDFADFSGVRPGSCSVSTAAREASFSDVLGAQLVARATGENAVRAPAEAKLKVAINGFGRIGRNFLRCWHGRKDSPLDVVVVNDSGGVKNASQLLKYDSMLGTFKADIKIVDDTTISVDGKLITVVSNKDPLKLSWAELGIDIVIEGTGV

SEQ ID NO: 31164 - DNA, 317 bp, Panicum virgatum
  misc_feature: Ceres CLONE 1903784
  misc_feature: Encodes the peptide sequence at SEQ ID NO. 31165
gttttgctctgcacaaagttgagcggccattgctggagtggagtagagctaggctagctgcactgcagccgccgctgcaaatcaagatcaagatcaagatgccgcacgccaagacggactcggaggtgaccagcctggcgccctcctcgccgccgcgctccccgccgcgcacgcgccccgtctactacgtccagagcccctcccgggactcccacgacggcgacaagacggccacctccgtccactccacgcccgcgctcagccccatggcctcccccccccactcccccccctcggcgggagggaatcctcctccc

SEQ ID NO: 31165 - protein, 72 aa, Panicum virgatum
  misc_feature: Ceres CLONE 1903784
  misc_feature: Useful for making plants with altered cell wall content and/or composition
MPHAKTDSEVTSLAPSSPPRSPPRTRPVYYVQSPSRDSHDGDKTATSVHSTPALSPMASPPHSPPSAGGNPP

SEQ ID NO: 31166 - DNA, 810 bp, Panicum virgatum
  misc_feature: Ceres CLONE 1903788-R
  misc_feature: Encodes the peptide sequence at SEQ ID NO. 31167
gaagttatctgatggaccttcttcatgcacaaaaagctaatggtgcccatgggaagcaagctcttactttggtctttgtggagacgaagaggggagctgatgctcttgaggactggttgttcaaaaatgggttcctggcaacaagtattcatggtgacaggacacaacaggaaagagagtctgcattgagatccttcaagagtggagctactcccatactcgttgcaactgatgtggctgctcgtggacttgatatacctcatgttgctcatgtcatcaattttgaccttccaaatgacatagatgactatgttcatcgtattgggaggacaggacgagcggggaaatctggtttggcaactgcattcttcaatgagggcaactcatcactggcaaagcctctgtgtgagctaatgcaggaagctaaccaggaggttcctccatggcttgagcgatatgcagcccgttcatcctatggaggtggcggtgggaggaaccgccgatcaggtggtgctcgatttggtggccgtgacttccgccgtgaccgggacttcaggggaggtggcagtggtggaggatatggtggtggcagcagtggatatggtggtggaggttatggcggcggtggatatggtggcggctatggtggaggtgcaacaagttcctgggattaaatactgtttcgtagtcaccagtgagaattgaactgaattcgtattctattgatgttaactgaaacagatgtggactttgtagtcaactctagggtggttggtatggtgctggagaaaggcccctatttaccttgtt

SEQ ID NO: 31167 - protein, 223 aa, Panicum virgatum
  misc_feature: Ceres CLONE 1903788-R
  misc_feature (38)..(114): Pfam Name: Helicase_C Pfam Description: Helicase conserved C-terminal domain
SYLMDLLHAQKANGAHGKQALTLVFVETKRGADALEDWLFKNGFLATSIHGDRTQQERESALRSFKSGATPILVATDVAARGLDIPHVAHVINFDLPNDIDDYVHRIGRTGRAGKSGLATAFFNEGNSSLAKPLCELMQEANQEVPPWLERYAARSSYGGGGGRNRRSGGARFGGRDFRRDRDFRGGGSGGGYGGGSSGYGGGGYGGGGYGGGYGGGATSSWD

SEQ ID NO: 31168 - DNA, 1196 bp, Panicum virgatum
  misc_feature: Ceres CLONE 1903788
aacgcgaagccatatccgcgataccccttcttctccctgcgttatccgcgatcccacgcgcgacgcctccccatcgcgactccacttctccctcgcgactctcctccctagcgccgccgcacacgccgccgcacacgccgccgccgacttcgcaggatctgccgcgtctcgccgcaaaaggaaagctctgtggggagggggagggaggagaagacgacgacgacgtgcatcaattggatcgggaaggatctgtaagatgatactcaagggaagaagtgaggagccatgcagaaagccaatgtctcagtgatcaccggtagcgtcctcatcaacggccttttgcaaaattatgcgatcttcatgggctgattcagttgcgaacgccgaggaatcggcgcccgcgactgttactgctcctgctcctgctgctaatcatcagagtgggtgccccaccctcagcacatacgtccctcctcatctccgtggtcgctcaggtggtccaccctctgagaaccaggcagtgcctgctgcagctcctgcaccagctgagctacggtcagctgctgcgcagccttcaggctacgcagctgttgttggtggcaactctcgttggtctggccctgctggcattggtggtagcagcgccgtagttggtcctcgccagggtggtgggggcgggggtagtggtcgaggtggcggcggcggttggaactctcgccctgggtgggactgtagagatcgcgaaccaaacccctttgccaatactgaggccgcagatgttgattttgagagtcaggagaacacgggcatcaactttgacgcatatgaggatattcctgtggagacaagtggccatgacgtccctccaccagtcaacacctttgcagagattgatttgggcgacgcactgaatgagaacatacaaaggtgcaagtatgtgaagccaacaccagtgcagcgacatgccattcctatcgccattgcaggtagggatctcatggcttgtgcccagacagggtctggaaagactgcagcattctgtttccctatcatcagtggtattttaaagtcatggccacctcagaggcaaagaggttccaggacagcttatccactggcgctgatattgtccccaactcgtgagctgtctatgcaaattcatgaagaaacaaggaagttttcataccaaactggtg

SEQ ID NO: 31169 - DNA, 1965 bp, Panicum virgatum
  misc_feature: Ceres CLONE 1903792
  misc_feature: Encodes the peptide sequence at SEQ ID NO. 31170
ttttcctttaaaaagatattcctttcatagtcgaaattccaacttgtgtagaaatgttatttgtttgaaatctttactaagttttcccttaactttcacacagtttaaattctgttattactcctttgtttgaaaagatgctaagtgctagtgatgctgggcggattggtcgtctagttttgccaaagaagtgtgctgaggcatatttccctccaatctctcaacctgaagggctccctttaaaggttcaggatgccagtggtaaagaatggatattccaattccgttactggcctaataataatagcaggatgtatgtattggagggtgtcacaccttgtattcagtcaatgcagttacaagcaggtgatacagtaaccttcagccgaatagatccagaagggaaattgatcatggggttcaggaaggcaactaatatttcatctgaacaggagcaaacaacaaagcctgccaatggggccccagcaacttcagaggcaaatggtaaagtttctgcttcagatcccagtccaaatgctgcagtttcccgacaaaacaaggtcagcacagagaccaaaagctctagccctgtggaacaaggcactacctccaaaattgaaaaagatggattaacacagaaggaagggccaggaactgctagttcttctccaggtcctgtcaagagaaaagcagctaatcttactccaaagaataaacgactacggatggaaaatgaggaatcaatggagttgaagataacatgggaggaagctcaagaattgcttcgtccccctcctaaggctcctaacgttgttattgttgatggccatgagttcgaggaatatgaggagccaccaatacttggaaggaagacatattttgtggcagatcaatcaggttcaaatcatcaatgggcccaatgtgagaattgttccaaatggaggaaactgccagtagatgccctcatgccctctaaatggacctgctctgacaataaatgggattcagaaaggtcttcttgcgaagctgcacaagaaataagtatggaggaacttgcagaattgattcctataaaatctggtccaggtggagcaaaaaagcccaaagctagggtagaaggtgaaactattgatgcttcagatgggctcgacactcttgcaaaccttgcaatccttggtgaaggtgaagccctcccgtcccagccaaccacaaaacatccccgccatcgtcctggctgctcatgcattgtctgcatccaaccaccaagcgggaagggcccaaagcacaagcaaacatgcacctgcaacgtctgtatgacggttcggcgtcgtttcaggacactaatgcttcgacgtgagaagagggcggccacagattcgcctcgtagaaaagatacaggccaatccagcgagacaggcagacaaagtggatctagccggctggcgaccaatgccagtgcaactggctcgtcccagaaagcagcagatgcgaagaccagggcacctgaagacatggccgtagatcacaaggtgtcatcctctccagtcaagaaccacattgacctgaacatccagcctgaacgggacgatgagcagtcaccgaagtctggtgcggctggtgcattgagccgagacaatccgacttagggtggctcacacggagaggctgggtcatatcggtgagagtggacatagatagctgatcgaacatatcattccgaaatgtctatacccattaagaaaagatgtggcatgaggtgttgtagtgtaggtattatatgttcccataccatagagccggttttcgtttttcccagacagacgccaggtggtaatgttatcgtgtatacataggccaggatgtcagtaggtgttgcgtggggccttgcagaccctgtatgcatgtatgtattgcaagaccagcgcgtcgtttcggcagtgtaaaatgggagttgtttgggtatcg

SEQ ID NO: 31170 - protein, 502 aa, Panicum virgatum
  misc_feature: Ceres CLONE 1903792
  misc_feature (257)..(302): Pfam Name: zf-CW Pfam Description: CW-type Zinc Finger
  misc_feature (1)..(100): Pfam Name: B3 Pfam Description: B3 DNA binding domain
  misc_feature: The sequence is a functional homolog of SEQ ID NO 2384 in the 10/374,780 US patent application
  misc_feature: The sequence is a functional homolog of SEQ ID NO 810 in the 10/225,066 US patent application
MLSASDAGRIGRLVLPKKCAEAYFPPISQPEGLPLKVQDASGKEWIFQFRYWPNNNSRMYVLEGVTPCIQSMQLQAGDTVTFSRIDPEGKLIMGFRKATNISSEQEQTTKPANGAPATSEANGKVSASDPSPNAAVSRQNKVSTETKSSSPVEQGTTSKIEKDGLTQKEGPGTASSSPGPVKRKAANLTPKNKRLRMENEESMELKITWEEAQELLRPPPKAPNVVIVDGHEFEEYEEPPILGRKTYFVADQSGSNHQWAQCENCSKWRKLPVDALMPSKWTCSDNKWDSERSSCEAAQEISMEELAELIPIKSGPGGAKKPKARVEGETIDASDGLDTLANLAILGEGEALPSQPTTKHPRHRPGCSCIVCIQPPSGKGPKHKQTCTCNVCMTVRRRFRTLMLRREKRAATDSPRRKDTGQSSETGRQSGSSRLATNASATGSSQKAADAKTRAPEDMAVDHKVSSSPVKNHIDLNIQPERDDEQSPKSGAAGALSRDNPT

SEQ ID NO: 31171 - DNA, 1690 bp, Panicum virgatum
  misc_feature: Ceres CLONE 1903805
  misc_feature: Encodes the peptide sequence at SEQ ID NO. 31172
gacagtgagagggggcgcacgacaaggcgcccacccaccttccccccgccccaagtctccccgctcccctaccgccgccgacctcgccgccggcaatggcgtggctcgcgcgctccatcgccaactccctcctctcctccgaggatgaagaacccggcggcaccgccccgggcccctccgctgcctcccccggctcctccccgccgcgcggcgtccgcgaggacctctccgagctcaccggcgcactcgcgaaccgcttccagggcctcgcgtccttcctcgcggtcccgggcgggggcgcgccgcgggggccggacccggccgagatcgccggccgcttccgcgccggcctcgcgcggctccggggccgccaggccgtcgcggatctcgccaagatcgcctcctcgctgctgcccccggagggcgacgcgggctgggcggaggacgccgtgggggtcaccgaggaggtggtcgccttcgcgcgggacgccgccatgcggcacgagctctggctcgacttccccctcctccccgacgacgccgactccgacgatttcgacatgaccgatgcgcagcaggaccacgcgctggccgtcgagagcgtggcgccggagcttgctgatctgcggatcgagctctgccccagccacatgagcgagggctgcttctggaagatatacttcgtgctgctgcatcctaagctcacgaaggaggatgccgagattctgtcgactccacagattttggaagctagagacaaattgtcacatgatttgcaatatcagacaaagttacagagcagcaatggggacactgtacctgcgcctttcagtactgtagatggtgctttagcttctcccgtagaggttttggatgccttaaagggtcaagatggctccgtgatggccacatcttttagcaacatagactatggcatccctcaaccaaccaatcaggaatttcaatcaactgatgcaaccagtgttgctggagctgtttcttcagataacataagcagcagtgtacctgtacagctagtccccataatgaaagatgatactgtggtgtcaaagtctacgatggaagaaagcacacgtgatctctctacagaagatgcagcagaagaagaacagagcgtgcaaatgtctgagatagcattggtggacaattctcctcctaaagatgatcaacagaagcaaccattggctgacatcaatgaacaatcaagagttgacattcagaaagcttatcatgatgaggatgaggatgaggatgaggatgacggcgatgaatggttggaagagacaggtggcccaggaaacacgacgattccaattgcagatgatgaagatgtatccttcagtgatctagaggatgacgatggtacaacatgacatcgtcagcaggggcttcatcatcctcttgaatttatgcaggccattccactacatggtcaaatgcaatgagcttggaacatgcccactgtacattctcatactctcatggggctgtttgtgaccagctgctactgcaggataatttgctgtgaccctgggactttgcagtgcatcatggctttcacggtacaaatatgccccccattgatcgtcgcactcgtggtcgtggatttaagcttgtgatgttagtgactgctgtacagtgtacattgggtgcattggaattttggatc

SEQ ID NO: 31172 - protein, 432 aa, Panicum virgatum
  misc_feature: Ceres CLONE 1903805
  misc_feature (143)..(209): Pfam Name: BSD Pfam Description: BSD domain
MAWLARSIANSLLSSEDEEPGGTAPGPSAASPGSSPPRGVREDLSELTGALANRFQGLASFLAVPGGGAPRGPDPAEIAGRFRAGLARLRGRQAVADLAKIASSLLPPEGDAGWAEDAVGVTEEVVAFARDAAMRHELWLDFPLLPDDADSDDFDMTDAQQDHALAVESVAPELADLRIELCPSHMSEGCFWKIYFVLLHPKLTKEDAEILSTPQILEARDKLSHDLQYQTKLQSSNGDTVPAPFSTVDGALASPVEVLDALKGQDGSVMATSFSNIDYGIPQPTNQEFQSTDATSVAGAVSSDNISSSVPVQLVPIMKDDTVVSKSTMEESTRDLSTEDAAEEEQSVQMSEIALVDNSPPKDDQQKQPLADINEQSRVDIQKAYHDEDEDEDEDDGDEWLEETGGPGNTTIPIADDEDVSFSDLEDDDGTT

SEQ ID NO: 31173 - DNA, 720 bp, Panicum virgatum
  misc_feature: Ceres CLONE 1903842
  misc_feature: Encodes the peptide sequence at SEQ ID NO. 31174
acacgccggttgtgccatctgtgcgagtggaaccaagggcgaactgccgaactccgtacgcaaccctagagcggccatggggaaggcggagacgagaaccagggggcgcggcggcggcggcagcggcagcggcggcggcggcggcggcggtggcaacccggggaagattttcgtcggagggctgccgcgggacaccacggatgctacatttgtgaggcattttggccagtatggagaaatagttgattcagtaataatgaaagataggtacacatctcagccacggggttttggcttcattacatactctgaccctgttgttgttgataaagtgatagaggataatcatgtcatcaacggaaagcaagttgagattaaaagaaccataccaaagggtgcaatgcagtctggctctaaggatttcaagactaggaagatatttgttggtgggctcccctcagcactaacagaagataatttcaagaatttctttgaaagatatggggctgtggtagaccaccagattatgtttgatcgtgaaacaaaacggtctagaggctttggatttgtagtttttgcttctgaggaaactgtagatgatttgttagcaaacggaaatatgattgatcttgctggttcaaaggtggagatcaagaaagcagaaccaaagaaatcctcaaacccacctccatcagggtgtggtagaagttctaggtcttc

SEQ ID NO: 31174 - protein, 214 aa, Panicum virgatum
  misc_feature: Ceres CLONE 1903842
  misc_feature (31)..(100): Pfam Name: RRM_1 Pfam Description: RNA recognition motif. (a.k.a. RRM, RBD, or RNP domain)
  misc_feature (121)..(192): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MGKAETRTRGRGGGGSGSGGGGGGGGNPGKIFVGGLPRDTTDATFVRHFGQYGEIVDSVIMKDRYTSQPRGFGFITYSDPVVVDKVIEDNHVINGKQVEIKRTIPKGAMQSGSKDFKTRKIFVGGLPSALTEDNFKNFFERYGAVVDHQIMFDRETKRSRGFGFVVFASEETVDDLLANGNMIDLAGSKVEIKKAEPKKSSNPPPSGCGRSSRS

SEQ ID NO: 31175 - DNA, 1368 bp, Panicum virgatum
  misc_feature: Ceres CLONE 1903846
  misc_feature: Encodes the peptide sequence at SEQ ID NO. 31176
agcattgcccttgtcttccgaaacacacactttgcagtataaagatcatccgcaagaactcgcgaagcaagccggccagagctctcagcaatcctctgttcctcgctcatcgtctccgttcctctgatcgaccttggctgggctttttgtcggaggagaagtagcaaaatggccgacgaagttcagcatctcaccagggccttctcaggtctgggcgggctcggcgtggacgagccggcgatggtgtcggcgctggcgcggtggcgcgggcagccggagaagcggtcgggcttccggaagggcttcccgggcttcttctcgagccacggcgagatggagcggtgcgaggaggagtacatgctccgcctggccgccgagttcgcgcggctcaagaacctggtggtgctgtgggcgatgcacccgtgggagcgcgacgcgcggctggcgcaccacgtcctccaccagcaccaccccgccgccatcgtcgtggaggtcgcctgcacgcgctccgccgacgagctcctcggcgcgcgccgcgcgtaccaggcgctctaccaccactccctcgaggaggacgtcgcctaccgcgccagggacaagccctactgcaacctgctggtggggctcgtgagcgcgtaccggtacgaggggccccgggtgaacgaggaggcggcgcgggcggaggccgaggcgctgggcgcggcggtgaagagcgccgccggcgggaagctgctggcggagaacggcgacgtggtccggatcctgagcaccaggagcaagcccgacctggtggagaccttgaggcgctacaaggagatccacggcaggcgcctcgaggaggatctcagcggccgcggcagggaggagacgacgaccctgctgctggaggccgtgctgtgcctcaccgcgccggccaagtacttcagccaggtgatggaggtggcgctgcgggagggggcggacgagcacgagaaggacgccctgacgcgggtggcggtgacgcggtcggagcacgacatggacgagatcagggcggcctacgaggagcagttcggggccaagctggaggacgccatcgcggccagggcgcacggccactacagggacgcgctgctctcgctggtgatgggcgcgcaccaccaccaccagtgaacgtacgtcaaccagctagcgctgcgctagctttctcttctcttcggtcgtctgcccgtgtccgtccgttcattcaatcgtggcgtccgtgtgtgtcgtgtgtgcgtgtgccaatgttggtctgttgcccatcgagactgtaacattttcctgctgagtctgtagtgtgtgtggcggctggtcaagaggccggtcaaataagatcggcgggcaacc

SEQ ID NO: 31176 - protein, 327 aa, Panicum virgatum; identical to SEQ ID NO: 19148
  misc_feature: Ceres CLONE 1903846
  misc_feature (251)..(318): Pfam Name: Annexin Pfam Description: Annexin
  misc_feature (171)..(245): Pfam Name: Annexin Pfam Description: Annexin

SEQ ID NO: 31177 - DNA, 464 bp, Panicum virgatum
  misc_feature: Ceres CLONE 1903878
  misc_feature: Encodes the peptide sequence at SEQ ID NO. 31178
atcctccccccccctcccctcccctgtccccgtccttttgcggagccgccaacccggaccaccaaccgggagccagctcggagtcggagggcggaggccccccccgacgagatgcccggcccccccgccccctccgactacgcggaggagccccccccccccccggccctcaagatcaactcccaggagccgtttaatgctgagcctccccggtcggcactagtcacatcttacattaccccggtggatttcttctacaagaggaatcatggacccattccaaacgtcgaggacctctcaagatacagtgtttgcatttctggtcttgtcaacacgcctattcagctatccatggctgacatttgcgctcttccaaagtacaatgtcaccgcaactttacagtgtgcgggaaacaggagaacagcaatgagtaaggtacggaaagtgagaggtgttggctggga

SEQ ID NO: 31178 - protein, 117 aa, Panicum virgatum
  misc_feature: Ceres CLONE 1903878
  misc_feature: SWISSPROT Homolog: EC 1.8.3.1 Sulfite oxidase
MPGPPAPSDYAEEPPPPPALKINSQEPFNAEPPRSALVTSYITPVDFFYKRNHGPIPNVEDLSRYSVCISGLVNTPIQLSMADICALPKYNVTATLQCAGNRRTAMSKVRKVRGVGW

SEQ ID NO: 31179 - DNA, 689 bp, Panicum virgatum
  misc_feature: Ceres CLONE 1903884
  misc_feature: Encodes the peptide sequence at SEQ ID NO. 31180
aagccacagccaatccatctagcgagagaaatcccggccggcctccatggaatccgtcgccgtcgtggctgtgccgttcccggcgcagggccacctgaaccagctcctgcacctgtcgctacagctcgcggcgcaggggctgcccgtgcactacgcggcgccggcggagcacgtccgccaggcccgcgcgcgcgtgcacggctggggcgacgacgccctccgccgcgtccagttccacgagatcgccatctccgagtacgcctcgccgccgccggaccccgccgcgggctcgcccttcccgtcgcacctcatgcccctgtgggaggccttcaccgccagcgcgcccgccccgttggcggcgctcctccgcgaggcctccgcctcccaccgccgcgtcgtggtcctgtacgacctcatgaacggcttcgtcgccgaagaggccgcgcggctgcccaacggcgaggggtacgggctgcactgcaccgccgtctcgtccatcatcgggcgggtggaatacgggggcaggcttctgcgcgagcgcgggcttgagtaccgccccatcgaccgctacgtgacggaggagttcatggagtacatccacaaacggacgagggcggagcaatccatggttgccagcgccggcttgctcgccaactcgtgccgcgcgctcgagggcgagttcatcgata

SEQ ID NO: 31180 - protein, 214 aa, Panicum virgatum
  misc_feature: Ceres CLONE 1903884
  misc_feature: SWISSPROT Homolog: EC 2.4.1.215 Cis-zeatin O-beta-D-glucosyltransferase
  misc_feature: The sequence is a functional homolog of SEQ ID NO 8 in US patent 7148405
MESVAVVAVPFPAQGHLNQLLHLSLQLAAQGLPVHYAAPAEHVRQARARVHGWGDDALRRVQFHEIAISEYASPPPDPAAGSPFPSHLMPLWEAFTASAPAPLAALLREASASHRRVVVLYDLMNGFVAEEAARLPNGEGYGLHCTAVSSIIGRVEYGGRLLRERGLEYRPIDRYVTEEFMEYIHKRTRAEQSMVASAGLLANSCRALEGEFID

SEQ ID NO: 31181 - DNA, 1966 bp, Panicum virgatum
  misc_feature: Ceres CLONE 1903903
  misc_feature: Encodes the peptide sequence at SEQ ID NO. 31182
gaccccgaccgagccctgcgcgtgcgcgtgcgccgttcgcgccgccggactcgccgtgctccaccgccgacccgacgtgctccgcgcctgcccacgccacgctccaccgtcggactccctcacactcccgtgccgccggccccggtgcaacactttcccggcctctgcaacccgcaggcaaacccgcagtctagggtttccactgggatttgccgcgaccggtcgtcgatccgccatctccggccgccgcgcctcagcttgttcactccagcgaccccccttgcaccgtctccctcatatcaagagagccaattttcccaacaggaattcgagtgcagcgcagcggctaacgcaagatggaaggctcgccggcgacacgcctcccggaggctgactccctccctgatggcttcgttgagagctctggcgcgtgcacggcctctcctccatcccctgcgcccacctcggaggatccaccacatgtcactctcaactccgattgccccgcagccaccggcccaggcggtaggcaaaccctgggcgatccctctctccccaccccaactgttgaggatgcctcctcggctgctgccgaagccttggaggcactctctctgcatgccaccgcggagccagaacgcgctctaggggagcatggatctggcaatgctgcaaaagatgctgaagaatccttgaagcagagctgtgcagctgaacaagaaggatctccaactgctcaaaagcaaaaggaaatcggtgagccgaaacgcaaggttgtgaagcgtagtaagttcgagaaggacagagagctgtttggacttgcccagcaataccacaaagtggtggcagaaagggatgcagccattgctgtcaaagaaaaactggaatctctttgtagagagtttcagcgtcaaaacaaaatgctgaaggaagagtgccgaagggtgtcgacagaggggcagaacatgcgtatggaattgtctgacaaattcaataatgccataaaggatgtgagtgtcaagcttgaggagcagaaaaatgaatgcattgctcagctagaagagaacaatctgttgagaagtaaactcaaagatctcgctgatcaatataacattactcagcagaaatttgctcatcagttgaaagagaagatgctggaacttgagcttgcggatctgaaacttcaacagcatcaagagaaggctgctcaggaacatacccaaatgcagttatatgctgagcaagtttctcagcttatgactactgagaagaacctgcggttgcaactagcttctgatggagaaagatttcagcagtttcaggatgccctgtcaaaaagcaatgaagtctttgaaacttacaagaaggagatggaaaagatgatctcggtgataaagaatctgaagaaggagaatgaatttctgaagggtaaatgtgagaactcagatatcgcactcgtgaagctcattgaagagcgtgagctaacaaagaagcaaatagagaagttgaaaaatcaaaaggagaagcttgagtccctgtgtcgttcgctacaggcagaaaggaaacaagtccccttcgccagcactccggaggccccttctagccaagatgtggcagtgacaagccaagattcataatgcttgtgtgcttcatctttctgatgtgcttgccaatgtttcattggtcccacctacccttgcccgagatttctgaatcctgagaaatacgtgagactactgggcacgtttatatcacacccaacccaattagcctttgtgttggggagtacggagagatacttgacagcctctggcgttttgagatttttgccagaagggtggtaacacctgaaaggctgaaactttagcatgctagtgactcgctattactagcaggcatatgtagtcctccaactgtatcctttcccccccttcgatataagggaatttttataatcttagatgat

SEQ ID NO: 31182 - protein, 426 aa, Panicum virgatum
  misc_feature: Ceres CLONE 1903903
  misc_feature: SWISSPROT Homolog: EC 2.7.11.1 Non-specific serine/threonine protein kinase
MEGSPATRLPEADSLPDGFVESSGACTASPPSPAPTSEDPPHVTLNSDCPAATGPGGRQTLGDPSLPTPTVEDASSAAAEALEALSLHATAEPERALGEHGSGNAAKDAEESLKQSCAAEQEGSPTAQKQKEIGEPKRKVVKRSKFEKDRELFGLAQQYHKVVAERDAAIAVKEKLESLCREFQRQNKMLKEECRRVSTEGQNMRMELSDKFNNAIKDVSVKLEEQKNECIAQLEENNLLRSKLKDLADQYNITQQKFAHQLKEKMLELELADLKLQQHQEKAAQEHTQMQLYAEQVSQLMTTEKNLRLQLASDGERFQQFQDALSKSNEVFETYKKEMEKMISVIKNLKKENEFLKGKCENSDIALVKLIEERELTKKQIEKLKNQKEKLESLCRSLQAERKQVPFASTPEAPSSQDVAVTSQDS

SEQ ID NO: 31183 - DNA, 601 bp, Panicum virgatum
  misc_feature: Ceres CLONE 1903915
  misc_feature: Encodes the peptide sequence at SEQ ID NO. 31184
tcccattcggtcagtgcattgatagctcccgctagccgctcgccacatgctcacggcggctcgcacccagatcccgatgcgcgcctcctcgccgctcgaggcaaagacaaactcaagtgatacctagacgaccagcgctcacgcgccccaaatcccctcatccacgtgcccccctccacgtcctcctagcgggggggaacaaccacgccgagaatgccgcctccgtcctctcccctgtccatgacgcccccgaccctgcccttctcgcctcccaagaaaccggcgccgatgccggtgtacaacgacctgcacttcaaccgcgacctcgccgctaccaagaagctccaggccggggtggacctggtggcgcggttggtgggggtcaccatgggccccaaggggaggaacgtggtgcttggcaacaagtatggccctcccaagattgtcaatgatggggagaccgtcctcaaggagatcgaattggacgatccattagaaaatcttggagtgaagctggtcagacaggctggtgcaaggaccaatgatattgcaggagatggctgcaccacttccataatacttgctcgaggcctgattgctg

SEQ ID NO: 31184 - protein, 104 aa, Panicum virgatum
  misc_feature: Ceres CLONE 1903915
  misc_feature: Useful for making plants with modulated nitrogen use efficiency
MPVYNDLHFNRDLAATKKLQAGVDLVARLVGVTMGPKGRNVVLGNKYGPPKIVNDGETVLKEIELDDPLENLGVKLVRQAGARTNDIAGDGCTTSIILARGLIA

SEQ ID NO: 31185 - DNA, 696 bp, Panicum virgatum
  misc_feature: Ceres CLONE 1903934
  misc_feature: Encodes the peptide sequence at SEQ ID NO. 31186
atccccccagtcctgctgccttcttcgacagcactgccgcatccgccgccaccgccggcgctgccgtggcgtcggcctccgtttccgtctccggccgcgctccgccagatccaaaagggcgacctcgacctcacggcagggggatcctgactccacgagatggagtcgccccccgagaagaggaacccggcgtccagcctcgcagacgagctcctcgtggagatcctccgccgcgtccccgtccgctccctgtgccgcttcaaatgcgtctcccggtcctggcgcaacctcatctccgaccccgactaccgcaagaagctgccccagaccctggttggcttcttctaccagagcctcagcggcaagcgttacccttgctcggctaaccacttcaccaacgtcaccgggaaaggcattcctttcatctacccctctttctccttcttgcccgtccccagtgacgatttagtcctcttggattcctgcaatggcctcctactttgccgttgctttgagcctgatcctcacaagggcgatgagattccaccgttccattatgctgtgtgcaatccggcgacccacaagtgggtgatgttgccggatggcagttgggctagtgatgaggctcgcacagccctcttgcggtttgatccggcagtctcctcgcacttctatgtgggtgagtacgtgctggac

SEQ ID NO: 31186 - protein, 178 aa, Panicum virgatum
  misc_feature: Ceres CLONE 1903934
  misc_feature (9)..(56): Pfam Name: F-box Pfam Description: F-box domain
MESPPEKRNPASSLADELLVEILRRVPVRSLCRFKCVSRSWRNLISDPDYRKKLPQTLVGFFYQSLSGKRYPCSANHFTNVTGKGIPFIYPSFSFLPVPSDDLVLLDSCNGLLLCRCFEPDPHKGDEIPPFHYAVCNPATHKWVMLPDGSWASDEARTALLRFDPAVSSHFYVGEYVL

SEQ ID NO: 31187 - DNA, 1551 bp, Panicum virgatum
  misc_feature: Ceres CLONE 1903940
  misc_feature: Encodes the peptide sequence at SEQ ID NO. 31188
gtgttcgtcgtcgccggcgatccagcgcgcggtctcacgccgccgaatccgcctccggccttattccatggaagcacgacagccacactgctagtcattgcagtcttccccgtcctcatccgttgtactaggcggcgtggtgtggcaatttgggttcggtcgattcctttaagctgcgcgcacaagatcagtgggtctcagttcacaccatatacgactttaaattgaaaccgaggagtgggtacttttatttttccaatgtccaaaagaagcctcccttcttggatgggttcttctgaagagggagaggacgattcaggcaagaagaaacatgcaggcacctctcagaaggctcagaaagtgcctgatttctccaaacttttggatggggtcgtctttgtgctgtcagggtttgtgaatccggagaggagcacactgcggtcgcaagcattggatatgggagctgagtatcggcccgattggacatcagattgcacccttcttgtttgtgcatttgctaacacacccaagtttcgacaagttcaagctgataatggaaccattatctcaaaggattggatctctgaatctcacaagcaaagaaaacttgtgaacattgaaccttaccttatgaatgctggaaggccatggcgaaaaaataaggagccagttgaatatgatcaagatcagaaggagatgcataaagagcataaaaagcaagttcaacggtctcacgtcaagtcatccacctctgcaaccacagaggcaggacatttagactctggaaacaaacaattttctccctcaaaaataaaacaatgggcaatggatgatttgacgcagactgtgtcatggttggagagccaagaagagaagccagagccaagtgaactgaaggcaatagctgctgaagggattattacttgtctgcaagatgccatagaatcccatgagcaaggcaatgatattaaaggagtggcagagcagtggagcttcgtcccccatgttgtcagcgaactattgaaactggatggaagcagaaaggatgcatctttgcctaaagaacagctctcgcaactagcaatcaaatgtaagaagatttatcaggctgagtttgctcgcatggacagtgacgacaagaaggggacgaaggagcagagcagcttgcctataactaagcatcgcaggaagactaagtccgatgatgatcactacgacagtgatgacacgatagaaatgacagaggaagagattgatctggcgtgcagacagctccctgggctatgcggatgatactagctaggttagtagaggcgtgcgtgtgtcccactgccccactaagaactgaagagggagaattatgctggatggccatctcctatcgtttcttgctgccacccaaataaaccatatttgaattcggttgttaggcaaattgactagcccaaggttgtattatgaactttgctcttgtatatataaaaaattcttttcgatccatggtgtggaatgatctttgggcggcgtagtgattcgttcgccggtgcggtt

SEQ ID NO: 31188 - protein, 335 aa, Panicum virgatum
  misc_feature: Ceres CLONE 1903940
  misc_feature (28)..(103): Pfam Name: BRCT Pfam Description: BRCA1 C Terminus (BRCT) domain
MGSSEEGEDDSGKKKHAGTSQKAQKVPDFSKLLDGVVFVLSGFVNPERSTLRSQALDMGAEYRPDWTSDCTLLVCAFANTPKFRQVQADNGTIISKDWISESHKQRKLVNIEPYLMNAGRPWRKNKEPVEYDQDQKEMHKEHKKQVQRSHVKSSTSATTEAGHLDSGNKQFSPSKIKQWAMDDLTQTVSWLESQEEKPEPSELKAIAAEGIITCLQDAIESHEQGNDIKGVAEQWSFVPHVVSELLKLDGSRKDASLPKEQLSQLAIKCKKIYQAEFARMDSDDKKGTKEQSSLPITKHRRKTKSDDDHYDSDDTIEMTEEEIDLACRQLPGLCG

SEQ ID NO: 31189 - DNA, 1797 bp, Panicum virgatum
  misc_feature: Ceres CLONE 1903955
  misc_feature: Encodes the peptide sequence at SEQ ID NO. 31190
aaaaccctagctcccctgccctgccgaatggtcgccgccctccgccgcgcaccaccatgctgctccgccgcctcctcctctcctcccgccacttccggcacggcctccaaaccgtagctccggccaccagcgcctcgtcctccgcctcctcctctccatttccatttcgccgcctccgggacctcctcccctcgcgcgtcctctccccgaggctcctctccacctccggccgcgacgacgacggcaacaagccatggagtttcgcggccgactcgggcgatccggaccccttcgcccaagaggacgccgcagctgacgctggagaggcactgcgggtaggacctgcggccgtcgccgacgagccctggacgaagggcttcggcgtggaaggcgagaatggggacgtgttcgaggggatctacaaggaggtggcgtcggcggtcccggcgagcggagaggcggctccagccggtgacgaggagcagtggacgctgagtggggatgagaaggatccctttgccgattccgtgctcgaggagggcatcgatgggattcaaagagagggtggtgggctcgatgagctcgatgggggtgaagaccctgaggctgagctgaagcgacagaagaacatggagagggagaaggagctgatggagatactcaaaggtccaaatcgtgcgtttggtgatctcattgctaactctgggatcaccgagggaatgattgatagtttgatcctcttaaaggatgtcagggatgttccgggattgcctcccctaagtgaaatagaagatgaaggtatccagaaacttagtgcaacatcaagtagagctgaagtcgagcgccaaaagcaagaagaaattgccaaggcacgagtaagacaggttgatgagaaaggaagggcttatggaacagggaaaaggaaatgcagcattgcccgtgtttggattgagcctggtaatggcaaattcattgtcaatgaaaaggagtttgatgcatacttcccaattctggaccatcgagccgaacttcttcgtccatttacagttaccaagaatttgggcctttttgatgtgacctgtactgtaaaaggtggtggcatctcaggacaagttggagctatccgcttaggaatcagcagggccttgcagaattgggaaccaggactgcgtccatatcttaaagcagctggatatttgacaagagattcacgtgtggttgaaaggaaaaagcctggaaaggcaaaagcaagaaagagcttccaatgggtcaagcggtaacaggtctgtcagcagaactaccatctatttttgtggcagatctctgctcttcgttgtgggttttcttgtcaatgtggagatctccttgcacttgatctgcggaaggtccgttcagcttgatactaaaatactcctgcttgtatggacatggggatcatgctatacttgagtattctatttatgaaatgatcacacagcgaattgatccagagaatgtcgttttgacctaatcaagattcgaagttgctctgcattgagctgccaataaagcaggccgtgccaatgaaactcaatgttcagctccgatgaaaaatcccctcacctcgatgagggtttcatggctgagaaacaggtttcgtatgccaacagatgattatgataatttgcttcacaatttcttttctctctccatgtttgttcatgtactctagccatcaggtatcatttgactagggtaaaggtgttgtacacgattgttttctgtctgatgaaataatagctagcaagtcccaatctc

SEQ ID NO: 31190 - protein, 407 aa, Panicum virgatum
  misc_feature: Ceres CLONE 1903955
  misc_feature (287)..(407): Pfam Name: Ribosomal_S9 Pfam Description: Ribosomal protein S9/S16
MLLRRLLLSSRHFRHGLQTVAPATSASSSASSSPFPFRRLRDLLPSRVLSPRLLSTSGRDDDGNKPWSFAADSGDPDPFAQEDAAADAGEALRVGPAAVADEPWTKGFGVEGENGDVFEGIYKEVASAVPASGEAAPAGDEEQWTLSGDEKDPFADSVLEEGIDGIQREGGGLDELDGGEDPEAELKRQKNMEREKELMEILKGPNRAFGDLIANSGITEGMIDSLILLKDVRDVPGLPPLSEIEDEGIQKLSATSSRAEVERQKQEEIAKARVRQVDEKGRAYGTGKRKCSIARVWIEPGNGKFIVNEKEFDAYFPILDHRAELLRPFTVTKNLGLFDVTCTVKGGGISGQVGAIRLGISRALQNWEPGLRPYLKAAGYLTRDSRVVERKKPGKAKARKSFQWVKR

SEQ ID NO: 31191 - DNA, 764 bp, Panicum virgatum
  misc_feature: Ceres CLONE 1903960
  misc_feature: Encodes the peptide sequence at SEQ ID NO. 31192
accctagccccccgccgccgccagccctcgccctcttccaaaccctacccgcacccccgccgccgccgccatgccgccgaagctcgacccgtcgcaggtggtggaggtcttcgtccgcgtgacgggcggcgaggtcggcgcggcgtcgtcgctggcgcccaagatcggcccgctcgggctctccccgaagaagatcggtgaggacatcgccaaggagacggccaaggactggaagggcctccgcgtcaccgtcaagctcaccgtccagaaccgccaggccaaggtctcggtcgtgccctccgccgccgcgctcgttatcaaggcgctcaaggagcccgagaaggacaggaagaaggtcaagaacatcaagcacagcggcaacatcagcctcgacgacgtcatcgagatcgccaggaccatgagggctaggtccatggccaaggagatggccgggaccgtcaaggagatcctcggcacctgcgtcagcgtcgggtgcaccgtcgacggcaaggaccccaaggacctgcagcaggagattgacgacggcgaggtcgagatcccctcagcttagaggctaaggagattgtcattgatgctgctgaagtggtgctctgttctgcatgctgttgtaccttaccaaacaatgtgattccaccttttttttactacccgctattagtgttgtcctggtgagagaaaccacacaaccaaccacacttagcactgatcgagctagctagctaacaaccaagatgggcggccag

SEQ ID NO: 31192 - protein, 166 aa, Panicum virgatum
  misc_feature: Ceres CLONE 1903960
  misc_feature (76)..(144): Pfam Name: Ribosomal_L11 Pfam Description: Ribosomal protein L11, RNA binding domain
  misc_feature (12)..(71): Pfam Name: Ribosomal_L11_N Pfam Description: Ribosomal protein L11, N-terminal domain
MPPKLDPSQVVEVFVRVTGGEVGAASSLAPKIGPLGLSPKKIGEDIAKETAKDWKGLRVTVKLTVQNRQAKVSVVPSAAALVIKALKEPEKDRKKVKNIKHSGNISLDDVIEIARTMRARSMAKEMAGTVKEILGTCVSVGCTVDGKDPKDLQQEIDDGEVEIPSA

SEQ ID NO: 31193 - DNA, 758 bp, Panicum virgatum
  misc_feature: Ceres CLONE 1903969
  misc_feature: Encodes the peptide sequence at SEQ ID NO. 31194
aaagcctcgcctcctgccgcataaacagcatcgacacccacccgcctcaccaccacacccagatttcctctcctcgccgcggcctccattgaccgcccgcgattcccccgcgcgccgcgccagcccagccaccttcttcgtgccgccgccgagctagggacggccgccctcactcgccgctgcgccctgctgcttctcttcgtcctcgcccgtccggatctgaactggcctttcgataacaaggaaacaccttagggaatgcagaaagatgtgcttgcatgttaaagagctacctagtgagggacttgacagggtagccgcccatatttcttctttgccgcctcttgatgacattggggctcatcaacacgcacagctcctgctccttgtgcttctgcacaatggggttcgacgtggcagctcaaccatcttcttagagaaccaccttgggggagacggttgaagtcttcaataaacacttgcaggcttcttgttagtccgtttcaagtcttggatcagtgcggccttttgtgtacatatagtatacattcagcttgatggcggagcataaaggaaatgttttgatgcagaaatatgagatgggagagatgcttggacaagggacctttgcaaaggtctaccatgcccgtaacatgaacactttagaaagtgtgggcgataaggtgattgacaaggagaaggttatgaaggtgggcctcatcgatcagatcaagcggggaaatctctgtcatggagct

SEQ ID NO: 31194 - protein, 66 aa, Panicum virgatum
  misc_feature: Ceres CLONE 1903969
  misc_feature: SWISSPROT Homolog: EC 2.7.11.1 Non-specific serine/threonine protein kinase
MAEHKGNVLMQKYEMGEMLGQGTFAKVYHARNMNTLESVGDKVIDKEKVMKVGLIDQIKRGNLCHG

SEQ ID NO: 31195 - DNA, 3102 bp, Panicum virgatum
  misc_feature: Ceres CLONE 1903971
  misc_feature: Encodes the peptide sequence at SEQ ID NO. 31196
agcgcctctccctcttcctctccaaacgagaagaaagcaccccgccgccgccgccgccggtgatcgagaggggactagccttcccttgcctcgcgttgcctcctctcgccaggagaagcatcgtcatcatcagttcagcagctgcagccatgttcggctccaccaacccatttgggcagtcatcaaccagcccatttggccagaactcattcggaacccagcagggatttggccaggctacccctgctgctaacaacccctttgcgccaaaaccgtttggcagcccaaccacaacttttggggcacagactggaagctcacttttcggcactacatctactggtgcctttggccagcagcagtccactcccacatttggcactacatccactgctgcatttggccagcagcaatccactcccacgtttggtactccgtcctcctctccattcgggagctctccagctttcggtgcatcgcccactcctgcctttggtgctacatcctctacttttggctctggatctttatttggacaaaagccaagttttgggggttttggatcatctcctagccagtcaagtccttttggtggcacgttccagcaaacacagccaacatttggcagcagcacttttggtacatcaactacaccaacattcggtaccacaacttcgccggcatttggtgtaactacaccagcctttggcaccacaactacaccggccttcggcgccacgactaccccagcattgggttcaacatcgccatctttatttggtgcttctagcactccggcgtttggctcatcagctcctggttttggaacttcagcgaccacagcatttggtgtgagtagtagtactacaggttttggatcttccagcacaccgtcatttggcacatcaaccaatgcattcagttttggtccgtcaccatcttttggacaaacaacagttgcctctggtagttccccctttggaacaacatcacctttcggtgtgcagactccagcatttggctcacagacagcagcacccacttttgggcaagcacaatttggtaatcaagctggagggactaaaataaaaccttacgctcaaacaccagatgttgacggtgctaccagtggtactcagcctgctgcaaaacttgattccatatcagcgatgccagaatacaaagataagagtcatgaagagttgaggtgggaagattaccagcgtggagacaagggtggaccaaacccttctggaactccaacagtgacgcctacctttccatcatcaacaccactgaatacttttacaacaaacagtgcatttagccaaactactccaaacccattttcatcaaacaatccatttgctaagaatggttcaactagtgcatcactattcaacacctcatttaacaatacatcagttgcaagttcaagcccattcacatcatccactagtaccacaatgtttggacaaacagatgtttctgcatttccagcaagtagttcatcatctttgtttccaaatgctgctcctgcttttgcttcatcttcattatttggcacgtcagcaccaaataattcaagtctattcggcactggattgtcgttggctaacactcaatcagccccactatttcaatcatcccctgcatttacacaacagccatcaagtacaccagctttctcctctggaaatctatttagcgcagctaatactagcagtctgtttggcagcggaccttcactttttacaacgccaacatttctgcaatctgcccctgctcaaacttcaagcatgttctccttccaacctccgcctcaaccagcttcttcaggtggatttcctgttttttccaacattgctaatcaggccctcattggacagcaaactcctagccaatccaatatggtcatgcaacttgctcctgtctcgaatccatttgggacacttccagcaatgcctcagatgtccatcgggaatggtggatcttctccttcggttcaatatggaatatcgagtttgccggttgctgagaagcctcttccgagtagaacattgtccgcgacagttcctaggcatttattacagagaaggatcaaattgctgccaagaaaatataatccaatatcagatggcaaggttccattctttgctgatgatgctgaatctcctgcaacaccaaaagcggatgctttcttcatccctagagagaacccgaggaatctgataatccgcccactcgagcagtggccctcgcggagtggaattaacaggcaatcagttccaaaggattcagctagtttggacaaatatgaagatgcatccactgaaagtgcgcgtgataaggctgtcaagccaccaagtagcaatccttctctggtggaaaatggcaagcagcatgagcccagcaatcatgggaatgggaagggcacttcagttgaggggctgttgcctaagctccctcaggcagattacttcacggaacctaatctggaggagcttgctgccaaagaacgtggtgagccaggctactgcggtcgtgtggaggactttgttgtggggcgccatggctatggcagcatcaagttccttggggacacggatgtgcggggcctggatctggagtcaatcgtggagttcaacaacagggaggttattgtgtacaaggacgacagcaagaagcccccggtgggtgaggggcttaacaaggctgcggaggtggctcttctgaacatcaagtgcatgaacaagaagacaggggatgagtaccgagatggcccgcgggtggacaggtacaggcagatgcttatgaagaaggcggaggagcagggcgcggagttcgtgtcctttgacgttgccaagggagagtggaagttcagggtggagcacttcagcgcctacgggctctggtgagatgaatcctagggaaggagggatggatgatgaaattgtgtagccaccttaccttgtagcgcttttctggttactagttttggtgtagcaacaaacttgcacgctgtggtgatgtcagtgtcgtgcatgggttttgttatcgatgtcgttgctgtctgtagaatgcttgtcaattaccctaatg

SEQ ID NO: 31196 - protein, 922 aa, Panicum virgatum
  misc_feature: Ceres CLONE 1903971
  misc_feature (754)..(922): Pfam Name: Nucleoporin2 Pfam Description: Nucleoporin autopeptidase
MFGSTNPFGQSSTSPFGQNSFGTQQGFGQATPAANNPFAPKPFGSPTTTFGAQTGSSLFGTTSTGAFGQQQSTPTFGTTSTAAFGQQQSTPTFGTPSSSPFGSSPAFGASPTPAFGATSSTFGSGSLFGQKPSFGGFGSSPSQSSPFGGTFQQTQPTFGSSTFGTSTTPTFGTTTSPAFGVTTPAFGTTTTPAFGATTTPALGSTSPSLFGASSTPAFGSSAPGFGTSATTAFGVSSSTTGFGSSSTPSFGTSTNAFSFGPSPSFGQTTVASGSSPFGTTSPFGVQTPAFGSQTAAPTFGQAQFGNQAGGTKIKPYAQTPDVDGATSGTQPAAKLDSISAMPEYKDKSHEELRWEDYQRGDKGGPNPSGTPTVTPTFPSSTPLNTFTTNSAFSQTTPNPFSSNNPFAKNGSTSASLFNTSFNNTSVASSSPFTSSTSTTMFGQTDVSAFPASSSSSLFPNAAPAFASSSLFGTSAPNNSSLFGTGLSLANTQSAPLFQSSPAFTQQPSSTPAFSSGNLFSAANTSSLFGSGPSLFTTPTFLQSAPAQTSSMFSFQPPPQPASSGGFPVFSNIANQALIGQQTPSQSNMVMQLAPVSNPFGTLPAMPQMSIGNGGSSPSVQYGISSLPVAEKPLPSRTLSATVPRHLLQRRIKLLPRKYNPISDGKVPFFADDAESPATPKADAFFIPRENPRNLIIRPLEQWPSRSGINRQSVPKDSASLDKYEDASTESARDKAVKPPSSNPSLVENGKQHEPSNHGNGKGTSVEGLLPKLPQADYFTEPNLEELAAKERGEPGYCGRVEDFVVGRHGYGSIKFLGDTDVRGLDLESIVEFNNREVIVYKDDSKKPPVGEGLNKAAEVALLNIKCMNKKTGDEYRDGPRVDRYRQMLMKKAEEQGAEFVSFDVAKGEWKFRVEHFSAYGLW

SEQ ID NO: 31197 - DNA, 639 bp, Panicum virgatum
  misc_feature: Ceres CLONE 1903972
  misc_feature: Encodes the peptide sequence at SEQ ID NO. 31198
atcacatctaccccacaccaacccgaaccctagccagcgtcccggtcgcggtgccggcctccgcgagccgcagcgttggttttcccccctcctcagcttcagagcttctccccgagatcggcggcggaatctcaggaaggggtggtggaggcgaggccatgaggctccatggctgaggatgcctgtgctgcgtagcgcggcgcggagggctcgagaggcgcaggggagtccggcggcggcggcggcggcgggagctccggcggcggcagcaccggcaccggtgccaccgccggcaaacacgaggcggagggcgacgagggccgccgcaagggcggaggagagggagcgggaggagatcaggcccgcggaggtcgtcgcgggggaaggcggcgacgacggagaccagggtaggcgtggaatggacgagccggacagcggggcgcacagcgccgacaggctggtagccgatgacgagggcggccctcctgtccctgacacggtccaggtgggaaattcaccaaagtatagagtcgacagaaagcttgggaaaggaggttttggccaagtatatgttggccaccgcatgtcagctactggtcctggtgcagttgaggtggcattgaagtttgagcataagac

SEQ ID NO: 31198 - protein, 153 aa, Panicum virgatum
  misc_feature: Ceres CLONE 1903972
  misc_feature: SWISSPROT Homolog: EC 2.7.11.1 Non-specific serine/threonine protein kinase
MPVLRSAARRAREAQGSPAAAAAAGAPAAAAPAPVPPPANTRRRATRAAARAEEREREEIRPAEVVAGEGGDDGDQGRRGMDEPDSGAHSADRLVADDEGGPPVPDTVQVGNSPKYRVDRKLGKGGFGQVYVGHRMSATGPGAVEVALKFEHK

SEQ ID NO: 31199 - DNA, 1784 bp, Panicum virgatum
  misc_feature: Ceres CLONE 1903989
  misc_feature: Encodes the peptide sequence at SEQ ID NO. 31200
agatcatagcgacgagctagaagtgagaactgagaagcgagctagccagctaggagtaagagagctgatcgatcagggagctgaggaagaagagagaggatagtatcgtacgtagatggcgtcggagaaggtggagacgatcgtggccgggaactacatggagatggagagggccggcagcggtgaggccagcgacggtgccggagacgatcaagccggcggcacggcaaaggcgtcggcgtcgaggaggggcggcggcaaggcgctgtcgagcctgttctggcacggcgggtccgtgtacgacgcctggttcagctgcgcgtcgaaccaggtggcgcaggtgctactgacgctgccctactccttctcgcagctgggcatggcgtccgggatcgtcttccagctcttctacggcctcatgggcagctggacggcctacctcatcagcgtcctctacgtcgagtaccgcaccaggaaggagcgcgagaaggtcgacttcaggaaccatgtcatccagtggtttgaggttctggatgggctgctggggaagcactggaggaacatgggcctcttcttcaactgcactttcctcctcttcggctccgtcatccagctcatcgcatgtgcaagcaacatctactacatcaacgacaagtatgacaagcggacatggacgtacatcttcggcgcctgctgcgccaccacggtcttcatcccctccttccacaactaccggatctggtctttcctcggcctcctcatgaccacctacaccgcatggtacctcaccatcgccgccatcgtgcacggccaggtggaaggtgtgacgcactcggggccgagcaagatggtgctctacttcactggggccaccaacatcctctacacctttggaggccatgctgtcacagtggagatcatgcacgccatgtggaagccgcagaagttcaagctcatctacctggctgccacgctgtacgtgctgacgctgacgctgccgtcggccgccgccgtgtactgggccttcggcgacgcgctcctggaccactccaacgccttctccctcctcccgcgctccggcttccgcgacgccgccgtggtcctcatgctcgtccaccagttcatcaccttcggcttcgcctgcaccccgctctacttcgtctgggagaagctcgtcggcgtgcacgaggcccggagcgtggcgctccgcgccgccgcgaggctccccgtcgtgctccccatctggttcctcgccatcatcttccccttcttcgggcccatcaactccaccgtgggctccctgctgatgagcttcaccgtgtacatcatcccggcgctggcgcacatggccaccttcgcgccggcggccgccagggagaactccgtcgagcggccgccgcgggggctcggcggctggccgggcatgtacgccgccaactgcttcgtggtggcgtgggtgctcgtcgtcggattcgggttcgggggatgggccagcaccgtcaacttcgtccggcaggtcgacaccttcgggctcttcaccaagtgctaccagtgcccaccaaagcactgacacgatctactactctgacagcagagagacacatcgagattaagcagagcttgttcttcgtctatttccatgtcgtgtcggcacacatacgacgacgtacgacatgatgtgttgtcagtacgcgtgctgtatgtatgtatgtatgtatgtatgtatgtatgtatgtatgtatgtatgtatgtatgtatgtatgtatgtatgtatgtatgtatgt

SEQ ID NO: 31200 - protein, 484 aa, Panicum virgatum
  misc_feature: Ceres CLONE 1903989
  misc_feature (57)..(451): Pfam Name: Aa_trans Pfam Description: Transmembrane amino acid transporter protein
MASEKVETIVAGNYMEMERAGSGEASDGAGDDQAGGTAKASASRRGGGKALSSLFWHGGSVYDAWFSCASNQVAQVLLTLPYSFSQLGMASGIVFQLFYGLMGSWTAYLISVLYVEYRTRKEREKVDFRNHVIQWFEVLDGLLGKHWRNMGLFFNCTFLLFGSVIQLIACASNIYYINDKYDKRTWTYIFGACCATTVFIPSFHNYRIWSFLGLLMTTYTAWYLTIAAIVHGQVEGVTHSGPSKMVLYFTGATNILYTFGGHAVTVEIMHAMWKPQKFKLIYLAATLYVLTLTLPSAAAVYWAFGDALLDHSNAFSLLPRSGFRDAAVVLMLVHQFITFGFACTPLYFVWEKLVGVHEARSVALRAAARLPVVLPIWFLAIIFPFFGPINSTVGSLLMSFTVYIIPALAHMATFAPAAARENSVERPPRGLGGWPGMYAANCFVVAWVLVVGFGFGGWASTVNFVRQVDTFGLFTKCYQCPPKH

SEQ ID NO: 31201 - DNA, 1364 bp, Panicum virgatum
  misc_feature: Ceres CLONE 1903998
  misc_feature: Encodes the peptide sequence at SEQ ID NO. 31202
acacacacctgcgcatccgctgctgccgcatccctcaagcttccgcccggggagagggagagacctcggctcctccccagtggtccttttcactatcctccttccttgctcacctcgaaacccgaatcttgttttgcgatgatatgatggtacatagctccaggccttcacccgattcaaggtctcggctttcggcgtcccccgtgctctagtgccgcttggattcgggccaatgggcgcggctcagctggtggcttggttcttggcgctcgccgccgccgcgggggcggcggtgtcggcggcgggggcgcggccgagcaaggtggccctgggcgccctcttcacgtacgactccacgattggccgcgcggcgcggctcgccgtcgagctcgccgtcgacgacgtcaacgcggacggcacggtgctcgcggggacgaagctcagtctgaagagccgcgacaccaactgcagcgcctttcttgggaccgtcgaagcatttcagcttatggaggaaaatgtagttgctgtgattgggccgcagtcctcggggataggccatgtcatctctcatgttgctaatgagctacatgttcctcttctgtcatttgcggccacagatccagctcttgctgcattagagtatccctacttcttaagaacaaccataagtgactacttccaaataaatgctgttgctagcattgttgattactatcaatggaaaagagtgactgctatatacgttgatgatgattatgggcgaggtggtgtgtccgcccttggtgatgcacttgcaacaaaaagggcaatcatttcatataaagcagctattcccccaaattcaaatgcagacgtgatcagtgatgtactggttagagcaaatatgatggaatcaagggtcatggttgtgcatgtcaatcctgacacgggaaagagaatattttctgcagctaacaagctccagatggttgccagtggctatgtctggatagtaactgattggctagctgctgtccttgattcctcagcatctagagatcttaaagatatgagtcatattcagggactgattgttcttcgtcagcatactcctgaatctgatgctaagaataagttcatatctaaatggaatactatggctcgtaacagaagtgttacttctggcttgaactcatatggcttttatgcttatgacagtgtttggactgttgctcgtgctatcgatcaattcctcgacagtgggcaacagatcaacttctcaacagatcccaggttgcatgattcaaatggcaacactttgcgtctatcaactctcaagatatttgatggtggtgagcagatgctacagcaacttctactcacaa

SEQ ID NO: 31202 - protein, 377 aa, Panicum virgatum
  misc_feature: Ceres CLONE 1903998
  misc_feature (46)..(368): Pfam Name: ANF_receptor Pfam Description: Receptor family ligand binding region
  misc_feature: SWISSPROT Homolog: EC 4.6.1.2 Guanylate cyclase
MGAAQLVAWFLALAAAAGAAVSAAGARPSKVALGALFTYDSTIGRAARLAVELAVDDVNADGTVLAGTKLSLKSRDTNCSAFLGTVEAFQLMEENVVAVIGPQSSGIGHVISHVANELHVPLLSFAATDPALAALEYPYFLRTTISDYFQINAVASIVDYYQWKRVTAIYVDDDYGRGGVSALGDALATKRAIISYKAAIPPNSNADVISDVLVRANMMESRVMVVHVNPDTGKRIFSAANKLQMVASGYVWIVTDWLAAVLDSSASRDLKDMSHIQGLIVLRQHTPESDAKNKFISKWNTMARNRSVTSGLNSYGFYAYDSVWTVARAIDQFLDSGQQINFSTDPRLHDSNGNTLRLSTLKIFDGGEQMLQQLLLT

SEQ ID NO: 31203 - DNA, 791 bp, Panicum virgatum
  misc_feature: Ceres CLONE 1903998-R
  misc_feature: Encodes the peptide sequence at SEQ ID NO. 31204
ggaccaaactacggcggtgttgccgtgattgtggatgagaagccgtatattgatatcttcctgtcatactactgcaacttcagaatagtagggcagcaattcacaagggaaggatggggctttgcattccagagggactcccctcttgctgcagacatgtcaacagccatacttcaactttcagagagtggccaacttcagagaattcatgacgagtggttcacgcgtcgtggttgcgcctctgatgatgagagccaggtgggagcaaccaggcttggcgtcggaagcttttcaggccttttcctcatgtgtgccctgatatgtatcttcgctctggtggtgttcttcatacggatctgctggcaatacaaccagtactccagttctgaagctgcccgtgagcccagtgcagccgatgctgatgctatccagcggaggccatcaggctgcagcttcaaagagctgttacagtttgtcgacaagaaggaggaagaaatccggaggaagatgaaacgaagatcaagcgacaaagataaccaagctgcaggttcctctggtgcgctgtcagtgacttcagcgtactaacgttctttcaggcgtcagtccttcagatggcagagcatggaaatacattaccaagaaacatatcgaacagattcatgtagatagtggtgatatatcttgatcctagaatcccttaagatctataggattgccttgtctatgatatacgtggtttgtattccacaactgtaagtttctttgcttttctaacaagcatatttctggcc

SEQ ID NO: 31204 - protein, 194 aa, Panicum virgatum
  misc_feature: Ceres CLONE 1903998-R
  misc_feature (1)..(118): Pfam Name: Lig_chan Pfam Description: Ligand-gated ion channel
GPNYGGVAVIVDEKPYIDIFLSYYCNFRIVGQQFTREGWGFAFQRDSPLAADMSTAILQLSESGQLQRIHDEWFTRRGCASDDESQVGATRLGVGSFSGLFLMCALICIFALVVFFIRICWQYNQYSSSEAAREPSAADADAIQRRPSGCSFKELLQFVDKKEEEIRRKMKRRSSDKDNQAAGSSGALSVTSAY

SEQ ID NO: 31205 - DNA, 721 bp, Panicum virgatum
  misc_feature: Ceres CLONE 1904006
  misc_feature: Encodes the peptide sequence at SEQ ID NO. 31206
tccaatccggaggagttgggtgggagagtggccatccgcgagaggagaagatggcgagcagcaacggcaagccggcgcaggcggaggaggggaagggggcagcggaggggtcgatcggcgggtacgagtccctgcacaggctcctggaggccaacctctcccccgagctcttccaggaagcaagccggttgctgttggggctgaattgtgcacgacctcttgaggctatcgcactgcctgaagccacaatgactcttgcagaaacacataattttgatgtgcaggccttccgttttagtgcagataaagagtttcttaggcaaccacgagttgttcgagttggtctaattcagaactcaattgctgttcccactacttgtcattttgctgagcaaaagaaggctatcatggataaaattggacccatcgttgatgcagctggtgcttctggtgtcaatattttgtgcttacaagaagcctggacaatgccttttgcattctgcacacgtgagaaaaggtggtgtgagtttgccgaaccagttgatggagaatctactcagttccttcaagaacttgcacaaaagtataacatggtaattgtgaacccaatcctcgaaagggatgtaaaccatggggagactatttggaatactgctgtcataattggaaataatggcacataattggcattcatcgaaagatcatatcccaagagtgggtg

SEQ ID NO: 31206 - protein, 210 aa, Panicum virgatum
  misc_feature: Ceres CLONE 1904006
  misc_feature (96)..(210): Pfam Name: CN_hydrolase Pfam Description: Carbon-nitrogen hydrolase
  misc_feature: SWISSPROT Homolog: EC 3.5.1.6 Beta-ureidopropionase
MASSNGKPAQAEEGKGAAEGSIGGYESLHRLLEANLSPELFQEASRLLLGLNCARPLEAIALPEATMTLAETHNFDVQAFRFSADKEFLRQPRVVRVGLIQNSIAVPTTCHFAEQKKAIMDKIGPIVDAAGASGVNILCLQEAWTMPFAFCTREKRWCEFAEPVDGESTQFLQELAQKYNMVIVNPILERDVNHGETIWNTAVIIGNNGT

SEQ ID NO: 31207 - DNA, 734 bp, Panicum virgatum
  misc_feature: Ceres CLONE 1904011
  misc_feature: Encodes the peptide sequence at SEQ ID NO. 31208
atccctagcaaatccaaacgtcgcgacgctgctgatttcggccggctacaagaaagagcctcgacaaaataggattgtcggaccccagggtcgcctgcaaccccgcttccgaggagcctgccgcggacatctccagccatggggcgcaggcctcgctcgatctgggcaggctgaacttgacgtggtcgcccgcgtcgtagtagccgctgatgaggtccaccccctgctgcagcccgtcgctagttgccggaatcccggagtcacgagtcggagatcggagctcgaaacagggccggaagaactcacacagctgcatgcccgcatacataacaggcgcgtttagaccaaacaacaagcaagcctgtgtacaaggagcaaacatggcgttgagaggcttggcaacagcgctgctcctaatcaacttgtcctcttgttatctctctactccatccttcgccacctctgatggcttcatccagtgcctgacgcagaagatacccagtgagctgatcgtcacgccgggctccagtaacttcaccagcgtgcttgtctcaaccagcaagaactccaacttcttaaccaatgccacggtgaagccgatttgcatcgtcaccgtgacagacgcctcccacgtgcagaccgccgtggtgtgcgggcgtcagaacggcgtgcgcctccgcgtgcgcagcggcgggcacgactacgagggcctgtcctacgggtcggcgcggggc

SEQ ID NO: 31208 - protein, 117 aa, Panicum virgatum
  misc_feature: Ceres CLONE 1904011
  misc_feature: SWISSPROT Homolog: EC 1.21.3.3 Reticuline oxidase
MALRGLATALLLINLSSCYLSTPSFATSDGFIQCLTQKIPSELIVTPGSSNFTSVLVSTSKNSNFLTNATVKPICIVTVTDASHVQTAVVCGRQNGVRLRVRSGGHDYEGLSYGSAR

SEQ ID NO: 31209 - DNA, 684 bp, Panicum virgatum
  misc_feature: Ceres CLONE 1904044
  misc_feature: Encodes the peptide sequence at SEQ ID NO. 31210
atcggctgcagcaaggagaggccacacccctagtagtgcgcgcttctcgcctgcactagctatagccagcggcacattgacgccggccgtgcaccacctcaccgcggccgcagcgacgggagcgtggagagagagagagagagagagagagagagagagagagagagagagagagagagagagaaatacctacgggccggtatagccgctgcgaggtagtgaggaagaaagaggaagaagtgggaggttagcagcatagtagccatgacgatgaggcagtcgaggttcaagaggatctgcgtcttctgcggcagcagccagggcaagaagcggagctaccatgacgccgccattgagctcggcaacgagctggtggcgcggagcatcgacctggtgtacggcggcggcagcatcgggctcatggggctcgtctcccaggccgtctacgacggcggccgccacgtcatcggggtcattcccaagacgctcatgacaccggagatcagcggcgagacggtcggtgaggtgcgtccggtggccgacatgcaccagaggaaggcggagatggcgcggcagtccgacgcattcatcgccctgcccggagggtacggcacgctggaggagctgctcgaggtcatcacgtgggcgcagctgggcatccaccacaagccggtcgggctgctg

SEQ ID NO: 31210 - protein, 139 aa, Panicum virgatum
  misc_feature: Ceres CLONE 1904044
  misc_feature (53)..(139): Pfam Name: Lysine_decarbox Pfam Description: Possible lysine decarboxylase
MTMRQSRFKRICVFCGSSQGKKRSYHDAAIELGNELVARSIDLVYGGGSIGLMGLVSQAVYDGGRHVIGVIPKTLMTPEISGETVGEVRPVADMHQRKAEMARQSDAFIALPGGYGTLEELLEVITWAQLGIHHKPVGL

SEQ ID NO: 31211 - DNA, 1471 bp, Panicum virgatum
  misc_feature: Ceres CLONE 1904054
  misc_feature: Encodes the peptide sequence at SEQ ID NO. 31212
acctctggtaaccctacactctcgttctgtgcgcttccctcaccgccgccgccgccgcgccctcgcagcagctagccgccatggcgccgccggccagcaccgacgagcccgcgcgccacaggaaggccaagaaatccaagctcgataaggaagagaagaagcagaagaagaggagccaggagcgccccgccaccgaggacgcccctgcccccgacgccgccgagcgcaagaagcggaagctgtactggagaataacccctccaagagcgcaagctccaaggagcagattttttctggtacagagaacacgaatgcaaacaatgctcgtggtgccacctcaataaaatctccaaaaggagcacatgagaaggctggctctgtcggaaaaggtggagagcaaccttttctctaccagcacaatgtgtatgcaccgcagccacaggcactctatcctggaggatacatgaatccttcagggcaatgggaagaatatccccattatgtgaatatggaggggctccactctgtatcacctggtatctacaatgacaaccagtcactcatgctatctcctggatatgcaaacaacccccaaatgatgtatggggcctattctcctgtttcaaccgttggggatggccaacaatacttacctatgcacttccccttctcaaattcatactatcaaccaccagcttctcctagcatgggatactcaaactcagtgccaggaatatctcaaggagaccctatgcttcagccagagtacttccttcctgatggccttctatattcacccactccagggtatcaccaaccatttagttcatttgacagagcaccaacacagccaaataacgctcctggattatttggtcaagggagcatgccactggcttctggaatgcatcatggatcggcgtatggtcctggatcctataaggcacgccagcaaggtagcaaatttggaggcactactccaagttggagttctggtcgcagatttggtgctttcgacttcagtgccaatcaacaaaggggcatgccatttggtagccacaatggctctctggagtttatgaatgagcaaaaccgtgggccacgtgccacaaaaccaaagatgcaagacgcagagaactcctcaggagacgaagaaagcgagaaaacagttccgctgattgatagtgaactgtacaatcgccctgattttatcactgagtacaaagatgccaaattctttgtaataaagtcctacactgaggaccatgtacataggagcattaagtatagtgtttgggccagcacagctagcgggaatagaaagctggattctgcttaccgtgcggccaaagagaaagaagagcattgtccaattttcttgtttttctcggttaacggcagtggtcaattctgcggtgttgctgagatgattggacctgtcgatttcgacagaagtgttgattactggcag

SEQ ID NO: 31212 - protein, 335 aa, Panicum virgatum
  misc_feature: Ceres CLONE 1904054
  misc_feature: SWISSPROT Homolog: EC 2.7.7.6 DNA-directed RNA polymerase
MNPSGQWEEYPHYVNMEGLHSVSPGIYNDNQSLMLSPGYANNPQMMYGAYSPVSTVGDGQQYLPMHFPFSNSYYQPPASPSMGYSNSVPGISQGDPMLQPEYFLPDGLLYSPTPGYHQPFSSFDRAPTQPNNAPGLFGQGSMPLASGMHHGSAYGPGSYKARQQGSKFGGTTPSWSSGRRFGAFDFSANQQRGMPFGSHNGSLEFMNEQNRGPRATKPKMQDAENSSGDEESEKTVPLIDSELYNRPDFITEYKDAKFFVIKSYTEDHVHRSIKYSVWASTASGNRKLDSAYRAAKEKEEHCPIFLFFSVNGSGQFCGVAEMIGPVDFDRSVDYW

SEQ ID NO: 31213 - DNA, 671 bp, Panicum virgatum
  misc_feature: Ceres CLONE 1904054-R
gatgctaaccatcttcaagaaccatgaggctgagacgacaatcatggaggattttgacttctatgagcagcgggagaaagccttgcaggagaacagacgtcaacagcagcctggcagcgctgatcctcagaagccagcagataccaaggcacaagctgtggccgatatgtcagacgcatttgctaaggtcatccagttgaaggagaccgagaacagtgggaaatcccagaaagctgagggcgcctcagctgaaaatggatccactatggctaaggttgaagaaggcgatgcaaacgtgaaggcaggccctgtggaggaaagtggttgatttatctgtctgctcatttggaagcagcagctgtgtgaaggttggagggggcaaagtgcaggttgattgtgttaaatatggttgtcgtgtcagttgtacaacatcatagggctttgtttcatctccatttaggttataatttcaatatcatagttctataattgttgttcgcagttctcttcatccctgttttattcttgcatgtgtcttctcatgcctctcgtgtcgcaccaagaatgctgttcattctagtggtttagccataagaaactgcagaattatgctgcggtaacgttgcattttctgcagttggaagatgatactatcatgtctttccttgtct

SEQ ID NO: 31214 - DNA, 546 bp, Panicum virgatum
  misc_feature: Ceres CLONE 1904060
  misc_feature: Encodes the peptide sequence at SEQ ID NO. 31215
gaaatcgaagcagcagcagcaatggcggcatccatgatcacgtcgtcagctctggtggcgccggccagggcccagggcctgccgtcccacggccgccgcgcctcctccttcgccgtcgtctgcggcaccggcaagaagatcaagaccgacaagcccttcgggattggaggtggcctcaccgtcgaccacgatgcctccgggaggaaggtcaagggcaagggcgtgtaccagttcgtcgacaagtacggcgccaacgtcgacggatacagcccaatctacaaagaggaggactggtctcccaccggtgacgtctacgtcggtggaaccaccggacttctgatctggtccgtcaccctcgtcgggctccttgccggcggcgccctccttgtttacaacaccagcgccctcgccagctagcaacattattcatgcatagtccatgaaagcgcttgcggccggtccatatataagatttatcatcagcccgggtgtctgtgtgtaatctagcctgcagcttcgatgcccaatataatgcttggttcatgc

SEQ ID NO: 31215 - protein, 131 aa, Panicum virgatum; identical to SEQ ID NO: 12594
  misc_feature: Ceres CLONE 1904060
  misc_feature (35)..(131): Pfam Name: PsbR Pfam Description: Photosystem II 10 kDa polypeptide PsbR

SEQ ID NO: 31216 - DNA, 703 bp, Panicum virgatum
  misc_feature: Ceres CLONE 1904066
  misc_feature: Encodes the peptide sequence at SEQ ID NO. 31217
atctcgccctggccttgattttggtttgccgccggttgctgcttaccctgcctgatgttgctttgattcatccagaggctgggaactccaaagaggaacagggtccatggagggtggaggcgcaggaaatggtttcactgggacggcgcagacaaaggggactgggggtgatggctccgccaagccgctgcccccttgctgcgtcaaggccagggccgcggcggctgagtctgaggccaagtgtcatgctacagtggtgtcgggatggttcaccgaaccacggtcacgatgcggtaaagcaagcaaagttcaatactacaataacccgatgtggccaggagaggcccactccttgaaagtggagaagatcttgtaccaggggaagtcaccataccaagaagtcttagtttttgagtcgtcaacctatggtaaagtccttgtgcttgatggcattgttcagttgactgataaggatgaatgcgcgtaccaagaaatgattactcacctcccactttgttccatttcatcccctaaaaaggttttagttattggtggtggtgatggtggtgtactccgagagatttccagacatagttctgtggagtctattgacatatgtgaaattgatcagctggttattgatgtttgcaaagatttcttcccacaactgtctggttggatttgaagatcctcgtgttcaact

SEQ ID NO: 31217 - protein, 192 aa, Panicum virgatum
  misc_feature: Ceres CLONE 1904066
  misc_feature (53)..(192): Pfam Name: Spermine_synth Pfam Description: Spermine/spermidine synthase
  misc_feature: SWISSPROT Homolog: EC 2.5.1.16 Spermidine synthase
MEGGGAGNGFTGTAQTKGTGGDGSAKPLPPCCVKARAAAAESEAKCHATVVSGWFTEPRSRCGKASKVQYYNNPMWPGEAHSLKVEKILYQGKSPYQEVLVFESSTYGKVLVLDGIVQLTDKDECAYQEMITHLPLCSISSPKKVLVIGGGDGGVLREISRHSSVESIDICEIDQLVIDVCKDFFPQLSGWI

SEQ ID NO: 31218 - DNA, 735 bp, Panicum virgatum
  misc_feature: Ceres CLONE 1904070
  misc_feature: Encodes the peptide sequence at SEQ ID NO. 31219
gactcggcgaccgagccggcgaagaagaggtacatcgttctaacagaggaccttctcctggcgcggcaagcggcggacacggccaccgtcgccgaggtcctgacgatcccggcgggcttcgcggccgtcctcctgcgccgcttcaactggagcccggaaagggtccaggacgcgtggttttccgacgaccggcgcgtccgcgacgccgtcgggatgccggccgacggcgcagtcgcccccgcgcccatggcgctcggcgcccggcgcctcgtctgcggcatctgcttcgccaagttctacgccggcaagacgcggtcggccgggtgctcccacttctactgcgacgagtgctggcgcgggtacgtcggcgcggcggtgggcgacggcccgcgctgcctggcgctgcggtgcccggacccggcctgctcggcggccgtcgtccgggacctcgtcgacgcggtggccgcggacgaggacagggcccggtacgcgcggttcgcgctccggtcgtacgtggaggagagcggcggccggctcaagtggtgccccggcgccgactgcgccctggctgtcgagctcctcggcggcgccgccctcggccccggagagcaggtcgacgtgttctgcgcgtgcgggcacggcttctgctggagctgcggcgaggaggcgcaccggccggtgtcgtgcgacacggtgcgggcgtggctggcgaagaactcgtcggactcggagacg

SEQ ID NO: 31219 - protein, 244 aa, Panicum virgatum
  misc_feature: Ceres CLONE 1904070
  misc_feature (161)..(229): Pfam Name: IBR Pfam Description: IBR domain
DSATEPAKKRYIVLTEDLLLARQAADTATVAEVLTIPAGFAAVLLRRFNWSPERVQDAWFSDDRRVRDAVGMPADGAVAPAPMALGARRLVCGICFAKFYAGKTRSAGCSHFYCDECWRGYVGAAVGDGPRCLALRCPDPACSAAVVRDLVDAVAADEDRARYARFALRSYVEESGGRLKWCPGADCALAVELLGGAALGPGEQVDVFCACGHGFCWSCGEEAHRPVSCDTVRAWLAKNSSDSE

SEQ ID NO: 31220 - DNA, 1236 bp, Panicum virgatum
  misc_feature: Ceres CLONE 1904077
  misc_feature: Encodes the peptide sequence at SEQ ID NO. 31221
tccctcgtttcgtcacaccgctacaccccaaaaacctcacgcgctcccacccctgcccctcgccgcgccggcgagaggggcgctcacccacccgtgcccgtgtaaccacgccggagcgggaggcctccggaggtaccccgcgccttatccgctcgcccagatctacctctgcctcccgccgcgtcggggcgatcccgccgaggtcctgggtataagctactgtcatggcgaccaacacaggagcgtcaggatggttgaggggtaaggtgaaggctgtgacatcaggggattgtctactcatcatgggaagcacaaaggctgagatcccacctgagaagtccatcaccctgtcctaccttatggctccaaggctggctcgccgtggtggagtggatgagccctttgcatgggaaagcagagagtttctgagaaagctttgcattggcaaggaggtcacattcagagtggattatacagctcccaatattggacgagaatttggtactgtttatcttggtgacaaaaatgttgcgtactcagtagtttctgctggatgggcaagggtaaaggagcaaggccccaaggggggtgaacaaaatccataccttactgagctgctaaggttggaggaagttgccaagcaacagggtgttggtcgttggagcaaggaacctggtgctgctgaagagtccataagagatcttccaccatctgcaattggtgaagcaagcggttttgatgcaaagggttttgcagttgcaaataaaggcaagagtttggaggccattgttgaacaagttcgcgatggcagcaccgttcgtgtgtacttgctccctagtttccagtttgtgcagatatatgttgctggagtacaggctccatccatggggaggcgctcatcagcacctactgttgttgctaaaacggatggtactgctaatggtgcaaatggtgaagattctgagggagcacctgctcagctgactacagcacaaagacttgctgcatcggcagcttctgctgaaattccaccagataggtttggaagagaagccaagcacttcacagagactagagttctcaacagagatgtgcggattgtggtggaaggcactgacagcttcagtaatataattggctctgtgtattaccctgatggagacactgcgaaggacttggccctcgagctagttgaaaatggtcttgcaaagtatgttgagtggagtgctaatatgc

SEQ ID NO: 31221 - protein, 337 aa, Panicum virgatum
  misc_feature: Ceres CLONE 1904077
  misc_feature (9)..(148): Pfam Name: SNase Pfam Description: Staphylococcal nuclease homologue
  misc_feature (183)..(335): Pfam Name: SNase Pfam Description: Staphylococcal nuclease homologue
MATNTGASGWLRGKVKAVTSGDCLLIMGSTKAEIPPEKSITLSYLMAPRLARRGGVDEPFAWESREFLRKLCIGKEVTFRVDYTAPNIGREFGTVYLGDKNVAYSVVSAGWARVKEQGPKGGEQNPYLTELLRLEEVAKQQGVGRWSKEPGAAEESIRDLPPSAIGEASGFDAKGFAVANKGKSLEAIVEQVRDGSTVRVYLLPSFQFVQIYVAGVQAPSMGRRSSAPTVVAKTDGTANGANGEDSEGAPAQLTTAQRLAASAASAEIPPDRFGREAKHFTETRVLNRDVRIVVEGTDSFSNIIGSVYYPDGDTAKDLALELVENGLAKYVEWSANM

SEQ ID NO: 31222 - DNA, 783 bp, Panicum virgatum
  misc_feature: Ceres CLONE 1904077-R
  misc_feature: Encodes the peptide sequence at SEQ ID NO. 31223
atagtcctcgcacaatttagcctcgacaactcctggaacagagctatgattgtaaatggacctcgtgctgtggaatctccaaatgacaagtttgaagtattctatattgactatggcaaccaagaggtggttccctacagccgtttgcgacctgtggacccatctatttcctcgtctcctgctcttgctcagctatgcagccttgctttcataaaagtgcctattctagaggaggattttggtcaggaagcagcagaatatctgagtgaatgtttgctcagtagctcaaagcaataccgggcaatgattgaagaccgtgatacttctgggggaaaatcaaaaggacaaggaacaggaaatgttctcattgttactcttgttgatgcagagacggaaagcagcataaatgctaccatgcttgaggaagggcttgcccggcttgaaaggagcaagaggtgggacactagagagaggaagacggctctccagaacctggagcagttccaggagaaagcaaagaaggaacggctgcggatgtggcagtatggagatgttgaatctgatgaggacgagcaggctccagctgcaaggaagcctgggggccgtcggtagagagtagagaaccgggcgtaaggctgtggtctggttattccgtattttacatcgtaagattaaaggttaaaggtacattttttcccccgtaaacttaataagtcatgtctgttcgctgcggttctttgtagacaaaaatataatgttgagaattgcagtgaattaaaattc

SEQ ID NO: 31223 - protein, 203 aa, Panicum virgatum
  misc_feature: Ceres CLONE 1904077-R
  misc_feature (1)..(70): Pfam Name: TUDOR Pfam Description: Tudor domain
IVLAQFSLDNSWNRAMIVNGPRAVESPNDKFEVFYIDYGNQEVVPYSRLRPVDPSISSSPALAQLCSLAFIKVPILEEDFGQEAAEYLSECLLSSSKQYRAMIEDRDTSGGKSKGQGTGNVLIVTLVDAETESSINATMLEEGLARLERSKRWDTRERKTALQNLEQFQEKAKKERLRMWQYGDVESDEDEQAPAARKPGGRR

SEQ ID NO: 31224 - DNA, 706 bp, Panicum virgatum
  misc_feature: Ceres CLONE 1904122
  misc_feature: Encodes the peptide sequence at SEQ ID NO. 31225
  misc_feature (601)..(601): n is a, c, t, g, unknown, or other
atctcctccagactgcaatagtgctcgtgtttactgtgccgaaatgattcagtccactgagcctgggagcacgctttacagtgatcgcacaccgactctgtcggtgctccgcccttaaattgggcagcatcatggcgccacggtccatcatcgcatcggcactcctctctgcaaagagagctatcggaggaggaggagagcttttgggcttttgggggtgcgtggtgcgccatgggggaggtgaagcacctgtgcctggtgaagttcaaggagggcgtcgtggtggaggacgtcctcaaaggcatgaccgaccttgtcgcccagatggacatggtcaaatccttcgagtggggccaggacgtgctgaaccaggagatgctgacgcagggcttcacgcacgtcttctcgctcaccttcgcctccgccgacgacctcaccacctacatgggccacgacaagcacgccgcgttcgccgccacgttcatggccgcactcgagaaggtggtcgtcatcgacttccccgtcgtcatcgccaagccaccgccatcggcatgatcgacctgccacagcatctgtcggccattgtacggtgccttttcangtagcagatcatcgcctatttgcagcggtgatgtactgcgtgtctaagtacgtactatgtactaagctccttattactactcgttctgcctgatgctgtgtcccg

SEQ ID NO: 31225 - protein, 107 aa, Panicum virgatum; identical to SEQ ID NO: 9934
  misc_feature: Ceres CLONE 1904122
  misc_feature (4)..(98): Pfam Name: Dabb Pfam Description: Stress responsive A/B Barrel Domain

SEQ ID NO: 31226 - DNA, 788 bp, Panicum virgatum
  misc_feature: Ceres CLONE 1904128-R
  misc_feature: Encodes the peptide sequence at SEQ ID NO. 31227
atcccatctttcctgtcactgaatatgatcaagaattggatgaggagagcctgaatccgggagagcagatctacgagaagttaatgtcaggaatgtatttaggtgaaattgtaaggagggtactccttaaaatatcattgcactcctcaattttcggcaatattgatcacactaagctcaaaacccacttcgtcttgcggactccacatatttctgcaatgcaccatgatgaaacacctgatctgaagattgtggctgaaaaactggaagaaaacctagagataacaagcacatctttggagactcgaaaattggttgtagaagtctgtgacatcgtggcaagaagggcagcccggctggctgctgcagggcttgcagggatcctcaaaaggctcgggagagattgcaacgcccaggagcaacgatcagtcattgccattgacgggggattattcgagcactacaccaaattccacgaatgcttggagagcacactgggcgagttgctgggagaggaggcgtccaagtcagtggccgtcaagcacgcagatgacggttcaggaataggtgctgccctgattgcagcttcgcagtctcagtacagaaatgttgagtgatatagtaaaagctggcaaaagtatttgccatacatcttgggaagattaactagcaagtagctcgaaattcttccccacatcttaacagtccagcatgtgcagttcacaatgctgagctggaagcaatctgtaaccgaaatgaggcttgaggaagtgactatgcatagttcc

SEQ ID NO: 31227 - protein, 204 aa, Panicum virgatum
  misc_feature: Ceres CLONE 1904128-R
  misc_feature (3)..(199): Pfam Name: Hexokinase_2 Pfam Description: Hexokinase
  misc_feature: SWISSPROT Homolog: EC 2.7.1.1 Hexokinase
PIFPVTEYDQELDEESLNPGEQIYEKLMSGMYLGEIVRRVLLKISLHSSIFGNIDHTKLKTHFVLRTPHISAMHHDETPDLKIVAEKLEENLEITSTSLETRKLVVEVCDIVARRAARLAAAGLAGILKRLGRDCNAQEQRSVIAIDGGLFEHYTKFHECLESTLGELLGEEASKSVAVKHADDGSGIGAALIAASQSQYRNVE

SEQ ID NO: 31228 - DNA, 489 bp, Panicum virgatum
  misc_feature: Ceres CLONE 1904128
aaaaaccctctccctcccagatcacagctcccgcacacgcttccactcacccgaggccgccggggggccaccggccgccgtccgcgggtgagggcgacccttcccatcccgggctcccggccaacttctcctttcacctccacggcgacctgacgcaggaaactccatgtgatccccggcccgatccggccgctccgccccctggatggaatctatccctggagcgcgctagcatgatccgcccccgcgcatctcgctctgcacgtcccgagaaagtagcaagaaaacagcgccgcgcccacacaggagcacacgggcgcgccgccgtccctttcctgctccccccccccccccmgagcgagatgcgcgggggcggatcatgctagcgcgctcaagggatagattccatccagggggcggagcggacggatcgggccggggataacatggagtttggtgaaattagaaaaaaaatttgataacaaacac

SEQ ID NO: 31229 - DNA, 260 bp, Panicum virgatum
  misc_feature: Ceres CLONE 1904131
  misc_feature: Encodes the peptide sequence at SEQ ID NO. 31230
ctctcctctcctctccgccccgcgccgaagaacccccggccaaacccccagcccgtgataacctcgcacctgccttcgccccgtcgaccatggcgctccaggcggcgacgtccttcctcccctcggccctctccgcgcgcaaggaggggtcggtgaaggactcggcgttcctgggtgttcgtctcgcggatggcctcaagctggagaccagcgctctgggcccgccgaccacgagggggagagcgtgttccgggcccatg

SEQ ID NO: 31230 - protein, 56 aa, Panicum virgatum
  misc_feature: Ceres CLONE 1904131
  misc_feature: SWISSPROT Homolog: EC 1.3.1.33 Protochlorophyllide reductase
MALQAATSFLPSALSARKEGSVKDSAFLGVRLADGLKLETSALGPPTTRGRACSGP

SEQ ID NO: 31231 - DNA, 715 bp, Panicum virgatum
  misc_feature: Ceres CLONE 1904135
  misc_feature: Encodes the peptide sequence at SEQ ID NO. 31232
agcttcccgtcgccgcctcctgcttcctaccagtatctcctctggactccggcggggggcgagagagagggcggcggcggcgctggctgttccgaggctgatggcgaggggcgcgacggcggggctgcttctgcttctgctcctcgcggcgctcctggcctccgcttctcccgcggcggcggcggaggggcgagggcgacgagtgcttaggacgaagcattctggtggtggttatcattacaaccatactctcgctcatattcttgtcgaatatgcatccgctgtctatacatctgacttaacgtcactgttcacgtggacatgtccaaggtgcaaaggtcacacgaagggttttaaggtgatagaggtcattgtagatgtggagaactgcttgcaggcatttgttggagttgcccctgacccacggtctgtaatcgttgcatttagaggcactcaagaacacagcatttcaaattggattgaagatctcttctggaagcagctcgatgtgacttatccaggcatgcctgatgcaatggtccatcatggcttttattctgcatattataatacaactctgcgacatgagatattgaaatctattcaatgggcatggaagacatatggaaaactacccatagatgttgtgggtcactccatgggaggggccttagcttcattttgtgcccttgatctttctgttaagtttgggtca

SEQ ID NO: 31232 - protein, 204 aa, Panicum virgatum
  misc_feature: Ceres CLONE 1904135
  misc_feature (112)..(204): Pfam Name: Lipase_3 Pfam Description: Lipase (class 3)
  misc_feature: SWISSPROT Homolog: EC 3.1.1.3 Triacylglycerol lipase
MARGATAGLLLLLLLAALLASASPAAAAEGRGRRVLRTKHSGGGYHYNHTLAHILVEYASAVYTSDLTSLFTWTCPRCKGHTKGFKVIEVIVDVENCLQAFVGVAPDPRSVIVAFRGTQEHSISNWIEDLFWKQLDVTYPGMPDAMVHHGFYSAYYNTTLRHEILKSIQWAWKTYGKLPIDVVGHSMGGALASFCALDLSVKFG

SEQ ID NO: 31233 - DNA, 1770 bp, Panicum virgatum
  misc_feature: Ceres CLONE 1904164
  misc_feature: Encodes the peptide sequence at SEQ ID NO. 31234
aaggcttataaaaggaccttaatcctctcggttcattcccaagcaaaactgcaaagtaacacaaattcgacaagctagctacaccccccatcatggagctaagtgcagcaacgctcctcttcttcttcctcctttccttgccaattcttgtgaccttgctaagccgcaaatcaactccgacctccaagaagaggcggcctcctggcccgtggaacctccccttgattggaagcctcctccacttcatcaagtcgcatccgccgatcgttcttcgggacctggccaacaagtatggccctgtgatgttcctccggatgggccaggttgacactctcgtgatatcctcgccggcggcagcgcaggaggttctccgcgacaaggatgtcatcttcgcgtcgaggccgaccatcgtggcttcggaggtcttctgctacggaaacctcgatgtcggcttctcgccatatggcgcctattggcggacgctgcgcaagctctgcacggtggagctcctcagtgcaaagatggtgcggcagttcgcacccatcagggataacgagacgttgtccctcatcrgaaatatccaagctgctggccgaggtggtcagcctgtgaccaatctcgcgagcctgctcctagcctgctcgaactccatcacgacaaaggcggctttcggccaggtttccagcagcgagctccgggacaagttcctgtcgtcgattgctgtggcaatgagcttcagcggaggcttcaccgttggggatgtctttccatcgctgcgcttcattgacgtcgtcactgggctgaggcgaagcatgtggcgagcacgccatcagctggacgacgtctataacaagatcattgctggatgtgaggcgcagcgaggtgatgacctgttgagcgtcctcctccggatcagggacaagggggagctggaattccccatcggcacaacaaacatcaaggcaattatattggatatgttcgttggagggacggagacgacgtcgtcagctgcagagtggatcatctcagaactcatgaggaacccagatgtgatggtcaaggcacaggctgaggtgcgacgagtatttgataaagtgagcccacaagaccatgaagccaagatcgacgagctgcactacactaaaatggtgatcaaggagagtatgaggctgaacccagtggtgccattgctgattccccatttctgtcaggagacctgcgaggtaggtgggtaccaagtcaccaagggcaccagggtcctgatcaacgcgtgggctatggcaaggagccccgagtattggcttgacgcagagaagttcaggccggagaggtttgaggatggcatgcttgacttcaaaggctctcgcttcgagtacttgccatttggggcagggagaagaaggtgccctggtgatactttcgggttggctgtgttagagctcattgttgcacgccttctctactacatcgactggagcctcccagcagggatgcagcctggcgacattgatatggaaatgatcgttgctgcaacaactaggaggaagaacccgctgccgctagtggtatcaccatataaggttcccatgcaaggctgattcatgggataattagtatatgcatgctggccaacatctacagttgtgcctctggaccttataaggtccctgtcttgtttgtataatgggaatagacgaataaatataaaaactatgtgtgtactaaaaataatttctccaaagataattatgcatatgttatgaaggc

SEQ ID NO: 31234 - protein, 502 aa, Panicum virgatum
  misc_feature: Ceres CLONE 1904164
  misc_feature (36)..(493): Pfam Name: p450 Pfam Description: Cytochrome P450
  misc_feature: SWISSPROT Homolog: EC 1.14.13.68 4-hydroxyphenylacetaldehyde oxime monooxygenase
  misc_feature (161)..(161): Xaa is any aa, unknown, or other
MELSAATLLFFFLLSLPILVTLLSRKSTPTSKKRRPPGPWNLPLIGSLLHFIKSHPPIVLRDLANKYGPVMFLRMGQVDTLVISSPAAAQEVLRDKDVIFASRPTIVASEVFCYGNLDVGFSPYGAYWRTLRKLCTVELLSAKMVRQFAPIRDNETLSLIXNIQAAGRGGQPVTNLASLLLACSNSITTKAAFGQVSSSELRDKFLSSIAVAMSFSGGFTVGDVFPSLRFIDVVTGLRRSMWRARHQLDDVYNKIIAGCEAQRGDDLLSVLLRIRDKGELEFPIGTTNIKAIILDMFVGGTETTSSAAEWIISELMRNPDVMVKAQAEVRRVFDKVSPQDHEAKIDELHYTKMVIKESMRLNPVVPLLIPHFCQETCEVGGYQVTKGTRVLINAWAMARSPEYWLDAEKFRPERFEDGMLDFKGSRFEYLPFGAGRRRCPGDTFGLAVLELIVARLLYYIDWSLPAGMQPGDIDMEMIVAATTRRKNPLPLVVSPYKVPMQG

SEQ ID NO: 31235 - DNA, 703 bp, Panicum virgatum
  misc_feature: Ceres CLONE 1904170
  misc_feature: Encodes the peptide sequence at SEQ ID NO. 31236
cccgatggcgccgccgctcgccggcgtcatccgcctcgccgcggcctcccgcgtgctggtcctggccctctccctcctcgcccgcctcctcttccgcccctacgacacctccgcatcgctcagcccgccctgtctctcctgttccccctccaccgccccctcctccgcgtccacgaatctctccgccgccgtctcgtcgctggccgtctgggatggcgtccacttcgcccgccccgccgagtgcgggtacgagtacgagcagtccttcgccttcctcccgctcctcccggcctccctcgcgctcctcgcccgatccctgttcgcgccgctggtgctggtgccggtgctggggtacagggtcgtgctcgtgctctccgggtatgtcctcaacaacgtcgcgttcgttgccgccgcggcctacttctacagattgtccgtgatgatcttgaaggaccagagagcagcttatcgagcatctgttctgttctgtttcaaccccgcttctgtgttttactcgtcattgtattcagaaagtctttatgcactgttttctcttggaggactgttctacctgttttcgggtgctaatactgttgcagtgataatgctcgctctctctggttcagctaggtcaaatggagcacttaatgctggttatttctgttttcaggccttgctacaagcatatgatgctgctgtccga

SEQ ID NO: 31236 - protein, 232 aa, Panicum virgatum
  misc_feature: Ceres CLONE 1904170
  misc_feature (1)..(232): Pfam Name: Mannosyl_trans2 Pfam Description: Mannosyltransferase (PIG-V))
MAPPLAGVIRLAAASRVLVLALSLLARLLFRPYDTSASLSPPCLSCSPSTAPSSASTNLSAAVSSLAVWDGVHFARPAECGYEYEQSFAFLPLLPASLALLARSLFAPLVLVPVLGYRVVLVLSGYVLNNVAFVAAAAYFYRLSVMILKDQRAAYRASVLFCFNPASVFYSSLYSESLYALFSLGGLFYLFSGANTVAVIMLALSGSARSNGALNAGYFCFQALLQAYDAAV

SEQ ID NO: 31237 - DNA, 580 bp, Panicum virgatum
  misc_feature: Ceres CLONE 1904184
  misc_feature: Encodes the peptide sequence at SEQ ID NO. 31238
aattcaagctcccccccccccaccagaaaacaaacaatccccaatttccttcgtgttcggcagcggcggcgatgtcggggcgcggcaagggcggcaaggggctgggcaagggcggcgccaagcgccaccgcaaggtgctccgcgacaacatccagggcatcaccaagccggctatccggcggctggcccggaggggcggcgtgaagcgcatctcggggctcatctacgaggagacccgcggcgtgctcaagatcttcctcgagaacgtcatccgcgacgccgtcacctacaccgagcacaccaggcgcaagaccgtcaccgccatggacgtcgtctacgcgctcaagcgccaggggcgcaccctctacggcttcggcggctaggccgccggcgcgcctccgtcgtgtgctcgcgctccgtctcggcgcggttcctggattggggccgtctgtggttaggggtgatggttcgttgtcaagggattggctgtgttggcttagttgcggtggtggtagtagtagtagtattgctttgctcacattgttgccttgctcaatgtagtctactatctttgtgccgt

SEQ ID NO: 31238 - protein, 103 aa, Panicum virgatum
  misc_feature: Ceres CLONE 1904184
  misc_feature (25)..(94): Pfam Name: Histone Pfam Description: Core histone H2A/H2B/H3/H4
MSGRGKGGKGLGKGGAKRHRKVLRDNIQGITKPAIRRLARRGGVKRISGLIYEETRGVLKIFLENVIRDAVTYTEHTRRKTVTAMDVVYALKRQGRTLYGFGG

SEQ ID NO: 31239 - DNA, 711 bp, Panicum virgatum
  misc_feature: Ceres CLONE 1904206
  misc_feature: Encodes the peptide sequence at SEQ ID NO. 31240
aaggtaccagcggcgccgcaacttcgcagaggaggaagcccgcgcccccggccccgatccgatggccaacagcaacctcccgcgccggatcatcaaggagacgcagcggctgctcagcgagccagcgccggggatcagcgcgtcgccctcggaggagaacatgcgctacttcaacgtcatgatccttggcccggcacagtcgccctacgaaggtgtcaacttctaatctggaattccaccccaaaaaaaacttctaatctggaattgggacgcccttttttgtgttgcgtggcatggagtagtgacatcagagcgcttctagataacaaccctcgaattgagacgatgccactagaaatggggtgaattctgaaatgtttgctttagtttatgcacacgtaggtaagcttgtattgtttgatcggctggtgactttagccactaaattttactttcccagctagtattgttattgctgagtaccatctttcctttttattattctattaatggtgttaaaagatgcacgtaattttagtaatatctacgccaatataatatgttagttactttttgtggcttttgctctattttttgtgggtaaacaaaattcatctctgatttcctagattataacctgtccatggagttattttttatgatgcatatgcaataatagactttgtttccttcatgatcccattactcttt

SEQ ID NO: 31240 - protein, 54 aa, Panicum virgatum
  misc_feature: Ceres CLONE 1904206
  misc_feature: SWISSPROT Homolog: EC 6.3.2.19 Ubiquitin--protein ligase
MANSNLPRRIIKETQRLLSEPAPGISASPSEENMRYFNVMILGPAQSPYEGVNF

SEQ ID NO: 31241 - DNA, 479 bp, Panicum virgatum
  misc_feature: Ceres CLONE 1904210
  misc_feature: Encodes the peptide sequence at SEQ ID NO. 31242
gttctcggccttgtcccccgccccaggacaccgaaaggataggacagagatggtggccgcgtccttcaccgccgccgagttcctggccccggtggccgcgagatccggcggctagagggcgcccccgctccccgcccgcgccgcgtcctcctcctccgcccgggcgctgcgccgcggcggggcgcacctgccgcgcctgtgcactgctctcgccgtctcctccgacgtgctccctgggaacaatgccgcgcccgcgcctccagatgcgacacgggaacaaccgctggagttgtaccacgacgtggtccttggccgcgtctttgaggacttgtgtgcgcatatgtcctaccgtcccaagatgtttggtttcgtccaccttttctatggccaagaggctgtttcctctggctttatccagcttctataccaggttgactgtgttgtgagcctatatcgtgatcatgtccatgcgctatccc

SEQ ID NO: 31242 - protein, 46 aa, Panicum virgatum
  misc_feature: Ceres CLONE 1904210
  misc_feature: SWISSPROT Homolog: EC 1.2.4.1 Pyruvate dehydrogenase (acetyl-transferring)
MSYRPKMFGFVHLFYGQEAVSSGFIQLLYQVDCVVSLYRDHVHALS

SEQ ID NO: 31243 - DNA, 726 bp, Panicum virgatum
  misc_feature: Ceres CLONE 1904224
  misc_feature: Encodes the peptide sequence at SEQ ID NO. 31244
attttgcacccatgagatgtcatatgcatatactgctagcttgatagttataacacaacttgcatcagcatttaacttttgtgttcgtgtgcatagccagcagctatagtattgttaagctagatatagctataactagtgaattttcaagtttgtgttgtgtgtgcatggggcatcattcctgctgcaaccagcagaaggtgaagagggggctctggtctcctgaggaggatgagaagctcatcagatacatcaccacgcatggctacgggtgctggagcgaggtcccggagaaagccggtctgcagcggtgcgggaagagctgccggttgcgatggatcaactacctcagaccggacatcaggcgagggcggttcaccgcggaggaggagaagctgatcatcagcctccacgccattgttggcaacaggtgggcccacattgccagccacttgcctggccggacggacaacgagatcaagaactactggaattcatggatcaagaagaagatccgaaagccagcagtgagcacgacgagctcgtcggtgacgacgtcgagccctccacgcagcacagcggcatcggatgcagcggcgcttggccacctgcagacgccgttcggcgcggcggagcaccagctcgacgccatcatcagccagagcctagcgctgcctccgcactgcccctttctcatgttcgacaccagcgtgagcgtcaacccgc

SEQ ID NO: 31244 - protein, 186 aa, Panicum virgatum
  misc_feature: Ceres CLONE 1904224
  misc_feature (67)..(112): Pfam Name: Myb_DNA-binding Pfam Description: Myb-like DNA-binding domain
  misc_feature (14)..(61): Pfam Name: Myb_DNA-binding Pfam Description: Myb-like DNA-binding domain
  misc_feature: Useful for making plants with modulated biomass
  misc_feature: The sequence is a functional homolog of SEQ ID NO 188 in the 10/412,699 US patent application
  misc_feature: The sequence is a functional homolog of SEQ ID NO 2274 in the 10/374,780 US patent application
  misc_feature: The sequence is a functional homolog of SEQ ID NO 704 in the 10/225,066 US patent application
  misc_feature: The sequence is a functional homolog of SEQ ID NO 1660 in the 11/479,226 US patent application
  misc_feature: The sequence is a functional homolog of SEQ ID NO 840 in the 10/412,699 US patent application
  misc_feature: Useful for making plants with altered lignin content
  misc_feature: The sequence is a functional homolog of SEQ ID NO 1040 in the 10/225,066 US patent application
  misc_feature: The sequence is a functional homolog of SEQ ID NO 2864 in the 10/374,780 US patent application
  misc_feature: The sequence is a functional homolog of SEQ ID NO 296 in the 11/479,226 US patent application
  misc_feature: The sequence is a functional homolog of SEQ ID NO 2574 in the 10/374,780 US patent application
  misc_feature: The sequence is a functional homolog of SEQ ID NO 278 in the 10/225,066 US patent application
  misc_feature: The sequence is a functional homolog of SEQ ID NO 504 in the 10/666,642 US patent application
  misc_feature: The sequence is a functional homolog of SEQ ID NO 896 in the 11/435,388 US patent application
  misc_feature: The sequence is a functional homolog of SEQ ID NO 1072 in the 10/374,780 US patent application
  misc_feature: The sequence is a functional homolog of SEQ ID NO 996 in the 11/435,388 US patent application
  misc_feature: The sequence is a functional homolog of SEQ ID NO 1069 in the 10/374,780 US patent application
  misc_feature: The sequence is a functional homolog of SEQ ID NO 988 in the 11/435,388 US patent application
  misc_feature: The sequence is a functional homolog of SEQ ID NO 108 in the 10/412,699 US patent application
  misc_feature: The sequence is a functional homolog of SEQ ID NO 1740 in the 10/412,699 US patent application
  misc_feature: The sequence is a functional homolog of SEQ ID NO 1964 in the 10/374,780 US patent application
  misc_feature: The sequence is a functional homolog of SEQ ID NO 255 in the 11/479,226 US patent application
  misc_feature: The sequence is a functional homolog of SEQ ID NO 908 in the 11/435,388 US patent application
  misc_feature: The sequence is a functional homolog of SEQ ID NO 134 in the 10/412,699 US patent application
  misc_feature: The sequence is a functional homolog of SEQ ID NO 321 in the 11/479,226 US patent application
  misc_feature: The sequence is a functional homolog of SEQ ID NO 1064 in the 10/374,780 US patent application
  misc_feature: The sequence is a functional homolog of SEQ ID NO 1306 in the 10/412,699 US patent application
  misc_feature: The sequence is a functional homolog of SEQ ID NO 990 in the 11/435,388 US patent application
  misc_feature: The sequence is a functional homolog of SEQ ID NO 148 in the 10/412,699 US patent application
  misc_feature: The sequence is a functional homolog of SEQ ID NO 2266 in the 10/374,780 US patent application
  misc_feature: The sequence is a functional homolog of SEQ ID NO 341 in the 11/479,226 US patent application
  misc_feature: The sequence is a functional homolog of SEQ ID NO 58 in the 11/375,241 US patent application
  misc_feature: The sequence is a functional homolog of SEQ ID NO 1681 in the 10/374,780 US patent application
  misc_feature: The sequence is a functional homolog of SEQ ID NO 58 in the 10/666,642 US patent application
  misc_feature: The sequence is a functional homolog of SEQ ID NO 116 in the 10/412,699 US patent application
  misc_feature: The sequence is a functional homolog of SEQ ID NO 280 in the 11/479,226 US patent application
  misc_feature: Useful for making plants with altered carbohydrate content
  misc_feature: The sequence is a functional homolog of SEQ ID NO 271 in the 11/479,226 US patent application
  misc_feature: Useful for making plants with altered alkaloid content
  misc_feature: Useful for making plants with modulated nitrogen use efficiency
  misc_feature: The sequence is a functional homolog of SEQ ID NO 156 in the 10/412,699 US patent application
  misc_feature: The sequence is a functional homolog of SEQ ID NO 164 in the 10/412,699 US patent application
  misc_feature: The sequence is a functional homolog of SEQ ID NO 1754 in the 10/412,699 US patent application
  misc_feature: The sequence is a functional homolog of SEQ ID NO 1978 in the 10/374,780 US patent application
  misc_feature: The sequence is a functional homolog of SEQ ID NO 353 in the 11/479,226 US patent application
  misc_feature: The sequence is a functional homolog of SEQ ID NO 369 in the 11/479,226 US patent application
  misc_feature: The sequence is a functional homolog of SEQ ID NO 40 in the 10/374,780 US patent application
  misc_feature: The sequence is a functional homolog of SEQ ID NO 776 in the 10/225,066 US patent application
  misc_feature: The sequence is a functional homolog of SEQ ID NO 2570 in the 10/374,780 US patent application
  misc_feature: The sequence is a functional homolog of SEQ ID NO 634 in the 10/225,066 US patent application
  misc_feature: The sequence is a functional homolog of SEQ ID NO 832 in the 10/412,699 US patent application
  misc_feature: The sequence is a functional homolog of SEQ ID NO 796 in the 11/435,388 US patent application
  misc_feature: The sequence is a functional homolog of SEQ ID NO 2394 in the 10/374,780 US patent application
  misc_feature: The sequence is a functional homolog of SEQ ID NO 544 in the 10/225,066 US patent application
  misc_feature: The sequence is a functional homolog of SEQ ID NO 999 in the 11/479,226 US patent application
  misc_feature: The sequence is a functional homolog of SEQ ID NO 1680 in the 11/479,226 US patent application
  misc_feature: The sequence is a functional homolog of SEQ ID NO 202 in the 10/666,642 US patent application
  misc_feature: The sequence is a functional homolog of SEQ ID NO 852 in the 10/412,699 US patent application
  misc_feature: The sequence is a functional homolog of SEQ ID NO 112 in the 10/412,699 US patent application
  misc_feature: The sequence is a functional homolog of SEQ ID NO 267 in the 11/479,226 US patent application
  misc_feature: The sequence is a functional homolog of SEQ ID NO 1071 in the 10/412,699 US patent application
  misc_feature: The sequence is a functional homolog of SEQ ID NO 587 in the 10/374,780 US patent application
  misc_feature: The sequence is a functional homolog of SEQ ID NO 728 in the 11/435,388 US patent application
  misc_feature: The sequence is a functional homolog of SEQ ID NO 836 in the 10/412,699 US patent application
  misc_feature: The sequence is a functional homolog of SEQ ID NO 263 in the 11/479,226 US patent application
  misc_feature: The sequence is a functional homolog of SEQ ID NO 478 in the 11/435,388 US patent application
  misc_feature: The sequence is a functional homolog of SEQ ID NO 54 in the 10/666,642 US patent application
  misc_feature: The sequence is a functional homolog of SEQ ID NO 1033 in the 10/412,699 US patent application
  misc_feature: The sequence is a functional homolog of SEQ ID NO 540 in the 10/374,780 US patent application
  misc_feature: The sequence is a functional homolog of SEQ ID NO 1746 in the 10/412,699 US patent application
  misc_feature: The sequence is a functional homolog of SEQ ID NO 1970 in the 10/374,780 US patent application
  misc_feature: The sequence is a functional homolog of SEQ ID NO 452 in the 10/225,066 US patent application
  misc_feature: The sequence is a functional homolog of SEQ ID NO 584 in the 11/435,388 US patent application
  misc_feature: The sequence is a functional homolog of SEQ ID NO 126 in the 10/412,699 US patent application
  misc_feature: Useful for making plants with altered cell wall content and/or composition
MGHHSCCNQQKVKRGLWSPEEDEKLIRYITTHGYGCWSEVPEKAGLQRCGKSCRLRWINYLRPDIRRGRFTAEEEKLIISLHAIVGNRWAHIASHLPGRTDNEIKNYWNSWIKKKIRKPAVSTTSSSVTTSSPPRSTAASDAAALGHLQTPFGAAEHQLDAIISQSLALPPHCPFLMFDTSVSVNP

SEQ ID NO: 31245 - DNA, 2446 bp, Panicum virgatum
  misc_feature: Ceres CLONE 1904237
  misc_feature: Encodes the peptide sequence at SEQ ID NO. 31246
aattagtcaagttactctcaatgcttcagatatagcacaaaaccatgggataagttactgaaaataattcagacatgtctgttctacaaagaattgctacgagcggtatggcactgttgaaagactatggtctgaatggagttgttggtgctgtgctcctggctatagttattcctttattgcttacctcaatgtttggcaaaaaaacaaagaaaagggcagtgcaagctgacgtgggtggagaggcgggacttgccatgcgaaacagtagattttcatccttagttcaagtcccatgggagggtgccaccacaatggcagctctattcgagatggccagcaaaaagtactctcgacggaggtgtcttggcacaagaaagctaattaataagaaatttgtcgagtcatctgatggtaggaagtttgagaaattgcatcttggtgaatatcaatgggatacctatgcagaagcttttaatcgtgcatgtaattttgcttctggacttatcaagatgggccacaaactagatagtcatgcagcaatcttttctgatacaagagctgagtggatcattgctgcccagggatgtttccgacaaagtttgacggttgtaacaatatatgcttctcttggtgaggatgcattggtgcattcactaaatgagacacaagtttcaactctgatatgtgattcgaagcaacttaagaagttacctgcaatcagctctaaattgcaaagtcttaaacatattatctatattgaggatgaacctgttgaggccgagacactgaatcaaatgaatctttggacaacattgtctttcactgaagtagaggagctgggcaaaacatcacacattgatgctaggttaccttcaagctctgatactgcagttatcatgtatacaagcggaagtactggtcttcccaagggtgtaattatcacgcatggcaacatggtggccacaactgcagcagtcatgacaatcgtcccaaaccttggcatggacgatgtttatttggcttaccttccattagctcatgtctttgagctagcagcagagactgtcatgttggcttctggtactgctgttggatatggttcagctatgactatgactgatacttcgaacaagattaagaaggggacaaagggagatgtttctgtactgaaacctactcttatgatctcagttcctgcaattttggatcgtatcagagatgcggtgtttaagaaggttggtgagaagggtggcctgacaaaaaaactttttgattttgcatataatcgaaatctagcagcaattgaggggagttggtttggatcttgggcaccagagaggatgatatgggacaacattatttttaaaccaattcgcgcaatgcttggagggcgtgtacgatttgttctttgtggtggtgcacctctatcaagtgacacacaaagatttatgaatatatgtctaggtgtcccagtaggtcaaggatatggtttgactgaaacttgtgctggagcagctttctctgaatgggatgacacaagtgtgggtcgtgttgatccaccacttccttgctgctatgtcaagcttgtgtcatgggaagaaggtggttatacgatttctgattctccgatgccgagaggagaggttgtggttggtgggtacagcataacgaaaggttattacaacaatgatgcaaagacgaatgaagtatacaaggttgatgagaagggcatgcgctggttctacactggtgatattggtcggttccatcctgatgggtgccttgagataattgacaggaaaaaggatatagtaaaacttcagcatggagaatatgtgtctcttggcaaggttgaatcggctctaacaactagcaattatgtggatagcatcatggtttatgccgatccatttcataattattgtgttgccctggttgttccagcacaccaggctctggagaagtgggcacaagattcagggataaattacaaagactttgaagagctttgccaaaatgatcaagcaattaaggaggttcagcaatccttatcaaaggccgcaaaagcagctaggcttgagaaattcgagataccagcaaagatcttgttgctgcccgaaccatggactccagagtctgggctagtgacagcagcacttaaactgaggagggaacagataaagagcaaattcaaagatgatttgaacaaactccatcactgaagcagcgacagaaggctgtttggacctatgttttctgaaggtactggaagcagcctggaacagtagaacctactgacctctgaaaggaataagcgagctttgtgtacctctgcttgctaatacatagcttgttcttgtgtcagcagagaatgctcaattttatgtctgttcacgactgtaaatgtagtgtttgtttctccttgtaatacaaactacattcc

SEQ ID NO: 31246 - protein, 716 aa, Panicum virgatum
  misc_feature: Ceres CLONE 1904237
  misc_feature (129)..(609): Pfam Name: AMP-binding Pfam Description: AMP-binding enzyme
  misc_feature: SWISSPROT Homolog: EC 6.2.1.3 Long-chain-fatty-acid--CoA ligase
MSVLQRIATSGMALLKDYGLNGVVGAVLLAIVIPLLLTSMFGKKTKKRAVQADVGGEAGLAMRNSRFSSLVQVPWEGATTMAALFEMASKKYSRRRCLGTRKLINKKFVESSDGRKFEKLHLGEYQWDTYAEAFNRACNFASGLIKMGHKLDSHAAIFSDTRAEWIIAAQGCFRQSLTVVTIYASLGEDALVHSLNETQVSTLICDSKQLKKLPAISSKLQSLKHIIYIEDEPVEAETLNQMNLWTTLSFTEVEELGKTSHIDARLPSSSDTAVIMYTSGSTGLPKGVIITHGNMVATTAAVMTIVPNLGMDDVYLAYLPLAHVFELAAETVMLASGTAVGYGSAMTMTDTSNKIKKGTKGDVSVLKPTLMISVPAILDRIRDAVFKKVGEKGGLTKKLFDFAYNRNLAAIEGSWFGSWAPERMIWDNIIFKPIRAMLGGRVRFVLCGGAPLSSDTQRFMNICLGVPVGQGYGLTETCAGAAFSEWDDTSVGRVDPPLPCCYVKLVSWEEGGYTISDSPMPRGEVVVGGYSITKGYYNNDAKTNEVYKVDEKGMRWFYTGDIGRFHPDGCLEIIDRKKDIVKLQHGEYVSLGKVESALTTSNYVDSIMVYADPFHNYCVALVVPAHQALEKWAQDSGINYKDFEELCQNDQAIKEVQQSLSKAAKAARLEKFEIPAKILLLPEPWTPESGLVTAALKLRREQIKSKFKDDLNKLHH

SEQ ID NO: 31247 - DNA, 1386 bp, Panicum virgatum
  misc_feature: Ceres CLONE 1904238
  misc_feature: Encodes the peptide sequence at SEQ ID NO. 31248
agaaaagaaatctaagctgcacgcaacgaagggggaagaagagggcgggtataaaatttggcgggttcgtgccgcgtctccccccgctcctcgattccgccggcgaagcgtttacttcttcttcttccacctccgcgatctcgaggtgcgcgcgagcgaggaggggggcgcgcccatgttttgacctcgcctgcgtcgtcccggccgcgatccagatctgaggtcgtgaggttcttgattgagcgatctcaagaatcgtcactgcaatggtcgccaagatgccgtcatccagatggatctcggcctccctgctcgtcctgctcctgagcctgcacccggctgtccgcgccttctacctccccggcaccttcatgcacacctactcccccggagaggcgatctgggccaaggttaactccctcacctccattgagactgagctgcccttcagctactacagcctgccatactgcaagcctccggaaggtgtcaagaagagtgctgagaaccttggtgagatcctcatgggtgaccagattgacaactcgccataccgcttccgtgtcaatgtcaatgaatctgtatacctctgcaccacggaccagctcaccaaggaccaggctgagctgctcaagaagagggcgcggaatctgtaccaggtcaacatggtcctggacaatttgccggtcatgcggttcaccgagcagaacggggtgacaatccagtggactgggttcccagttgggtacaacccgacagggagcaatgaggattatatcattaaccacctcaagttcagagttttggtccatcaataccaggcgcagggtgatgtggtggtcacaggtgaggatggtgttgcaatggttgagtctgaccgcaagagcgggttccagattgttggatttgaggtcgtgccttgcagtgtgaggcgtgatcctgaggccatgtctaagctcaagatgtacgacaaggttgactccgtgaattgcccattggagcttgagaaatctcaggcgatccatgagaatgatcggattacatttacctatgaggttgagtatgtcaagagcaacatcaagtggccatcaaggtgggatgcttacctgaagatggatggtgccaaggtgcactggttctcgatcatgaactcaatgatggtcgtcttcttcctggctggcattgtgtttgtcatattcttgaggactgtccgcagagatctgacaaggtatgaggagatggacaagaaagcacaagctcagatgaatgaggagctctcaggatggaaacttgttgtcggtgatgtattcagagaaccctgctgctcaaagctgttgtgtgttatgggtgctgatggtatcagatcactggtatggcagttgttac

SEQ ID NO: 31248 - protein, 373 aa, Panicum virgatum
  misc_feature: Ceres CLONE 1904238
  misc_feature (59)..(373): Pfam Name: EMP70 Pfam Description: Endomembrane protein 70
MVAKMPSSRWISASLLVLLLSLHPAVRAFYLPGTFMHTYSPGEAIWAKVNSLTSIETELPFSYYSLPYCKPPEGVKKSAENLGEILMGDQIDNSPYRFRVNVNESVYLCTTDQLTKDQAELLKKRARNLYQVNMVLDNLPVMRFTEQNGVTIQWTGFPVGYNPTGSNEDYIINHLKFRVLVHQYQAQGDVVVTGEDGVAMVESDRKSGFQIVGFEVVPCSVRRDPEAMSKLKMYDKVDSVNCPLELEKSQAIHENDRITFTYEVEYVKSNIKWPSRWDAYLKMDGAKVHWFSIMNSMMVVFFLAGIVFVIFLRTVRRDLTRYEEMDKKAQAQMNEELSGWKLVVGDVFREPCCSKLLCVMGADGIRSLVWQLL

SEQ ID NO: 31249 - DNA, 821 bp, Panicum virgatum
  misc_feature: Ceres CLONE 1904238-R
  misc_feature: Encodes the peptide sequence at SEQ ID NO. 31250
tggaggaccatcaaaggaacctcagaagggtggaaatctgttgcctggctgacttcctgcttcttccctggcattgttttcatcatcctcactgtgctgaactccattctgtggggcaagaagagcactggcgctctacccatctcattgttcttcaccctcctggccctgtggttctgcatctctgtgccactcacacttattggaggcttgctaggcacacgtgcagcaagcattaactaccctgtccgcactaaccagattccacgggagatccctgagcgtaagttcccctcatggctgcttgtgctcggtgcgggaactttacccttcggtactctcttcattgagctcttcttcatcctctccagcatttggttgggaagattctactatgtctttggcttcctgttcattgtcctcttcctgctggtcatagtctgtggtgaggtttctcttgtcctaacctacatgcacctatgcgttgaggactggaaatggtggtggaaggccttctttgcttcaggttctgtagcattctatgttttcctctactcgatcaactacttggtgttcgacctcaggagcctgagtggaccagtctctgcaacactctaccttggctactccctgatcatggctcttgcaatcatgctctccactggtgccattggcttcctgctctcattctacttcgtccactacctcttctcgtctgttaagattgactagaggtgcgcctgctccctcctggtgcaatagagtcacctgatcatggtggcagttaccccttagaaacaatacacaataatatcaaacgg

SEQ ID NO: 31250 - protein, 243 aa, Panicum virgatum
  misc_feature: Ceres CLONE 1904238-R
  misc_feature (1)..(201): Pfam Name: EMP70 Pfam Description: Endomembrane protein 70
  misc_feature: Useful for making plants with altered cell wall content and/or composition
WRTIKGTSEGWKSVAWLTSCFFPGIVFIILTVLNSILWGKKSTGALPISLFFTLLALWFCISVPLTLIGGLLGTRAASINYPVRTNQIPREIPERKFPSWLLVLGAGTLPFGTLFIELFFILSSIWLGRFYYVFGFLFIVLFLLVIVCGEVSLVLTYMHLCVEDWKWWWKAFFASGSVAFYVFLYSINYLVFDLRSLSGPVSATLYLGYSLIMALAIMLSTGAIGFLLSFYFVHYLFSSVKID

SEQ ID NO: 31251 - DNA, 717 bp, Panicum virgatum
  misc_feature: Ceres CLONE 1904269
  misc_feature: Encodes the peptide sequence at SEQ ID NO. 31252
aagcccacaacgcagtaagcaggcgggcaatagtagaagacataagctcagttctcttactctcaagtgtttgagactatttgcgcaacaaaaaatgagcatcaaagccattaatgggaagagccccatagtggttggaccatggggagggacaggagggtacccttgggatgacagtgtgtactcaacaatacgccagattgtgatcacccatggtgcagctatcgactctataaggattgagtatgatctgaaaggaagatcggtgtggtcagagacgcatgggggcactgatggaggctccgaaacagataaggtaaaactagattttccagacgaagtccttgtgtctgtaagtggacactatggttctgtctgcgggactccagtgatcataagatcactgacatttcagagcaacagttcgaagtatggaccttttggcactgaagatgggacgcctttctcacttcctgtgagcagtggcaagatcattggatttcatggaaggtctgggtcatatctcaactcaataggcttctatctgaagcaagtgcattttccaaatccattgaattctccagccacacccagaagcctcccaactgcacatagtagaaatggatacagcttcagtggaggtgatactggagctgacatggtccttgctgtgcgagatagaggcgacagctatgctgtttatgctagcaatcaacc

SEQ ID NO: 31252 - protein, 207 aa, Panicum virgatum
  misc_feature: Ceres CLONE 1904269
  misc_feature (22)..(153): Pfam Name: Jacalin Pfam Description: Jacalin-like lectin domain
MSIKAINGKSPIVVGPWGGTGGYPWDDSVYSTIRQIVITHGAAIDSIRIEYDLKGRSVWSETHGGTDGGSETDKVKLDFPDEVLVSVSGHYGSVCGTPVIIRSLTFQSNSSKYGPFGTEDGTPFSLPVSSGKIIGFHGRSGSYLNSIGFYLKQVHFPNPLNSPATPRSLPTAHSRNGYSFSGGDTGADMVLAVRDRGDSYAVYASNQ

SEQ ID NO: 31253 - DNA, 1507 bp, Panicum virgatum
  misc_feature: Ceres CLONE 1904295
  misc_feature: Encodes the peptide sequence at SEQ ID NO. 31254
ctcaccccagccccgctgccttgcctccatttctaatcccccctcccgaagcccaaaccctaaacctaaacctctcaccccagccgccgccaccaccgctttcgccgccgccgcgactcccctccctgccgccgacgtcccccgcctcggatcgaagcaatgtcgtcggacgatgaggtccgggaggagaaggagctcgacctctcatccaacgacgtcgtcaccaagtataaggccgccgccgaaatcctcaacaacgctctgaagctggttgtatctgagtgcaagccgaaagccaagattgttgacctttgtgagaagggtgatgctttcattagagagcaaactgggaatgtctacaagaatgcaaagaggaagattgaaaggggcattgctttcccaacctgtgtatctgtgaataacacagtctgccatttctcaccgcttgccactgatgaggccgttctggaagaaaatgatatggttaaaatagatatgggctgtcacattgatggttttattgctgtggtggctcatactcatgtaattacgaatgggccggtcactggaagagcagctgatgttcttgctgctgccaacaccgcagcagaagtcgcaatgaggcttgtgagacctgggaagaagaacaaggatgtcactgaagcaatccagaaagtagctgctgcttatgattgcaaaattgtcgaaggtgttcttagccatcagctgaaacaatttgtcattgatggtaacaaagtcgtgctcagtgtctctaatgctgatactaaggtggatgatgctgaatttgaagaaaatgaagtatatgcaattgacattgtcactagcactggggagggaaagcccaagttattggatgagaagcagaccaccatctacaaaagggctgtagacaagaattatcacttaaagatgaaagcatcaaggtttattttcagtgagatcagccagaagttcccgatcatgcctttcaccgctagggcattggaagagaagcgtgcacgcttaggcttggtggaatgcatgaaccatgggctattgcagccatacccagtactccatgagaagccaggtgatcttgttgcgcacataaaattcactgtgctgctgatgcccaatggatcggataagattacatcacatccgctacaggagttaaagcccacaaaatccattgaagacaatgctgagataaaggcgtggcttgctttggggacaaaatccaagaagaagggtggtggaaagaagaagaaaggcaagaaaggagatgcagcagagcctatggaggaggcaacaaatggtgctccaagccaagaataattctgatttttggaattgctacctctagttttgttcatgtttctttgctgcatctgatggtgttatattacattcagttgtggaaaaaattgagtactgtttcaactgtcttaagaaatgacgcatcctgctgcacattatcgcatctaatgacaaagataattatcct

SEQ ID NO: 31254 - protein, 392 aa, Panicum virgatum
  misc_feature: Ceres CLONE 1904295
  misc_feature (22)..(277): Pfam Name: Peptidase_M24 Pfam Description: metallopeptidase family M24
  misc_feature: SWISSPROT Homolog: EC 3.4.11.18 Methionyl aminopeptidase
MSSDDEVREEKELDLSSNDVVTKYKAAAEILNNALKLVVSECKPKAKIVDLCEKGDAFIREQTGNVYKNAKRKIERGIAFPTCVSVNNTVCHFSPLATDEAVLEENDMVKIDMGCHIDGFIAVVAHTHVITNGPVTGRAADVLAAANTAAEVAMRLVRPGKKNKDVTEAIQKVAAAYDCKIVEGVLSHQLKQFVIDGNKVVLSVSNADTKVDDAEFEENEVYAIDIVTSTGEGKPKLLDEKQTTIYKRAVDKNYHLKMKASRFIFSEISQKFPIMPFTARALEEKRARLGLVECMNHGLLQPYPVLHEKPGDLVAHIKFTVLLMPNGSDKITSHPLQELKPTKSIEDNAEIKAWLALGTKSKKKGGGKKKKGKKGDAAEPMEEATNGAPSQE

SEQ ID NO: 31255 - DNA, 1719 bp, Panicum virgatum
  misc_feature: Ceres CLONE 1904298
  misc_feature: Encodes the peptide sequence at SEQ ID NO. 31256
gaaacaagccgacgaacgcgaccgaggaagcggaagcgggagggagggaaaagggcgaaatcgccgccgccgtcagcaccgattgatcggtgaggccgatgcgccgccccccgctcggtcggcaccgtatcccgccgcgttaatctccgccgccctcgccgaggccccgagtcggggaccgccgcttcggtttggccgcggccggctccgtgggggattccggacgcggggggaggggggagtcgttgtctccttgaggccgcattgcagcacggacttgcatctagcgccgcggtttcggcggttcgattcgtctgatcccccgttttgttgtgctcaaagcctgaaactgtgcggctgtatgatagggagcgttggcgctagctcgattggccggggaattcagggggcttgtctcagcctagcctggaattgatggagcagaagagagcaagggcagcggaggagcctgcccggttgatgtgtgatgatgcgctaacggaggtcttccgcaggctgcctgcccgtgcgctcgccgcttgcaggctggtgtgcaagtcctggatgacggtgctcacggatccacacttcatccacgagcaccttagccgcggccggcagaagctgctgctctttgcgagcgaccgggtgagcgataggtcgctcgccatggtgcttgcggatgacaacaagtccatgtaccagttgtcaaggcctgctgcgtctcggagcgtgtttgtccacaattcatgcaatgggctgctgtgcctgggtgacagtacaggaaccgtggaggtgctgaacccgacaaccggtgaatctctaatgttgccaactccgacatacacaacaaggagcatccagttctcatcctgtaattggcactgcttggggttttgtccaaagacgagggagcacaaggttgtgcatttctatcctggaacacatattgattcgttcaaggtgcgctgtgagatatacacacttggagctggtgtctggagacaatttgggagcttccgtggtgctccgatagatagaggggtgcatgtgaatggagcagtgtactatctgacaaagtttcgctacattgcttcatctcgtatcaattgcttgaatcttgagagcgaaaaaattgatgcgatgatgcttcctccacgcaagtcttatggagggcattgctctttgacggagcttgaaggaagggtatgcttgttagttgtggatggtgtgcttgaaggtccgcctcgtacgatggacatattgatgctcaatagtgatgagcagagctggactcccagataccacttctctttgccttggttgatgccttcctgttattttactccgaagcacacactcttccacgacgggaaaatttgggtgcaattgttggctaggaatctctactgttttgatccaacatcaaattctgaagaattgacaatagcgtggccagagcttgactttccgtttagcacacatactttcattgagagcatagttcctttgcggaaagactacttcatcaagcacatacagtgacagtggtgttctgccccttgttttccaagatggttttcagtttacagcattacagtgtcttagttgtttcttttttttttcttttatgaaccaagctgttagtcagcttaaggtgatgtgctactctggattctaattagtgatgacagatgcaatctcaatacatttctgagc

SEQ ID NO: 31256 - protein, 369 aa, Panicum virgatum
  misc_feature: Ceres CLONE 1904298
  misc_feature (11)..(58): Pfam Name: F-box Pfam Description: F-box domain
MEQKRARAAEEPARLMCDDALTEVFRRLPARALAACRLVCKSWMTVLTDPHFIHEHLSRGRQKLLLFASDRVSDRSLAMVLADDNKSMYQLSRPAASRSVFVHNSCNGLLCLGDSTGTVEVLNPTTGESLMLPTPTYTTRSIQFSSCNWHCLGFCPKTREHKVVHFYPGTHIDSFKVRCEIYTLGAGVWRQFGSFRGAPIDRGVHVNGAVYYLTKFRYIASSRINCLNLESEKIDAMMLPPRKSYGGHCSLTELEGRVCLLVVDGVLEGPPRTMDILMLNSDEQSWTPRYHFSLPWLMPSCYFTPKHTLFHDGKIWVQLLARNLYCFDPTSNSEELTIAWPELDFPFSTHTFIESIVPLRKDYFIKHIQ

SEQ ID NO: 31257 - DNA, 712 bp, Panicum virgatum
  misc_feature: Ceres CLONE 1904302
  misc_feature: Encodes the peptide sequence at SEQ ID NO. 31258
acaccttgcgcccgtcgacagagttcagcttcagctcctctcctgctccgatcgatcgagaatgtcgagcctcgaggagccgcttggtcttggagacctgccaaagttgagtattaacagacttggaagcttctcccagccaagtgcttatcgcagggcagcggctgatgactgcaacactcgcaagtacaacagctcctgcaatggtggcgcgctgatgggtttccatgccaattctcatgcatggcatcagcaatgccgtcaggccgattcgtcatgtgatgcggtggagcttagagatctccctcggaaggttatgtgggatctaccaagctttgtgaagattgttgaagttggaccccgagacggcctgcaaaacgaaaagggcaatgtaccgacatctgtaaagatacaactgatacacaaattagtggctgcaggtttatcagtagttgaagccacaagttttgtatccccaaaatgggtgccgcagctagctgatgcaaaggaagtcctcaaaggaatccagcagatgccaaatgtgcggtatcctgtgttaactcctaacctaagaggatttgaggctgctgttgcagctggtgcaaaggaaattgcggtttttgcatctgcctctgaatccttctctaagtcgaacatcaactgtaccatcgaggaaagccttgttcggtaccgtgatgttactgctgctgcc

SEQ ID NO: 31258 - protein, 216 aa, Panicum virgatum
  misc_feature: Ceres CLONE 1904302
  misc_feature: SWISSPROT Homolog: EC 4.1.3.4 Hydroxymethylglutaryl-CoA lyase
MSSLEEPLGLGDLPKLSINRLGSFSQPSAYRRAAADDCNTRKYNSSCNGGALMGFHANSHAWHQQCRQADSSCDAVELRDLPRKVMWDLPSFVKIVEVGPRDGLQNEKGNVPTSVKIQLIHKLVAAGLSVVEATSFVSPKWVPQLADAKEVLKGIQQMPNVRYPVLTPNLRGFEAAVAAGAKEIAVFASASESFSKSNINCTIEESLVRYRDVTAA

SEQ ID NO: 31259 - DNA, 698 bp, Panicum virgatum
  misc_feature: Ceres CLONE 1904306
  misc_feature: Encodes the peptide sequence at SEQ ID NO. 31260
aaattgccgttcaaggcctacgcttcttccccttcctctccccctcgaaccctagccaccctgctcacttcccagctcgaacccgccggggcgcgagtcctcggcatttggggcagctgatcctgcggtcaaggcggcggagaagagatggtggtggtgtccggcggcggggggaacgcgtgggcaaaggagatgaccatccgccgcaggatagccagcatattcaacaagacgcgggatcatttccctactctgaaggactacaacgattatctggaagaagttgaggatatgactttcaacctgatcgaagggatagatgtcgaagcgattgaagctaaaattgcaagataccagaaggaaaatgcagagcagatattcttgtcccgagcgaaaagggctgaagatcttgcggctgcactaaaagcaagcagaatgaaccctgtaaagaccgacgctgatgatacggctgctgggagttcccagggtattagtggtgggactggtgttcagggcgagtatgcgcctgctgctgtccctggcgggctggctcagcctcgtcccatgggtatggctccccaaccaatcggaggtcggtcagatcctcttcaaggagacgatgaggagaccaggagactacgtgcggagagagcagcacgagcaggcggatggactattgaattgagtaagaggagagc

SEQ ID NO: 31260 - protein, 183 aa, Panicum virgatum
  misc_feature: Ceres CLONE 1904306
  misc_feature (14)..(155): Pfam Name: MAT1 Pfam Description: CDK-activating kinase assembly factor MAT1
MVVVSGGGGNAWAKEMTIRRRIASIFNKTRDHFPTLKDYNDYLEEVEDMTFNLIEGIDVEAIEAKIARYQKENAEQIFLSRAKRAEDLAAALKASRMNPVKTDADDTAAGSSQGISGGTGVQGEYAPAAVPGGLAQPRPMGMAPQPIGGRSDPLQGDDEETRRLRAERAARAGGWTIELSKRR

SEQ ID NO: 31261 - DNA, 1853 bp, Panicum virgatum
  misc_feature: Ceres CLONE 1904307
  misc_feature: Encodes the peptide sequence at SEQ ID NO. 31262
agacgcggatgacgcgctcccccccgttctccgccatctccgtccgcaccaccaccaaatgccaccatgcgcggcggcgctcctcctccgccgccgcctctccacccgcccctccgggagcatcccaaactcgttgcgctgcttagcgtcctcaacccgccgccgacgtcctccactccgctcccgcgcgctctctccagagccttcccgtcgccctccggcgccttccctctccgcacactgcccctcccctccccgcctccacgcctctcccctccccgcatgctctctcctcactcgccacctctcttccagacctctcctcatctgtaccgctgctcctctcctcctccccacagcccctcccactcccacactacgccctcctactcaacctctcgactcacgccggtctcttccccgcctccctcgccatcctgcgccacatgcggtccttcggcctcgtccccaacgccgcctgcttccaccatgccctccgcgcggcgggctctgccgctgatgtctccgccgtgcttgagatcatgtccgggtccggcgcctctcccaccgtgcccgtgatcgtgaccgcggtgcataagctggcgtccgctgggaatttcgagagcgcccgcaggctgatcgacaaaatgccggagttcgggtgcgtgcccaatgctgtggtttacaccgcgatgctcgatgggatgtacaatttcgggaacttggatggtgcggtgaggttgatcgaggagatggagggcagtgggttgggtgcaaattgtgcgcccaacgtggtgacctatacatgtttggtgaaatgcctctttgagaaggggagggtggcagaggcacttggtgtactggataggatggcaggtagaggggtgatgccaaaccgggtttttgtgcagacactcctcgaaggtgtctgcacggaacggagggtggccgatacatataatgtggtcgagcgtgtggttggtgatcagggtatgtcgagtgagcagtgctacaatgttctacttatttgcttgtggagggttggcatgacaactgaagctgaaggattggcgcaaaggatgatgaagaaaggggtgcagttgtccccgcttgctggcagttcgatggtgagagagctctgtataaggaagaggtcactggatgcttaccactggttgggaatgatggaggagaacggtgtgctgtgtgactcggacgtgtatggaactctgttgcttggtttgtgtgaggaagggcatgtccatgaggcatcagcattggggtggaaggttgtcgagagagagatccacatagaagcatcttgtgctgaacgtttagtggagttactgaagcaatatggtgatgatgagctagcatctcatttattaggattgaaacagtgccctggagggttgttactttaagtaatgagcgattctgcccaactttcgcgcatgaagcacgtcatggttagtcatggggtgtgccaagaatagtgcttcacagctttgttgggaatttgcctgagaacaaatttagccagatggcttagtgcagtcaacagtttacagtcattgaataaagcatggaacagaattcaactgaagtgctgaactacttgcttattttgtacaaatttgctcaagatcatgatgcaggtccagaggacacttgtcatgtaaactaccattttgatcacttctcaggtacatcatcaccttgtctctcaggctgatgacatgcttggacaagtgctgtctgctgtgcctgtcagtcggtacattttagatatgtttcatgtactgtaatcctaggaaattatgtacaacggtgctcaagtcattaaacttgat

SEQ ID NO: 31262 - protein, 325 aa, Panicum virgatum
  misc_feature: Ceres CLONE 1904307
  misc_feature (117)..(151): Pfam Name: PPR Pfam Description: PPR repeat
  misc_feature (78)..(112): Pfam Name: PPR Pfam Description: PPR repeat
MRSFGLVPNAACFHHALRAAGSAADVSAVLEIMSGSGASPTVPVIVTAVHKLASAGNFESARRLIDKMPEFGCVPNAVVYTAMLDGMYNFGNLDGAVRLIEEMEGSGLGANCAPNVVTYTCLVKCLFEKGRVAEALGVLDRMAGRGVMPNRVFVQTLLEGVCTERRVADTYNVVERVVGDQGMSSEQCYNVLLICLWRVGMTTEAEGLAQRMMKKGVQLSPLAGSSMVRELCIRKRSLDAYHWLGMMEENGVLCDSDVYGTLLLGLCEEGHVHEASALGWKVVEREIHIEASCAERLVELLKQYGDDELASHLLGLKQCPGGLLL

SEQ ID NO: 31263 - DNA, 1641 bp, Panicum virgatum
  misc_feature: Ceres CLONE 1904310
  misc_feature: Encodes the peptide sequence at SEQ ID NO. 31264
acgctcgccgctgcagcagcgaagctcccccctcctccccgcttcgtctccggcgatgggtcctcgccgccgccgcggcctgcgcggcctgcgcggccgcctcctcgtcctctcgtcgctgctcctcctcgcgtccggcgaggtcttcttcgaggagcgcttcgaagatggctgggagtcccggtgggtggaatctgattggaaaaggagtgaagggaaagccggaaggttcaagcacacagcgggaagatactctggagatcctgacgacaaaggaatacaaacaacaatggatgctaggcattttgctatctcagccaagttcccacaattcagtaacaagaacaggacactggtggtccagtactccattaagtttgagcaggatatcgagtgtggtggtggatacatcaagcttatgtccggttatgtcaaccagaaaaaatttagtggggacactccatacagcttgatgtttgggccagatatatgtggtactgatacaaagaagctgcatcttatactttcttaccaagggcagaattatccaatcaagaaagatctagaatgtgagacggacaagttaacacatatgtatacttttattcttaggcctgacgcatcttatagcctacttgtcgataaccgtgaaagagaatctgggagcatgtacactgactgggacatcctccctcctcataaaatcaaggatgttcatgccaaaaggcctaaggattgggatgacagagaatatattgatgatcctgatgatgttaagccagagggctatgattctatcccaaaacagattcctgatccaaaggacaaaaagcctgacacatgggatgacgatgatgatggcatatggaagcccagaatgatatcaaatccagcatacaagggaccatggaaacgcaagagaattaagaatcctaactacaagggtaaatggaagaccccatggattgataatccagagtttgaggatgatccagatctgtatgtgctgaaacctttgaagtatgttggaattgaagtttggcaggtaaaagctggttcagtttttgacaacattctgatttgtgatgaccctgagtatgcaagaaaggttgttgaggaaactgtgggtgcgaatagggaggctgaaaaggaggcttttgaagaagctgaaaaggagaggaaagctagagaagatagggaagctcaacaaggaaaggatgaaggggctcggcgccgaagagacaaggacagatacaaaagacgttacagggatcactgggatgactaccatgatgagctgtgaagtactcggaaagttacattctttgaagcataatctcaagccaccatggacatgatgcaatgttttcatcagtaattggattgccaggcccaaacaacctgaagtgttccgtgctatgcgccaaaaaatattaaattccaggattgagatggcatggacaaaactgaatatcattcatgcttcctccgcaacagcaggacattccagtgaaaatttggctttgacacagaaatagtgggatgagtctgttatgcatgtaatttacacggcgctggcaatgtgctagctttgtaatgtcaaaacactgtccttgccaatatgaataatctaaattggcc

SEQ ID NO: 31264 - protein, 415 aa, Panicum virgatum
  misc_feature: Ceres CLONE 1904310
  misc_feature (30)..(342): Pfam Name: Calreticulin Pfam Description: Calreticulin family
MGPRRRRGLRGLRGRLLVLSSLLLLASGEVFFEERFEDGWESRWVESDWKRSEGKAGRFKHTAGRYSGDPDDKGIQTTMDARHFAISAKFPQFSNKNRTLVVQYSIKFEQDIECGGGYIKLMSGYVNQKKFSGDTPYSLMFGPDICGTDTKKLHLILSYQGQNYPIKKDLECETDKLTHMYTFILRPDASYSLLVDNRERESGSMYTDWDILPPHKIKDVHAKRPKDWDDREYIDDPDDVKPEGYDSIPKQIPDPKDKKPDTWDDDDDGIWKPRMISNPAYKGPWKRKRIKNPNYKGKWKTPWIDNPEFEDDPDLYVLKPLKYVGIEVWQVKAGSVFDNILICDDPEYARKVVEETVGANREAEKEAFEEAEKERKAREDREAQQGKDEGARRRRDKDRYKRRYRDHWDDYHDEL

SEQ ID NO: 31265 - DNA, 600 bp, Panicum virgatum
  misc_feature: Ceres CLONE 1904323
  misc_feature: Encodes the peptide sequence at SEQ ID NO. 31266
aaggtaccctttgcccctcatctttgactaggacgaagcccgccccccccgtccccatcctatggtcaacaccaacatcctgcgccggatcatcaaagacacatcccggctgtctcccgagccttcggcggggatccgcgcgccccccacgaaggagaacctgctctacttccccgtcctgatgcttggcccggcgcagtcgccgtactaaggggtcgacttcttgtctgcaattcctccccacaaaaagacttctaatctggagttgggacgcccttttttgtgtggcgtggctgtgcattactgacatcctaccacttctagataacaaccctcgaattgagacgatgccactagatttggggagaattctgaattgtttgctttattttatgcacactgatgttcgcttgtattgtttgatcggctggtgactttatccactaaattttgctttcccagctagtattgttattgctgagtaccatctttccttttaattattcgattattggtgttaaaagatgcatgttctttaagtaatatctacaccaatagaatatgtgaggtactttttgtggcttttgctctatctgctgt

SEQ ID NO: 31266 - protein, 49 aa, Panicum virgatum
  misc_feature: Ceres CLONE 1904323
  misc_feature: SWISSPROT Homolog: EC 6.3.2.19 Ubiquitin--protein ligase
MVNTNILRRIIKDTSRLSPEPSAGIRAPPTKENLLYFPVLMLGPAQSPY

SEQ ID NO: 31267 - DNA, 483 bp, Panicum virgatum
  misc_feature: Ceres CLONE 1904350
  misc_feature: Encodes the peptide sequence at SEQ ID NO. 31268
acacaaacgcatcgagctcagactaagagaactgagaagccaaagaagaacctctccctctcgtttcctgcacgaatccggcttccatccatcgatcggaacaccacacactgccagccggacgcagccgatcaagggcaatgggcgagctgatccccgggttgccggaggaagtggcgcgggagtgcctagtccgggtgggcttcgaccagctgcccgtggtgcgccgcatctcgcgccagtggaagtcggagttggagtcaccggactaccaccgcctgcgccgggccgaggggctggcgcgcccggtgctcgcgctggtccaggcgagccccgcgccgccggccgacggcgacgcgggcacggctgcggacaagcagcgctcctcggcggcgggccccgcgaactcgtaccggatggtgctgctggacccggaggagggccggtgggcgccgctgccggcgccacagggtggttgtgacc

SEQ ID NO: 31268 - protein, 114 aa, Panicum virgatum
  misc_feature: Ceres CLONE 1904350
  misc_feature (3)..(50): Pfam Name: F-box Pfam Description: F-box domain
MGELIPGLPEEVARECLVRVGFDQLPVVRRISRQWKSELESPDYHRLRRAEGLARPVLALVQASPAPPADGDAGTAADKQRSSAAGPANSYRMVLLDPEEGRWAPLPAPQGGCD

SEQ ID NO: 31269 - DNA, 614 bp, Panicum virgatum
  misc_feature: Ceres CLONE 1904357
  misc_feature: Encodes the peptide sequence at SEQ ID NO. 31270
aaaacgcatcgagctcagactcagagaactgagaagccaaagaagaacctctccctctcgtttcctgcacgaatccggctcccatccatcgatcggaacaccacacactgccagccggacgcagccgatcaagggcaatgggcgagctgatccccgggttgccggaggaagtggcgcgggagtgcctagtccgggtgggcttcgaccagctgcccgtggtgcgccgcatctcgcgccagtggaagtcgaagttggagtcgccggactaccaccgcctgcgccgggccgaggggctggcgcgcccggtgctcgcgctggtccaggcgagccccgcgccgccggacgacggcaaggcggagcagggctgcgcgacaagcagcgctcctcggcgcggggccccctgaagtcgcacctgatggtgctgctggagacgcagcgacgcgagggagcacgagggggaaagacaacccccacagcgtactatactatataggagcaggccagcgtttaaataagatcttgattggaaactggaaatcgtggttaattgaacactactgtatcaaggaaattgatgtgcctgcctgttggggaagaagttacatgccctcttg

SEQ ID NO: 31270 - protein, 88 aa, Panicum virgatum
  misc_feature: Ceres CLONE 1904357
  misc_feature (3)..(50): Pfam Name: F-box Pfam Description: F-box domain
MGELIPGLPEEVARECLVRVGFDQLPVVRRISRQWKSKLESPDYHRLRRAEGLARPVLALVQASPAPPDDGKAEQGCATSSAPRRGAP

SEQ ID NO: 31271 - DNA, 1672 bp, Panicum virgatum
  misc_feature: Ceres CLONE 1904385
  misc_feature: Encodes the peptide sequence at SEQ ID NO. 31272
gcatcgcccgttctgagacatttcggtggcgctcgctcaggtcaatcccgtgcgttcctttcgttgcttgttcgttcgttgccatggcgccttcccagagcggcggcggcgaggcggcaggagatctcctggagaccgggctgctggtggcagccgtcaaggcgacgtccacgtcggggcgcccggcggacgacgagaggggcgcgggggcgacgacgtcctcgcgggtgcggcggggcgcgcggctcgcggcggcgcagctgcaggaggtgttcctgggcacgaggctgttcccgctcttctccgccgtgccgctcgccgtcgccgcccagcacctccgcctcggccgggcctgggtgttcgttttcagcttgataggcatggccccccttgcagaacgtgtgagcttcttaagcgaacatattgccgataccgcaggaccaacagctggtgggattctgaatgcaacatgtgggaatgtacctgaacttattattgcactctttgctctgcataaggagaagttggagatcttaaagtggtcacttttaggttccatattatccaatttgctgcttgtccttggttcatccctcctgtgtggtgggcttgcaaatacaggcaaggagcgtccactagacaggagacaagcagatgtaagcataggccttttgatgctgggtgttctatgccacatattacctctactgtctaaatacgctaattgcactggacatagcataagttcatcaggttcggttctggaattatcaagattaagtgccattgtaatgctcaccgcgtactttggaggcctcatctttcagctaaaaacccatcgtcaaatttttgagcaagaggacagctcagagagcaccaacactaacaacagcaatgatgatgatggcagttcagttataggatttaccagtgcagtgatctggttgattggcatgactgtagtcattgctgtgttatctaattacatcatcactacaattgaggaagcatcagagtcattaggtattccactcaggttcatcagcattatcctacttccaattgttggaaatgctgccgagcatgcaggcgctatcatatttgctttcaagaacaaaattgatatcaccctggacattgctcttggttcggctactcaaatttcgctgcttgtggtgcccatcattcttattgtatcttgggtgaatggcatccctatggatctcgacttgaatcttcttgagactggatcgttggttatgactgtatttacaacagcatttacgcttcaggatgacaaatggcattacttgaaaggcttcaatttgacactttgctacattgtaatagcagcgtgcttcttcaccataaaggccctcccaacaccaaagaaggtacatgactgagctgctcaaggagatgctgcatcaaaaaaggtgcatgcctgagctgctcaaagagatgttgtccatgtttagaatgaaattgaggcacctcagttcaaggtagtagactggcgttccctcaagctccttatgatcaagcttttgttgaacacgccggggaccaacatatttgactatattgctgacaaaatgtgactcctaatatttctcccttatattactgacaaattaagtgtggtcagctgctccaaggaagcgaattttag

SEQ ID NO: 31272 - protein, 440 aa, Panicum virgatum
  misc_feature: Ceres CLONE 1904385
  misc_feature (293)..(426): Pfam Name: Na_Ca_ex Pfam Description: Sodium/calcium exchanger protein
  misc_feature (98)..(248): Pfam Name: Na_Ca_ex Pfam Description: Sodium/calcium exchanger protein
MAPSQSGGGEAAGDLLETGLLVAAVKATSTSGRPADDERGAGATTSSRVRRGARLAAAQLQEVFLGTRLFPLFSAVPLAVAAQHLRLGRAWVFVFSLIGMAPLAERVSFLSEHIADTAGPTAGGILNATCGNVPELIIALFALHKEKLEILKWSLLGSILSNLLLVLGSSLLCGGLANTGKERPLDRRQADVSIGLLMLGVLCHILPLLSKYANCTGHSISSSGSVLELSRLSAIVMLTAYFGGLIFQLKTHRQIFEQEDSSESTNTNNSNDDDGSSVIGFTSAVIWLIGMTVVIAVLSNYIITTIEEASESLGIPLRFISIILLPIVGNAAEHAGAIIFAFKNKIDITLDIALGSATQISLLVVPIILIVSWVNGIPMDLDLNLLETGSLVMTVFTTAFTLQDDKWHYLKGFNLTLCYIVIAACFFTIKALPTPKKVHD

SEQ ID NO: 31273 - DNA, 3077 bp, Panicum virgatum
  misc_feature: Ceres CLONE 1904396
  misc_feature: Encodes the peptide sequence at SEQ ID NO. 31274
caagcatgaagcccactagcccagcggctactacctcgcgctggccactcctcccttcttgccttcacgggcgttgctcggcgtgtccgtacaccggcggcgacaggcggcgtcctctgaacaaggcaacatgattcccgaggagaggatgctaccagcaagcatggaaatacttaccactgttgggcagatcattccaacaccaacgtaagttgcggaaaaattaaagtagaagctgcaaggatataaaacaatctcatgattaattagatttttcatgcagatataattgctagttttctggtaacatcaaattcgattttacccccccccccccctcatatatttttttaattgtttacctatcccttaccctctgtggtatgctttgagtccaaatgttgggatcgaagcaagtccacagttaggtccacctgtgtagaaccattgaaaaatgttccagcacagacttcctgcgaaggattgaagcatgacagacacttgcctcctggactcaaaaagtgctgaaatctttgatctccattgcttctcttggactcattgagagcaagaacgatccaaaaccacctgataacatgctagcatagagataagtccctcgaagaaacaaaacacaactgtgataaaaggcaagctaaagatagtttcaaggcagcaaatgtggttaccctatacttagaaggaacagtgctccttaattaactaccatgctccctataaaagccttctctccccttctctcccattgcatccagcatttgattatgtgtgtatgtcttggttttaaccaagacatacacacagaatcgaacaaatagttaaagcttattgttccatcaaatgcaactaatcggtcccccacaatggagcatgtcaatgatccccaggaaggtatctcaacagaacgcgcctttgaggcagatcctatcccatcgctgtcggagaccatcaccctacggtcattggtgcttagcctcatccttggtgcatccctcagcgccgtcgccatgaagatcagcctaaactcaggcttcctcccaccgctcaccattccggccggcctcattggtttttacctctcccgtgcattgatccgtgttcttgattattttgaggtggcacacctgccattcacccgccaggagaacaccgtcatacaaacctgtgtcgccgcctgctccgccattacatttagtggtgggtttggaacgtacatcctcgcgatgggcaaggaagcagctggaggggatatcggggatgggaagaatattgtcgagccaagcattggccggttgatcactttcctcttcctcgtcagtttctctggaatgttcatcctcatgcccttgaggaaggtcatgatcattcgtcacgggttgacataccctagtggcatggccacggcacaacttatcaatagcttccatacccctcaaggcgccaacaacgcaaggcagcaagtgcacattctgttcagatcattggggggaaccatattctggaacgcattccagtggtttttcactgctgcaaagggctgcggcttcagagccttccccgtgtttggccttgaggcatataagcatggattctacttcgacttctgcatgaccaatatcgcaatcggcatgctatgcccatacataatcactgtctccttgttcatcgggagtgttatctcatgggggatcgtttcgccatacattgcagcaaaggagggtatctggtacactactgaacttagcacggcaaccctcggcaacatgaggggctataaggtcttcattggagtgtccatgatactcgccgatggcctcttcaacttcctgtccatcatgctctgcacattgtgcgccatgtacaagaggcgcaggcagccaatgcaaggacaagatggcagtgatggtgatagtgacatgcagttgccgttccacagcctcaatgctgctgagcagcagaagacgatgcagagcttcgacgaccggcgcagggcgcaggtgtttgtccgggaccatataccaaacggggtcagcattctctgctacatcctcctgtcagcgctctgcgtcgtcgccatcccctacctctacccgcagataaggccccaccatgtcgccctcatctacctggctgctccggtcttcgccttctgcgacgcctatggctttggcgtgaccgacatgaacctgtcgagtacctacggcaagctggctatgctcctcgttggctcggtggtgggctgtgacaatggcggtgtgatcgctggcctcgtctcttgcgggatcgtgatggcaaccatgtgtaacagcaacaacctgatgcaggaactcaagacagggtatctaaccctgacctcgccgcgcgctgtgttcatcagccaggcgatcggcactgggctcgggtgcgtcatcaacccggtcatgttctgggccttctacaaggcgcaggacggcgacaccaacctcttcgacgcgccctacgcccgggtgtaccgcggcatcgccatgctgagcgccggcgggaaggggctgcccctgcacagcctgtggctctgcaagctcttctttgcgctggcgctggcgctgagcgtgttccgggatgtggcctcacgaaagcagtggcgcgtggcgccatacatgccgagcaccatctgcgtggctatcgccttcgtggtgccggcacgcatgcccatcgtgttcctgggcagcctggtgatgtacctgtggaggcgcgccgactccggcaaggcgctgacgttctcggcggcggtggcgtcggggctgatctgcggggatgggctcgggaacctgctgtcgtcgatggtggcgctgacgcacgcaacggcgcccatgtgcatcaagttcgtgtcgagcagcgaaaacgtcaagctggacgccttcctggctacactgactaggacatgacatagcttcttcttgttgggatctttgtaaattttccgtagggggcgtagtttgccgtgttgtatccacttgtaattgagttaatttcagtctgaatttacaattgaatacaattttaaatctctgtgtccg

SEQ ID NO: 31274 - protein, 686 aa, Panicum virgatum
  misc_feature: Ceres CLONE 1904396
  misc_feature (28)..(655): Pfam Name: OPT Pfam Description: OPT oligopeptide transporter protein
MEHVNDPQEGISTERAFEADPIPSLSETITLRSLVLSLILGASLSAVAMKISLNSGFLPPLTIPAGLIGFYLSRALIRVLDYFEVAHLPFTRQENTVIQTCVAACSAITFSGGFGTYILAMGKEAAGGDIGDGKNIVEPSIGRLITFLFLVSFSGMFILMPLRKVMIIRHGLTYPSGMATAQLINSFHTPQGANNARQQVHILFRSLGGTIFWNAFQWFFTAAKGCGFRAFPVFGLEAYKHGFYFDFCMTNIAIGMLCPYIITVSLFIGSVISWGIVSPYIAAKEGIWYTTELSTATLGNMRGYKVFIGVSMILADGLFNFLSIMLCTLCAMYKRRRQPMQGQDGSDGDSDMQLPFHSLNAAEQQKTMQSFDDRRRAQVFVRDHIPNGVSILCYILLSALCVVAIPYLYPQIRPHHVALIYLAAPVFAFCDAYGFGVTDMNLSSTYGKLAMLLVGSVVGCDNGGVIAGLVSCGIVMATMCNSNNLMQELKTGYLTLTSPRAVFISQAIGTGLGCVINPVMFWAFYKAQDGDTNLFDAPYARVYRGIAMLSAGGKGLPLHSLWLCKLFFALALALSVFRDVASRKQWRVAPYMPSTICVAIAFVVPARMPIVFLGSLVMYLWRRADSGKALTFSAAVASGLICGDGLGNLLSSMVALTHATAPMCIKFVSSSENVKLDAFLATLTRT

SEQ ID NO: 31275 - DNA, 593 bp, Panicum virgatum
  misc_feature: Ceres CLONE 1904398
  misc_feature: Encodes the peptide sequence at SEQ ID NO. 31276
atcacctcaagctcactgagcaccaagcaaataccacgccctggggtgttcccagatcataccctcccagccatccataatggcgggaaacctgctatctaactatgtccaggtctacttcatgctcccagctggatgtcatcacagacgacgacaccgttcgacaaggccgaccatacgagggtgcagctgatcaatctggcggaggccggcgctgacgaggtcatgatcgacatctggtgggagctggaggaatggaatgagcccggagactactactgcagatcctactgctaggtgttcgagctggtgcaagacgactggctgaccctgcccgccatcatgtcttgcctccattgctgcggctatgtcagcgacatcgtcatcatcccaatcccgctgtgggtgcggaacgttggcgacgccaacccccacatcttctacaccaaccggaggaagatgaggaacatctattacctcacgattggagtgaatgaccaccctctcttccaggagacaactgcagttcagctctatgatgattacttcatcagctgcacggataacaaggcagagctcttggacgctggtgt

SEQ ID NO: 31276 - protein, 83 aa, Panicum virgatum
  misc_feature: Ceres CLONE 1904398
  misc_feature: SWISSPROT Homolog: EC 3.2.1.2 Beta-amylase
MSCLHCCGYVSDIVIIPIPLWVRNVGDANPHIFYTNRRKMRNIYYLTIGVNDHPLFQETTAVQLYDDYFISCTDNKAELLDAG

SEQ ID NO: 31277 - DNA, 677 bp, Panicum virgatum
  misc_feature: Ceres CLONE 1904406
  misc_feature: Encodes the peptide sequence at SEQ ID NO. 31278
actccaatcctccaattcccaaatcctcctgcaacctcgcgccctccactccagcaaatccctagcctcgcccaccctctccgtccccgatggcccgcacgaagcagacggcgaggaagtccaccggcggcaaggcgccccgcaagcagctggcgaccaaggcggcgcgcaagtccgccccggcgaccggcggggtgaagaagccccaccgcttccgccccggcaccgtcgcgctccgtgagatccgcaagtaccagaagagcacggagctgctgatccgcaagctccccttccagcggctggtgcgggagatcgcgcaggacttcaagaccgacctccgcttccagagctccgccgtcgccgcgctgcaggaggccgccgaggcctacctcgtcgggctcttcgaggacaccaacctctgcgccatccacgccaagcgcgtcaccatcatgcccaaggacatccagcttgcgcgccgcatccgtggcgagagggcctagagcttgcctgatgtgtggaaatgtagagatgtgttccgtagtcgcttgatctatgttatgtcgtgggtggtgtggttgtttccttgttcgtggtatggctgtagtgttctggtgtgatgtagcttctgatgttccatctcattatcatcagtaatggaaaagttagttacctgatcc

SEQ ID NO: 31278 - protein, 136 aa, Panicum virgatum; identical to SEQ ID NO: 10238
  misc_feature: Ceres CLONE 1904406
  misc_feature (58)..(132): Pfam Name: Histone Pfam Description: Core histone H2A/H2B/H3/H4

SEQ ID NO: 31279 - DNA, 1506 bp, Panicum virgatum
  misc_feature: Ceres CLONE 1904428
  misc_feature: Encodes the peptide sequence at SEQ ID NO. 31280
agttgcatcccttctctctctaccctctcgccgcccagctcctccgggcccctgtatccggcagcgccgcggcggcgaagttcgaatcgagcgcgatccgagcctcaccgaagagccggcgatgggcggcgagaaggatactgtcgacctctccgacctcaacgccgccctccccgccgccgccgcagctctcagcgccgaggaccgcgccggcctcgtcaatgccttaaaggacaagctgcagagcttggcaggtcagcacgccgatgtgctggagacgctctcgcccaacgttaggaagcgcgtcgagtttttgagggaaatccagggccaacatgatgagatcgaggcgaagttttttgaagaacgagctgcacttgaagctaagtaccagaagctgtatgaacctttgtacacaaagaggtatgaaattgtaaatggagtagttgaggtagatggcgtcagtgatgaaccaaccagtgataatgctgctgagggaaaagaatcagatgctaaaggagttccagatttttggcttactgctatgaaaacgaatgaagtcttgtctgaggagatacaagagcgtgatgaacctgctttgaaatatctaaaagatatcaagtggtctagaattgaggatcctaagggtttcaagctggagtttttctttgatacaaatccgttcttcaagaactccgtcctatcaaagacctaccacatggttgacgaagatgatccgattctggagaaagcaattggaactgaaatcgagtggtatcctgggaaaaaccttactcagaagattctaaaaaagaaaccgaagaaaggttcaaagaatgctaagcctattactaaaactgaagtgtgcgagagtttcttcaactttttcaatcctccacaggtccctgatgatgacgaagacattgatgaagaaactgctgatgagctgcagggtcaaatggagcatgattatgacattgggaccaccataagggataagatcatccctcatgctgtttcctggtttactggtgaggctgttcaagctgacggttttgagcacattggtgacgatgatgatgatgaggaggaggacgaggatgatgatgaggacgaagaggaagaggatgaggatgatgaggacgaggaagaagaaagcaaaccagcaaggaagtcgggctctggccgcaaacaaaaggtaacacagaaggtgccgcagggaaatgctgatcaaccagcagagtgcaagcagcagtgaactgcccccattatcagtggtgcttggttgatgcagtattttccattgaactgcccaggagctttttcggttgtttctgtgagcgggttagatgttactccgtattaggtggtgaggttgttgtctggagcacctagtgctgtgttggtagatggtgaatggtttgaaacttctctgttagcagcgtcttatgtttcggttgcatgcaatcggatggtattattatatgattgtgtaattatctttgt

SEQ ID NO: 31280 - protein, 378 aa, Panicum virgatum
  misc_feature: Ceres CLONE 1904428
  misc_feature (59)..(308): Pfam Name: NAP Pfam Description: Nucleosome assembly protein (NAP)
MGGEKDTVDLSDLNAALPAAAAALSAEDRAGLVNALKDKLQSLAGQHADVLETLSPNVRKRVEFLREIQGQHDEIEAKFFEERAALEAKYQKLYEPLYTKRYEIVNGVVEVDGVSDEPTSDNAAEGKESDAKGVPDFWLTAMKTNEVLSEEIQERDEPALKYLKDIKWSRIEDPKGFKLEFFFDTNPFFKNSVLSKTYHMVDEDDPILEKAIGTEIEWYPGKNLTQKILKKKPKKGSKNAKPITKTEVCESFFNFFNPPQVPDDDEDIDEETADELQGQMEHDYDIGTTIRDKIIPHAVSWFTGEAVQADGFEHIGDDDDDEEEDEDDDEDEEEEDEDDEDEEEESKPARKSGSGRKQKVTQKVPQGNADQPAECKQQ

SEQ ID NO: 31281 - DNA, 1932 bp, Panicum virgatum
  misc_feature: Ceres CLONE 1904437
  misc_feature: Encodes the peptide sequence at SEQ ID NO. 31282
agcgctcgcggcgcccaccaggacactactctccgctgccccgcgccccccgcaccgcgctccctgccccccgctaccgccggcagccgagccgtgcaccggtgtcgtcgggcggccgccatggcggaggtggcggcgcagcgcgccgtcgccgccgccgtcccagcggggggcggcgaggacgcggacctggcggcggcggcaatgcgggggcgcggggaggtggacacgtcgtcgccgttccagtccgtgcgccaggccgtcgacctgttcggcggcggggccgccgccgtctcccagtggcggcacccgcaggcgccgccgcccgtccagctccgcccggaggaagaagaacttataaaagttgaggaacaaacagtgaagctggagatggaactttttgtcaaagaaaaggaaacatataatgtcttgaaagaactacaggaaacaaagcagattattgatggcttgaaagtacaaatagagaaggtaacgtcggagagcactaatgccgcaaaaggtcatgctgatatggggaaggtacatccacttcctgctactgaacataaatccagtagccacaaggagccaccaatccagagtgcaaaagttacacagtctccactaaccacattgatcaagctgaatcaggcaaaagcattccttaacacggatactatcaacatattaaggagcgagatagagaaggagaaagcatcacttgagaaaacccgtgaaaggttacagtcgaacctagggaaggcttcatcgctagaagcagatttgacgaaaaccgttgcaaagctgcaagcagtaaaagctccacaacctgtccttgagccttctgaaatctggttgcagatgaagcacttgaattctgagaaagcgaagcacaggaaggtgtcagaggatttgaagaacgagatttatgaatcaacagctgcaatcgagcacacaaggtctaagacgaagacactgcagttcaggatcgtcatggccgagaaattgaaggaagcctcacaacgtggagaagctattgctgtggcagagatgaaaaacctgagcaacgggcaggacctaagcacttcaacttccgatgtcacactctccgctgaggagcactctatgtttgtgctcaaagcacaagaagtggatggcgcggctaggaagaaaatcgacacagcaatgcaagagctagatcaggcaaaccagtgtaagctggaactcttggaaagagtagaggaagcaaggtcagctgttgagacgagccggaaggctctggaggaggctcagaagagggaagaatctgcaaacaaggcaaagctagcagctgaagagacgctccggaaactgcggtcagatcaaataatccagaactggcggccgatcaacaacaactccactaaattcaagaacacggcggtgacgccccggcgcgcgggctccgtgatatacgacgtgaacggcctgagcctggtgaccgccgggcagaagagcatgaagacggtgtccatcggcgagatcctgagcatgaagctggaccgcgagcttgaggccgcgaaggccacgcacgcgaggaagaaggtgtcgctggggcagctgctgagccagaagtacgaggtgttctccccgctgaggatcgaccacgacggcgcgtcccgcaagcagttccagcccaggcggaagaagatgggcttcgtcgtgtacgcgctgctcctcgcgaagaggcggcacaagaagaggcaggctccactcatggcggcttcagctagtttaagttttgttcgtcagtactcggtagcaccctagtagtttacatacttttaagagctcggaataattgtcgcctgtgtaattagctagatgtactccggttccggtatgaacaatttgtatttttaggacttcaaaaaaaaagttggtatttttagc

SEQ ID NO: 31282 - protein, 562 aa, Panicum virgatum
  misc_feature: Ceres CLONE 1904437
  misc_feature: SWISSPROT Homolog: EC 2.7.11.1 Non-specific serine/threonine protein kinase
MAEVAAQRAVAAAVPAGGGEDADLAAAAMRGRGEVDTSSPFQSVRQAVDLFGGGAAAVSQWRHPQAPPPVQLRPEEEELIKVEEQTVKLEMELFVKEKETYNVLKELQETKQIIDGLKVQIEKVTSESTNAAKGHADMGKVHPLPATEHKSSSHKEPPIQSAKVTQSPLTTLIKLNQAKAFLNTDTINILRSEIEKEKASLEKTRERLQSNLGKASSLEADLTKTVAKLQAVKAPQPVLEPSEIWLQMKHLNSEKAKHRKVSEDLKNEIYESTAAIEHTRSKTKTLQFRIVMAEKLKEASQRGEAIAVAEMKNLSNGQDLSTSTSDVTLSAEEHSMFVLKAQEVDGAARKKIDTAMQELDQANQCKLELLERVEEARSAVETSRKALEEAQKREESANKAKLAAEETLRKLRSDQIIQNWRPINNNSTKFKNTAVTPRRAGSVIYDVNGLSLVTAGQKSMKTVSIGEILSMKLDRELEAAKATHARKKVSLGQLLSQKYEVFSPLRIDHDGASRKQFQPRRKKMGFVVYALLLAKRRHKKRQAPLMAASASLSFVRQYSVAP

SEQ ID NO: 31283 - DNA, 1379 bp, Panicum virgatum
  misc_feature: Ceres CLONE 1904438
  misc_feature: Encodes the peptide sequence at SEQ ID NO. 31284
cgtacgccgcaccccgccaatccccgaaaccctagggggcgccaccaccgccggcgtcccgcggccatggacggcaccgcggcggcggcggccacggagctgcgcgaggcccaccgcctggcgggccacgccgaccgcgtgtgggcgctcgcctggaaccccgccggcgccggccccgtcctcgcctcctgcagcggcgacaagaccgtccggatctggaagcgcgcccccgacggcgcctggcgctgcacggacgtgctggaggacacgcacaaccgcacggtgaggtcctgcgcctggtcccccgacgggaggctgctggccaccgcgagcttcgacgccaccaccgccgtgtgggagtacaacggcgccaacttcgagtgcgtcgccactctggaggggcacgagaacgaggtgaagagcgtgtcgtggagcccttccggatcgctgcttgcgacgtgcagccgggacaaggcagcgtggatatgggaggtgcagccggggaatgagtacgagtgtgtgtcggtgctgcaggggcacacacaggatgtcaagatggtgcagtggcaccctttgctcgatattctggtctctgtcagctatgataatacaatcagggtctgggttgatgatggggacgatgagtggcactgtgtacagacattaaccgaagccaataactgtggtcattcatcaacagtatgggcagtatcatttaaccagaaaggtgataggatggtcacatgcagtgatgaccgctcactaaaaatatgggacaccagtgctgatttgtctcaaccaaaaactggtgaaggtcatgaatcttggcgacacctttctactctcacaggatatcacgatcgaacaattttttcagtccattggtcaagtgaggatgttatagctagtggtgctggtgacgatgcaatctgcttatttgctgagaatagtagtatggttgaggggccttcgtacaaactaatactgaagaaagagaaggcccacgacatggatataaactgtgtccgatggtgtcctcaggacccgaggttattggcatctgcaagcgacgatggcacagtgaaattgtgggagctgagggggagtgtactggattgagttttttttttctgtttacaatatactcctagttctaggtgtgtaccttgagattatagagcagattaggcatcacctttggggtttctgttttaccaaactctgccccctgttttgtttatacttgtatgtcaagagggtgcttggtgatgttctttgatcagatttaccatgcaaactatgaacaatgccatcctaccacgatgtggaattgtctgcttgtacattatggtccagccatttttacaaataagttatcc

SEQ ID NO: 31284 - protein, 350 aa, Panicum virgatum
  misc_feature: Ceres CLONE 1904438
  misc_feature (104)..(142): Pfam Name: WD40 Pfam Description: WD domain, G-beta repeat
  misc_feature (59)..(98): Pfam Name: WD40 Pfam Description: WD domain, G-beta repeat
  misc_feature (304)..(343): Pfam Name: WD40 Pfam Description: WD domain, G-beta repeat
  misc_feature (12)..(52): Pfam Name: WD40 Pfam Description: WD domain, G-beta repeat
  misc_feature (149)..(187): Pfam Name: WD40 Pfam Description: WD domain, G-beta repeat
  misc_feature (199)..(237): Pfam Name: WD40 Pfam Description: WD domain, G-beta repeat
  misc_feature: SWISSPROT Homolog: EC 2.3.1.48 Histone acetyltransferase
MDGTAAAAATELREAHRLAGHADRVWALAWNPAGAGPVLASCSGDKTVRIWKRAPDGAWRCTDVLEDTHNRTVRSCAWSPDGRLLATASFDATTAVWEYNGANFECVATLEGHENEVKSVSWSPSGSLLATCSRDKAAWIWEVQPGNEYECVSVLQGHTQDVKMVQWHPLLDILVSVSYDNTIRVWVDDGDDEWHCVQTLTEANNCGHSSTVWAVSFNQKGDRMVTCSDDRSLKIWDTSADLSQPKTGEGHESWRHLSTLTGYHDRTIFSVHWSSEDVIASGAGDDAICLFAENSSMVEGPSYKLILKKEKAHDMDINCVRWCPQDPRLLASASDDGTVKLWELRGSVLD

SEQ ID NO: 31285 - DNA, 1571 bp, Panicum virgatum
  misc_feature: Ceres CLONE 1904444
  misc_feature: Encodes the peptide sequence at SEQ ID NO. 31286
aaaagacacggtctcaaaacgctctccctcgccccactagggtttccctctccgccccttctccggcagctcaggagagcgcggcccaatcccggcggcggcggcaaacgccgcggcgacccaacgcggcgcaggcgccatggctgtgccggaggcgccctcatgctacgtagggatcgcgcggcagtccgccgccttccgcctcatgaaacaaatgggatgggaagaaggtgagggccttggcaaagacaaacagggcattaaaggtcatgttagggtgaaaaacaagcaggatactttaggtgttggtgtagataatcctcgtgacaaatgggtatatgataccacccaatttgacaacatactgaagaaattgaaagtgcaatcagctaagcctattcaagaagaaattgcagctgtaagtgatttgcctgacagcacgcccaagaaagacaaaccagcaaatgttgaagttactaaagttactcgacctcaaggaagatacaagaaaagagaggggggaaagagagtgagctcttattcagcaatagatcttcaaggcatacttgcacgcaaaaacgaagatagttgccaagtggatcagaaacctgaaccaatatgcttggatgaacctgatcctatcatttgccctgatgcagtatcccaagctgaagatctgaattggtgggggcacaagtttggattcgtatcaggagggtttctaggagcaacatcgcgtaaaagaaagtcttctcgaaaagatcctgctaatgtccgccagacatttgcggaggaagatcaagaaaatctatacaatcttattcaggataaggctacttctggcaagcagggtcttggcatcaagggactgccaatgaaaattgctggccatcgttggaagggaaacaaaacttcatttggtgatagtgacgatgatgattcagccaagtccgatgaatattcagaaattgaagaggacaatgaggaacaacccactgctgatgaatccatagagatagagaataatacagaaaaacaattgcatgtggatgttagatccaaaaccaaggtcaagaaactttgcaaaagaatacttcgtcaggccccagctcagtcgatgaaactgaaggatcttaaggtagccgttaaagaacattctaatgttgtattctccagcttctcttgtagacgtgaagctctgttgtttctgaagaagaagcttcaagggagcaggaagttcagcatagaaggcaagaaagtacaacttgtgtcttgaaagcgaagcagatacaaagcttttggggcggtgcattgttgaggtttccagtgctcatatttgttgttgcttgagatttcgaacagcagtggcaaattgagctctgtagaatagataagggatcaaaccctttcgcggacgcgggaggtagaattttgcgaaatttcgataggtgcagaggtgctaatctacatgtttgcagtacattcgatgtatctggttggtctgattctacgaactgcagaactatgagaatcgtatgtgattgtgctatatatgctacctatttgctggc

SEQ ID NO: 31286 - protein, 378 aa, Panicum virgatum
  misc_feature: Ceres CLONE 1904444
  misc_feature (15)..(59): Pfam Name: G-patch Pfam Description: G-patch domain
MAVPEAPSCYVGIARQSAAFRLMKQMGWEEGEGLGKDKQGIKGHVRVKNKQDTLGVGVDNPRDKWVYDTTQFDNILKKLKVQSAKPIQEEIAAVSDLPDSTPKKDKPANVEVTKVTRPQGRYKKREGGKRVSSYSAIDLQGILARKNEDSCQVDQKPEPICLDEPDPIICPDAVSQAEDLNWWGHKFGFVSGGFLGATSRKRKSSRKDPANVRQTFAEEDQENLYNLIQDKATSGKQGLGIKGLPMKIAGHRWKGNKTSFGDSDDDDSAKSDEYSEIEEDNEEQPTADESIEIENNTEKQLHVDVRSKTKVKKLCKRILRQAPAQSMKLKDLKVAVKEHSNVVFSSFSCRREALLFLKKKLQGSRKFSIEGKKVQLVS

SEQ ID NO: 31287 - DNA, 705 bp, Panicum virgatum
  misc_feature: Ceres CLONE 1904450
  misc_feature: Encodes the peptide sequence at SEQ ID NO. 31288
gtatggtcttggtggatcttccatggctctctttggaagagttggtggaggtatctacacaaaggcagctgatgtgggtgctgatcttgttggcaaagttgaaaggaacatccccgaggatgatcctaggaacccagctgtgattgctgacaatgtcggtgacaatgttggtgacattgctggaatgggatccgatctctttgggtcatacgcggaatcttcctgtgctgcccttgttgttgcatctatttcatcttttggaattaaccatgatttcactgggatgtgctacccattgcttgtgagctctattgggatcattgtctgcttgatcaccacactctttgccactgacttctttgagatcaaggccgtgaaagaaatcgaacctgcacttaagaagcagctcatcatctccactgctttgatgactgttggtattgcgataatcagctggttggcccttccagctaagttcaccatcttcaactttggcactcagaaggaagtatccaactggagcttgttcttctgtgttgcaatcggtctgtgggctggtcttattattggttttgtcacagaatactacactagcaatgcatacagtcctgtgcaagatgttgcagattcctgcagaactggtgctgccaccaatgtcatttttggtcttgctctaagatacaagtcagttatcattccaatttt

SEQ ID NO: 31288 - protein, 234 aa, Panicum virgatum
  misc_feature: Ceres CLONE 1904450
  misc_feature (1)..(234): Pfam Name: H_PPase Pfam Description: Inorganic H+ pyrophosphatase
  misc_feature: SWISSPROT Homolog: EC 3.6.1.1 Inorganic diphosphatase
  misc_feature: Useful for making plants with modulated water use efficiency
YGLGGSSMALFGRVGGGIYTKAADVGADLVGKVERNIPEDDPRNPAVIADNVGDNVGDIAGMGSDLFGSYAESSCAALVVASISSFGINHDFTGMCYPLLVSSIGIIVCLITTLFATDFFEIKAVKEIEPALKKQLIISTALMTVGIAIISWLALPAKFTIFNFGTQKEVSNWSLFFCVAIGLWAGLIIGFVTEYYTSNAYSPVQDVADSCRTGAATNVIFGLALRYKSVIIPI

SEQ ID NO: 31289 - DNA, 716 bp, Panicum virgatum
  misc_feature: Ceres CLONE 1904460
  misc_feature: Encodes the peptide sequence at SEQ ID NO. 31290
ctgcagttgcgcgcgctctctctctctcccgctgaacatcactcggtgtttgcgtcttgctttccgacgctgctggccggctagctgttctttactacttctgtggtgctcgatccgctcaccagctggttccggcaagccgccgtcaactcagctgctggctgcttcttcgggagccgccgagtgatcatataacaaagccctgaatttaaggaaggtagatgaccatgggaattattacagtggggcagtttctcttgttcctaattgcttgcaatgcacatgttgctgtcggatccttcaatgggagtcagtcagatcggatatcactccttgaattcaagaaggcaatcagtgatgatccacaacgggtctttatgtcctggaatgacagcattcacttctgcagttgggaaggggtcttgtgcaggtttaagaatccacatcgtgtaacttctctcgatcttgggggtcgaggcttagttggcaccatctctccctcgctcggaaacctcacattcctaaaatatctcttccttcccaacaacggattcattggagaaatccctccatcccttgtccatttgcgccgcatccagtatctctgcttgagcaataatacactccaaggacagacacctgactttgcaaattgtttcagcctcaagaagctatggctggacggtaatcacttcgtgaggcaaatgcctatatta

SEQ ID NO: 31290 - protein, 164 aa, Panicum virgatum
  misc_feature: Ceres CLONE 1904460
  misc_feature (30)..(70): Pfam Name: LRRNT_2 Pfam Description: Leucine rich repeat N-terminal domain
  misc_feature: SWISSPROT Homolog: EC 2.7.11.1 Non-specific serine/threonine protein kinase
MTMGIITVGQFLLFLIACNAHVAVGSFNGSQSDRISLLEFKKAISDDPQRVFMSWNDSIHFCSWEGVLCRFKNPHRVTSLDLGGRGLVGTISPSLGNLTFLKYLFLPNNGFIGEIPPSLVHLRRIQYLCLSNNTLQGQTPDFANCFSLKKLWLDGNHFVRQMPI

SEQ ID NO: 31291 - DNA, 714 bp, Panicum virgatum
  misc_feature: Ceres CLONE 1904505
  misc_feature: Encodes the peptide sequence at SEQ ID NO. 31292
ggaaggcagcaggcgcgcaaattacccaatcctgacacggggaggtagtgacaataaataacaataccgggcgcgttagtgtctggtaattggaatgagtacaatctaaatcccttaacgaggatccattggagggcaagtctggtgccagcagccgcggtaattccagctccaatagcgtatatttaagttgttgcagttaaaaagctcgtagttggaccttgggccgggtcggccggtccgcctttcggcgagcaccgacctactcgacccttctgccggcgatgcgctcctggccttaattggccgggtcgtgcctccggcgccgttactttgaagaaattagagtgctcaaagcaagccatcgctctgtcaaacatccttctgcagtggaacctgtgacatcctctcaaagacctggtagttcgacgtcttcgatgtcggagcgcattgctgcaaactcggtggcaagcgctcctggcttgtcgccaagctcttcaataagatctctcacctcagaaaagtcaactctgaacccaaatgctaaggaattcaagctaaatcctaatgccaagagcttcactccatcagcatctctgaggccaccacctcctccagcatctgatgcatcatactactatcctaacaacatgccggtggcaccacttggacctggtttacagtggggcatgggggttcctcccgcatatgggt

SEQ ID NO: 31292 - protein, 92 aa, Panicum virgatum
  misc_feature: Ceres CLONE 1904505
  misc_feature (36)..(53): Pfam Name: PAM2 Pfam Description: Ataxin-2 C-terminal region
MSERIAANSVASAPGLSPSSSIRSLTSEKSTLNPNAKEFKLNPNAKSFTPSASLRPPPPPASDASYYYPNNMPVAPLGPGLQWGMGVPPAYG

SEQ ID NO: 31293 - DNA, 745 bp, Panicum virgatum
  misc_feature: Ceres CLONE 1904550
  misc_feature: Encodes the peptide sequence at SEQ ID NO. 31294
gccaatcaaccaagaagcacgcgcagccacaccaagtcagggagaaggccatggccggcgtgaactcaaccagcgtcgtcgggctcaagcccgccgcggcggtgccgcaggccgccacctcctcgccggcggcgaagcgggtccaggtcgcgcccaaggaccgggcggccgagggccggcgcgcggcgctcctcggcctggcggccgtcttcgccgtcacggccaccaccgggtcggccaaggccgggatcatcgacgagtacctcgagaagagcaaggccaacaaggagctgaacgacaagaaaaggctggctaccagcggcgccaacttctcccgcgcctacaccgtcgagttcggcagctgccagttcccctacaacttcaccggctgccaggacctcgccaagcagaagaaagttcccttcatcactgacgacctcgagatcgagtgcgaggggaaggagaagtacaagtgcggctccaacgtcttctggaagtggtgaagcgcacgcttgattggcttggaactggagggggcgctggcggtgtaacgtgtgtacctagatgcccaaactgcaggaaaaatttggatgtgtaatttaccgtcactgtatctgtgccatctcatcatcgtctgaacatgaacctcttgtattgaggaaaaaaacaaccacacaagatagataagccttttgcagatcatactgaaccaggcagacacttcacactagagcacttgatcaca

SEQ ID NO: 31294 - protein, 150 aa, Panicum virgatum; identical to SEQ ID NO: 12907
  misc_feature: Ceres CLONE 1904550
  misc_feature (9)..(150): Pfam Name: PsaN Pfam Description: Photosystem I reaction centre subunit N (PSAN or PSI-N)

SEQ ID NO: 31295 - DNA, 2029 bp, Panicum virgatum
  misc_feature: Ceres CLONE 1904551
  misc_feature: Encodes the peptide sequence at SEQ ID NO. 31296
tcttcctccccctccagttcccaaccactcccccctccgcgtcgatccatctcgtccggggcggcacgaagccgaagcagctcgagcgctcgacgcgagagaacagcgaagcgagcgcggccgggttgccgggagcaggagcgcagctgacgcggcggcgagacggcggggagggatggaccggcacggcggcggcggggccggggcgggcgctaagctggcgcggaccccgtcgtcgctgctccgctcgccgaccgtccgcgccggccccggcgccgcgtcgttccacttccacgcggcgctcgacgacccggagcccgacgacaagaaggcgcaggcgccgccgctcgccagcaagcccggggcgctgctccgccgggcccaccaccggctcctccccgtcccggcccagtccgcgctcctcctcctcctcctcccggccctcgcgctcgccgcgctgctcctgcgcggcggaggcgggggccaccacctcgcgctcctggcggccgcggcgggggccgcgctcgccgccgccgcggccgtcgcgcggctccgcgccagcggcgcccgggcacgggcctccccggcgcgccagctcgcggcctccgtgcggtggttcgtcggcgagggggagggcggggaggagcagcagccgcggggggcggcgaggaaggggaggcgcgcggcggaggcgcaggagggcgtcgagttctacagcaacggggaccgctacgagggggagttccacggcgggcggtgcagcggcagcggcgtgtacagcttcttcgggaagggcaagtacgagggcgactgggtgggcggcaggtacgatggcttcggcgtcgagagctgggcgcgcggcagccggtaccgcggccagtacaggcagggcctccgccacggccacggcgtctaccggttccacagcggcgactgctacgcgggcgagtgggccggcggccagagccacggcatcggcgcccagacctgctccgacggcagctcctatgccggcgagttcaagggcggcgtcaagcacggcctcggctcctaccatttcaggaacggtgatcggtatgcgggggagtactttgcagacaagatccacagtttcggtgtctacacctttgccaatggccacagttacgagggctcttggcacgaagggaagaagcaggggtttgggatgtacgcatttcggaatggtgatgagcgagcaggggagtgggattctggaattctgaagaacttattgcctctgtcagactcggctcttcagcgcgccctgcaggctgctcgacgggccgcagacagcgccgttcacctcccaagagtggaggagcaggtgaacaaggccgtcatggctgcaaacagagcagccacagctgcccgagtggctgccatcaaggcagtgcagaacagaatcgatggcaagctctgtttcatcgacgtgtgaagtgtgttcaatcaagaactgtgccctttcgcttgtaaactgtacatttagcgtagcgaagagcggcaataaccaactgctgaggttcgcgaccggagcagcacgaccgcttgctccgtgttggagagatcggtaagatcggcagccaccaaagggctgagctgctgttgtcaagaccgtcgagaggttcgcgtcgtgctagattctgagagcaaggtgaccgtcttcatcatcctccttgtgcaggctgctgtagattgcagatagttccatccatgcgtatcaatggtggaggcggtgatctgtcagtcagtggctctctgttgtaatgtacgtgcattgtacatgtactgtgctctcttcctctgtcaagggcgtcggcgccaagggtagctggccctcgacttcgaagctcgtaggcacggacggtatgatcgcccggtggttgttccggtcgatctatggtgaacaggggggagattaggaagagagataggtttgggaatgtgtttgtattgcttgcctcgttctgcacgattacaactgaatagagtctttgccaaacaaactggg

SEQ ID NO: 31296 - protein, 426 aa, Panicum virgatum
  misc_feature: Ceres CLONE 1904551
  misc_feature (232)..(254): Pfam Name: MORN Pfam Description: MORN repeat
  misc_feature (278)..(300): Pfam Name: MORN Pfam Description: MORN repeat
  misc_feature (209)..(231): Pfam Name: MORN Pfam Description: MORN repeat
  misc_feature (324)..(346): Pfam Name: MORN Pfam Description: MORN repeat
  misc_feature (301)..(323): Pfam Name: MORN Pfam Description: MORN repeat
  misc_feature (255)..(277): Pfam Name: MORN Pfam Description: MORN repeat
  misc_feature: SWISSPROT Homolog: EC 2.7.1.68 1-phosphatidylinositol-4-phosphate 5-kinase
MDRHGGGGAGAGAKLARTPSSLLRSPTVRAGPGAASFHFHAALDDPEPDDKKAQAPPLASKPGALLRRAHHRLLPVPAQSALLLLLLPALALAALLLRGGGGGHHLALLAAAAGAALAAAAAVARLRASGARARASPARQLAASVRWFVGEGEGGEEQQPRGAARKGRRAAEAQEGVEFYSNGDRYEGEFHGGRCSGSGVYSFFGKGKYEGDWVGGRYDGFGVESWARGSRYRGQYRQGLRHGHGVYRFHSGDCYAGEWAGGQSHGIGAQTCSDGSSYAGEFKGGVKHGLGSYHFRNGDRYAGEYFADKIHSFGVYTFANGHSYEGSWHEGKKQGFGMYAFRNGDERAGEWDSGILKNLLPLSDSALQRALQAARRAADSAVHLPRVEEQVNKAVMAANRAATAARVAAIKAVQNRIDGKLCFIDV

SEQ ID NO: 31297 - DNA, 748 bp, Panicum virgatum
  misc_feature: Ceres CLONE 1904559
  misc_feature: Encodes the peptide sequence at SEQ ID NO. 31298
ctcctcagctcaggcgagcagcagagccgagcactagcagaccctcctcctcaaattcccgaccaggcgaccaccacttcaccggctcagcgcgatggggtccgtcccggaggacaccgccgcggccgtgttccgctccaagctcccggacatcgagatcccgcgcggcctctcgctgcaggcctactgcttcgagcggctccccgaggtgtcctcccgcccgtgcctcatcgacgggcagacgggcgccgtccacacctacgccgacgtggagctcctctcgcggcgcgcggcggcggcgctgcgcgcgattggggtgggcaagggggacgtggtcatgaacctcctccgcaactgccccgagttcgccttcgtcttcctgggcgccgcgcggctgggcgcggccaccaccacggccaacccgttctacaccccgcacgagatccaccgccaggcggccgcggcgggggcgagggtgatcgtcaccgaggcctgcgccgtcgacaaggtgcgcgccttcgccgccgagcgcggcgtgcccgtggtgtccgttgacggcggccccgggggctgccccctgctccgggacctcatggacgccgccgagccgctcgccgccgacgaggaggtccaccccgacgacgtcgtcgcgctgccatactcctccggcaccaccgggatgcccaaaggcgtcatgctcacgcaccgcagcctcgtcaccagcgtcgcgcagcaagtggacagcgag

SEQ ID NO: 31298 - protein, 217 aa, Panicum virgatum
  misc_feature: Ceres CLONE 1904559
  misc_feature: SWISSPROT Homolog: EC 6.2.1.12 4-coumarate--CoA ligase
  misc_feature: Useful for making plants with altered carbohydrate content
  misc_feature: Useful for making plants with altered lignin content
  misc_feature: Useful for making plants with altered cell wall content and/or composition
MGSVPEDTAAAVFRSKLPDIEIPRGLSLQAYCFERLPEVSSRPCLIDGQTGAVHTYADVELLSRRAAAALRAIGVGKGDVVMNLLRNCPEFAFVFLGAARLGAATTTANPFYTPHEIHRQAAAAGARVIVTEACAVDKVRAFAAERGVPVVSVDGGPGGCPLLRDLMDAAEPLAADEEVHPDDVVALPYSSGTTGMPKGVMLTHRSLVTSVAQQVDS

SEQ ID NO: 31299 - DNA, 712 bp, Panicum virgatum
  misc_feature: Ceres CLONE 1904561
  misc_feature: Encodes the peptide sequence at SEQ ID NO. 31300
gccaggtagtcaccaccctcctcttgtccgcttctttccttcctccctccctccctcctcacccgccgcgcgagaattcggctggactcgttggcgctcccctgagaatcggagctttttttttttgactggtggatagattggtattgggcgatcgattggtcgatcgggggcggaggaagggggaggcccgggaggaggcggggagatggcggcgtgccggggattcttcgagtgcctgctcaggctgctcaacttcttcctcaccgtcgccggcctcgccatggtcgggtacgggatctaccttctcgtcgagtggatgaagatatccggcggcgggggctcgccggcgcacgtgctcgtcctcggccggccgttgctcggggccgtcgcgctaggtgacagcttcctcgaccatctaccaaaagcatggtttatttatttgttcatcggtgttggtgctatcgtcttcctcgtgtctctgtttggctgcatcggtgcagggacaagaaacacctgctgcttgtgtttctatgctttcttggtcttattgttgatccttgctgaggctggagctgccgcgttcatcttctttgaccatagctggatagatgtaataccaaaggacaagacacgtaacttcgatgttatgtatgactttctgaaggataactgggagattgcaagatgggttgctctcggcgttgttgtt

SEQ ID NO: 31300 - protein, 167 aa, Panicum virgatum
  misc_feature: Ceres CLONE 1904561
  misc_feature (7)..(167): Pfam Name: Tetraspannin Pfam Description: Tetraspanin family
MAACRGFFECLLRLLNFFLTVAGLAMVGYGIYLLVEWMKISGGGGSPAHVLVLGRPLLGAVALGDSFLDHLPKAWFIYLFIGVGAIVFLVSLFGCIGAGTRNTCCLCFYAFLVLLLILAEAGAAAFIFFDHSWIDVIPKDKTRNFDVMYDFLKDNWEIARWVALGVV

SEQ ID NO: 31301 - DNA, 668 bp, Panicum virgatum
  misc_feature: Ceres CLONE 1904563
  misc_feature: Encodes the peptide sequence at SEQ ID NO. 31302
gtgtcaaaacctccgagccccgaagcgatcgctagctcagcgcgccggcgacggcggcggtcgccggaggggagatggaggacgtgatggactccgcggtgggcccccacttcagcggactccgcctcgactcgcgccgcctctcgtcctcctcgctcccgtcccccacctccgccaacggcaacggcaacggcacggccgacgccgtcgaagggctcgcgtcccccagggcggacgggaccgagcagcccttcgtgataggcgtgtcgggagggacggcgtcggggaagacgacggtgtgcgacatgatcctccagcagctccacgaccaccgcgtcgtgctggtcaaccaggattcattctaccacggtttaactgaggaacagtctgagcacgtgcaagactacaactttgatcaccctgatgcatttgatacagatcatcttctggagtgcatgggaaagctaaaaagtgggcaatctgtgaatattcctatatatgattttaagaatcatcggcgatgctctgaaagttttagaaaggtcaatgcatcagatgtcatcattttggaggggatcttagtttttcatgaccaaaaggtttgtgatttgatggacatgaatatttttgtagatacagatgctgatattaggcttgctcgacgtata

SEQ ID NO: 31302 - protein, 197 aa, Panicum virgatum
  misc_feature: Ceres CLONE 1904563
  misc_feature (61)..(197): Pfam Name: PRK Pfam Description: Phosphoribulokinase / Uridine kinase family
  misc_feature: SWISSPROT Homolog: EC 2.7.1.48 Uridine kinase
MEDVMDSAVGPHFSGLRLDSRRLSSSSLPSPTSANGNGNGTADAVEGLASPRADGTEQPFVIGVSGGTASGKTTVCDMILQQLHDHRVVLVNQDSFYHGLTEEQSEHVQDYNFDHPDAFDTDHLLECMGKLKSGQSVNIPIYDFKNHRRCSESFRKVNASDVIILEGILVFHDQKVCDLMDMNIFVDTDADIRLARR

SEQ ID NO: 31303 - DNA, 677 bp, Panicum virgatum
  misc_feature: Ceres CLONE 1904577
  misc_feature: Encodes the peptide sequence at SEQ ID NO. 31304
acacccgccaccgtctcctggcatccgcgtccggcaggccactaccgtgctcccgcggtcccgccccgccgctgcaatggctgcggcggcctcgccggcagcgtgcgctcgggcatccggcccccgcgcgggggcccgcctcgccgtccgcaccgcagccctcccggcggacgggcgcggcgacggcgccgcctcttacaaggagctcggtctgtactccttgaaaaagaggattgaagacgcagttgtccaggttgaaaccaccgcatccagtgctctggagttggaggaagcacggagaattaagcaggaagaagtactgcggaagcgtaacttgtgggataatccagctaagtcacatgagacgctctctgctctggcagatgccatcagggtggtcgaccatctgaaagatcttcgcttcaaggctgaagaggcaaagttgttaagtcaactatcagagatggatgccataaatggtgagctatttaagcaagcatacaaatcttcagtagatgctagcgagtatctagatcgctaccagatgtacaagcttcttaagggtccatacgacaaggaaggagcttgtattattgttactgcagtatcagatggtgttgcttctgagctatgggcagcgaaggtctttggcatgtatacaagttgggcacggaagc

SEQ ID NO: 31304 - protein, 200 aa, Panicum virgatum
  misc_feature: Ceres CLONE 1904577
  misc_feature (126)..(199): Pfam Name: PCRF Pfam Description: PCRF domain
MAAAASPAACARASGPRAGARLAVRTAALPADGRGDGAASYKELGLYSLKKRIEDAVVQVETTASSALELEEARRIKQEEVLRKRNLWDNPAKSHETLSALADAIRVVDHLKDLRFKAEEAKLLSQLSEMDAINGELFKQAYKSSVDASEYLDRYQMYKLLKGPYDKEGACIIVTAVSDGVASELWAAKVFGMYTSWARK

SEQ ID NO: 31305 - DNA, 645 bp, Panicum virgatum
  misc_feature: Ceres CLONE 1904612
  misc_feature: Encodes the peptide sequence at SEQ ID NO. 31306
attccttcgcttctcgatttcacagcagcctttgcagccgagctgaatcgtctggttcaaatcatctcccctctctctctctctctctctctctctctctctctctcaggtgctaattttatttcaagaaagtctgtggtgacgaatctgaacttcatgatggacggaaggaaaacaacatattcacgcataactgtctctaagaaaactgagatcaagaatgatgagaagtcagtcatagaggaggaagatgctgctggaagtgatttggagatggagcgagtgaggagtgaccctagccagctccaatcaatgacggtgaaagagctcagggagcttacaaggaggatgggtgtttctgggaaaggcaccaagaaatatttagtatcagcactgatggattctctaggggtggaaggaaatggtaaaggggggaagtcatcttctgagctggttagcccctcggaggaacctttaaaaagaaaaagtggtgcttcagttgtggttgaacaaaaactagaaagttctgaggttatatctgaaactcctaacaataaaagaagtagaacaaaacagaagttaatcaagaccactactcttgaggagaattctgtgagtaatggcaagattaataagacttcagtc

SEQ ID NO: 31306 - protein, 214 aa, Panicum virgatum
  misc_feature: Ceres CLONE 1904612
  misc_feature (102)..(136): Pfam Name: SAP Pfam Description: SAP domain
  misc_feature: SWISSPROT Homolog: EC 4.2.99.18 DNA-(apurinic or apyrimidinic site) lyase
IPSLLDFTAAFAAELNRLVQIISPLSLSLSLSLSLSGANFISRKSVVTNLNFMMDGRKTTYSRITVSKKTEIKNDEKSVIEEEDAAGSDLEMERVRSDPSQLQSMTVKELRELTRRMGVSGKGTKKYLVSALMDSLGVEGNGKGGKSSSELVSPSEEPLKRKSGASVVVEQKLESSEVISETPNNKRSRTKQKLIKTTTLEENSVSNGKINKTS

SEQ ID NO: 31307 - DNA, 734 bp, Panicum virgatum
  misc_feature: Ceres CLONE 1904614
  misc_feature: Encodes the peptide sequence at SEQ ID NO. 31308
actctctcccttgcatcaccaacaagaaggctaacgcacaccaacccaagaacaaggaggggaagagaaggaaagggaaaaaaaaaaggaattttgatcgcccagagtgtggtagtagaatagcaatttgatctctcctcgttcgaggtcagtgcgcgaggcaataatggtggccgtggaggctgcggcggcggcggcggtggagggctcgatccgggcggaggccaaggtggcgccggagccggaggccgaggtggaggtgaagggcgatgccccggccgcgggggaaggccgaggaggaggaggagaaggagtacaagagcgacatgaggaagctggaggagctcatgtccaagctcaacccctgcgcgcaggagttcgtgccgtcgtcgcgccgcgccgcggcgccggcggcgaagccggcggggggaggcgtgctctccgccgacgcgccggtgttcgtctccgccgccgagtactacggcgctgccggagggcacctgcaggtggccggcggcgggagccgggactccagcagcgacggatccagcaacggcagcggccaccctctgaatcgccggagaaggagtagcttcaaccaggggaggcggaggatggggggccgaccccgacgggctgatagggaggatagtgtgcagcgaaccgtctacgtctctgacattgatcagcatgtgactgagcagaagcttgctgaagtgttttctaattgtggg

SEQ ID NO: 31308 - protein, 154 aa, Panicum virgatum
  misc_feature: Ceres CLONE 1904614
  misc_feature (25)..(42): Pfam Name: PAM2 Pfam Description: Ataxin-2 C-terminal region
MPRPRGKAEEEEEKEYKSDMRKLEELMSKLNPCAQEFVPSSRRAAAPAAKPAGGGVLSADAPVFVSAAEYYGAAGGHLQVAGGGSRDSSSDGSSNGSGHPLNRRRRSSFNQGRRRMGGRPRRADREDSVQRTVYVSDIDQHVTEQKLAEVFSNC

SEQ ID NO: 31309 - DNA, 679 bp, Panicum virgatum
  misc_feature: Ceres CLONE 1904643
  misc_feature: Encodes the peptide sequence at SEQ ID NO. 31310
aagaaccagacaaagggcgcgaaaaataccatcgccggaggggacgagctctggcgacaagctgctcttcaatcgtgtggtcccttctctcatgaaagaaccacctggttgagatggaagaagagggcaacaaagcaaacaatgagtccaatgcagctatactaccagatttcatacctcaagttggcatggaatttggaagttcagatgaggcttgggcattttggcttcgttatggtgggcacagaggctttgaagttagaaaaaggtacacaaacaaaagggagtctgatggcaagattacatcatgtaaatttgtttgtgcaaatgagggtcatcgagtagcagacaaaagggatcatttaacaaagtgccctcgagctgaaactagaacagactgtcaagttcacatgaatcttaaacttgataggaaaaaggaaattctgaaagtatcttatgtgtttttggaacacaatcacaaactacaccttcctgaaatcttacacttaatggtgtcgcggagaaaaatttcagatttacaagcatttgaaattgaaacagcagatgatgctggaattggaccaaaagctgcgcatgagtttgcttgtcgccaagttggcggaccactcaatcttagctacacccttcgtgatcacaagaattatttacggtccaagcg

SEQ ID NO: 31310 - protein, 188 aa, Panicum virgatum
  misc_feature: Ceres CLONE 1904643
  misc_feature (36)..(126): Pfam Name: FAR1 Pfam Description: FAR1 family
MEEEGNKANNESNAAILPDFIPQVGMEFGSSDEAWAFWLRYGGHRGFEVRKRYTNKRESDGKITSCKFVCANEGHRVADKRDHLTKCPRAETRTDCQVHMNLKLDRKKEILKVSYVFLEHNHKLHLPEILHLMVSRRKISDLQAFEIETADDAGIGPKAAHEFACRQVGGPLNLSYTLRDHKNYLRSK

SEQ ID NO: 31311 - DNA, 2436 bp, Panicum virgatum
  misc_feature: Ceres CLONE 1904649
  misc_feature: Encodes the peptide sequence at SEQ ID NO. 31312
ggagtcgcctcgcctcctccgtctcccagaggtctcgcgctcctcgacccttgggcttgtgttggccctttgcaccttgccccaggcatcgggctgcttttcatggagacagcataaaccctccttctccccactctctctgcagcgcggcaagcccccgcttccttcatccgccatggctcgcaacaaggaagcactggttttgctactggatgttggtccttcaatgcatggggtgctgcaggaggtcaagaacatatgctcgactctggtgcataagaagttagtttataatagaagtgatgaggttggtattgtcctctttggaactaaagaaacatgcaatgagcttgcgaaggagattgggggctataagcatgtgacagttgcgcatgatattaaagttgtagacgaagggatgttacaggctctgcaaaatcttccagcggtatctgtccctggtgattttctggatgctattgttgttggcttggatatggtaattaggaaatttggaaataccaaaggaaagcggcgcctctgtctaatcaccagtgcacagtatccgttaagagatccacctgaggggactaaagaagatcaggtggacactattgcagaccagatgaaaagacatgatatcaagatggagtgcattgtcttcagagaaccgggagttcatcataattctgtaatggaagaaaatgactgtctattgtatcaattcagaaatagatcagtagcaaaggtagtccaggttgacagcccagcatccctgttgggtgctctgaaaacaagaaatgtgcttccagttactgtcttcaggggagacctggaagtgagccctaattttaaaatcaaggtgtgggtctataagaaaacagctgaggaaaagttccccactttgaagaagtattcagacaaggctcctccaagtgataaatttgcctctcatgaagtcaaagtggattatgagtataaaagtgttgttgaaccagacaaagttgttccaccagatcagaggattaagggatatctttatggtcctcaagttgtcccgatatcatctgccgaatgggaggcggtgaagttcaagccagagaaaggtgtgaagcttctaggatttacagatagatccagcatatcacggcaccattttatgaaagatgtatgcttgtttatacctgaaccaggtaacacaaaagcaactcttgcagtttccgccatagcaagagcaatgcatcaaatgaacaaggttgctattgtgcgatgtgtgtggagacaaggtcaagggaatgttgctcttggtgtattgacgccaaacatttcatcagtgaacaatgtccaagattcattttacttcaatgtgctcccatttgctgaggacatcagagagtttcagttccgatcctttagcagtctgccatcatcgtctcagcccactgaagaacaacaagaagctgcagataacttggtgaagatgttagacctagcaccacctggaagagaagtcctcaagcctgagtttacaccaaatcccatgttggagagattttacagttaccttgatctaaaggcgaagcagccagatgcaaatgtaccaccacttgaaagatgtctaaggaggataactgaacctgatcctgatgtcattgaccaacaaacaccattaatccaaaatctaggcaaagcctttgagctgaaggagaatcccaagaaaaagaaagcacgaacacaggacaggctggcatatattgatgcaggtgatcaagctaaatcagaagcagagacctctgcagagaaggatggggttttgggggctttgtatccgccatcagagaacgtcgagcagatcagagatttaaatcctgtccaagattttgaagccatgctggcaaagagatctagctcaacttgagttcagaaggcaatcgaagagatgcagaaatacacagcagctttgttagaaaactcacgtgaggggggtaattaccaaaaagcacttgaatgttttgctgccctgcggaaggcctgcattattgaacaggaaccagaggaattcaaccagttcttaacaaagacttatgagagattgaagggtagtgctgctaacttctttcagcttctgtcctcaaaaaatatttcacttatcagcaaagaggaagcgcctgacagtgatgtgactgaagagatggcaagaagtttctatctgaatcaagaagtggcttctcagtagcagctgaaagaaactggaagcgccattgcgggcttggggatcctcgaactggattgcgcaaaacgatagcttagcctagccctttgcttgtgtctggcatgttttgaggctttctacatggatggaactgcaactaatcctcaactctctgggtttagtcactgtcttgctgcacaatttatttgagtttgtttcctgct

SEQ ID NO: 31312 - protein, 580 aa, Panicum virgatum
  misc_feature: Ceres CLONE 1904649
  misc_feature (220)..(430): Pfam Name: Ku Pfam Description: Ku70/Ku80 beta-barrel domain
  misc_feature (7)..(212): Pfam Name: Ku_N Pfam Description: Ku70/Ku80 N-terminal alpha/beta domain
MARNKEALVLLLDVGPSMHGVLQEVKNICSTLVHKKLVYNRSDEVGIVLFGTKETCNELAKEIGGYKHVTVAHDIKVVDEGMLQALQNLPAVSVPGDFLDAIVVGLDMVIRKFGNTKGKRRLCLITSAQYPLRDPPEGTKEDQVDTIADQMKRHDIKMECIVFREPGVHHNSVMEENDCLLYQFRNRSVAKVVQVDSPASLLGALKTRNVLPVTVFRGDLEVSPNFKIKVWVYKKTAEEKFPTLKKYSDKAPPSDKFASHEVKVDYEYKSVVEPDKVVPPDQRIKGYLYGPQVVPISSAEWEAVKFKPEKGVKLLGFTDRSSISRHHFMKDVCLFIPEPGNTKATLAVSAIARAMHQMNKVAIVRCVWRQGQGNVALGVLTPNISSVNNVQDSFYFNVLPFAEDIREFQFRSFSSLPSSSQPTEEQQEAADNLVKMLDLAPPGREVLKPEFTPNPMLERFYSYLDLKAKQPDANVPPLERCLRRITEPDPDVIDQQTPLIQNLGKAFELKENPKKKKARTQDRLAYIDAGDQAKSEAETSAEKDGVLGALYPPSENVEQIRDLNPVQDFEAMLAKRSSST

SEQ ID NO: 31313 - DNA, 1704 bp, Panicum virgatum
  misc_feature: Ceres CLONE 1904659
  misc_feature: Encodes the peptide sequence at SEQ ID NO. 31314
ttttccattagctctataaattaaagaagaagagcgcttgcgctgtctgccgcctccgctccttccccattgctgaaggctcagtggcatccatcgtcgacgtcgaggcgctcctgccggcggccatggagatacagcagctcgacgactactctccggccaagcttgccagccttgctcttgcgcccagcaaagggcgtacggactccaaggagggcagctggagcgcgccggagaagccggtcgaggactggcgtgccatcaactcgaggaggaacgccaagtggtggtacgccgccttccacaatgtcaccgccatggtcggcgccggcgtgcttagccttcccttcgccatgtccgagctcggctggggggttggcatcacggtgctggtcctgtcatggatcctcacggtgtacaccctgtggcagatggtggagatgcacgagatcgtgccggggaagcggttcgaccggtaccacgagctggggcagcacgcgttcggcgagaagctgggcctctggatcgtcgtgccgcagcagctggtggtggaggtcggcctgaacattgtctacatggtcaccggcggccagtccctgcagaagttccacgacttggtctgccacggcaggtgcaataacatcaagctcccctatttcatcatgatcttcgcctccgtccagttcgtgctctcccagctccccaacttccactccatctccagcatctccctcatcgcagccgtcatgtcagtcagttactcgacgattgcatgggctgcatcaacacatcatcacaagacaaattcggcagaggtggactacagccttcgtgcaacgacgacgcccggcaaggtgttcgacttcttggggggactgggcgacgtggcgttcacatacgccgggcacaacgtggtgctggagatccaggccaccatcccgtcgacgccggagaagccgtccaagaagcccatgtggaagggcgtcgtcgtcgcctacatcatcatcgccgcgtgctacttccctgttgcgcacgccggctactgggccttcggcaaccaagtggatgagaacatcctcatcgccctaaacaaacccaagtggctcatcgccgtcgccaacatgatggtcgtcgtccatgtcgttggcagctaccaggtctatgcgatgccggtattcgacatgatagagacgatgctagtgaggaagttttggttcactccagacctgaggctccgtctgatttcccggactgtctatgttgcgttcacaatgttcatagccatgaccttccccttcttcagtgaattgctcagtttcttcggtggatttgcctacgcgccaacaacttatttccttccctgcatcatgtggctcataatctgcaagccgaaaagattcagcctctcatggttcgccaactggacgtgcatttttattggagtgccactgatgatattggcaccgattggaggtctccggcagatcattttgagggtcaagacatacaaattctaccaagactaccatggtttaagccattagccatagttaacagagctcaccatgtctcaggccatcattagcattttaaaaaaaaatcgtaccgtaaaattcctcttttttttgtttctggcatgataagggaaattgacatcatcatgtactgtaatttgcccgtggaaatgcgagttttatgccatgc

SEQ ID NO: 31314 - protein, 472 aa, Panicum virgatum
  misc_feature: Ceres CLONE 1904659
  misc_feature (50)..(452): Pfam Name: Aa_trans Pfam Description: Transmembrane amino acid transporter protein
  misc_feature: Useful for making plants with altered oil content
MEIQQLDDYSPAKLASLALAPSKGRTDSKEGSWSAPEKPVEDWRAINSRRNAKWWYAAFHNVTAMVGAGVLSLPFAMSELGWGVGITVLVLSWILTVYTLWQMVEMHEIVPGKRFDRYHELGQHAFGEKLGLWIVVPQQLVVEVGLNIVYMVTGGQSLQKFHDLVCHGRCNNIKLPYFIMIFASVQFVLSQLPNFHSISSISLIAAVMSVSYSTIAWAASTHHHKTNSAEVDYSLRATTTPGKVFDFLGGLGDVAFTYAGHNVVLEIQATIPSTPEKPSKKPMWKGVVVAYIIIAACYFPVAHAGYWAFGNQVDENILIALNKPKWLIAVANMMVVVHVVGSYQVYAMPVFDMIETMLVRKFWFTPDLRLRLISRTVYVAFTMFIAMTFPFFSELLSFFGGFAYAPTTYFLPCIMWLIICKPKRFSLSWFANWTCIFIGVPLMILAPIGGLRQIILRVKTYKFYQDYHGLSH

SEQ ID NO: 31315 - DNA, 491 bp, Panicum virgatum
  misc_feature: Ceres CLONE 1904665
  misc_feature: Encodes the peptide sequence at SEQ ID NO. 31316
ttgttgctgcctcatctgcttgctgtcatcgctggcagtcccacacccctctgctgaggatctatcttctcttctggatgagcatggctgtgaaattgacaatgaacagatggagctgctgctgtcccaactgagcggcaaagaccttaccgatctcattgctgctggattggataaatttgcttctctccctcgccgtgggggtggaggggctgtggcggcacctgcccctgctgctggtggagctgctcctgcatctgacgcccataaagaaaatgaagcggaggacaaagaagagagtgatgatgatatgcgctatctcctcatcaactacgcagagcggtcaccagagtagtgtcttttcggcgggaaaacctcagtcgccatgtttggattttaaccttgttttatgttgcagctcacccgaaaagactgctacggtctggatgtgtattgatccaaccctaagtggctacgatggggtgttggtg

SEQ ID NO: 31316 - protein, 117 aa, Panicum virgatum
  misc_feature: Ceres CLONE 1904665
  misc_feature (15)..(108): Pfam Name: Ribosomal_60s Pfam Description: 60s Acidic ribosomal protein
CCCLICLLSSLAVPHPSAEDLSSLLDEHGCEIDNEQMELLLSQLSGKDLTDLIAAGLDKFASLPRRGGGGAVAAPAPAAGGAAPASDAHKENEAEDKEESDDDMRYLLINYAERSPE

SEQ ID NO: 31317 - DNA, 872 bp, Panicum virgatum
  misc_feature: Ceres CLONE 1904677
  misc_feature: Encodes the peptide sequence at SEQ ID NO. 31318
agacgacatggctctcttgcctgctgcgggcgccgccctcctcaccgtcttcgtcctgcttccgctctcctacctcctcctccttgccgtcaacaagcctgcctctccgcagcgtcacgggggtgccagtggccatgggcgacggcagaggctgccgccgtcgccgcctggcctcccgctgctcggccacctccacctcctcggctcgctgccgcaccgcgccctccagtccctggcgcgggcgcacgggcccgtcatgctgctcctgctcggctgcgtgcccaccgtcgtcgtgtcctccgcggcgggcgccgaggaggtgatgcgggcgcgcgacctggccttcgccagccggcccaggagcgccatggccgagcgcctcatgtacggccgcgacgtcgccttcgcgccctacggcgactactggcgccaggcgcggcgcgtctgcgtcgtgcacctcctcagcgcgcgccgcacccggtccttccgccgcgtcagggagcaggaggccgccgcgctggtcgagcgcgtccgagccaaggccggagccgccgtcggcctgaccgagctcctcaccgagtacgccaacaccgtcgtgtgtcgcgccgctttcggcgacgagagcgctcgcggcctcttcgacggcggtgaccgcgcccgcgagcggatctgggaggtgcttaccggcgacttccagaagctgatggggacggagccgctgggggagctcctgccgtggttgggatgggtggacgccgtgcgcgggctggaggggaagatcacgcggacgttccakgcgctcgacggcttgctcgagaaggtgatcgacgaccaccggcgccggcctccgaacacgaacgacggcgatcacc

SEQ ID NO: 31318 - protein, 288 aa, Panicum virgatum
  misc_feature: Ceres CLONE 1904677
  misc_feature: SWISSPROT Homolog: EC 1.14.13.68 4-hydroxyphenylacetaldehyde oxime monooxygenase
  misc_feature (263)..(263): Xaa is any aa, unknown, or other
MALLPAAGAALLTVFVLLPLSYLLLLAVNKPASPQRHGGASGHGRRQRLPPSPPGLPLLGHLHLLGSLPHRALQSLARAHGPVMLLLLGCVPTVVVSSAAGAEEVMRARDLAFASRPRSAMAERLMYGRDVAFAPYGDYWRQARRVCVVHLLSARRTRSFRRVREQEAAALVERVRAKAGAAVGLTELLTEYANTVVCRAAFGDESARGLFDGGDRARERIWEVLTGDFQKLMGTEPLGELLPWLGWVDAVRGLEGKITRTFXALDGLLEKVIDDHRRRPPNTNDGDH

SEQ ID NO: 31319 - DNA, 688 bp, Panicum virgatum
  misc_feature: Ceres CLONE 1904677-R
  misc_feature: Encodes the peptide sequence at SEQ ID NO. 31320
tggggccatggcggagctggtgacccacccgcgcgccatgcgcaagctccaggacgagatccgcgcggcggtcggccccgcgtccaccggcggcggcgtcgtcgacgagggccgtgtcgcccagctgcactacctcaaggccgtggtgaaggagacgctccggctgcacgcgccggtcccgctgctggtgccccgggagccggcggcggacgccgagatcctgggctaccacgtgccggcgcgcacgcgcgtggtggtgaacgcctgggccatcggccgggaccccgcggcgtgggaggacgctgaggagttcgtgccggagaggttctcgggcagcgccgccgtggacttgaaggggcagcacatggagctggtgccgttcggcgccggcaggagggggtgccccggggtcgggttcgccgaggcaagtattgaggtggcgctggcgagcttgctgtatcacttcgattgggaggctgccgaggggaaaggaagccgggcaggggcatcgtcgctggacatgagcgagatgaatgggctgtccgtgcacatcaagtccggcctgccgctcgtagcgaagccgtggatcccttgagacatacaggcgttttatttattcaggttgtgtttgcagtattgtaagtactaccattatatatagctagacagtgtcacattagtagtttgg

SEQ ID NO: 31320 - protein, 195 aa, Panicum virgatum
  misc_feature: Ceres CLONE 1904677-R
  misc_feature: SWISSPROT Homolog: EC 1.14.13.68 4-hydroxyphenylacetaldehyde oxime monooxygenase
MAELVTHPRAMRKLQDEIRAAVGPASTGGGVVDEGRVAQLHYLKAVVKETLRLHAPVPLLVPREPAADAEILGYHVPARTRVVVNAWAIGRDPAAWEDAEEFVPERFSGSAAVDLKGQHMELVPFGAGRRGCPGVGFAEASIEVALASLLYHFDWEAAEGKGSRAGASSLDMSEMNGLSVHIKSGLPLVAKPWIP

SEQ ID NO: 31321 - DNA, 929 bp, Panicum virgatum
  misc_feature: Ceres CLONE 1904679
  misc_feature: Encodes the peptide sequence at SEQ ID NO. 31322
aaaaaaccctactgctcccgctccgcctccctccccttcaccccttcgcctcgcgcccttgcgctcccttccccacacctcgccgccgccgtctccggcgagatctccgtgggtgagcaagcgagcgaggcgaggcatcagccatgtcgctccgcgtgctgaacccgaacgccgaggtgctcaacaagtcggcggcgttgcacatgaacatcaacgccgccgagggcctccaggacgtgctcaagaccaacctcggccccaagggcaccatcaagatgcttgttggtggagctggtgacctaaagctaaccaaggatgggaacaccctcttgaaggaaatgcaaattcagaacccaactgccatcatgattgcgaggacggccgtggcacaggatgataccagtggtgatggcacaacctctactgtgcttttcattggggagctaatgaagcagtctgagcggtgcattgatgaaggtactcacccaagatttttggttgatggttttgatgttgccaagagagcaactcttgagtttctcgagaaattcaagacaccagttgttattggtgatgagcctgatagggataccttgaagatgatagcaagaacaactcttaggacaaagttgtatgaaggattgactgatcagctgacggatattgtcgtgaatgcggttctatgcatccgcaaaccagaggaacccatcgatctttttatggtggaaataatgcacatgcgccacaaatttgatgttgacaccctcctgattgagggtctggttctggaccatggttcccggcaccctgacatgaagcgcagggcagagaactgttacatcttgacctgcaatgtctcattagaatatgagaaaagtgaatcaatgcgggatttttctactcaaacgcagaacaaagagagaagatgg

SEQ ID NO: 31322 - protein, 261 aa, Panicum virgatum
  misc_feature: Ceres CLONE 1904679
  misc_feature (29)..(261): Pfam Name: Cpn60_TCP1 Pfam Description: TCP-1/cpn60 chaperonin family
MSLRVLNPNAEVLNKSAALHMNINAAEGLQDVLKTNLGPKGTIKMLVGGAGDLKLTKDGNTLLKEMQIQNPTAIMIARTAVAQDDTSGDGTTSTVLFIGELMKQSERCIDEGTHPRFLVDGFDVAKRATLEFLEKFKTPVVIGDEPDRDTLKMIARTTLRTKLYEGLTDQLTDIVVNAVLCIRKPEEPIDLFMVEIMHMRHKFDVDTLLIEGLVLDHGSRHPDMKRRAENCYILTCNVSLEYEKSESMRDFSTQTQNKERR

SEQ ID NO: 31323 - DNA, 774 bp, Panicum virgatum
  misc_feature: Ceres CLONE 1904679-R
ggcttgtctatgagcatgtcctgggagaagaaaagtacacatttgtcaaaaacgtaaaaacccctcgctcttgtacgatactgattaaagggcctaatgaccataccatcgcacaaatcaaggatgccgtccgcgatggtctaagatctgttaagaatacagttgaggatgaaacagttgtgctgggtgctggtgcttttgaggttgctgcgaagaagcatcttattgacaatgtgaagaaaaccgtcaaaggacgagcacaacttggggtggaagcatttgcggaagctcttcctgttatacccaagaccttagcagaaaactctggtctagatacccaagatgtcattgtttccctccagaacgagcatgaccgtggattggtcgtgggattgaaccatcactctggggaaccgattgatccccagatggagggcatcttcgataattactctgtgaagcgtcaaatcatcaactctggacctatcattgcatcgcaattgctgctggtggatgaagtgatcagagctggccgcaacatgaggaaaccaacttagatactctgtaaacggctagctgagacatttgttcatgatgagttgtcatggattttgtttggctattttacccttcttttttgttttgtgcttagtagtgaccagggtgatacatttggggcttcagttagttgcccatttcacgtagcaggttgcacttgtaatatctgtgactcgtgttttgtgccgttcctctaatcttgggattagtgcgtgc

SEQ ID NO: 31324 - DNA, 2779 bp, Panicum virgatum
  misc_feature: Ceres CLONE 1904699
  misc_feature: Encodes the peptide sequence at SEQ ID NO. 31325
ccttccttctctcctcctccccctgagggctgaggatatcctccctccaacccatccacctcacgaggaatccgcacttgcttttgctcggcaatttattgctcagggttcttgctgggtggtgggagcagtagttcacaagagcgaagctgttcttgtgtgcgtggttctatgcctgcttgcttggcgtggggaggaggaggcggagcagtgggagttgaggggtgcaggttccggcattgctgaggcggcgcgagaagatcaggctatgtcggaggccgaccgggtacgcctccgcgcggcggcgctggcgctgcaagacgatggggtaagggacaagccggacgccaaggctaacgtcttcgcggatcttggctcgccggtgtcgccgctgcggccgcgggcgagcgtggcgacgtcgtcgtcctcgtcgtccgggtcggccaagtccccggtgccgtcgaatgctgggatggcgggcgggaggaggcactccggcgagctagtggcggagtgcaacccgccgcgaatgacggggcaccggcggtgcggatctgggccgttgatattctccggcggcagcagcggggggagcggcggcggcggcggggaccgtgggagcacggcgagctcgccgatgctgaatgcgctccccaccgggaacatctgcccgtccgggcgcatcccggcggcggcggccgcgccgcctccgccgcgctcccgcccggacgtgctcggatccggcaccggccactacggccatgggagcatcatgcgcggcgcgggcatagcccccgccaggagcagcattgactccccgtcgtccctcggacactcgtcgaggtcgccgtggagctccccagcaagcggcgggagccttcaggaggtgacccgtttggggaacgagtggtacaagaagggcaagtacgcggaggcgctccgccactacgagcgcgccgtgtcgctttgccccgagagcgccgcgtgccgcggcaaccgagccgcagcgctcatagcacttggccggctcgccgacgcgctccacgaatgcgaggaggccgttcggatcgaccctgccagcggccgcgcccacagccgccttgccggcgtctgcctccggttggggatgattgataaggcccggaggaacttcacccaggcgggtcatcttcagcagtctgatcctcttgagtggcagaagctgcaggaggtggagatgcatctgggcagaagcactgatgcacggaaaattggggattggaagagtgcattgagggaagctgatgctgccattgctgctggcgctgactcctctcagttacttcttgccttgagatcagaagcactcctccgacttcacaagctggaggaggctgagtcgactcttgcaagcttgctgaaattggatggtgcattgacctcatcattaacagcagtgaaactctcaggcatgctcgctgagtcatatgtacatattgtccgagcccaagttgacatgactttggggagatttgaggctgctgttgctgcagctgagaaggctagagatcttgatcctgggaatgcagaagtggggatgattctgaataatgtgaggctagttgctaaagcccgagcccaaggaaacgatctatttaaagctgccaagtttgctgatgcatctatagcatatggtgaagggctcaagtatgatccctcaaattcagtgctccactgcaatcgagctgcttgctggtcaaagctagaaaagtgggagaaagctgtcaacgattgcaacgaggcactaaaaatacaaccaaattatacaaaggctctcttaaggagggctgcgtcctacgctaagcttgagcattgggctgattgcgtgcgggattatgaggtgcttcggaaagagcttcccagtgataaggaggttgcagaagcactattccatgcccaaattgccttgaaggcgacttgtggtgaggatgtgtcaaatatgaaatttggaggagaggtagagatagtaaccaatgtagagcaactccgtgctgccataggttctccgggggtatctgttgtctacttcatgtcggcaatgaaccagcaatgcacacaaatcacacctttggtgaacactctctgcactgaatgcccctcggtgaattttctgaaggtaaacgtggacagcagccctctggtggcaaaggcagagaatgttcggatattcccaacattcaagatatataaagatggggtgaaagtgaaggagatgatctgcccgactttacatgttctgcgttacaccgtgcgtcactattctgtgtccagttcttgagaagctttaggtactggtaccccaatttcccattttccttgatgcatagagctccccttttctccgtcaaacttgcagcattaccaaccttggcattctcaccacctgcgtaactattcccattgagcatgagcataatgagctaagattgtcgagtggaagagcccccccccacccctgcttttgtttttgccttttttatcgttcatccgttcatatgccaaccccattcaattcaatactttctttttttcatgtttcgggctcctttcacctcatgtattttgatacccattttgatttacctctatcatagactcatagtccatagtccagccagcaccctgcttctcaagaatgggaaatgtttataatgttgtctagatttagcatacatcttttagggaggggggagggaggctgcgggtttgcgattttcgttacatgtaaataccttatagg

SEQ ID NO: 31325 - protein, 682 aa, Panicum virgatum
  misc_feature: Ceres CLONE 1904699
  misc_feature (204)..(237): Pfam Name: TPR_2 Pfam Description: Tetratricopeptide repeat
  misc_feature (238)..(271): Pfam Name: TPR_2 Pfam Description: Tetratricopeptide repeat
  misc_feature (399)..(432): Pfam Name: TPR_2 Pfam Description: Tetratricopeptide repeat
  misc_feature (479)..(512): Pfam Name: TPR_2 Pfam Description: Tetratricopeptide repeat
  misc_feature (592)..(676): Pfam Name: Thioredoxin Pfam Description: Thioredoxin
  misc_feature: SWISSPROT Homolog: EC 3.1.3.16 Phosphoprotein phosphatase
MSEADRVRLRAAALALQDDGVRDKPDAKANVFADLGSPVSPLRPRASVATSSSSSSGSAKSPVPSNAGMAGGRRHSGELVAECNPPRMTGHRRCGSGPLIFSGGSSGGSGGGGGDRGSTASSPMLNALPTGNICPSGRIPAAAAAPPPPRSRPDVLGSGTGHYGHGSIMRGAGIAPARSSIDSPSSLGHSSRSPWSSPASGGSLQEVTRLGNEWYKKGKYAEALRHYERAVSLCPESAACRGNRAAALIALGRLADALHECEEAVRIDPASGRAHSRLAGVCLRLGMIDKARRNFTQAGHLQQSDPLEWQKLQEVEMHLGRSTDARKIGDWKSALREADAAIAAGADSSQLLLALRSEALLRLHKLEEAESTLASLLKLDGALTSSLTAVKLSGMLAESYVHIVRAQVDMTLGRFEAAVAAAEKARDLDPGNAEVGMILNNVRLVAKARAQGNDLFKAAKFADASIAYGEGLKYDPSNSVLHCNRAACWSKLEKWEKAVNDCNEALKIQPNYTKALLRRAASYAKLEHWADCVRDYEVLRKELPSDKEVAEALFHAQIALKATCGEDVSNMKFGGEVEIVTNVEQLRAAIGSPGVSVVYFMSAMNQQCTQITPLVNTLCTECPSVNFLKVNVDSSPLVAKAENVRIFPTFKIYKDGVKVKEMICPTLHVLRYTVRHYSVSSS

SEQ ID NO: 31326 - DNA, 673 bp, Panicum virgatum
  misc_feature: Ceres CLONE 1904747
  misc_feature: Encodes the peptide sequence at SEQ ID NO. 31327
tggtagcaaaaaaagaagaggaactgaccgacgacgatggacatgccgtgtgcttgcagctgaggatggggagcgcggtggagacgctgtgcgggcaggcgtacggcgcgcacaagtacgacatgctgggcgtgtacctgcagcgctccacggtgctgctcatggccacgggggtgcagctcgccgccctctacgccttctcccgcccgatcctcgtcctcctcggcgagtccccggacatcgccgccgccgccgccgtcttcgtctacggcctcatcccgcagatcttcgcctacgccgccaacttccccatccagaagttcatgcaggcgcagagcatcatggcgcccagcgcctacatctccgccgccacgctcgccgcccacctcgtcctcagctacctcgtcgtctaccgcctcagactgggcctcctcggggcctcgctcacgctcagcctcagctggtgggtcatcgtcgccgcccagttcgtctacatcgccaccagccggcgatgcaggctcacctggacggggttctcctggcaggccttctccggcctccccagcttcttcaagctctccatcgcctccgccgtcatgctctgcctcgagacctggtacttccagatactcgtgctcatcgccggcctcctcaaggaccctgagcttgcact

SEQ ID NO: 31327 - protein, 223 aa, Panicum virgatum
  misc_feature: Ceres CLONE 1904747
  misc_feature (1)..(134): Pfam Name: MatE Pfam Description: MatE
VAKKEEELTDDDGHAVCLQLRMGSAVETLCGQAYGAHKYDMLGVYLQRSTVLLMATGVQLAALYAFSRPILVLLGESPDIAAAAAVFVYGLIPQIFAYAANFPIQKFMQAQSIMAPSAYISAATLAAHLVLSYLVVYRLRLGLLGASLTLSLSWWVIVAAQFVYIATSRRCRLTWTGFSWQAFSGLPSFFKLSIASAVMLCLETWYFQILVLIAGLLKDPELA

SEQ ID NO: 31328 - DNA, 741 bp, Panicum virgatum
  misc_feature: Ceres CLONE 1904749
  misc_feature: Encodes the peptide sequence at SEQ ID NO. 31329
atcgcccacgttgagacacgagttcctccctcccacctgggctcccccgcctccacgccgctccgctacgcgcgagccactgacccgcctcgcctagtccgcctccgctgcctctcttctcctccggagcccgcctctgcacattagtggaagccgagctgacaacaatctatcaagagttgcttcaacatggatactggctgtttatcatctatgaacattactggagtgagccaagcaagatcttttgcggggcaatttcctacccggagatgctttgcaagtagtcaccttgcaagctttgctgtgaaatctcttgtcttgaggaataaaggaagaagctcacaccgtagacattctgctctgcagattgtctgcaaggattttccaagacctccactagaaagcacaataaactatttggaagctggacagctctcttcattttttaggaacagcgaacgccccagtaaaccattacaggtcgtgattgctggtgcaggattagctggtctgtcaacagcaaaatatctggcagatgcaggccataaacccatattgcttgaggcaagagatgttttgggcggaaagatagctgcttggaaggatgaagatggagattggtacgagactgggcttcatatcttttttggagcttatcccaacatacagaatttatttggcgagcttggtattgaggaccgtttggcatgggaagagcactccatgatatttgccatg

SEQ ID NO: 31329 - protein, 183 aa, Panicum virgatum
  misc_feature: Ceres CLONE 1904749
  misc_feature: SWISSPROT Homolog: EC 1.14.99.30 Carotene 7,8-desaturase
MDTGCLSSMNITGVSQARSFAGQFPTRRCFASSHLASFAVKSLVLRNKGRSSHRRHSALQIVCKDFPRPPLESTINYLEAGQLSSFFRNSERPSKPLQVVIAGAGLAGLSTAKYLADAGHKPILLEARDVLGGKIAAWKDEDGDWYETGLHIFFGAYPNIQNLFGELGIEDRLAWEEHSMIFA

SEQ ID NO: 31330 - DNA, 506 bp, Panicum virgatum
  misc_feature: Ceres CLONE 1904775
  misc_feature: Encodes the peptide sequence at SEQ ID NO. 31331
aaaacggagacgggggcggggggatctcgtccgctccagctcgagcacccccgtccgctgcgctgcctacctcgtctccctctacctctgctggcctgctttatacaaactcctcctacactaaaaaaaacaactactactccgcgccctcgtggttttcttttttttttctttcccaacatctccggccttccaaaccaattcaatcgacccggcggcaggcggatccactccccgcgcgccggcaggaagaacatcaggtagccatggcgttcgatgccttcaccgacaagaacgccgtcttccgccgcctcaaggccaagccagagaacaagatgtgcttcgactgcaacgccaagaaccccacctgggcctccgtcacctacggcatcttcctctgcctcgactgctccgccgtccaccgcagcctcggagtacacatcaccttcgtcaggtcaacaaaccttgactcatggactccagatcagctcaagatgatggctttc

SEQ ID NO: 31331 - protein, 79 aa, Panicum virgatum
  misc_feature: Ceres CLONE 1904775
  misc_feature (10)..(79): Pfam Name: ArfGap Pfam Description: Putative GTPase activating protein for Arf
  misc_feature: SWISSPROT Homolog: EC 3.2.1.8 Endo-1,4-beta-xylanase
  misc_feature: Useful for making plants with altered terpenoid content
  misc_feature: Useful for making plants with modulated nitrogen use efficiency
MAFDAFTDKNAVFRRLKAKPENKMCFDCNAKNPTWASVTYGIFLCLDCSAVHRSLGVHITFVRSTNLDSWTPDQLKMMA

SEQ ID NO: 31332 - DNA, 1718 bp, Panicum virgatum
  misc_feature: Ceres CLONE 1904795
  misc_feature: Encodes the peptide sequence at SEQ ID NO. 31333
attcgttccgccattgctgccgcagctccaccgccgatcgagcaagccaaggcatgggcttgggcgtggcggctctgctccgcgaggcctcgccggggagcctgctggccggcgcggcggccgtgctgctcctgtggtgggcggcagccgtgctggagtgggcctggctgtccccccggcgcatggagcgggccctcagggcgcagggcctgaggggcacccggtaccgcttcctctggggcgacctcaaggaggagcgccggctgacaggggcagccctggccagacccgtgcccatgaaccggccccacgacatcctcccgcgtgtctcccctctcctccaccgtgccgttcaggagcatggtaagctctcgttcacatggttcgggacgatcccaagaattacaatcatcgaccctgagctggcccgggaggttatgtcaaacaaagacggccgcttcgtgaaaacaaagctagccactcgcatgatgaagtttctgattggtggggtcgcgatacttgacggcgagaaatgggtcgagcataggaggattatgaacccagccttccatgcagagaagctgaaggggatgtttccggaattctcagcagcgtgcagtgatctaatctgcagatgggagaacttgctcgctgattctgctggaaccattgagctagatgtttggtctgagtttcaaaatttctcaggagatgttatttcaagagctgttttcggtgttagctaccaagatggcagaaggatattccaactccaagctgaacaacttgttcgtgttactcaagctttcaggacaagtcacatcccaggattctctctcttaccgacggaaagcaaccgaaggatgaaggctattaacagggagaccaatacgatcctaaggggaataatagagaagagacatgaggctatgaagaacggcgaacccgccaaggatgacttgctcggcatgctgatggaatcaaacatgaattacagcgactcggatggaaagtccagtagggggatcaccgttgaggaagtcatcgaggaatgcaagttgttctacttcgcaggatcagagactaccgccatcgtgctgacttacacaatggtagccttaagcatgcatccggagtggctagatcgagccagggatgaagttctgcaagtcttcgggcagaacaagccagatttcagcggtgcaggtcgtctaaaagttttgaccatggtgctgtacgaggtgctacgactgtaccctccggcgttgttcattaaccggcggacacacaagcagacggagctcggaggcgtcacgtacccgccggatgtcatgttcgttgttcccatcatgttcatccaccgcgaccctccgctctgggggcacgacgccgacgagttcaacccggggaggttcgccgagggcgtgtccaaggcgtgcagcgacccgggcgccttcatccccttcagctgggggccgcgcatctgcatcggccagaacttcgcgctgctggaggccaagctggccatcagcatggtcctgcagcgcttcgcgttcgagctctcgccagaatacgtgcacgcgcccttcagcatcctgacactccatccgcagcacagcgttctggttagggtacgccggctctgatgagcacatgtattctgattaaatcattttggtattggtaaatgaagtgcattttgcacagaagtttcatgc

SEQ ID NO: 31333 - protein, 530 aa, Panicum virgatum
  misc_feature: Ceres CLONE 1904795
  misc_feature (85)..(525): Pfam Name: p450 Pfam Description: Cytochrome P450
  misc_feature: SWISSPROT Homolog: EC 1.3.3.9 Secologanin synthase
  misc_feature: Useful for biocontainment applications
  misc_feature: Useful for making plants with modulated biomass
  misc_feature: Useful for making plants with modulated flowering time
MGLGVAALLREASPGSLLAGAAAVLLLWWAAAVLEWAWLSPRRMERALRAQGLRGTRYRFLWGDLKEERRLTGAALARPVPMNRPHDILPRVSPLLHRAVQEHGKLSFTWFGTIPRITIIDPELAREVMSNKDGRFVKTKLATRMMKFLIGGVAILDGEKWVEHRRIMNPAFHAEKLKGMFPEFSAACSDLICRWENLLADSAGTIELDVWSEFQNFSGDVISRAVFGVSYQDGRRIFQLQAEQLVRVTQAFRTSHIPGFSLLPTESNRRMKAINRETNTILRGIIEKRHEAMKNGEPAKDDLLGMLMESNMNYSDSDGKSSRGITVEEVIEECKLFYFAGSETTAIVLTYTMVALSMHPEWLDRARDEVLQVFGQNKPDFSGAGRLKVLTMVLYEVLRLYPPALFINRRTHKQTELGGVTYPPDVMFVVPIMFIHRDPPLWGHDADEFNPGRFAEGVSKACSDPGAFIPFSWGPRICIGQNFALLEAKLAISMVLQRFAFELSPEYVHAPFSILTLHPQHSVLVRVRRL

SEQ ID NO: 31334 - DNA, 1298 bp, Panicum virgatum
  misc_feature: Ceres CLONE 1904818
  misc_feature: Encodes the peptide sequence at SEQ ID NO. 31335
gatacagtccatccagcagaaaaaaaaaagcaatttctcaattttctctctctcccctgcttctcttctctcctctcccgcatccgccgtctcatccttcccaaatcaaatcaaaccaacctttcgctcagatcctcccccgaatcctcgaatccggacacccccctccgtcggctccaaaaccctaccccctcgcgccaccggcggggggcatgcggcggtgaccgcgcgtgcggcctcttccgtctgcgctcgggtgggcattgcgatcgctagggggccgcggagccatggcgtccgcggggtcgggcgccggcggcgcgggggcgggcgggctcaagacctacttcaagacccccgaggggcggcacaagctgcagtacgagaagacgcactcccccgccgtcgtgcactacaaccacagcggcaagaccgtctcccagatgacggtggcatatttgaaggagaagccagccggccaggggtccacgccttcaactccgagcgccggcagtgggatgcgttctgctgctgcaaggctgcttggtacagggaatgggagccgggcacttagctttgggagcaatggtaccagcagggctgtctcaggaagcagccgcgttggtggtggcattggtgcgtcgacgagcgcaagtggatcacaagggatggtgaattatgatggcaagggaacatacatcatattcaacactgctgatacgctcttcatcagtgacctcaactcacatgacaaagatccaataaagtccattcacttcagcagctcgaacccactttgccatgcatttgaccctgaagccaaggatgggcacgatctgcttgttggggtgttctcaggagatgtctattcaatgtcattgaggcagcagttgcaagaccctggaaaaaagcctgttgcatatcaacattttattaataaagacaaagacaaagacaaagacccaagtcaaggtggcgctgccagcaaccgatgcacttgtgttgcgtgggttccagagcgtgaaggaatttttgttgttggccatgctgatgggaatttgtatgtttatgacaaatctaaggatgggaatactgattgggcgtttccaactataaaggatcaaagtcagctgctgatttcacatgcaaagtcgagtaagggcaatccaattgcaagatggcatatctgtcagggtgcaatcaatgccatttccttttcaccagatggtgcttacttggcaactgttgggagagatggttacttgagaatatttgactttgcgaaagaacagctaata

SEQ ID NO: 31335 - protein, 335 aa, Panicum virgatum
  misc_feature: Ceres CLONE 1904818
  misc_feature (291)..(329): Pfam Name: WD40 Pfam Description: WD domain, G-beta repeat
MASAGSGAGGAGAGGLKTYFKTPEGRHKLQYEKTHSPAVVHYNHSGKTVSQMTVAYLKEKPAGQGSTPSTPSAGSGMRSAAARLLGTGNGSRALSFGSNGTSRAVSGSSRVGGGIGASTSASGSQGMVNYDGKGTYIIFNTADTLFISDLNSHDKDPIKSIHFSSSNPLCHAFDPEAKDGHDLLVGVFSGDVYSMSLRQQLQDPGKKPVAYQHFINKDKDKDKDPSQGGAASNRCTCVAWVPEREGIFVVGHADGNLYVYDKSKDGNTDWAFPTIKDQSQLLISHAKSSKGNPIARWHICQGAINAISFSPDGAYLATVGRDGYLRIFDFAKEQL

SEQ ID NO: 31336 - DNA, 683 bp, Panicum virgatum
  misc_feature: Ceres CLONE 1904818-R
cccaagcgaatcaatcctcaccatatgccgtgaagggctatcaaaatctgggccagacccagccacagtgaaaacaaccagcagcctgattcttctgatcaggccataggcaatgccactgcaaaggataagatgctaacatcgttgaacaaagcaggcgcttcgggctccagcttcaaacaatcatctgttgttttcacatgacaggctttgccagcatttttatgatgctcgcctggctgtggctattcatcttttgttactaacgtgaggattcatggagcgggagtagtagattgtgagaggttgccagcaaagagtcgcgccttctttttttcctgcttcgtcgactacatctttgggttacagaagtcccattattgccatctgtgttggcaaaagaaaataacggagctttccctgtacatatacagatactgcgctaagatgaatagtacaagcttacttatttgatataatttgatcgttcttttgtaacatttctatagactagagtgtgtacccattttttatgtagtcttgttacacatggaggctgcagatcattgggtgtccaatggattccctaggcataatggtaattttctcccctagactcaatcatcaattttctctgttggagacattgtaaactactgctgtaagctcttcgtttttacagc

SEQ ID NO: 31337 - DNA, 1213 bp, Panicum virgatum
  misc_feature: Ceres CLONE 1904830
  misc_feature: Encodes the peptide sequence at SEQ ID NO. 31338
ccgaaacggcgcggcctcatacttctaatgaacgcccttgaagtttactagggttttcgccgtcttatccctccgtccacgctgccccgcagccgccgcccaaaccctagcgaccccgacccgccgtccgtcaccatggctgacgaccactactcctccaagcgcaagtacgacgacccctcgccgccgccgcggcgcacggggttctcctccggcccgccgcccgcctctccgcccgccggcgccccgtcgtacaacagcgtgccgccgccccccgacgagatccagctcgcgaagcagcgcgcgcaggagatcgcggcgcggatcttcaacgccgccgaggccaagcgcccccgcgtcgacaacggcgacgatgacgtcggcggctacgggggaggaggctcccatggcggcggcggcggcggaggtgggcgcatcggcggcggggggctcggctactcgtcctctgccggtggtgggcatggttcttctatcgcgccattatcttcacagagcggtgtgtctcagtactcttcatatggtggatatcagggtacaagcaaaaagattgaaataccaaatggaagggttggtgttattattggaaaagctggggaaactatcaggtatctccaacttcagtcaggagcaaagattcaagtaacaagagacaatgaagctgaaccaggtgcaccaacaagaccagttgagctttcaggcactcctgagcagataagcaaagctgagcagctgatcaaagaagttctggcagaggctgatgctgggtcttctggtactggatctggtggccggaaatataatgcaccacagccaggtgccgacacgttccagatgaaaattgctaataacaaggtgggtctggttattggtaagggtggtgagactataaagttcatgcaagccaaatctggagctcgtattcaggtcattcctttgcatctgcctgctggtgatacttcaactgaaagaactgtgcatattgatggcacacaggaacaagttgaaattgcaaagcagctggtgattgaggttaccagtgagaaccgtgccagaaatccaatgtcaggtggctattctcagcagggttatcgccctcctcgtcctcagtcgaactggggccaacctggtgcaccaccccagcagccaggttatggttatatgcagcctggagcctatcctggggcaccaccac

SEQ ID NO: 31338 - protein, 359 aa, Panicum virgatum
  misc_feature: Ceres CLONE 1904830
  misc_feature (237)..(303): Pfam Name: KH_1 Pfam Description: KH domain
  misc_feature (142)..(207): Pfam Name: KH_1 Pfam Description: KH domain
MADDHYSSKRKYDDPSPPPRRTGFSSGPPPASPPAGAPSYNSVPPPPDEIQLAKQRAQEIAARIFNAAEAKRPRVDNGDDDVGGYGGGGSHGGGGGGGGRIGGGGLGYSSSAGGGHGSSIAPLSSQSGVSQYSSYGGYQGTSKKIEIPNGRVGVIIGKAGETIRYLQLQSGAKIQVTRDNEAEPGAPTRPVELSGTPEQISKAEQLIKEVLAEADAGSSGTGSGGRKYNAPQPGADTFQMKIANNKVGLVIGKGGETIKFMQAKSGARIQVIPLHLPAGDTSTERTVHIDGTQEQVEIAKQLVIEVTSENRARNPMSGGYSQQGYRPPRPQSNWGQPGAPPQQPGYGYMQPGAYPGAPP

SEQ ID NO: 31339 - DNA, 621 bp, Panicum virgatum
  misc_feature: Ceres CLONE 1904830-R
atcttcaccgtatgggcaggctccacctcctggatctgtacaaggtggttatggacagtatggttacagccagcctggttatggtgcgcctccgccttaccctggtgcaccccctgcaagccacccgggctatgcgcagcagcagtcttatggtgatgcatatggcagtggaagttatggtcagcctccagcatactctactgaagcaacaactgctgcatcccaggatcaatctgctgtacctggctccactggtgctaccacaacatctgctcctgctcctgctcctgctcctgctaacagtggcggtgcacaaacatctgcagaaagttaagcttcaatggctcgttggggaacaaaagatttttcaagcatccgccgtggtttcctctgttgctttatgttttagggaagagggtccatatctacgagttatattgttttccttgttgctttagctttgacttttatcatcttaattattcgtcagtactgtgttatctatgttgtttagatgcctgtacgttctggtaatatctgtacttgtggttgctctggttgggccctactgtacggggtcttacattgaacatctaccaatacaatatgcattctgaaccc

SEQ ID NO: 31340 - DNA, 741 bp, Panicum virgatum
  misc_feature: Ceres CLONE 1904882
  misc_feature: Encodes the peptide sequence at SEQ ID NO. 31341
agcaagctaagaaagcagcatgcagtagccagtaataagagctggcgatcgaggccggactagatagctagctaagctagtactagatactagataggatggcggccaaggacgtggcgccggcggtgctgctgatgagcaacgggcacagcatgatgccggcggcggcggcgggcaacgggcaccgcagcaggtcgtcgataatgccgccggcggtgacgctgagcagcgggcaccggatgccggcggtggggctgggcgtgtggcggatggacaaggcggacgtccggggcctcatccacgccgccatccgccagggctaccgccactttgactgcgccgccaaataccaaaatgaagctgaagttggtgatgcgcttgcagaggcattcgaatgtgggcttgtcaagagagaggaccttttcatcacaaccaagctgtggaactcagatcatggccatgtgattgaagcctgtaaggatagcttgaagaagttgaagttagattatctcgatctctatcttattcacttcccagtggcttctaggcacactgaaattggcacagttgctagtgttattggtgaagatggtgtgctagacattgataccactgtctcactggaggcaacatggcatgcaatggaagatcttgttaatatgggactggttcgcagcattggaatcagcaactatggagtcttcctcaccagagactgcttggcctatgccaagataaaag

SEQ ID NO: 31341 - protein, 214 aa, Panicum virgatum
  misc_feature: Ceres CLONE 1904882
  misc_feature (42)..(214): Pfam Name: Aldo_ket_red Pfam Description: Aldo/keto reductase family
  misc_feature: SWISSPROT Homolog: EC 1.1.1.200 Aldose-6-phosphate reductase (NADPH)
MAAKDVAPAVLLMSNGHSMMPAAAAGNGHRSRSSIMPPAVTLSSGHRMPAVGLGVWRMDKADVRGLIHAAIRQGYRHFDCAAKYQNEAEVGDALAEAFECGLVKREDLFITTKLWNSDHGHVIEACKDSLKKLKLDYLDLYLIHFPVASRHTEIGTVASVIGEDGVLDIDTTVSLEATWHAMEDLVNMGLVRSIGISNYGVFLTRDCLAYAKIK

SEQ ID NO: 31342 - DNA, 1747 bp, Panicum virgatum
  misc_feature: Ceres CLONE 1904886
  misc_feature: Encodes the peptide sequence at SEQ ID NO. 31343
ggatcacggaacagagcaggaagcaaagcagccctgctgagccgccgagcacgccaaccctagtcgttcgtacttacttcccttccctcgctgcggcagtggcagactggcagctgatggtgtccatgagcacaacgcctcacccgctggattcgttggccacgggcggcggcaaggaggaggcgacccggatgccgctcccggagccggaggccgtgccgccgccagcgccagggaatgaggacgacgaagggcccaggagggtgcgcaagccatacaccatcaccaagtcgcgcgagagctggaccgaccccgagcacgacaagttcctcgaggcgctgcagctgttcgatcgcgattggaaaaagatcgaagcgtatgttggctcaaagacagtaatacagttatcttaacagattaggagtcacgcgcagaagtactttttgaaggttcaaaagaatggaacaggtgaacatttgcccccacctaggccaaaacgcaaggcttcccatccatatccacataaagcctcaaaaaaagcctctcaagttgtcttgccacaacaagcttctcatacaatggaacaaggctgtggtgcctatgtggaaacagctagtattgctacggactcaagtggaaatggtgcttttccttcttgggaaaatgatcctgttcaacatttcagtccgaagcatgcacaaggttcaggtgcaacaaacaattactctagtagcataggtagccagtctggaacttggcctacttctgaagccacagaacaagaaatcatgcttccagcactgcatgccatgccagactttgctcgcgtatacaacttcctggcaagcatatttgatccagagacaaatgggcatttgcaagagttgaaggaaatggatcctattgacgctcaaacggtactgttgttgatgaaaaatctgtcaatcaacctaactagcccaaactttgaggaacacaggaggttactctcttcacatggctcgaacatggatcaagatatgggctcttctccaagtcttcatcttccattcatgtaattctagcttcttcttttttctcaatttcagctctgcttcacaatatctaattatttcactaagcctatggatcaccacattgtaggataacgagcaagtgagagaagctgcactgaagcaagcacccaaggcgctggagtcagtctgcagcatggcggtgctgggggtgcttggcacatgtgtacatagctcttagtagccatccacaatgggagggaccaaaggacggttttgcaccgtagatgcatcgtagccgtgagtgggagcgagaaaatgggatggggatggtccccctcattgtggatggccacgccctgagcaccacgtagtttatgtgtctttggttctctgccccctccaattttccctcattatagcttatatatgcgatgctgccatcaagccttagcctagtggcgaattatggtgtgtgttagctttacacctcttgctttttccccctcacagggatgaatggatatggtgtagtttttgctgtgtgtgtatatatagttatgcgtacggctatatgtgtacagggtaacaaactgctgtaataacttgtatgcatagttgaggatgtgtgattccacagcaggccatgtcaaagactcgttgaagaaggggggcagatgtaacataaacaaaatccagttgcccttgctgttacaaggtttgctttgcgagtc

SEQ ID NO: 31343 - protein, 98 aa, Panicum virgatum
  misc_feature: Ceres CLONE 1904886
  misc_feature: The sequence is a functional homolog of SEQ ID NO 392 in the 10/666,642 US patent application
  misc_feature: Useful for biocontainment applications
  misc_feature: The sequence is a functional homolog of SEQ ID NO 1049 in the 11/479,226 US patent application
  misc_feature: The sequence is a functional homolog of SEQ ID NO 454 in the 10/412,699 US patent application
  misc_feature: The sequence is a functional homolog of SEQ ID NO 1752 in the 10/412,699 US patent application
  misc_feature: The sequence is a functional homolog of SEQ ID NO 1974 in the 10/374,780 US patent application
  misc_feature: The sequence is a functional homolog of SEQ ID NO 337 in the 11/479,226 US patent application
  misc_feature: The sequence is a functional homolog of SEQ ID NO 146 in the 10/412,699 US patent application
  misc_feature: The sequence is a functional homolog of SEQ ID NO 12 in the 10/225,066 US patent application
  misc_feature: The sequence is a functional homolog of SEQ ID NO 1889 in the 11/479,226 US patent application
  misc_feature: The sequence is a functional homolog of SEQ ID NO 2676 in the 10/374,780 US patent application
MVSMSTTPHPLDSLATGGGKEEATRMPLPEPEAVPPPAPGNEDDEGPRRVRKPYTITKSRESWTDPEHDKFLEALQLFDRDWKKIEAYVGSKTVIQLS

SEQ ID NO: 31344 - DNA, 1463 bp, Panicum virgatum
  misc_feature: Ceres CLONE 1904896
  misc_feature: Encodes the peptide sequence at SEQ ID NO. 31345
gggggtgtacgacacgtacgctcggctcggctcctccggcttcgcttcggcagccgggagctaggaacagtagtcttctcgttacgctgctcgtcagtttgccggaaaagcggggccctcactagctagtggtctgccgtctgcccgtccggtcaggtggttcgggccgatctccgtgggtcctcgtcgccgatcaacctgctcgatctgctgacggattagccgtcgtcgtcgtccgggtttttgtttagctcgcgggatcttgcgcaagatcttattccccgtgtaatctaaggcgaacgtcgatcgcgagccgcttaattaacgccagtttggtgggtgctgcaggttcggtggatccgggcgctctactccaacttcgccgagttcacggcggaccaggagcgcctcatctccctcggcgccggcggccgccggttcgactacgtggagggcttcgtcgtcgccgccgagggcctcatcaacaactggcgctcctccttcttctcgccgcagaacccggtgaagctcagctccctcaagcaccactccggcgtgctctactgcctcgaggtcaccaagaactacgacgaagacgacgccgagtccgtcgaccaggacgtggacgcgctgctgggcgagctcaacttcctgccgggcacggtgttcacgacggacctgccgtacgtggacttcctggaccgcgtgcacgacgcggagctgaacctgcgcgccaagggcatgtgggaggtcccgcacccgtggctcaacctcttcgtgccggcgtcccgcatcgccgacttcgaccgcggcgtcttccgtggcatcctcggcggccgcaccgccggcgccggcgggcccatcctcatctaccccatgaacaagcacaagtgggacccgcggagctcggtggtgacccctgacgaggaggtgttctacctggtggcgttcctgcggtcggcggtgccgggcgcgccggagagcctggaggcgctgtcccggcagaaccagcggatcctcgacttctgcgcggaggccggcatcggcgccaagcagtacctgcccaaccacaaggcgcggcacgagtgggcggagcacttcagcggcgcgcggtgggagcgcttcgcgcggctcaaggccgagttcgacccccgggccatcctggccgcagggcagggcatcttcccgccgccggcgctcgtctccgactcgtaggctcgtggcggtggtggtggtcgtcgagctgctactgattgatttgttaggcgcgtgtaggtagttacagtatacgaggaagattatttagttggttgattatagttagcgctccctggttgatcatcgatgtacaaaagtggggtggttcgtcacgtggtggtgtggcatagcagttgtgattggttctctgtatagggcaggtgagagtaaatgtcaatgtggcaaagtgaaatttttttggcggc

SEQ ID NO: 31345 - protein, 157 aa, Panicum virgatum
  misc_feature: Ceres CLONE 1904896
  misc_feature (1)..(148): Pfam Name: Cytokin-bind Pfam Description: Cytokinin dehydrogenase 1, FAD and cytokinin binding
  misc_feature: SWISSPROT Homolog: EC 1.5.99.12 Cytokinin dehydrogenase
MWEVPHPWLNLFVPASRIADFDRGVFRGILGGRTAGAGGPILIYPMNKHKWDPRSSVVTPDEEVFYLVAFLRSAVPGAPESLEALSRQNQRILDFCAEAGIGAKQYLPNHKARHEWAEHFSGARWERFARLKAEFDPRAILAAGQGIFPPPALVSDS

SEQ ID NO: 31346 - DNA, 460 bp, Panicum virgatum
  misc_feature: Ceres CLONE 1904902
  misc_feature: Encodes the peptide sequence at SEQ ID NO. 31347
accgcagtttctgtttcccgttaggcttcctgtcttcttcttctccggctccggctccggcgaccgtcggcggcggcggcgatgggggtcaagaacctctgggacatcctcgactcctgcaagaagaagctcccgctccagcacctccagaacaagaaggtgtgcgtggatctttcctgctggctcgtgcagctctgcagcgcccaccgctccccggccttcctcaaggataaggtctacctcaagaacctcttccaccgcatccgagccctcctcgccctcaattgcagcctcgtcttcgtcacagatggggctattccttctgtcaaattggcaacttacaggcgccgcctcggagtaaatgctgctgaggctgctcgagaggaggacaactcacaacccctgacttctttgcgccggaccaagagctctgaattctcgcgcatgataaaagaggccc

SEQ ID NO: 31347 - protein, 126 aa, Panicum virgatum
  misc_feature: Ceres CLONE 1904902
  misc_feature (1)..(97): Pfam Name: XPG_N Pfam Description: XPG N-terminal domain
MGVKNLWDILDSCKKKLPLQHLQNKKVCVDLSCWLVQLCSAHRSPAFLKDKVYLKNLFHRIRALLALNCSLVFVTDGAIPSVKLATYRRRLGVNAAEAAREEDNSQPLTSLRRTKSSEFSRMIKEA

SEQ ID NO: 31348 - DNA, 1311 bp, Panicum virgatum
  misc_feature: Ceres CLONE 1904906
  misc_feature: Encodes the peptide sequence at SEQ ID NO. 31349
cccccgtttacctctcccccacttctcgggccctgtttcctggcggcgacggctgggcgtgaggcgccgcccttcgccaggtcttagccgggccggtcgccggcgacgagcacccgccaggtacgccctcccctcccctcccctcctcttcgcttcgcttctcttccctcctcgccgtgcgagaccgagcaccccgaaccctattcggcgacgaccccttgggcagctcttcctcgggcgcttcgccgccgacgagcatccgacagtttgcagtggggtcttgtgaccccacaagacccaaatcagatagtcgccgtcaagaatggaatctgggagtgggttctacgcaggcgaaggtctctccatcgatcctacgtggcttatcgacccaaagcttctctttgttgggccacgcattggcgagggcggacatgcaaaggtctatgagggaaagtacaagaaccaaaatgttgccatcaagattgtgcacaaaggggacacccctgaggagatgaccaagagggaggggaggttcttgagagaggtgtccatgctgtcaagggtgcagcacaagaatctcgtcaagtttatcggggcctgtctagaacctgtcatggtggtggtgactgagcttctggtggggggctcgttgcgtaagtacttggtcaatctcaggcctaggagcctggagcctcgtgtagcagtggggtttgcattggacattgcccgagctatggaatgcttgcatgctcatgggatcattcatcgtgatcttaagcctgagaatttgttgctgactgcagaccagagaacagtcaaacttgttgatcttggtttggctagagaagagacgttaacagagatgatgactgctgagaccggaacataccgttggatggcccctgagttgtacagcacagttacgttgaggcatggagaaaagaagcattacaaccacaaagtagatgtttacagctttgcaattgtgctgtgggaactccttcacaataagctgccgttcgagggcatgtctaatctgcaagctgcgtacgctgctgctttcaagaatatcagaccaagtgcagataacttgcctgaggagttgtcagaaatactaacatcctgctggaaggaagacccgaacgacagacctaacttcacgcagatagtgcaaatgctcctacattatctatccaccctttcaccacaagaaaacttggcccctcgccgcacattcagttcggagaacacaatcctgcctccggaatctcctgggacaagctcactgatggcttcccggggtgacctcgg

SEQ ID NO: 31349 - protein, 329 aa, Panicum virgatum
  misc_feature: Ceres CLONE 1904906
  misc_feature (26)..(286): Pfam Name: Pkinase Pfam Description: Protein kinase domain
  misc_feature: SWISSPROT Homolog: EC 2.7.11.1 Non-specific serine/threonine protein kinase
MESGSGFYAGEGLSIDPTWLIDPKLLFVGPRIGEGGHAKVYEGKYKNQNVAIKIVHKGDTPEEMTKREGRFLREVSMLSRVQHKNLVKFIGACLEPVMVVVTELLVGGSLRKYLVNLRPRSLEPRVAVGFALDIARAMECLHAHGIIHRDLKPENLLLTADQRTVKLVDLGLAREETLTEMMTAETGTYRWMAPELYSTVTLRHGEKKHYNHKVDVYSFAIVLWELLHNKLPFEGMSNLQAAYAAAFKNIRPSADNLPEELSEILTSCWKEDPNDRPNFTQIVQMLLHYLSTLSPQENLAPRRTFSSENTILPPESPGTSSLMASRGDL

SEQ ID NO: 31350 - DNA, 269 bp, Panicum virgatum
  misc_feature: Ceres CLONE 1904906-R
cccccccccccccccccccccaaagaacggcgaaagtcatagtcaaactgttgtttctgctaattaggtctcctgcatcgctgacgttttgacatatcagcagggtaaatcgagtaacctttggactccagatagtaatgatggaaatagcttatcccctgtattttccgtgaaccatggtaccatggagttactgccgcgcgcctagattggccgtctcgcgccgcgcgccatcgtatagaaataaaccaataaatcacattgcattc

SEQ ID NO: 31351 - DNA, 507 bp, Panicum virgatum
  misc_feature: Ceres CLONE 1904922
  misc_feature: Encodes the peptide sequence at SEQ ID NO. 31352
gctcctgtttcctgaagaactcttctttccctgcttctgttctgcccctaccttccattcagggaatctgaggaggggccgcgatgcggccgggcgccggagacgagctggcgcgggggtcttacgcgctgtaccacttcggcaccagcggctccgccgtcgccgctgccaccgccgccacccacccgctcgatgttattaaagttaggcttcaaatgcagcatgctaggcaaagaggaaacttagttggaatgggaacaatatttacacaactggtcactagggaagggcctcggtcactctacctgggacttgcaccagcattgacgagatctgtcgtctatggtggccttcgattaggactgtatgaaccctgcaaacatgtatgcagttatgcctttggttcaacaaactttgcttttaagtttgcatctggaatcattgctggggcccttgcaactgctttaacaaatcccatggaggttttaaaggtgaggctgccgatga

SEQ ID NO: 31352 - protein, 141 aa, Panicum virgatum
  misc_feature: Ceres CLONE 1904922
  misc_feature (14)..(106): Pfam Name: Mito_carr Pfam Description: Mitochondrial carrier protein
MRPGAGDELARGSYALYHFGTSGSAVAAATAATHPLDVIKVRLQMQHARQRGNLVGMGTIFTQLVTREGPRSLYLGLAPALTRSVVYGGLRLGLYEPCKHVCSYAFGSTNFAFKFASGIIAGALATALTNPMEVLKVRLPM

SEQ ID NO: 31353 - DNA, 1936 bp, Panicum virgatum
  misc_feature: Ceres CLONE 1904924
  misc_feature: Encodes the peptide sequence at SEQ ID NO. 31354
gtgctgtatcagctccaggcctccagctcagcgtcggccctcggcagttgctttgctctctcgtctacccacccaccctctcatcatcgcttgctctctccgccgctcgcgccccgcgggtcaaatccccccaaattggaattgagaatccccgatggccaagaggagtacgcgccagctccgctgcccactgctgacccccggcgccaggcggcgggacgcgtctgcctccgaggatcgaggttgatggcgagggaaccggacgcggcggcgcggcggcgctggacgctggtgctggtgaacttggcgtccgtgctggagaaggcggacgaggtgctgctccccgccgtgtaccgggaggtgggcgccgcgctgggcgcctccccgacggcgctcggatccctcacgctctgccgcgcgctcgtccaggccgcctgctacccgctcgccgcgtacgcctccgcgcgccacgaccgcgcccgtgtcgtcgccgccggggccttcctctgggccgccgccaccttcctcgtcgccgtctccggcaccttcctccagatggccatctcgcgggggctcaacggcatcggcctggcgctggtcctcccggcgatcagctccctcgtcgccgactacaccgacgaccacacgcgcggcgccgccttcggctggctccagatgacctgcaacctgggctccatcctgggcggagccttcggcgtgctgctcgcgcccgtcaccttcctcggcgtcgccgggtggcggctcgccttccacgccgtcgcgggcgtcagcgtcgcgctgggcgcgctcatgtggctcttcgccgccgacccgcgcgccaagtcaaagaccgccgcttcggcgggggaagaagccagggagctgctccgggacgccaggcgcgtcctcggcgtgcccacgttccagatcatcgtggcgcaggggatcgcggggtccatcccctggtccgcgctcaacttctccgccatgtggctggagctcgtggggttcacgcactgggagaccagcgtcatcacggggctctacctcttcgccacggccctcggcgcgctcttcggcggcatcgtcggggaccccgtcgccaggcgctttcccaacgccggcaggatcgcgctagcgcagatcagctccgcgtcggcgctcccgctcggcgccatcctgctgctcgcgctgcccaacgacccgtccaccggcgtcgcgcacgccgtcgtcttcttcgtcatgggcttcgccatctcctggaacgccccctccaccaacaaccccattttcgcggagattgtgccggagaaggccaggacgacggtctacgcactggacaagtgcttcgaagccgtgttcgcgtcgtttgcgcctcccatcgttggagtccttgcagagcgcgtgttcggctacaagcctgtctcttccgacacgtgcgtggacacggacagagagaatgcggccgcactggccaaggcggtttacacggagatcgccgtgcccatggccatctgctgcctgacctacaccttcctctactgcacgtacccgcgagacagggagcgtgctcggaaggagcttctggtggcgtcagctgaccagctcggtgaggaaggcagtgacagtgcgccgagtgcggttcgcccactgggagatgaagaatcttctgccagatccttaaatcagaggctaatttccagaggagagtagcaggcgaaaggcaggtcgggaagcgcaagacagccaattttacggctttgtatcgtttcctagatgatgtaaatcctggtgctgctcgcctgctcttcagtttcagattcatcctgtggatagactcgatctgactcgtcggaactatttaccaggccagctaccaatggagtgaaatgtactcagtggatgcaattctaaatctattgaaatgttgttgtgc

SEQ ID NO: 31354 - protein, 488 aa, Panicum virgatum
  misc_feature: Ceres CLONE 1904924
  misc_feature (15)..(377): Pfam Name: MFS_1 Pfam Description: Major Facilitator Superfamily
MAREPDAAARRRWTLVLVNLASVLEKADEVLLPAVYREVGAALGASPTALGSLTLCRALVQAACYPLAAYASARHDRARVVAAGAFLWAAATFLVAVSGTFLQMAISRGLNGIGLALVLPAISSLVADYTDDHTRGAAFGWLQMTCNLGSILGGAFGVLLAPVTFLGVAGWRLAFHAVAGVSVALGALMWLFAADPRAKSKTAASAGEEARELLRDARRVLGVPTFQIIVAQGIAGSIPWSALNFSAMWLELVGFTHWETSVITGLYLFATALGALFGGIVGDPVARRFPNAGRIALAQISSASALPLGAILLLALPNDPSTGVAHAVVFFVMGFAISWNAPSTNNPIFAEIVPEKARTTVYALDKCFEAVFASFAPPIVGVLAERVFGYKPVSSDTCVDTDRENAAALAKAVYTEIAVPMAICCLTYTFLYCTYPRDRERARKELLVASADQLGEEGSDSAPSAVRPLGDEESSARSLNQRLISRGE

SEQ ID NO: 31355 - DNA, 2014 bp, Panicum virgatum
  misc_feature: Ceres CLONE 1904957
  misc_feature: Encodes the peptide sequence at SEQ ID NO. 31356
gcgaaatcctcaggggttcttaatcacgggttcctgcggtcatcctttacctcctaggctcctacccatccctccggtgctcgttccgccggataggcggcggcggcagcgacccaatcggcggagcaccgttccctcccgtgcacggccatcttcggcctcgggagggacgccgtccggcgggagctctggatggagttccagcagctggtgaggggcatctgggcggtcccggtcaacctgcccttctccacctacagccgctgcctcgccgcgagccgccgcgggcggcacgccgtcgctggggtcatcaaggagaggagggccaagctggagcgcggagagagctcgccgtccagcgacgtggtcaccctcatgctcgcggagggcctgcctgacgaggagatcatcgacaacgtcatgtttctcatggttgccgcgcacgacaccaccgccgccctcctcaccttcctcgtccggcagctcgaggccgacaaggatgcctacgacaaagttgtccaggagcaagaagagatcgcgcggagcaaggcgcccagggaggctctgtcgtgggaggacatcatccacggtggagacgttggtggccgttcactacatcgtgacgcgctgcaggtggaagctcgccgccggctgcgaccgcagcttctccaggttcccgctgccgtacccgtcccagggtctcctcatcgacatcgagcctattcagaaatgaatgctcggttgcatccgattcagttggatgaatccgtgtgcagaagcaagaagcgccttgagaaagctcagtaacaggtgtagttcagttcagttggcttgatgtgcaggtttaatggctgtgaatttgcagcataattttgtgttgcttgccagttattatgccaatacactgaaatatataatcagtagcagagcagcagcagcagctgaatccagcggagcatggcggccaagggcgccgcgccggcggtggcgctgagcagcggccaccggatgcccgcggtggggctgggcgtctggcggatggagaagcccgccatccgcagcctcgtccactccgcgctccgcatcggctaccgccacctcgactgcgccgctgactaccagaatgaagctgaagttggtgaggcacttgcagaggcattccaaactggacttgtcaagagggaggatctgttcatcacaaccaagctatggaattcagatcacggtcatgtgattgaagcctgtaaggatagcttgaagaagctgcagctagattatcttgatctctatcttgttcacttcccagtagctactagacatactggagttggtacaacttcgagtgctcttggtgatgatggtgtgcttgacattgataccactatctcattagaaacaacatggcatgcgatggaagaacttgtttctatgggactggtccgcagcattgggatcagcaactatgacatcttcctcaccagagactgcttggcctatgctaagataaagcctgcagtgaaccaaattgagacgcacccctacttccagcgtgattcgcttgtcaagttctgccagaagcatgggatctgcgttacagcgcacacccccttgggtggttccactgccaataccgagtggttcgggtcagtctcatgcctcgacgatcctgtcattaagagcttggctgagaagtacggcaagacgcttgcgcagcttgtcctccgctggggcctccaaaggaacacggtggtgatccccaagacctccaaggctgagaggctgaaggagaactttgaggtctttgatttcgagatctcgggcgaggacatggagaagatgaaggccatcgacaggaagtaccgaaccaaccagcctgccaagttctggggcatcgatctgtatgcttagttcacttgcattgcgcctgtgctttcatgtgtgtggacgtttctgaataattgttccatcccctgtccctccatacggcatcaataatgaggatctctgcttttcc

SEQ ID NO: 31356 - protein, 316 aa, Panicum virgatum
  misc_feature: Ceres CLONE 1904957
  misc_feature (12)..(299): Pfam Name: Aldo_ket_red Pfam Description: Aldo/keto reductase family
  misc_feature: SWISSPROT Homolog: EC 1.1.1.200 Aldose-6-phosphate reductase (NADPH)
MAAKGAAPAVALSSGHRMPAVGLGVWRMEKPAIRSLVHSALRIGYRHLDCAADYQNEAEVGEALAEAFQTGLVKREDLFITTKLWNSDHGHVIEACKDSLKKLQLDYLDLYLVHFPVATRHTGVGTTSSALGDDGVLDIDTTISLETTWHAMEELVSMGLVRSIGISNYDIFLTRDCLAYAKIKPAVNQIETHPYFQRDSLVKFCQKHGICVTAHTPLGGSTANTEWFGSVSCLDDPVIKSLAEKYGKTLAQLVLRWGLQRNTVVIPKTSKAERLKENFEVFDFEISGEDMEKMKAIDRKYRTNQPAKFWGIDLYA

SEQ ID NO: 31357 - DNA, 1188 bp, Panicum virgatum
  misc_feature: Ceres CLONE 1904964
  misc_feature: Encodes the peptide sequence at SEQ ID NO. 31358
aaaaaaatcgctgaaagggcaaggaaaacgcattgcaccagcgaacagcgatcgttcccctccaattttcccggccgccgccgccgcctccaagtcctaaccaccccgtcgagcatccgccgccacctacgccgccgcggccatgagccccaccgccacggtggcactgaatcgccgcacgcgcagtaagccgccgtcggtcgcgtcctcccgcaggtccaatgatcccaccttcgcctccgactacggcaacggcaagttctcccccaagccccgctgccccagccacgcagcaggggagaggactgtcaagaagctccggctgtccagggcgctgacgatcccggacgggacgacggtctcggaggcgtgcaagatgatggcggtgagacgggtcgacgccgtgctgctcaccgacgccaacgacctcctctccggcatcctaacggacaaggacatagccacgagggtgattgccgagggtctgcgttgtgagcaaacaatcgtctccaagatcatgacaaggaaccctgtgtatgtcacgtctgacacacttgctattgacgcgctgcagaaaatggtccaagggaaatttagacaccttccagttgtggaaaatggtgaggttattgcgatgctgaacattgcgaaatgcctctatgatgcgatatcaagactggaaagggcagcagagcaaggaaataatgcactagcagctgctgtagaaggggttgagcgtcaattagggggcaatgtctcatcttctcaaaatctcatagagactctgagagaacagatgtataaactttctttgtcaaccattatcacggagaatacaaaagtagcaactgcttcaccttcagatcctgtttatgtagcaacccagaaaatgcgtgacttacaatttaattcagttgttattactgccggaaattcactgctaggaatctttacttcaaaggatgtgcttatgcgagttgtggcgcaaaatctttctcctgagttaactctggtggaaaaggtaatgactgcacaccccgactgcgctacattagacatgacaatcattgatgcactacatatcatgcatgatggaaaattcttgcatattcctgttctcgatggagaggggcgagtcgctgcttgcttggatgttctgcaacttactcatgcagccatttcaatgtt

SEQ ID NO: 31358 - protein, 348 aa, Panicum virgatum
  misc_feature: Ceres CLONE 1904964
  misc_feature (58)..(176): Pfam Name: CBS Pfam Description: CBS domain pair
  misc_feature (228)..(346): Pfam Name: CBS Pfam Description: CBS domain pair
MSPTATVALNRRTRSKPPSVASSRRSNDPTFASDYGNGKFSPKPRCPSHAAGERTVKKLRLSRALTIPDGTTVSEACKMMAVRRVDAVLLTDANDLLSGILTDKDIATRVIAEGLRCEQTIVSKIMTRNPVYVTSDTLAIDALQKMVQGKFRHLPVVENGEVIAMLNIAKCLYDAISRLERAAEQGNNALAAAVEGVERQLGGNVSSSQNLIETLREQMYKLSLSTIITENTKVATASPSDPVYVATQKMRDLQFNSVVITAGNSLLGIFTSKDVLMRVVAQNLSPELTLVEKVMTAHPDCATLDMTIIDALHIMHDGKFLHIPVLDGEGRVAACLDVLQLTHAAISM

SEQ ID NO: 31359 - DNA, 684 bp, Panicum virgatum
  misc_feature: Ceres CLONE 1904964-R
catattgacgactctgattccaaaaacaaagtggcgacacaacaattgtcagagctagaaccatcccacgggattgagttgatggatgttcattatggtctgatggcttgtggaattgctctaacaggagtagccatgatggttttcttcagacactccacagtctaaatttttcaaggggaatgtataattttgtacttatatataaagttaatatgtatagatgtgtagcacgccttggctcattaagaaggctaagaatgaagaaaaacaagggtcgtcaatggttcactgaatgcatttgtggcccaaaaggaatcggctgactgtcaagttctccagttggctcagtgtggtggtgggaaggaagcctgtacaacttgaatccagacccagtgacgtctcgagtaatctctgtaactatgtatatgcatgtgagtaagaaaatcaagacttatcgcatggttgaggtacctttttttcccatgggaatttgcatttttcacgggtttggtgaaacctgtgatttttacagtttttttatatgaccaccatttttttaaaatttcggagcatacacatgacaggcagtgaaaattaatgtggccgctcaggatctctgaacttgatgtacagttgcttttattgtgaaagggtttccatgttggccataactggtaatgc

SEQ ID NO: 31360 - DNA, 1848 bp, Panicum virgatum
  misc_feature: Ceres CLONE 1904977
  misc_feature: Encodes the peptide sequence at SEQ ID NO. 31361
tttttcccttttttctcctcgtcttccttcccccgcccgctgctctcctcccctgcgtgcgagagagcaccagcagctcccgcttccaattccgccgcccccgcccccgtgcctctcctccattggctcgccgtcgccgcggcctcgaccgcctcgcctcacccgtcgccaccggcctcgtcacctcctgtgctactccgtgccatcggggcctgacagggacggcctacccgcacagcggaggacggcgtcaggacaagcgctcccgagcaacaagtatcccggcagcgcttcgcggccgctcggcgctcgagctccacatacaccagcagcagcagcagcagcacgccagcacgagcgaaagcgggagggagcgctagctgcttgattcggtcaactcctgcgcgctcgcggcaggatcgaggccaatggggcgggagaggaggccgtggccggcggcggccgccgccgttcttctgctcgtcgcctcctgcgtcgccgcggcgccgctgcagcagcaccagcgcgccaggatcacaggggacgccggcggcgtgctggacgacaacccggtggggaagctgaaggtgttcgtgtacgagatgccgcgcaagtacaaccagatgctgctgtccaaggacagccggtgcctgcaccacatgttcgcggccgagatcttcatgcaccagttcctgctgtccagcgcggtgcggacgctggacccggaggaggccgactggttctacacccccgtgtacaccacctgcgacctcacgccgcagggcttccccctcccgttccgggcgccgcggatcatgcgcagcgccatcaagtacgtcgccaccacgtggccctactggaacaggaccgagggcgccgaccacttcttcctaacaccccacgacttcggcgcctgcttccactaccaggaggagcgggcgatggagaggggcatcctgccgctgctccggcgcgcgacgctggtgcagacgttcgggcagcggaaccacgtgtgcctgcaggaggggtccatcaccatcccgccctacgccaacccgcacaagatgcaggcgcacctcatcaaccccggcacgccgcgctccatcttcgtctacttccgcggcctcttctacgacatgggcaacgaccccgagggtggctactacgccaggggcgcgcgcgcgtcagtgtgggagaacttcaaggacaacccgctgttcgacatttcgacggagcacccgtcaacgtactacgaggacatgcagcgcgccatcttctgcctgtgcccgctggggtgggcgccgtggagcccgcggctggtggaggcggtggtgttcggttgcatcccggtgatcatcgccgacgacatcgtactgcccttcgcggacgccatcccctgggagcagatcagcgtgttcgtggcggagcgcgacgtgccgcgcctcgactccattctcacctccatcccgctccaggacatcctcaggaagcagcgcctgctcgccggcgcgtccgtcaagcaggcgctgctcttccaccagcccgcaaggcccggggacgccttcgaccagatactcaacgggctggcgcgccagctgccgcacggcaagggcgtgttcctccagcccggggagaaggtgctcgactgggacgctgggctcgagagcgacctcaagccttggtaggcgcagcagcgcctgccttcacatttgttcatgttcttttgttttgttcttttatttaaatctttcgatcgatggatggatggatcacgcattagtttttgcacgaccagtttacacgcagcagcaatatagagcgagatttctcgggatatttgtgagaggc

SEQ ID NO: 31361 - protein, 418 aa, Panicum virgatum
  misc_feature: Ceres CLONE 1904977
  misc_feature (54)..(358): Pfam Name: Exostosin Pfam Description: Exostosin family
  misc_feature: Useful for making plants with altered carbohydrate content
  misc_feature: Useful for making plants with altered cell wall content and/or composition
MGRERRPWPAAAAAVLLLVASCVAAAPLQQHQRARITGDAGGVLDDNPVGKLKVFVYEMPRKYNQMLLSKDSRCLHHMFAAEIFMHQFLLSSAVRTLDPEEADWFYTPVYTTCDLTPQGFPLPFRAPRIMRSAIKYVATTWPYWNRTEGADHFFLTPHDFGACFHYQEERAMERGILPLLRRATLVQTFGQRNHVCLQEGSITIPPYANPHKMQAHLINPGTPRSIFVYFRGLFYDMGNDPEGGYYARGARASVWENFKDNPLFDISTEHPSTYYEDMQRAIFCLCPLGWAPWSPRLVEAVVFGCIPVIIADDIVLPFADAIPWEQISVFVAERDVPRLDSILTSIPLQDILRKQRLLAGASVKQALLFHQPARPGDAFDQILNGLARQLPHGKGVFLQPGEKVLDWDAGLESDLKPW

SEQ ID NO: 31362 - DNA, 688 bp, Panicum virgatum
  misc_feature: Ceres CLONE 1904985
  misc_feature: Encodes the peptide sequence at SEQ ID NO. 31363
ctctcctactcccgaaaacttcacaaaaccctcgctcccaccacccgccgccgcccgcgccgccgcctgcaccagccgcgacaaagatgagtcggcaccctgaagtgaagtgggctcagaggatcgacaaggtttacatcaccgtacagttatctgatgcaaaggatgctaaggtcaatttggagccagatggtgtcttcacattctctggcagtgttggtacaaacttatatgaattgaaactagaactgaatgacaaagtcaatgtggaggctagcaagataagtgtgggtgtcaggtccatattctgtatcgtagaaaaagctgaggccaaatggtggaagaagcttgttcgggatgatcaaagggcacctcactttgtgaaagttgattgggacaaatgggtggatgaagatgatgacggtggtgatgtcaacttggatgggatggacttctcgaattttggtggcatgggcggtatgggcggcatgggtgatatggctggtctgggcggcatgggtggcatgggtggtctgggcggcatgggtggcatgggtggtctgggcggcatgggtggtctgggcggcatgggtggtatgggaatggatgaatttgaggatgagagtgatgatgaagaagaagtatcaaagcctcaagctgcggagaaggctggtgaggctgagaagac

SEQ ID NO: 31363 - protein, 200 aa, Panicum virgatum
  misc_feature: Ceres CLONE 1904985
  misc_feature (5)..(79): Pfam Name: CS Pfam Description: CS domain
  misc_feature: SWISSPROT Homolog: EC 5.3.99.3 Prostaglandin-E synthase
MSRHPEVKWAQRIDKVYITVQLSDAKDAKVNLEPDGVFTFSGSVGTNLYELKLELNDKVNVEASKISVGVRSIFCIVEKAEAKWWKKLVRDDQRAPHFVKVDWDKWVDEDDDGGDVNLDGMDFSNFGGMGGMGGMGDMAGLGGMGGMGGLGGMGGMGGLGGMGGLGGMGGMGMDEFEDESDDEEEVSKPQAAEKAGEAEK

SEQ ID NO: 31364 - DNA, 696 bp, Panicum virgatum
  misc_feature: Ceres CLONE 1904994
  misc_feature: Encodes the peptide sequence at SEQ ID NO. 31365
ttccgcggctccgccccaacccaaaacgcgcaaaccctagcttcggcttccccggcctcaccctctcctccgcagaccagtttacctgtcctgccggccaagatgtcgtcgtcgggcggcggcggggggcagcagttccgctatacgcagacgccgtcgaaggtgctccacctgcggaacctgccgtgggagtgcgcagaggaggagctcgtcgagctctgcaagcccttcggccgcatcgtcaacaccaaaagcggcgttggcgccaaccgcaaccaggccttcgtcgagttcactgatgttaatcaggcaatctcaatggtttcttactttgcatcatcttcggaaccagcacaaattcgaggcaaaactgtttacattcagtattcaaataggcaagaaataattaacaacaagagccctggagagactgctggaaatgtgttgcttgttaccatagagggtgttcaagctagtgatgtcaccattgatgtaatccatatgcaggcccatgttaacacggagaaaatgtcgttatcaacacctgcaattggagagataccatgtttgttttgctgcctctgtcttctaattagtacattcaaagttcttatgaactcccatgtctcgtcttgaggatgcaatctataagtatcctccatcaacgcgcttatccccggtgtagggcacctccct

SEQ ID NO: 31365 - protein, 177 aa, Panicum virgatum
  misc_feature: Ceres CLONE 1904994
  misc_feature (22)..(93): Pfam Name: RRM_1 Pfam Description: RNA recognition motif. (a.k.a. RRM, RBD, or RNP domain)
MSSSGGGGGQQFRYTQTPSKVLHLRNLPWECAEEELVELCKPFGRIVNTKSGVGANRNQAFVEFTDVNQAISMVSYFASSSEPAQIRGKTVYIQYSNRQEIINNKSPGETAGNVLLVTIEGVQASDVTIDVIHMQAHVNTEKMSLSTPAIGEIPCLFCCLCLLISTFKVLMNSHVSS

SEQ ID NO: 31366 - DNA, 2505 bp, Panicum virgatum
  misc_feature: Ceres CLONE 1904995
  misc_feature: Encodes the peptide sequence at SEQ ID NO. 31367
aaaacatttgagccgtaaagaaaggcgaggaggctggcgagagcgagcacaagcgcagcaccacccacgccacgcacgcacaccggcgctcgccgccacactcatcagagagcgggaacgcgcgcgcagatctcccgccgcggcccgagccctcgcgattccggccgtagcggtgccgtcctggtcgccggcggcttcgattcgatctgacggggcccccggcggcggctgcggaggctagggttagggttccgccgcgatgcagcggccgggacggctgcagcgcacggggtcgaagcgcgggcttgaccccaccggcggtggcgacgacgacgaccatgcgccgaagcggccgcgcgtccccgccctcgcgagtgtcattgtggaagctctcaagatggacagtctgcagaagctttgttcatcactcgagcccattctccgaagagttgtaagcgaagaagtagagcgtgctttagccaaattgggccctgctaggatccaaggaagatcctcccccaaacgaattgaaggccctgatggaagaaatcttcagcttcagttcagaagccagttagcccttccaatctttactggtggaaaagttgaaggtgagcagggagcagctatacatgttgtgctgctggatgcaaacactggatgtgttgttacctcaggtcctgaatcgtttgcaaaactggatatccttgtgctcgagggcgactttaataaagaggaagatgaggattggacagaagaagagtttgaaagtaatattgtcaaggaacgtgaagggaagaggcctcttttgacgggtgacctgcaagtgactcttaaagaaggtgttggaaccataggggagcttaccttcactgacaactccagctggataagaagcaggaaattcagacttgggctgaggattgctcctggcttttgtgaaggtattcgtgtccgagaggccaagacagaagctttccccgttaaggatcacagaggagaattgtacaaaaagcactacccacctgcgttgaaggatgatgtttggagattagaaaagattggcaaagatggtgcattccacaagaagttaaatgccagtggaatctacatggttgaagatttcctccagcttcttgttagggatcagcagagattgcgtagcattctgggcagcggcatgtcaaataagatgtgggagagccttgttgagcatgcaaagacttgtgtcttaagtggaaagcattatgtatattatgctagtgacacaagaaacgttggtgcaatattcaataacatctacgagtttactgggttgattgctgatgatcagttcatttcagcagaaaatctcacagacaatcagaaggtctatgcagacgcattggtaaagaaggcatatgaggactggatccatgctgtagagtatgatggcaaggcactcttgagcttcaagcagaaaaagaaatctgtcacaacaagaagtgacactgcagctgcttcaacaagcgatcctgcttcatatggttcggccaattcacagaaacaatcgtccctgccagcgaaatctggacaaccttcctcggcaggtagtatgaatgatgcagatggaactagaagtgcatacaatggaaaccagtcagcaagacaggcagccaacactgagaacattcccacaaacatcaccatgcaatatgacaggagtgcactgttgccagaaagccaatttagtggttcatcccttcaggctcaagcttcaagagggtccaatatgctagcattgggacctctgcagcaacagaaccaaagttttgaattcccagcacttggtcagtccatgcagtcagggatgaatccttttgatgaatggccgcaaccacaggagaaccgtggtggggttgatgactacttgatggaggagattaggatgaggagccatgagatactagaaaatgaagaaatgcagcaaatgttgcggattctgagcatgggtggcgcaggaaccaacctaactgaagatggcttcaacttcccttcttacatgcctacaccttccccgaacttgagcgttgaggatgaccgcacccgtgcgcctgggaaagctgttgtcgggtggctcaagatcaaggctgcgatgcggtgggggatctttgtgaggaagaaggctgccgagagaagagctcagcttgttgagcttgacgactagagaaagtattaacagctggaagcatgcgctctcgagctggtcttgtaccaaggtttcatcgatgttgtttgtgtacgggtgggctcagctcagctatgacccttaggcggacagttctggccctgagcttaattatggacaaaactcatttccatttttccttttgtatagctcttcctgccattttccatgcttttgtttgtttagtgtgatgctagtcctgttatgaaccttaacctgaactctgtacatttatttgttacagaatccaaacaggcattaaacattggcacctgggc

SEQ ID NO: 31367 - protein, 648 aa, Panicum virgatum
  misc_feature: Ceres CLONE 1904995
  misc_feature (96)..(399): Pfam Name: Calmodulin_bind Pfam Description: Calmodulin binding protein-like
MQRPGRLQRTGSKRGLDPTGGGDDDDHAPKRPRVPALASVIVEALKMDSLQKLCSSLEPILRRVVSEEVERALAKLGPARIQGRSSPKRIEGPDGRNLQLQFRSQLALPIFTGGKVEGEQGAAIHVVLLDANTGCVVTSGPESFAKLDILVLEGDFNKEEDEDWTEEEFESNIVKEREGKRPLLTGDLQVTLKEGVGTIGELTFTDNSSWIRSRKFRLGLRIAPGFCEGIRVREAKTEAFPVKDHRGELYKKHYPPALKDDVWRLEKIGKDGAFHKKLNASGIYMVEDFLQLLVRDQQRLRSILGSGMSNKMWESLVEHAKTCVLSGKHYVYYASDTRNVGAIFNNIYEFTGLIADDQFISAENLTDNQKVYADALVKKAYEDWIHAVEYDGKALLSFKQKKKSVTTRSDTAAASTSDPASYGSANSQKQSSLPAKSGQPSSAGSMNDADGTRSAYNGNQSARQAANTENIPTNITMQYDRSALLPESQFSGSSLQAQASRGSNMLALGPLQQQNQSFEFPALGQSMQSGMNPFDEWPQPQENRGGVDDYLMEEIRMRSHEILENEEMQQMLRILSMGGAGTNLTEDGFNFPSYMPTPSPNLSVEDDRTRAPGKAVVGWLKIKAAMRWGIFVRKKAAERRAQLVELDD

SEQ ID NO: 31368 - DNA, 2247 bp, Panicum virgatum
  misc_feature: Ceres CLONE 1905004
  misc_feature: Encodes the peptide sequence at SEQ ID NO. 31369
acgtcgtgatgccgggcaccgacgactttgcgaatttggatgggatcccgtcatttcctccctccgatcggtcccgcggtggcgcccatggcctccgccaccggcggcgagctgcggctgcttgatcgctgcatcgacgcggccgcgcgcgacgcggccaccgtggaggcctggcgccggcagcgccgctccctggagcgcctcccggccccgctcgccgacgcgctcttccgccgcctcgccgcgcgccgcgtcctcttcccctccctcctcgaggtgttcaagtggtccgtggaggaggtcgacctgagcggattcctcgccgtggacgcggagtggctgtcgtacctcggctcgttccggtacctgagggtgctcaagctggcggactgcaagaacgttgacaatggcgccatctggtcactcgctggaatgaatacattgaaggagttggacttgtcaaggtgcgcaaagatctctgacgctggcctcagacatatagtgaccatccaaagcttggagaagctgcggttatctggtactaagttgactgacaatggagtgatgctcatttcttcgctgacgaatctaaatctccttgatctgggaggaattcgtatcacagataaaaccttgcggactttacaggtattgacacgacttgagcatcttgatgtatggggtagtgaaattacaaatgaatgggcttctgttctaaaagcctttacaggattgagattcttgaatctttattggacaagtgtcaattatttatcagtccctccaaccatgcgatgtctaaatatgagcaagtgcaaaattcattctatctattatgaggattctgaagttcctgttgctctagaaaatttaattgtctctgaagccgaatttggcaatattgataaagtattttctggaatccaagcagactcgctgttatatttggacatgtctagttgcgatttaagcaacttgtctttcatggaaaatatgaaaaatctagagcatctggaccttagctccaacagaataactgatgacacaattgaacatattgcaaaagttggaacaaacttgaaatatttgagcctcaagggaactgggataacttctcaggccttatgtgttctggcagggacagttccaaacctcacttcactgtctttatctcatacaaaaattgatgactctgctctagcgtatgtcagcatgatgcctttgctgagtacgatagatttaagccatacaagtatcaaaggtttgctcttgcttacaaaacatctattttctttgattacgtcaacttgctttctgttataaaaaagggcgtacccagtgacgtaggcttcccgcactgtgtggggtctggggaagggttgtctttaagccccaagccttacccacacaaatgtgcagaggctggggctcgaacccgggaccttctggttacagacggatttactcgtgctgaagtaaatgctgacaaaatgttgtctatgtccgcttttgagcatctcaaatatctggaaagcttaaatctagaggatacaccactatcagctgaagttatacctcccttggaatcgtttgcagcattgaaatatttgtacctgaaaagtgatttcttgtctgatcctgccttgcatgccctctctgctgcctccaatctgatacatcttgggttctgtgggaatattttgtccagctctgggcttttacaatttgtaccccctgccacattacacgtgttagatttaaggggctgttggatcttaacaggtgatgctgtttcaacattctgtaagcggcatcctactattgaagtgaggcatgagctcatgcaggagcttaaggcaagtagtgtcggtatgtcccaacttaaagcttggcaatctcaacaggtgaaagcaaaagtagcaaacagtttcgctggcccaagtaggcttcctgatatccgttttgtagatgaaaggataaaatacgacaaggaggaaatgatggagcttcagaaccttgttaaaccagattcagtaatgcatggcgtgcgacttccaccagaactgcataggctcacatgaaacaaagtttttgttagaccttagtttcttatgcacctgcctaagcatgacattttccttagttcaattatccttgaatgtgacaattttgaaaatagagcatcagcatgatacaacagagttttgctcaaatataaatgtaatatcagtggacaaaatgactgtt

SEQ ID NO: 31369 - protein, 411 aa, Panicum virgatum
  misc_feature: Ceres CLONE 1905004
  misc_feature: SWISSPROT Homolog: EC 2.7.11.1 Non-specific serine/threonine protein kinase
MASATGGELRLLDRCIDAAARDAATVEAWRRQRRSLERLPAPLADALFRRLAARRVLFPSLLEVFKWSVEEVDLSGFLAVDAEWLSYLGSFRYLRVLKLADCKNVDNGAIWSLAGMNTLKELDLSRCAKISDAGLRHIVTIQSLEKLRLSGTKLTDNGVMLISSLTNLNLLDLGGIRITDKTLRTLQVLTRLEHLDVWGSEITNEWASVLKAFTGLRFLNLYWTSVNYLSVPPTMRCLNMSKCKIHSIYYEDSEVPVALENLIVSEAEFGNIDKVFSGIQADSLLYLDMSSCDLSNLSFMENMKNLEHLDLSSNRITDDTIEHIAKVGTNLKYLSLKGTGITSQALCVLAGTVPNLTSLSLSHTKIDDSALAYVSMMPLLSTIDLSHTSIKGLLLLTKHLFSLITSTCFLL

SEQ ID NO: 31370 - DNA, 1843 bp, Panicum virgatum
  misc_feature: Ceres CLONE 1905008
  misc_feature: Encodes the peptide sequence at SEQ ID NO. 31371
agaacccagatcgccggccggtggcctgcttgcttgcttgcctgccaatggtggctgcccataccggcagcgaccccaagccgcgaagctgagcagcgtctagcccgacgagaggagaggcgcgagcgcggaggtcccggaaggatgggggcggcggcggcggggccgcaggggcggcggacgctggtgctggtgaacctggcgtccatcatggagcgcgccgacgaggcgctgttgccggcggtgtaccgggaggtgggcgccgcgctgcacgccacgcccacggggctcggcgccctcacgctgtaccgctccatcgtgcaggccgcctgctacccggtggccgcctacgccgcctcgcgccacaaccgcgcccacgtcatcgcgctgggggccttcctctgggcggccgccaccttcctcgtcgccgtctccgacaccttcctccaggtagcagtgtcaagaggcttgaacggcattggtctagctctggtcataccagcagtccagtcgctggtcgccgactccactgacgacgacaaccgtggtgccgctttcggctggctgcagctgaccagcagcataggctccatatttggggggttctttgccttgatgctggcacaaaccacattcttggggatcgctggatggcgcatcgccttccatctcgtcgcaatcgtcagcgtcatcgtaggccttctcgtgtggctcttcgtcgtggatccccatttccccgcgaacaacatcggctcgcatgccgcaccgatgagcaaaaagtctgcactggaagaggcgagggagcttatcatcgaggccaagtctataattcagatcccaacgttccaggtcttcgttgctcagggtgtcagcggctcgttcccatggtcagcgctgtccttcatgtccatgtggcttgagctcatcgggttcagccatgaggatactgccattttcacgacaatcttcgcggtcgccacctccattggcggtcttcttggtggcaagatgggggatttcctcgcccagcggtacccgaacgccgggaggatcatcctgtcgcagataagcgctggctcagctgttccattggctgctgttcttctgctggggctgcctgatgatccatccagatccagtggtgtagcccatgggcttgttttgttcatcatgggactcatcatctcctggaatggagctgctacaaactgcccgatcttcgcggagattgtgcccgagaagcaaagaacaagcatttatgctctggacaggactttcgagtctattcttgcttcatttgcgcctcctgtcgtcggcttattgtcgcagcacctctatggtttcaaaccggatgacaaagggagcagccctgaacaagaccgggagaacgctgcatcgctggccaaggcgctgtacacggccatttccataccaatggtaatctgcacctccatatacactttcatgtaccgcacttaccctcgagacagggagcgtgcgcgcatgcagtctatgattcagacagagttggatcagattgaacttgggggttcgcattttggatgtggtgacgacaggtttgagctctttgatacggtgaacgctggtaaaaaaaatgatcaggttgatggcagttatggcactgaagaatctgctgaggccgatgctggcactgaaaaactactaggaaaccatgagtagtgacaaaccacgagtctaggaaagaggatacttctgcagattttaggaaattgtaacacggcaatgaatgtgattgaccaaagtgaacatctttgtttatgctgctactgctactatgcaacacatcccactgacttggacg

SEQ ID NO: 31371 - protein, 518 aa, Panicum virgatum
  misc_feature: Ceres CLONE 1905008
  misc_feature (14)..(387): Pfam Name: MFS_1 Pfam Description: Major Facilitator Superfamily
MGAAAAGPQGRRTLVLVNLASIMERADEALLPAVYREVGAALHATPTGLGALTLYRSIVQAACYPVAAYAASRHNRAHVIALGAFLWAAATFLVAVSDTFLQVAVSRGLNGIGLALVIPAVQSLVADSTDDDNRGAAFGWLQLTSSIGSIFGGFFALMLAQTTFLGIAGWRIAFHLVAIVSVIVGLLVWLFVVDPHFPANNIGSHAAPMSKKSALEEARELIIEAKSIIQIPTFQVFVAQGVSGSFPWSALSFMSMWLELIGFSHEDTAIFTTIFAVATSIGGLLGGKMGDFLAQRYPNAGRIILSQISAGSAVPLAAVLLLGLPDDPSRSSGVAHGLVLFIMGLIISWNGAATNCPIFAEIVPEKQRTSIYALDRTFESILASFAPPVVGLLSQHLYGFKPDDKGSSPEQDRENAASLAKALYTAISIPMVICTSIYTFMYRTYPRDRERARMQSMIQTELDQIELGGSHFGCGDDRFELFDTVNAGKKNDQVDGSYGTEESAEADAGTEKLLGNHE

SEQ ID NO: 31372 - DNA, 704 bp, Panicum virgatum
  misc_feature: Ceres CLONE 1905015
  misc_feature: Encodes the peptide sequence at SEQ ID NO. 31373
gtcgatgtcagtgtttatcaggccccagttgccaccacactggcacagcaaagccacgataatggccggagaccagcagcaagaggaagccatggcggcagatcctctccacgttgtggtgttcccatggctggcgttcggccacctcatcccgttcctcgagctctccaggcggctggcggcgcggggccacgccgtcaccttcgtctccacgccgaggaacgtcgccaggctcccgccggtgccagagggcctgtccggcctggtccggaccgttgccctgccgctgccggcggtggacgggctgccggagggcgccgagtcgacggccgacatgccgccggagaaggtcgagctcctcaaggccgccttcgacggcctcgccgcgcccttcgccgacttcctcgccgccgcctgcgccggcggccgggagcaagcgtcggggttcagtaggaggccggactgggtcgtgctcgacttcgcgcaccactggctctgccccatcgctgagcaacaccaggttccttgcgcgatgttccaaatcatcacggcgacgggactcgcgtacatcggctcacgtcgccagaacgtcagccatccccgcgtcaccgtcgaggacttcatgcccatgccgaggtggttcccctccccaccttccctcaccttgcgccgccacgaggctgcctggttcgccgccgccgccc

SEQ ID NO: 31373 - protein, 214 aa, Panicum virgatum
  misc_feature: Ceres CLONE 1905015
  misc_feature: SWISSPROT Homolog: EC 2.4.1.115 Anthocyanidin 3-O-glucosyltransferase
  misc_feature: Useful for making plants with altered carbohydrate content
MAGDQQQEEAMAADPLHVVVFPWLAFGHLIPFLELSRRLAARGHAVTFVSTPRNVARLPPVPEGLSGLVRTVALPLPAVDGLPEGAESTADMPPEKVELLKAAFDGLAAPFADFLAAACAGGREQASGFSRRPDWVVLDFAHHWLCPIAEQHQVPCAMFQIITATGLAYIGSRRQNVSHPRVTVEDFMPMPRWFPSPPSLTLRRHEAAWFAAAA

SEQ ID NO: 31374 - DNA, 729 bp, Panicum virgatum
  misc_feature: Ceres CLONE 1905041
  misc_feature: Encodes the peptide sequence at SEQ ID NO. 31375
gcacctcgctcgcactagcaaagctctcatcagcttgctgctcctgcctcggtcgccagcctgaggcactagtactagctagtggcctgtctcgacaaccactcgtcactgcgcgacgctagcttctgacgagctagtagcttaattagcgctcccatttgttgatttccatggcgagccaccaccggtccgccgccatggacagggcggaactgttccggacggtgaggcaggccacgctcaaccacgcgcgcctgctgtaccaccgcctcgccgcccgcctgccgcacgtcctcgccttcacgctcctcgtcgccgcggcccagctcgtgccgtcgtcgtcgcttgcgggggcgccccgggcgctccgggactgggcgcgcgccaacgcggggctggcggccgcggcgtgcgcgggcctggccgccgcagcgtgcgcgtacgccgcgtcccggccccgccccgtgtacctcgtcgacctgtccgggtacaggccgggccccgcgcacgaggccacccgcgcccagtccatccgccacttcgcggtggcggggcggttcacggacgagagcatcgcgttccagacgcggatgctggagcgcgccggggtgggcgaggccacgcacttcccggcgtcgctgctcaccgtccccgtcgacatgtccctccgcgccgccagggaggagtccgaggccgtcgtcttcggcgccgtcgacgacctgctgggcc

SEQ ID NO: 31375 - protein, 177 aa, Panicum virgatum
  misc_feature: Ceres CLONE 1905041
  misc_feature (82)..(177): Pfam Name: FAE1_CUT1_RppA Pfam Description: FAE1/Type III polyketide synthase-like protein
  misc_feature: SWISSPROT Homolog: EC 2.3.1.119 Icosanoyl-CoA synthase
MDRAELFRTVRQATLNHARLLYHRLAARLPHVLAFTLLVAAAQLVPSSSLAGAPRALRDWARANAGLAAAACAGLAAAACAYAASRPRPVYLVDLSGYRPGPAHEATRAQSIRHFAVAGRFTDESIAFQTRMLERAGVGEATHFPASLLTVPVDMSLRAAREESEAVVFGAVDDLLG

SEQ ID NO: 31376 - DNA, 658 bp, Panicum virgatum
  misc_feature: Ceres CLONE 1905071
  misc_feature: Encodes the peptide sequence at SEQ ID NO. 31377
gttatttccgcccgcctctcgcagaaaaaatcagacagaataagcggagggggaagggagaggaacaaggaaacaaaatcagacagaattctctgcggtgaatggaggtgccggccgagtgcgcgggcggcgggagggtcaagaaggaggcggacctcttcctcgtcgacgacctactcgacctgccgtgcgacggcgacgaggaggaggtgcaggaggcggtggtggaggagggcgagggcgagggtagtaaggcgagggattgtggcggcgccggcggcgaggacggtgccgccgggaacgcttcgaacgattcgtctacggtgactgcgctggacagctgcagcaactccctctccggcctcgccgacggggacttctccggcgggctgtgcgagccgtacgaccaattggcggagttggaatggctgtccaactacatgggcgaggacaacttcccgacggaggacctcaagaagctgcagctcatcaccggcatcccgccggcctccgcctccgcctccgccgccacggccttcgctcccacccccgctcccgcggccgcagcggcgcagcccggcggcggcgtgttgccaccggaggcgcccgtgccaggcaaggcgcgcagcaagcgctcccgcgtcgcgccatgcagctg

SEQ ID NO: 31377 - protein, 185 aa, Panicum virgatum
  misc_feature: Ceres CLONE 1905071
  misc_feature: The sequence is a functional homolog of SEQ ID NO 1655 in the 10/374,780 US patent application
  misc_feature: The sequence is a functional homolog of SEQ ID NO 1657 in the 10/374,780 US patent application
MEVPAECAGGGRVKKEADLFLVDDLLDLPCDGDEEEVQEAVVEEGEGEGSKARDCGGAGGEDGAAGNASNDSSTVTALDSCSNSLSGLADGDFSGGLCEPYDQLAELEWLSNYMGEDNFPTEDLKKLQLITGIPPASASASAATAFAPTPAPAAAAAQPGGGVLPPEAPVPGKARSKRSRVAPCS

SEQ ID NO: 31378 - DNA, 661 bp, Panicum virgatum
  misc_feature: Ceres CLONE 1905078
  misc_feature: Encodes the peptide sequence at SEQ ID NO. 31379
gcccccgctccctcccagcatcacatcgcgtgttcactgttcacactaccgtctccgtcccggctcactcagctgaagctagagacaagaaccacccacgcatcacatcgccctgctcgcttcgcccgtccggtgctccggcaattgcttgctgctgtttgattcggcagaggggaggtcgggaggaggaggcagagggggaagggacgatggtggggcggatgcggatggcggcggcgctgctgctggcgctggcggcgtgcgcggcgctgccgtcgaggacggcggcgaacaagatcagcatcaactggaagcccaacaccaactactccgactgggtggcgcagcacagccccttctacaaggacgactggctcgtgttctactacacggcggggcaggcggacgtggtgcaggtggacgaggccgggtacaacaagtgcgacgccagcaacgccatctacaactacagcaagggccgcaccttcgcgttccagctcaacgagaccaagacctactacttcatctgcagctacggctactgcttcggcgggatgcgcctcgccatcaagaccgagaagttgccgccgccgtccccgccgccgtccgccagccacaggtcccccgccgccgccgccgccttcgccaggtcccacgccgc

SEQ ID NO: 31379 - protein, 150 aa, Panicum virgatum
  misc_feature: Ceres CLONE 1905078
  misc_feature (34)..(116): Pfam Name: Cu_bind_like Pfam Description: Plastocyanin-like domain
MVGRMRMAAALLLALAACAALPSRTAANKISINWKPNTNYSDWVAQHSPFYKDDWLVFYYTAGQADVVQVDEAGYNKCDASNAIYNYSKGRTFAFQLNETKTYYFICSYGYCFGGMRLAIKTEKLPPPSPPPSASHRSPAAAAAFARSHA

SEQ ID NO: 31380 - DNA, 699 bp, Panicum virgatum
  misc_feature: Ceres CLONE 1905084
  misc_feature: Encodes the peptide sequence at SEQ ID NO. 31381
aaaacagttcaggctgagatcgacctcggctcgggacgctcgagcttcaggtggtaggctcgctcgagcctcgagctcggctgccaaaggttcactcctccctctgcttcctaaacctttcgcttctctcggactctctctcctccttgctctttcttccctggcggtgacgattgggcgagcggcggcgccatttgtcacgtcgtcgcccagccctttgccgacgacgagcatcctccaggtgcacagtcgtgttggcattgtactggccagaggagattaggactaagcatgggggttccaaaacagaggtggacatctgaggaagaagctgcccttagagctggaatagcgaggcatggagttggaaaatggcgcacaatattgaaagacccagaatttagttccaccttgtgctaccgctcaaatgttgacctcaaggacaaatggcgcaacatgaatgtaattgtcggtacatcgagttctcgtgacaagggaaagactgcagtgaagaaaacacgaacgactcccaagaataatgaacacaccacagcaatcatcacagttacttctgatattgatgatgagattgttgatgacaagcctttagcatcattgcctagtgaagcacagaatgcatcgaatccaaagaaatctcactcgagactggataatattataatggaggctataaagagc

SEQ ID NO: 31381 - protein, 135 aa, Panicum virgatum
  misc_feature: Ceres CLONE 1905084
  misc_feature (5)..(57): Pfam Name: Myb_DNA-binding Pfam Description: Myb-like DNA-binding domain
  misc_feature: The sequence is a functional homolog of SEQ ID NO 1220 in the 10/666,642 US patent application
  misc_feature: The sequence is a functional homolog of SEQ ID NO 1221 in the 10/666,642 US patent application
  misc_feature: Useful for making plants with altered alkaloid content
MGVPKQRWTSEEEAALRAGIARHGVGKWRTILKDPEFSSTLCYRSNVDLKDKWRNMNVIVGTSSSRDKGKTAVKKTRTTPKNNEHTTAIITVTSDIDDEIVDDKPLASLPSEAQNASNPKKSHSRLDNIIMEAIK

SEQ ID NO: 31382 - DNA, 746 bp, Panicum virgatum
  misc_feature: Ceres CLONE 1905099
  misc_feature: Encodes the peptide sequence at SEQ ID NO. 31383
atgacccggtagtagtagaaagggaacgccccccgacgacctgctcctcagtttgctccccttccgcctccgcgtccgcttcccatcttggcctggacacctgggctgctccccctccgtttccgcgctccccggacgcgcaccgatctcgcgccgcgcgcctaagtcgccgccggaatccgccccgccctcgcgccgctgccagcgtcgcgcgacaaggtaggacgagaggggtcaagttcttactggtttcattcttgaagccgccgacttcacatgccaacaaccccgaggagcagaagccaggctaggaccactaggccttggatcttgccagggatggactttgcggattcaagacggaagcctaatttcacggggaagattgctgtggctgttgccctcactgtcatgtgcataattgtattgaaacagtcgcctggtttcagcggtaccaatgtgttctctcgccatgaaattggggtgacccatgtcttagtgacaggaggggctgggtatattggctcgcatgctactcttcgtctccttaaggacaactaccgtgttaccattgtggataacctttccagaggtaacatgggagctgtaagagttcttcaacggctgtttccacagcctggaaggcttcaatttatttatgctgatttaggcgatgccaaagctgtgaacaaactattttcggaaaatgcatttgacgctgttatgcactttgcggctgttgctta

SEQ ID NO: 31383 - protein, 135 aa, Panicum virgatum
  misc_feature: Ceres CLONE 1905099
  misc_feature: SWISSPROT Homolog: EC 5.1.3.5 UDP-arabinose 4-epimerase
  misc_feature: Useful for making plants with altered carbohydrate content
  misc_feature: Useful for making plants with altered cell wall content and/or composition
MDFADSRRKPNFTGKIAVAVALTVMCIIVLKQSPGFSGTNVFSRHEIGVTHVLVTGGAGYIGSHATLRLLKDNYRVTIVDNLSRGNMGAVRVLQRLFPQPGRLQFIYADLGDAKAVNKLFSENAFDAVMHFAAVA

SEQ ID NO: 31384 - DNA, 663 bp, Panicum virgatum
  misc_feature: Ceres CLONE 1905115
  misc_feature: Encodes the peptide sequence at SEQ ID NO. 31385
ggaggggggcgacggcgatggcacggcattgccagggtcacattgtgcactgcctcggcggcgtcctcgcccgccgcggtggcgccaccgtcgccctggactcaggcggtcgcaggctctctggcgcggagttcgtcgacggcgtgcggaggctggccgcggggctcgtcggcagcggggtgcgccccggcgacgtcgttgccgccgtcgccttcaacagcatccagtacgtcgagctgttcctcgccgtcgcacacgtcggagcaatcatcgcccctctcaactaccgctggagcttcgaggaggcagcgcaggcactggagctcgtggagccaacggcgttcatcttcgacagcgtcttcagctcttgggcgctccgactgacggacagcaacaagtattcgtccattggcctctacctcattctgggggattcttgcagcacaggccatgcagcaaactttggatctgttgatcacatcaagaggagcgtgagaggacctatagcgacagagcccgtaaccgctccaagagatgttgctttgatatgcttcacatctggtaactctccaaactttgtggctgatttcctacttcaatctgtgcccaatttgaactgaaactgggttccgaattgatgctacgtgataagctatttttatt

SEQ ID NO: 31385 - protein, 200 aa, Panicum virgatum
  misc_feature: Ceres CLONE 1905115
  misc_feature: SWISSPROT Homolog: EC 6.2.1.12 4-coumarate--CoA ligase
MARHCQGHIVHCLGGVLARRGGATVALDSGGRRLSGAEFVDGVRRLAAGLVGSGVRPGDVVAAVAFNSIQYVELFLAVAHVGAIIAPLNYRWSFEEAAQALELVEPTAFIFDSVFSSWALRLTDSNKYSSIGLYLILGDSCSTGHAANFGSVDHIKRSVRGPIATEPVTAPRDVALICFTSGNSPNFVADFLLQSVPNLN

SEQ ID NO: 31386 - DNA, 588 bp, Panicum virgatum
  misc_feature: Ceres CLONE 1905124
  misc_feature: Encodes the peptide sequence at SEQ ID NO. 31387
accaccaccagaagaggaggggggggggaggcgcctgctcctcccgcggcgagcggcggcggcgggagaggtgggggagagatgtcggggtggctcaaggcactggcgtacggcgcggggggcgtggcggtggccggcctggcggcgctggtggcgctgcaggagcacctcgtctacgtgcccgtgctcccgggcctggcgcgcgcgtaccccatcacgcccgcgcgcctccgcctctcctacgaggacgtctggctccgcgccgccgacggcgtgcggctccactcctggttcatccgccactcccctacctgccgaggtccaaccatcctgttcttccaagaaaatgctggcaacattgctcatcgtttggaatttgttcgactaatgatgcagcggctacagtacaacgtctttatgctttcttatagagggtatggtgagagtgacggctatccttctcagaaagggatccaatatgatgcacaggctgcacttgatcatctagctcagaggaaggacattgatacatccaggatagttatctttggaagatctttaggaggcgctgtgggtgcagttcttgcg

SEQ ID NO: 31387 - protein, 168 aa, Panicum virgatum
  misc_feature: Ceres CLONE 1905124
  misc_feature: SWISSPROT Homolog: EC 3.1.1.23 Acylglycerol lipase
MSGWLKALAYGAGGVAVAGLAALVALQEHLVYVPVLPGLARAYPITPARLRLSYEDVWLRAADGVRLHSWFIRHSPTCRGPTILFFQENAGNIAHRLEFVRLMMQRLQYNVFMLSYRGYGESDGYPSQKGIQYDAQAALDHLAQRKDIDTSRIVIFGRSLGGAVGAVL

SEQ ID NO: 31388 - DNA, 2065 bp, Panicum virgatum
  misc_feature: Ceres CLONE 1905141
  misc_feature: Encodes the peptide sequence at SEQ ID NO. 31389
gaggtggtgtggcgagagctcgcgcgaggagggggcgagaagcttctggcgggtggtggtgcggaccctcgccgtcgaagcgggcggggagagagagagagagagagagagagagagaggagcggggatcgcgcggcggaaggggggaggcggtggatggcggtggagtaccactgctgctcggcgcccttcttcgagcacatcgtcatcatcgtcgtgctcgttctcttcgcgggcctcatgtcgggcctcaccctcggcctcatgtccctcagcctcgtcgacctcgaggtcctcgccaagtccggcaccgaacaggaccgcaagcacgcagctaagattttgcctgttgtgaagaaccagcaccttctgctatgcactcttctgatctgcaatgctgcagccatggaggctttgcccatattccttgatagcttggtgactgcttggggtgcgattttgatctcagtgacactgattctactgtttggtgagatcttaccacagtccatctgctcacattatgggctggctattggtgcttcagttgctccattagtccgtgtgcttgtctggatctgcttctccattgcctatcctataagcaagctactagactgtgtactgggtcatggtcaaacagctctcttccacagagctgagctaaaaacacttgtcactctgcacggaaatgaggctggtaaaggcggagagttaacccatgatgaaactaccataattgctggagcacttgaactcactgaaaagaaggctaaagatgctatgacactgttatgtcaaacctttgcaattgatataaacgcaaagcttgacagagaactgttgcaagaggtcctcgagaaagggcatagcagagtgccagtttattatgaaaagaagacaaatattattggattgatattggtgaagaacttattatcagttaacgccgatcacgaggttcccataaaaagtgtgactatccgcaaaattcctcgtgtttttgaagatatgcccctctatgacatcctaaatgagtttcagaaaggccacagccacatggcagtggtcataaggaaaaacattcccaatgaatcagctgaacaacctgccaatgatggaggaacttatgaggtgtccattgctattgatgaaaagaacaacgaaaaggtcgtgaagaacctgccgccaccactgcgaagatggaagagctaccctaacactcagaacgtatcaaataggggaagcaggcctaaaaaatggtccaaagatcaatcagatgtcctgcagatacatgaagagcccctgcccacattgagcgaagatgaagaggctgtcggtatcataaccatggaggatgtcattgaggagcttctgcaggaggagatatatgatgagacagacgtacatgaggagcaatgacactggcttcacggcccgctgtttatagctgcctactggacagagcagctgttagaaaagtgcggcatacgtaatatctgtactttatgttgataggtatatacattgagagagactagccatccattgtagtaccaggtggctgtctaggatatcatattggtaagaatactgtttggactttagagtatttcggtctcaggactgcaggattgcccaggtccggaaattatgccgggtaccctggtaagaaacggaccggaaactgtaacgagcatcctggtggtaagaaacggatgcgtttgacggatccgttcggttcagaagccccaataagatatcagtttctttacggtggctcacatctgcaggggattccgtcagtatttgtagagatctcaccttttcaagcaccaaggcaggtactgtcaaatggaacacagcagcgaagtggggagccatgatggatcgccgctggactggagccgcagcagcccgcatgtaccgcgcgtgcgccaaagtcctttgagcacggtgaattatggtacgtgtgttctcttcataatccaacttaacttttataatttttaaacttaaatttgtataagataaagattatctagattaaaattttgagaccctc

SEQ ID NO: 31389 - protein, 421 aa, Panicum virgatum
  misc_feature: Ceres CLONE 1905141
  misc_feature (210)..(318): Pfam Name: CBS Pfam Description: CBS domain pair
MAVEYHCCSAPFFEHIVIIVVLVLFAGLMSGLTLGLMSLSLVDLEVLAKSGTEQDRKHAAKILPVVKNQHLLLCTLLICNAAAMEALPIFLDSLVTAWGAILISVTLILLFGEILPQSICSHYGLAIGASVAPLVRVLVWICFSIAYPISKLLDCVLGHGQTALFHRAELKTLVTLHGNEAGKGGELTHDETTIIAGALELTEKKAKDAMTLLCQTFAIDINAKLDRELLQEVLEKGHSRVPVYYEKKTNIIGLILVKNLLSVNADHEVPIKSVTIRKIPRVFEDMPLYDILNEFQKGHSHMAVVIRKNIPNESAEQPANDGGTYEVSIAIDEKNNEKVVKNLPPPLRRWKSYPNTQNVSNRGSRPKKWSKDQSDVLQIHEEPLPTLSEDEEAVGIITMEDVIEELLQEEIYDETDVHEEQ

SEQ ID NO: 31390 - DNA, 484 bp, Panicum virgatum
  misc_feature: Ceres CLONE 1905142
  misc_feature: Encodes the peptide sequence at SEQ ID NO. 31391
catcccgtccccgcctcttctccctccggccgggtccccgaataactatcaccaacgcaagaggttggtggattaatttaccctacaacaacgtggcagcttcggcgatggcggctgatatcttcctcttcccctcccagtccgtgaacgaggggcaccccgacaagctgtgcgaccaggtctcggacgccgtcctggacgcgtgcctggcgcatgaccccgacagtctggtggcctgcgagacctgcgccaggacccacatggtgatggtgttcggctagatctccaccgaggccaccgtcgactaccagaagatcgtgcgcgactcctgccgcgaaatcggcttcacctcccactacttgggcctctacgcccaccggtgcttggtgctcttctgcatccagcagcagtcccccgacgtcccgcagggcgtgcatcggccacttcaccttgcgccccgaggagatctgcgccggccacctcg

SEQ ID NO: 31391 - protein, 57 aa, Panicum virgatum
  misc_feature: Ceres CLONE 1905142
  misc_feature (4)..(57): Pfam Name: S-AdoMet_synt_N Pfam Description: S-adenosylmethionine synthetase, N-terminal domain
  misc_feature: SWISSPROT Homolog: EC 2.5.1.6 Methionine adenosyltransferase
MAADIFLFPSQSVNEGHPDKLCDQVSDAVLDACLAHDPDSLVACETCARTHMVMVFG

SEQ ID NO: 31392 - DNA, 1495 bp, Panicum virgatum
  misc_feature: Ceres CLONE 1905143
  misc_feature: Encodes the peptide sequence at SEQ ID NO. 31393
gcaccgcaacggggactcgagccagaagcagcttcttcttcttcttcctcgggaatagcttagctagctgctgataggagccgttatggggagcaagggagcagcgctcgcgctgctgctctgcctgagcagcgcggccgtgggcgcgtgggctcgcccggtcgccaccaccagggacgccgccggggacgagaagttcctctggctcaagaagcacttgggcaagggccttggcggtgggatcgggaagggcggctatggcggaggaggaggtggaggcggcgggtacggtggaggagccggcggcggctacggcggtggcgctgggatgggcggcggcgaaggccacggcatcggcggcgggtttggaaaaggtggcgggctcggcggcggtgctgggcttgggcacggcgtcggcggcgggttcggcaagggcggcggccttggtggagggttcggcaagggcggagggctcggccatggcatcggcggcgggtacggcaagggcggtggccttggagaagggatcggccacgacatcggtggcggcgttggcagcggcatcggtggcggctacgggaagggcggcggtcttggtggagggttcggcaagggcagtggccttggagaagggatcggccacggcatcggtggcggcgttggcagcggcatcggtggcggctacgggaagggcggcggccttggtggagggttcggcaagggcggcgggctcggcgaagggatcggccatggcatcggcggcggcgttggcagcggcatcggcgcgggctacggaaagggcggcggtcttggtggtgggtacggcaagggcggcgggctcggaggaggaatcggccatggcatcggtggaggctacggcaagggaggcggccttggcagcgggatcggccacggcgttggcggcggctttggcaagggcggcgggatcggcggcggcttcggcaagggcggcgggatcggccatggggtcggcggcggcttcggcaagggcggcggtcttggcggtggaggcggctacggcggtggtgccggcagcggcggcggcggcggcggcaaggccttcgggtttgggtttggcaacggcgccggcttcggcggtggaggcggcggcggcggcggcggcattggcggtcaccactgagagagatactacgccggcacgcgttctccgtagttccatcacttaagctctacatacctcagagcatgcagatcgtgcttttgcagtggtgagactttgcacttctgggttggtctcgttgtgtgtcctgtctgccctccggtttgttggagggatttgttcgtgcttgctttgtactcctactttgattgtatcttttttgttattaattccggtgatggtagtgatggtgatggtgatgccagtcacaatatgtacgtacgtatacatgatccatgcatgtaaggctcactgaatgattcgagaaatataaatgaagccatgctttggtgg

SEQ ID NO: 31393 - protein, 358 aa, Panicum virgatum
  misc_feature: Ceres CLONE 1905143
  misc_feature: Useful for making plants with modulated nitrogen use efficiency
  misc_feature: Useful for making plants with altered lignin content
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
  misc_feature: Useful for making plants with altered alkaloid content
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: Useful for making plants with altered terpenoid content
MGSKGAALALLLCLSSAAVGAWARPVATTRDAAGDEKFLWLKKHLGKGLGGGIGKGGYGGGGGGGGGYGGGAGGGYGGGAGMGGGEGHGIGGGFGKGGGLGGGAGLGHGVGGGFGKGGGLGGGFGKGGGLGHGIGGGYGKGGGLGEGIGHDIGGGVGSGIGGGYGKGGGLGGGFGKGSGLGEGIGHGIGGGVGSGIGGGYGKGGGLGGGFGKGGGLGEGIGHGIGGGVGSGIGAGYGKGGGLGGGYGKGGGLGGGIGHGIGGGYGKGGGLGSGIGHGVGGGFGKGGGIGGGFGKGGGIGHGVGGGFGKGGGLGGGGGYGGGAGSGGGGGGKAFGFGFGNGAGFGGGGGGGGGGIGGHH

SEQ ID NO: 31394 - DNA, 736 bp, Panicum virgatum
  misc_feature: Ceres CLONE 1905150
  misc_feature: Encodes the peptide sequence at SEQ ID NO. 31395
acgcctctcgtccaggttctcctccccccaaatcctccaaatccgacgcgattcctccgagccgccgccgccccgatcccgctgcggaggcggcgtatcgctgccaacccgtggctccgctcgcctaccgactgaacacacaagagtgttgggaatggagatccagtcgtccggccggtccatcgacgtgctgatggagaaggtgctgtccgtgaacatcctctcctcggactacttcaaggagctctacaagttcaagacctaccacgaggtggtcgacgaaatctaccaccaggtcgaccacgtcgagccctggatgaccggcaactgccgcgggccctcctccgccttctgcctcctctacaagttcttcaccatgaagctcaccgtcaagcagatgcacggcctgctcaagcacccggactccccctacatcagagctattggatttctctacctgcgatacgttgcagaaccaaaaacactgtggacttggtacgagccctacatcaaggatgacgaggagttttcccctggatcaaatggaaaaatgactacaatgggcgtttacgtgcgtgatctccttcttggccagtactatttcgacagtcttcttccacgagtgcctctcccaattttgcaacaggtcactgtccatcttgagaagctgacgcttccaacaagcagtcaggaatgacaggggattccaataggcatgaatcaaatgatactggcc

SEQ ID NO: 31395 - protein, 180 aa, Panicum virgatum
  misc_feature: Ceres CLONE 1905150
  misc_feature (1)..(169): Pfam Name: PRP38 Pfam Description: PRP38 family
MEIQSSGRSIDVLMEKVLSVNILSSDYFKELYKFKTYHEVVDEIYHQVDHVEPWMTGNCRGPSSAFCLLYKFFTMKLTVKQMHGLLKHPDSPYIRAIGFLYLRYVAEPKTLWTWYEPYIKDDEEFSPGSNGKMTTMGVYVRDLLLGQYYFDSLLPRVPLPILQQVTVHLEKLTLPTSSQE

SEQ ID NO: 31396 - DNA, 722 bp, Panicum virgatum
  misc_feature: Ceres CLONE 1905165
  misc_feature: Encodes the peptide sequence at SEQ ID NO. 31397
attccatccagccagagccagacctcccacccgcatcctcctccccgccgccggcaatggcccggctcgtgctctccgagtgctgcggcctcgcgccgctgcgcctgcgcgccggccggggtgccattgcggcgccggcgccccccgccgcgctctccgccgcggcgctgccgcgcaggcccgcggccgcggccatccaccgcgactgggcgctccgcgtctccgcgcccacgcgcctcgcgtcggccgtcgacgaggggggcaggaggagcgctccgctcggggaggaggagaaggccgccgcgggcggggacttcgaccccggggcgccgccgccgttcgggctggcggagatccgcgccgccatccccaagcactactgggtcaaggacccctggcgctccatgagctacgtcctccgcgacgtcgtcgtcgtcctggggctcgccgccgccgccgcgcgcctcgacagctggctcgtctggccgctatactgggccgcgcagggcaccatgttctgggcgctcttcgtcctcggccacgactgtggacacgggagcttctcaaacaaccccaagctcaacagcgtggtcggccacatactccattcctccattcttgtcccatacaacggatggaggattagccacaggacgcaccatcagaaccacggccacgtcgagaatgacgagtcctggcatccgctaccagagaggctgtac

SEQ ID NO: 31397 - protein, 221 aa, Panicum virgatum
  misc_feature: Ceres CLONE 1905165
  misc_feature: SWISSPROT Homolog: EC 1.14.99.33 Delta(12)-fatty acid dehydrogenase
  misc_feature: Useful for making plants with modulated heat sensitivity
MARLVLSECCGLAPLRLRAGRGAIAAPAPPAALSAAALPRRPAAAAIHRDWALRVSAPTRLASAVDEGGRRSAPLGEEEKAAAGGDFDPGAPPPFGLAEIRAAIPKHYWVKDPWRSMSYVLRDVVVVLGLAAAAARLDSWLVWPLYWAAQGTMFWALFVLGHDCGHGSFSNNPKLNSVVGHILHSSILVPYNGWRISHRTHHQNHGHVENDESWHPLPERL

SEQ ID NO: 31398 - DNA, 541 bp, Panicum virgatum
  misc_feature: Ceres CLONE 1905168
  misc_feature: Encodes the peptide sequence at SEQ ID NO. 31399
ccccgtgctctctcagaggtgggttggcttctccccctcttaccaagtcctcggttctagggttttagttggaaggggagatggcggcggcggatgtggagtaccgctgcttcgtcggcggcctcgcctgggccaccgacaacgcgtccctccagcaggccttcgcctcctacggcgacgtcctcgactccaaggtcatcaccgaccgtgagacggggaggtcccgcgggttcggcttcgtcaccttctcaaccgagcagtcgatgctcgacgccatcgaagccatgaacggcaaggagctcgacggccgcaacatcaccgtcaaccaggcccaatcccgcggcggtggcggcggcggcggcggttacggcggcggtcgccagggaggctacggcggcggcggcggtcgccgtgagggcggctacggtggcggcggctacgacggtggcggtggcggatacggcggcggtcgccgcgagggcggctacagggctgctggctcctgcatccgcgggatctccggtgggtactggaggggcta

SEQ ID NO: 31399 - protein, 153 aa, Panicum virgatum
  misc_feature: Ceres CLONE 1905168
  misc_feature (10)..(81): Pfam Name: RRM_1 Pfam Description: RNA recognition motif. (a.k.a. RRM, RBD, or RNP domain)
  misc_feature (48)..(135): Pfam Name: GRP Pfam Description: Glycine rich protein family
  misc_feature: SWISSPROT Homolog: EC 5.2.1.8 Peptidylprolyl isomerase
  misc_feature: Useful for making plants with altered alkaloid content
  misc_feature: Useful for making plants with modulated flowering time
  misc_feature: Useful for making plants with altered lignin content
  misc_feature: Useful for making plants with modulated nitrogen use efficiency
  misc_feature: Useful for making plants with modulated biomass
  misc_feature: The sequence is a functional homolog of SEQ ID NO 1042 in the 10/374,780 US patent application
  misc_feature: The sequence is a functional homolog of SEQ ID NO 852 in the 10/666,642 US patent application
MAAADVEYRCFVGGLAWATDNASLQQAFASYGDVLDSKVITDRETGRSRGFGFVTFSTEQSMLDAIEAMNGKELDGRNITVNQAQSRGGGGGGGGYGGGRQGGYGGGGGRREGGYGGGGYDGGGGGYGGGRREGGYRAAGSCIRGISGGYWRG

SEQ ID NO: 31400 - DNA, 632 bp, Panicum virgatum
  misc_feature: Ceres CLONE 1905171
  misc_feature: Encodes the peptide sequence at SEQ ID NO. 31401
gccgcatctccgcggcgcggtccttcccgacgagccgccgccgccgccgctccccctccatcggccagggagaagatggagggagctggcaaggatggcaacccgctgaggaattaccggattggtaagactctggggattggttcattcggtaaggttaaaattgcggagcatataggtactggacacaaggtggcaatcagcatcctcaaccgtcgtaaaatcagaggcatggagatggaagaaaaagttaagagagagattaaaatattgaggttatttatgcacccacatatcattcgcctctatgaggtcatagacacgccggctgatatttacgttgttatggagtatgttaagtccggggaattgtttgattacattgatgagaaaggtaggttgcaggaggacgaggctcgccgtttcttccaacagattatatccggtgttgaatattgccatagaaacatggtggtgcatcgtgatctaaagccagaaaacctcctattggattcaaaatgcaatgttaagatagcagattttggtttaagtaatgttatgcgggatggtcattttctcaagacaagctgtggtagcccgacttatgctgctcctgaggtgatatctggtaa

SEQ ID NO: 31401 - protein, 185 aa, Panicum virgatum
  misc_feature: Ceres CLONE 1905171
  misc_feature (14)..(185): Pfam Name: Pkinase Pfam Description: Protein kinase domain
  misc_feature: SWISSPROT Homolog: EC 2.7.11.1 Non-specific serine/threonine protein kinase
  misc_feature: Useful for making plants with modulated salt sensitivity
MEGAGKDGNPLRNYRIGKTLGIGSFGKVKIAEHIGTGHKVAISILNRRKIRGMEMEEKVKREIKILRLFMHPHIIRLYEVIDTPADIYVVMEYVKSGELFDYIDEKGRLQEDEARRFFQQIISGVEYCHRNMVVHRDLKPENLLLDSKCNVKIADFGLSNVMRDGHFLKTSCGSPTYAAPEVISG

SEQ ID NO: 31402 - DNA, 1838 bp, Panicum virgatum
  misc_feature: Ceres CLONE 1905179
  misc_feature: Encodes the peptide sequence at SEQ ID NO. 31403
agagggatcccgtccgcgtccatccaccgcccgtcgtgccccgtgggaagggaagagcagcgagcgacgcaggcaggcaggcatcggctccggctccgcccgccgccgcaccgccccccccccccacctcccccgatccgatcgccgatcgccgaccctcgcttcgcctcgccgcgcggcaatatttggaaccctcgtcaccgatcgcctcatgccgtatcactgaccgatcccctcacaactccgcccttccacctccgcgccgccgttcgcgcagtcgcctccaccccatagaactcgctatctcccgtgtgatttcggtgcggacgatggctaccagcgccgacccgcatgctgccgttgatggggccgggacgccgcccccgtccgatagcccgtttgaggcgaagaaggctggggcggccgcggccgcctggaagcgccccgggggcgcgactgtgccagccgcggtggcggttgaaaaccccatcatggacacgaactcgtggccggcgctgccggggctggcgtctcccccgccgccgccggccaaggcgtcacctaaggccacttctcccgcttccacaggggcggtgatctcgccggtctctttgggcatttccggtgctccggatgctaaccctggcaatgagactcctgtgcgcaatcctgtggcccggcgtgccctggtgatgcctgtggcagatgggctggagaagagtgcccctgccacagaaccgtcccctgtctatgcgcctaatgcccggagcaacggcggagattttcatcatcagaatggacgttttggttcccataaccatagtcgagggggtggctatggtgggggaaacaggaggggcaatggtggaggtgggggacgacgtgggaatgagcaccatgggggctttgatgggccacggcgaggaggtggccgcagagatggccatggaccagctcaccagcagcgtggccaccagccaacatacattagggctcctcctgctctggctgttgtaacaggagcacctccgccgccgccacctttccttagccctactactcagacaccaccttatggggtacctatgggcttccctgacatagcaccgcatgtttactattttgcgccggcagcccccacggaaggcattcaaggcctgccttttgtgcctcatccagcaagcccccaagctattttagttgatcctcatcggaaggagcttctggagcaaattgattattatttcagtgatgacaatttgtgcaaggacccatacttgcggcaacacatggatgaccaaggttgggtgccattatccctgattgctggcttccgcaaagtccagaagctgactgataatattcagtttatcttagaaacagtcatgatgtctactgttgtggaagttcagggtgataaactacgaaggcgtggaacatgggagaattggctgcttccaaaaccaaattattctgctggaagttctggtccgttgacccctgtgacatctaacactgatttgctggtatctcagtttcattctgttggacttgagggggcaacttaccatgctaatatgcaaggaatgcctggtgaagctcttctgactagatcagtgacttcagtcagtctaggttatcatgcaccaaccttgggcgggctacacaacattgggagtggaccacgttttggaccaaaggcagcaagaaatttactccggagcgataccttttgaggctatatattcaaggaatatgaagtacaatggcaggccgagttttcacagtgacggcatgcacaccttaccttgtatgaggtgtaaagatcagttggtttt

SEQ ID NO: 31403 - protein, 468 aa, Panicum virgatum
  misc_feature: Ceres CLONE 1905179
  misc_feature (298)..(355): Pfam Name: La Pfam Description: La domain
MATSADPHAAVDGAGTPPPSDSPFEAKKAGAAAAAWKRPGGATVPAAVAVENPIMDTNSWPALPGLASPPPPPAKASPKATSPASTGAVISPVSLGISGAPDANPGNETPVRNPVARRALVMPVADGLEKSAPATEPSPVYAPNARSNGGDFHHQNGRFGSHNHSRGGGYGGGNRRGNGGGGGRRGNEHHGGFDGPRRGGGRRDGHGPAHQQRGHQPTYIRAPPALAVVTGAPPPPPPFLSPTTQTPPYGVPMGFPDIAPHVYYFAPAAPTEGIQGLPFVPHPASPQAILVDPHRKELLEQIDYYFSDDNLCKDPYLRQHMDDQGWVPLSLIAGFRKVQKLTDNIQFILETVMMSTVVEVQGDKLRRRGTWENWLLPKPNYSAGSSGPLTPVTSNTDLLVSQFHSVGLEGATYHANMQGMPGEALLTRSVTSVSLGYHAPTLGGLHNIGSGPRFGPKAARNLLRSDTF

SEQ ID NO: 31404 - DNA, 1878 bp, Panicum virgatum
  misc_feature: Ceres CLONE 1905180
  misc_feature: Encodes the peptide sequence at SEQ ID NO. 31405
agctgctcttatactgtacatggtgtggcggccgtagagacagagagagcccgcgcgcgaggaagaagaggtcgtcggtggactccggcagcctcacccaaatctcatcgacccggcaaccgggagagacgagtgagtgaacgactctcccagtcccagctgcctctcgtcatcggcgtttgctaggtcgcgctgccacgcgggccccgcccccgccgcttggcttagctggtcggccgtggacacggtcgggcgcgcgcgcgaataatatagcaggcagctggcagcggcagcgcccgagctcgatcagaccgcgtctcgtctgccggagcatggccgggcgcgaccgccgcggggccctgtcgccctcgtcgtccgggcggctcacgccggagcaggggcggcgctgggcgtggagccccgcatggtcgcgcccgctctccgaccgcggcaccaccagcagcagctcgtcgtcgtcgtcgtcgtcctcatcttcatctttgaggtccctgttccgctccatcggggtctggttcacctcgctctcctcctcctccaccaccaccacgtcgtcggcctccaggaggcggcggatcaaggaggccgcgccggcggcggttgacgtgatcaagaagccgccgttgccggcgcagaccggggggaagccgtccgcccgcgggctctaccggaacggcagcggccggcggcagcagcagcagctgcgcccgtcgttccagagctccgtcttctccatggaggagatcctccgagccaccaacaacttctcgccggcgctcaagatcggccagggcggcttcggggccgtttacaagggcgtcctccccgacggcaccgtcgtcgccgtcaagcgcgccaagatgcggatgcagaaccctcacgtggacgtggagttccgcagcgaggtcaagatcatggcgcgcatcgagcaccagagcctggtgcgcttctacggctacctggagtgcggcgaggagcgcatcgtcgtcgtcgagtacgtccccaacggcaccctgcgggagcacctcgacaggtgccacgggcggttcctcgacttggggacgcgcctcgacgtcgccatcgacgtcgcccacgccgtcacctacctgcacatgtactccgaccaccccatcatccaccgcgacatcaagtcctccaacatcctcctcacccactcgctccgcgccaaggtcgccgacttcggcttcgcccgcctcggctccggcgccggcgccggcgaggccacgcacattaccacgcaggtcaagggcacggcggggtacctggacccggagtacctcaagacctgccagctcaccgaccgcagcgacgtctactccttcggcgtgctcctcgtcgagctcgcctccgcgcgccgccccatcgagaccaagcgcgacatcaaggagcgtctcaccgcgcgctgggccatggccaggttcatcggcggcaccgccgccgccgtgctcgacccgcacctcgcgcgcacgcccgccgcggagcgcgcgctggagatgctgctggagctcgccttccggtgcatggggcccgtcaggcaggacaggcccgccatgagagactgctgcagggcgctctgggccatcaggaagacatacagggacatgctcgccgccgccgccgtcacccccagcactccgaccgactcaccggcgccggcgacctctggaggacctgatgcctgcactgcatcatccaacgcaacaaacactattattgctactactaactgattggtttgactgacaataactctgctctgctctgctctgctgtaaatatagaccaaccagccaaacaattcttgttgcatttgttcttatcaattacattttactagcc

SEQ ID NO: 31405 - protein, 478 aa, Panicum virgatum
  misc_feature: Ceres CLONE 1905180
  misc_feature (151)..(429): Pfam Name: Pkinase Pfam Description: Protein kinase domain
  misc_feature: SWISSPROT Homolog: EC 2.7.11.1 Non-specific serine/threonine protein kinase
MAGRDRRGALSPSSSGRLTPEQGRRWAWSPAWSRPLSDRGTTSSSSSSSSSSSSSSLRSLFRSIGVWFTSLSSSSTTTTSSASRRRRIKEAAPAAVDVIKKPPLPAQTGGKPSARGLYRNGSGRRQQQQLRPSFQSSVFSMEEILRATNNFSPALKIGQGGFGAVYKGVLPDGTVVAVKRAKMRMQNPHVDVEFRSEVKIMARIEHQSLVRFYGYLECGEERIVVVEYVPNGTLREHLDRCHGRFLDLGTRLDVAIDVAHAVTYLHMYSDHPIIHRDIKSSNILLTHSLRAKVADFGFARLGSGAGAGEATHITTQVKGTAGYLDPEYLKTCQLTDRSDVYSFGVLLVELASARRPIETKRDIKERLTARWAMARFIGGTAAAVLDPHLARTPAAERALEMLLELAFRCMGPVRQDRPAMRDCCRALWAIRKTYRDMLAAAAVTPSTPTDSPAPATSGGPDACTASSNATNTIIATTN

SEQ ID NO: 31406 - DNA, 621 bp, Panicum virgatum
  misc_feature: Ceres CLONE 1905181
  misc_feature: Encodes the peptide sequence at SEQ ID NO. 31407
aaagcacgggcatagcggccttcctctgtcgcgtccttccgcccgaaggaagcgaacgaaagccccccaaaacagccttcaaccgcgtccgcgtccgcgtccgccttcttctccttcaccgcacacacaggcaggctcccgacgcgcctccgccggccgcgcgcggttgccctgccctctctccgccgctcctccaccggtttctccaaccatgtataataactatgggaaccctcctgggatgcagatgccacagcaaaattctcagcctggccagtttaacaatccattatatggtgcaagctcaggtctaattagatctgggctaggagtatatggggagaagttcttggattctagttcagaattcatgcaaagcaatatcaatagatacttctccaacccgcagtattacttccatgtgaatgatcaatatgtcaggaacaagttgaaagttatattgtttccattctttcacagggggcactggactcgtataagtgaacctgttggtgggcgtttgtcctacaaacctccaatctatgatataaatgcaccagatctgtacatccctttcatggcatttggaagcggcaagtagcaagaaatgctcaaggtttg

SEQ ID NO: 31407 - protein, 129 aa, Panicum virgatum
  misc_feature: Ceres CLONE 1905181
  misc_feature (34)..(129): Pfam Name: YIF1 Pfam Description: YIF1
MYNNYGNPPGMQMPQQNSQPGQFNNPLYGASSGLIRSGLGVYGEKFLDSSSEFMQSNINRYFSNPQYYFHVNDQYVRNKLKVILFPFFHRGHWTRISEPVGGRLSYKPPIYDINAPDLYIPFMAFGSGK

SEQ ID NO: 31408 - DNA, 1743 bp, Panicum virgatum
  misc_feature: Ceres CLONE 1905184
  misc_feature: Encodes the peptide sequence at SEQ ID NO. 31409
ctctctctctctctctctctctctctctctgcatacaacacagggaactagagccatggctactccgaagaagacgatgagagccctgcagtacgacaagtatggcggaggagcagaaggtctcaagcatgtggaggtgccggtcccgtcgccgaagaagggggaggtgctgctcaagctggaggcggccagcatcaaccctatcgactggaaaattcagaagggcatggtccggcccttccttcccaggaagttccccttcataccaggtacgttacctatctgaacggaacatatcggtatacacagcggcacagcgcctgactgcatcagtacccagtacagtacattacatagcctgtacggaacgtcgatctgggtggtacctcataactagtgcttgttaagaaattggtacgatctgaagagaaatggtttcatgctttgtgaaagaaaactgaagagatcataaaaccaaattgttttagatgcagatatcgtaaagcagtaggtacagtctggatcaatttagatgctctgttgtcacagcactactacggctcaagattcctaaaacactagatcttattatgcggcaatactagttggtgatggatgctgattttcaaaagaaaaagtaatctttcaaaaagaaaaagaaaaaagtgatattacttggagcggtgaaggttggccatgagcataaatcatgagagagcagtgtgataaatcagatgaggtgtcctctgctttccttttccttgagcatgaatcatccatccatcaggtgaccactgtgaggaacgagagtactctatcctgcttgtgataagtgaattgtcaaccgtgcggtgtgatcgtgcgcttggtctttggattgcaggtacacgggcgtcgagtgtcgacggggagctgccgtggaggtgctgtggccgatggaccgtgcggtggacggcggtgaagggcagccgggaccggagctcggaccgggcggcagctgtggcgtccactactggatcgagggcgcaagcggcgacggaaggcggatttcttggtttgcgccacaaaaccaaggaggcggacggcggttgaagacgccaagtcgtggaggcacgggcgtcggtctcgggactgacggaggcgacgggcgtcgacggcgtctagggcctcgctgcgggcgaggaggtgacgggcgtcgggcggcgtctagggctgtcagaaggccgaggcgggaacggcgtctagggccacggcgcggaggcgggaatcttcccgcgcgtgaggttttggcggttttctcaaaaccggccacctacccgggtttcgcggaccctccaaaaccgcggactggatcttcatcaagacggcggcatcgcggagaagacttcgtttcgaagaaagaacctcggccgtcggatgagatcgttgtacagggggtgctgcaggccaaccggtctgaccggtccctggcaccggtctgaccggtctaaccaaccggtcagaccggtccagcgtaccggtctgaccggtcccgcgggtataaataccccttcacttgtgttaggttaattacggcttttgtaatctgttcgtggactctctgtttctccaggccgccgcccctgcgtctccctccctctgttcttctcgtttgagttgattttgtccatggattgttgaaactttgtaagggatttgattgggaaaggaggccctatcctcctcgtgccctctgggcttttg

SEQ ID NO: 31409 - protein, 76 aa, Panicum virgatum
  misc_feature: Ceres CLONE 1905184
  misc_feature: SWISSPROT Homolog: EC 1.6.5.5 NADPH:quinone reductase
MATPKKTMRALQYDKYGGGAEGLKHVEVPVPSPKKGEVLLKLEAASINPIDWKIQKGMVRPFLPRKFPFIPGTLPI

SEQ ID NO: 31410 - DNA, 2356 bp, Panicum virgatum
  misc_feature: Ceres CLONE 1905224
  misc_feature: Encodes the peptide sequence at SEQ ID NO. 31411
ctcccccaacccgaatcccatttccaaaccgcccgctcgtctcctcgagaacgcccccggatcccctcctccccggacggagaccccccagatcgcagccatggagccggatcctgtcgccgtgggggcttcctcctcgccgccggccgcgtctccgccgcggcagctgccaccgccaggtgacgacgagcgcggcgcgggggagtgcgcggatgccgcgaggccagatcagcgcgcgtccggaggagacccgaacgacgcgccgccgccgtcgcccgcatcggccgcgccgcagccgtcgcctcaggagcccacaggtgaggacacggcggcgagctgcgaggtggagcaggagcaggagaaggagaaggagaaggaggtggtccccggagtaggggaggctctccgcgtcttcatggaggagtttggagaagaagacaacacccttaccctgtcaccgctgcttaaggagatcactactcctgatggcgctgctgccctccgcttccttgggggaaagtataacagcatcttggagaggtacaaacagcaggtggccaaatgtgctgatcagtgcgaacctagatatgatgacctgaagaagaagtacacagatgagtgcgctgagaggaagcgtctatacaatgaacttattgagctgagggggaacataagggtgttctgcagatgcaggcctctgagctctgatgagatcacccgtgggtgctcgtctgtggttgagattgactcatcacaagagaacgagctgcagttcgtcccctctgaaaaagaaagaaaagccttcaagtttgatcatgtttttggtccaaaggatgatcaagagaccgtattttcagagaccgtacccattgttaggtcagtgatggacgggttcaatgtatgcatatttgcttacggacaaacaggaaccgggaaaacctttacgatggaaggggttccagaaaataggggtgtaaattatagggctttggaagaattgttcaaaatatcagaggagaggactacgtctgttgcatacaccttcttagtaagcatattggaagtctataatgaaaaaatcagagatctgcttgatgagagcaatgatcaatcaaaaaggttggatgttaagcaaagtgccgatgggacacaagacgttgctggtttagttgaggctccagtttataacatagatggtgtgtgggagaaactgaaatttggctcccgaaacagatctgttggatcaaccaatgcaaatgaactcagtagccgctcccactgtttggttagggttactgttaagagcgagcatttgttgacgggtcaaaggagcagaagccaaatgtggttggttgaccttgctggaagtgagagagtaggtaaaactggagtagaaggtgataggctgaaggagtcacagtttatcaacaaatcactctctgccttgggtgatgtcatatcagctctggcatcaaaacattctcatatcccatacaggaactccaagctgactcatttgctccaaagttcattaggtggagattgcaagacactaatgttcatacagataagtccaagctctacagattcaggagaaactctctgttccctaaattttgctagtagagtccgggctgtagaacatggccctgctcgtaagcaagcggatccagctgaaagtttgaagttcgaacatatgtctgaaaaacttcggcatcaggaaaaagaaatcgcgcagctgaatcaaagcttgcagttgatgcaactcaagtatgcatctcgtgagaatgtgttcaggacactaaatgagaaggtgaaggatgctgaacaagcatgcaaaaatcatcagcagcggattagagagctggaaaatgaattaggtaatgagaagaaggctgctaaggattctgctagatcttcaaggccaccgcttgttcctacgagacagagacaacctcaaggaaggaataacaactatgcaccaccttcaggtccttctaggtcaaggttcagtaaagcaccgacaattcaaaacaaagagaacattcctgtgacgatgagcaaagcatatcctggggctgatcctaataaggctgttggcaaagcaaggcgtgtatctctgactccgatgatccggcaaattcctatccagcctaaaaggcgttcctcaatggcgatattaccatctctaagagagcagctgtctgtgctcaatgaaaagagagcaggatctcgactttctcatgcccatgtgcctagaagatcaattccagcaacaccccttcctggccatgggacagttgatgcaaccccagatggagcaaagttgaggagaattgattttggcagcagcagc

SEQ ID NO: 31411 - protein, 751 aa, Panicum virgatum
  misc_feature: Ceres CLONE 1905224
  misc_feature (196)..(514): Pfam Name: Kinesin Pfam Description: Kinesin motor domain
MEPDPVAVGASSSPPAASPPRQLPPPGDDERGAGECADAARPDQRASGGDPNDAPPPSPASAAPQPSPQEPTGEDTAASCEVEQEQEKEKEKEVVPGVGEALRVFMEEFGEEDNTLTLSPLLKEITTPDGAAALRFLGGKYNSILERYKQQVAKCADQCEPRYDDLKKKYTDECAERKRLYNELIELRGNIRVFCRCRPLSSDEITRGCSSVVEIDSSQENELQFVPSEKERKAFKFDHVFGPKDDQETVFSETVPIVRSVMDGFNVCIFAYGQTGTGKTFTMEGVPENRGVNYRALEELFKISEERTTSVAYTFLVSILEVYNEKIRDLLDESNDQSKRLDVKQSADGTQDVAGLVEAPVYNIDGVWEKLKFGSRNRSVGSTNANELSSRSHCLVRVTVKSEHLLTGQRSRSQMWLVDLAGSERVGKTGVEGDRLKESQFINKSLSALGDVISALASKHSHIPYRNSKLTHLLQSSLGGDCKTLMFIQISPSSTDSGETLCSLNFASRVRAVEHGPARKQADPAESLKFEHMSEKLRHQEKEIAQLNQSLQLMQLKYASRENVFRTLNEKVKDAEQACKNHQQRIRELENELGNEKKAAKDSARSSRPPLVPTRQRQPQGRNNNYAPPSGPSRSRFSKAPTIQNKENIPVTMSKAYPGADPNKAVGKARRVSLTPMIRQIPIQPKRRSSMAILPSLREQLSVLNEKRAGSRLSHAHVPRRSIPATPLPGHGTVDATPDGAKLRRIDFGSS

SEQ ID NO: 31412 - DNA, 351 bp, Panicum virgatum
  misc_feature: Ceres CLONE 1905224-R
gctctgcgtgagcagatggtggtggggagaacagaaaatgcaatgcgggtgctcaataccaagagaagacaatcagttatttagctctgttgttctggaagcaaaagatacagtgaatgtttggacgttcaaacggatctgtaagagtctgggagtgagctttgttgataaggaaaccgtgttagaactcaagatgttctttttatcatcattataatgattgtgcttagctattactagttgataagaaaaccgtgttagcattttcatggaaatctgtgattgtattaattcgttaccaaagaagcactagccagaatttcctgaatttcgactctcgtctgttcattt

SEQ ID NO: 31413 - DNA, 1850 bp, Panicum virgatum
  misc_feature: Ceres CLONE 1905225
  misc_feature: Encodes the peptide sequence at SEQ ID NO. 31414
atctccccgacgtggccgccgcctaaaccccacgcgctcccccaactctctaaaccccgacgagccgccgccgggttcttcttcctccgcaagccacctcgccgccgccgccagggccacgatggggagcagggtggccgcggcgctgctccggcgtggcagggaccaggcctcggccatgatgatcccccgcctggccccgaggagcgcccccgcccccgcccccgctgttcccaggatcggatccggctccggctccggctccggctccggcggccgcggcggatgcctcctcccgccgcggccgggtgcgacgggggccttctcctccgcttcccgattcgcccccttccacgccttccgctccctcgcccccaagaccttactgggccaatgcacaagaaaaatgtcaactgccacagcagcattgaattcaacgatggtcaatggagcagtgaattctggattaaagctgcttgttacaaaagggcctcaagcacagaaggctattgggatatggctttttggctgtgctgcctgggtctttagtctggtcatcctcggaggaataactcggcttacacgttctggtctgtcaatgactgattggaagttcactggggaaatacctccagcatcaaatgaggcctggctgcttgaatttgagaaatacaagcagtcgcctgagtacaagagggtgaacaaaggaatgagccttgaggattttaaatttatatattggatggagtatgcacacagaatgtggggaagagctttgggctttttatttgcgggtccttttgcgtactttattgcgaaagggtatgttacccgccaacttgggctcaggctgtcagctctatttgcacttggtggtgctcaagggttgattggctggtggatggtgaaaagtggtcttgaggaaccaacatctgagtatgttcaacccagggttagcccttacaggttggcaactcatctaacatctgcttttgttatatactgtggtatattgtggactgctttgtcagtagtgatgccagatcctccaacgggatcaatgagttgagtaaatggtgcagcaaaaattaggaagttggctattcctgtcagtgccgtcgtaggcattactgccatatctggagcatttgttgcaggcaacgatgcagggcatgcatacaattcattcccaaagatgggtgacacttgggttcctgaagatgtatttagtatggagccttttgtacgcaatttttttgagaatacatccactgtgcagctcaatcaccgaatccttgcaacaaccacattattgtctgtggctggattatggctggctgcaagaaaaatagacatgcatccagcagtcaagtcactgattgggagcacacttgggatggctgctcttcaggttacgttgggcatatcgacactcttgatgtacgtccctacatcattgggctcagcgcaccaagctggagcattaactctattgtcacagatgattcttctcactcatactttaagaaggccgtcaccaactcttcttaaatcgcttgcggctgctgcgaaacaaacctgatactacgccttgaaaattttcgtacaacaatttaccctactaacatgcatggctgcccttgtttctttgcaccccacccgactactgaagcttttggccagaaaagcatgctacgcttgaataaagtgtccttcatgatagtgctgagtattagaatatttaatttttaacacattctgttttgacatgtgaactcttgtaccattgtgcccgtggaagcggatggatttgtaccctgagcttgtacacaagcctcagttccctttcg

SEQ ID NO: 31414 - protein, 315 aa, Panicum virgatum
  misc_feature: Ceres CLONE 1905225
  misc_feature (120)..(315): Pfam Name: COX15-CtaA Pfam Description: Cytochrome oxidase assembly protein
MGSRVAAALLRRGRDQASAMMIPRLAPRSAPAPAPAVPRIGSGSGSGSGSGGRGGCLLPPRPGATGAFSSASRFAPFHAFRSLAPKTLLGQCTRKMSTATAALNSTMVNGAVNSGLKLLVTKGPQAQKAIGIWLFGCAAWVFSLVILGGITRLTRSGLSMTDWKFTGEIPPASNEAWLLEFEKYKQSPEYKRVNKGMSLEDFKFIYWMEYAHRMWGRALGFLFAGPFAYFIAKGYVTRQLGLRLSALFALGGAQGLIGWWMVKSGLEEPTSEYVQPRVSPYRLATHLTSAFVIYCGILWTALSVVMPDPPTGSMS

SEQ ID NO: 31415 - DNA, 744 bp, Panicum virgatum
  misc_feature: Ceres CLONE 1905233
  misc_feature: Encodes the peptide sequence at SEQ ID NO. 31416
atctcacggccatatccgcctgtatgctccttctccaagatccatccctgcagctaggatccttcaagagttcttctccagaagcctcgatttgtagcaggtcagatccatagctactccaatcatcagaaatggcgagcctgcagagccaggagagtcttgcgagtacattaccgacaaacctaccagcaacctttatgaaggaaattaccgccgattttgcttctgagcgagaacttggccgctctgtatttggaatagcttacaaggtaaatgatcaggccctaacatttaaacatcaaattcttcgatacaaaacccttgtactaatgatccatggaggaggttaaattaacagggtgttcttccagagacagaagggaaccgcatgattgctgtgaagaggcttgctgaaaactcacctgtgccggctggcaaaacatttgaaactgaggttacaaatcttatggcacttaaacacagaaatgtagtagagctggttagcttctgccacgaagcgcagaagaaagtagttcagcataatgggagatatgtgattgtagacgtgatcgaaagctgtctttgctacaaatatctaccaaagggaagtcttgacaagcatctttatggtatgcaatgccctatcccacacatttgtcttctgtttgtactattgatacttgagatgtaaacaaatgtgtgatattgatacttgagatgtaaacaaatgtgtgatacatcatg

SEQ ID NO: 31416 - protein, 100 aa, Panicum virgatum
  misc_feature: Ceres CLONE 1905233
  misc_feature: SWISSPROT Homolog: EC 2.7.11.1 Non-specific serine/threonine protein kinase
MIAVKRLAENSPVPAGKTFETEVTNLMALKHRNVVELVSFCHEAQKKVVQHNGRYVIVDVIESCLCYKYLPKGSLDKHLYGMQCPIPHICLLFVLLILEM

SEQ ID NO: 31417 - DNA, 1547 bp, Panicum virgatum
  misc_feature: Ceres CLONE 1905248
  misc_feature: Encodes the peptide sequence at SEQ ID NO. 31418
ctaatatttgattcccattttacccctgccttccgaaaccatccagttggttcgccctcgaaccaggggtaaaacggcgacactaaaacctctcccatcgctcgcttcgaacccatcgccaccgcggccgctacgcccccacaccaccacgaggccgcgaaatctggcgcccccgattccggcggccgcgatgcagagctcgctcgcgcggccgctgcgtccgccggtatgggctggccgcggtgggagcggcgacccgcgcggcgcggtctccgtggtgcggtgccgcgccgaggcggcgccgccggtgggcacggcggctaaggcgccggtggggccgtacaccgggagggaccccgaggtgaagaagcccgcgtggctgcggcagcgggcggcgcaaggggagaagtacgcgcgcctgcgggagtccatcggcgagctcaagctcaacaccgtctgcgtcgaggcgcagtgccccaacatcggcgagtgttggaacggaggcggaggggccggcggggaaggggatggcatcgcgacggccacgatcatggtgctcggcgacacttgcacgcgcggctgccggttctgcgctgtgaaaaccagcaacaagccgccaccccctgatcccctggagcctctgaacacggctttggctgttgcaagctggggagtagattatgttgtgctaaccagtgtcgatagagatgacttacctgatggtggaagtagccattttgctcagacagtgaaagctttaaaggagctcaaacctgggatactggtggagtgcttaacctcggatttccgaggtgacctggaagctgtctcatctttggcaaactctggtctagatgtctatgcacacaacattgaaacagtgaggagtctacagcgaattgtgagggatcctcgagcaggatatgatcagagcatggcagttctcgagcatgcaaaaagttgcagggaaggcatgattacaaagtcttcaatcatgcttggtcttggagagactgatgaggaggtgagacaaaccttgatggacttacgggccattggtgttgatattcttactttgggccagtatttacagccaacagaaagacatttaacagtaagagagtatgtgactcctgagaagttccagttttggaaggagtatggagaatcagtgggtttccgttatgttgccagcggacccttggttcggtcttcgtaccgtgcaggagagctctttgtccaaaatttggtcagaaatagcaaaactgtatcttcctcgtcttaaccaaatatcttctgctgaagcaatccgtgggatccatacatactggacttaagagcagcaaaacaagagtaggacgggcagaatcattcgattctcatgaaagctgagccccggtttttgttttcttttctttcgggatgttgcatacacttttgctcgctgccgtagttgcccctgttgaatggagaaaaacgaggataccgaatcttttctgtatcatttactttgacaccttatacgaaaagctgttcgaaaatagtcc

SEQ ID NO: 31418 - protein, 364 aa, Panicum virgatum
  misc_feature: Ceres CLONE 1905248
  misc_feature (121)..(286): Pfam Name: Radical_SAM Pfam Description: Radical SAM superfamily
  misc_feature: SWISSPROT Homolog: EC 2.8.1.8 Lipoyl synthase
MQSSLARPLRPPVWAGRGGSGDPRGAVSVVRCRAEAAPPVGTAAKAPVGPYTGRDPEVKKPAWLRQRAAQGEKYARLRESIGELKLNTVCVEAQCPNIGECWNGGGGAGGEGDGIATATIMVLGDTCTRGCRFCAVKTSNKPPPPDPLEPLNTALAVASWGVDYVVLTSVDRDDLPDGGSSHFAQTVKALKELKPGILVECLTSDFRGDLEAVSSLANSGLDVYAHNIETVRSLQRIVRDPRAGYDQSMAVLEHAKSCREGMITKSSIMLGLGETDEEVRQTLMDLRAIGVDILTLGQYLQPTERHLTVREYVTPEKFQFWKEYGESVGFRYVASGPLVRSSYRAGELFVQNLVRNSKTVSSSS

SEQ ID NO: 31419 - DNA, 725 bp, Panicum virgatum
  misc_feature: Ceres CLONE 1905251
  misc_feature: Encodes the peptide sequence at SEQ ID NO. 31420
gtcgcgccagtcagtccacttgctctggcaaacgcaacggcaaacggattcccctctccgtctctcgtaccgcccgccgctagcagcccccccgcgccggagtcgccgccgcgatggcctcccgatccgccggggccgtcgggcccctcctcctcctcctggccgccgtcgcgatcgcgggctccgccgcctccgccggggcaggggagaggaagtggcgggaggagcaggcgcgggaccgggtgccgcgggtgccggggcagggcttcaacaccagcttcgcgcactacgccgggtacgtcaccgtcagcgagccgcgcggcgccgcgctcttctactggttcttcgaggccgagaaggacccggggtccaagcccctcgtgctctggctcaacggagggcctggatgctcatccattgcctatggacttggagaagaagtgggacctttccatgttaatgcagatgggaaaggggtgcatatgaatccttattcttggaacaaagttgcaaatttattgtttgttgattcacctgttggtgttggttactcatattcaaacacctccgatgatattttaagaaatggagatgcgaggactgccaaggattcattggaattcttactggagtggcttgaacgctttcctcagtataaggggcgtgaattttatttgacaggggagagttatgctggtcactacgttcctcaactggctcaagcc

SEQ ID NO: 31420 - protein, 203 aa, Panicum virgatum
  misc_feature: Ceres CLONE 1905251
  misc_feature (48)..(203): Pfam Name: Peptidase_S10 Pfam Description: Serine carboxypeptidase
  misc_feature: SWISSPROT Homolog: EC 3.4.16.6 Carboxypeptidase D
MASRSAGAVGPLLLLLAAVAIAGSAASAGAGERKWREEQARDRVPRVPGQGFNTSFAHYAGYVTVSEPRGAALFYWFFEAEKDPGSKPLVLWLNGGPGCSSIAYGLGEEVGPFHVNADGKGVHMNPYSWNKVANLLFVDSPVGVGYSYSNTSDDILRNGDARTAKDSLEFLLEWLERFPQYKGREFYLTGESYAGHYVPQLAQ

SEQ ID NO: 31421 - DNA, 687 bp, Panicum virgatum
  misc_feature: Ceres CLONE 1905285
  misc_feature: Encodes the peptide sequence at SEQ ID NO. 31422
agtctgggcaacatactcgagcggctcagaacctctatcctgctaccataaatggcatctggttgcttctcccctgataagtcacactgcccatcgacctggactaacaagccacatacgaccctatggtgcttatttgtcttggcactataacagtaaaagaaagtgtgacctaattactgttagatcactaccctggagcggccagcctgtagaatatttgacgccattcgaaatcccaaggagggactggttcagcgactatttcgtctttggctccgccacttcatcataccaaattgaacgtgcttgcaatgaccatggctagggtcccatcccttgcgaccacttctgccacacttatcctgaaaggatagttgatggaactcatgggaatgttgcattgaactcctaccatatgtatgaacaggatgtcaagttactgaagcgaatgggcatggacgcctataggttctcaatctcttggtctacaatactgcccaatggaacgctcgaacgtgggataaacaatcatggcctccagtactacagaaacctgatcaacacgttgaaatacaatggcatagagccgtatgtaacactttttcactgtaacactcctcaagcaatgtaagacaagtatggtatcttcagagatccgaggattgaataacactacacatactt

SEQ ID NO: 31422 - protein, 71 aa, Panicum virgatum
  misc_feature: Ceres CLONE 1905285
  misc_feature: SWISSPROT Homolog: EC 3.2.1.21 Beta-glucosidase
  misc_feature: Useful for making plants with altered cell wall content and/or composition
  misc_feature: Useful for making plants with altered carbohydrate content
  misc_feature: Useful for making plants with modulated biomass
MYEQDVKLLKRMGMDAYRFSISWSTILPNGTLERGINNHGLQYYRNLINTLKYNGIEPYVTLFHCNTPQAM

SEQ ID NO: 31423 - DNA, 650 bp, Panicum virgatum
  misc_feature: Ceres CLONE 1905307
  misc_feature: Encodes the peptide sequence at SEQ ID NO. 31424
atcttgcacaccgacacactgcttgcttgcttggatatcatcgatcgacctcatgcacattccctatcactactactagattgccgcgcgccggcgtccgcacgtgcgagatcatcatcaaggcaggatcagaacagcaatgaggaagccggagggtccagtggcggcgaacagctgcaatgcgggggcggcggcggcggcggcgaagctgcgcaaggggctgtggtcgccggaggaggatgagaagctggtggcgtacatgctgcggagcgggcagggctcgtggagcgacgtggcccggaacgccggcctgcagcgctgcggcaagagctgccgcctccggtggatcaactacctccggccggacctcaagcgcggcgccttctcgcggcaggaggaggagctcatcgtcagcctccacgccatcctcggcaacaggtggtctcagatcgctgcccggctgccggggcgcaccgacaacgagatcaagaacttctggaactccaccatcaagaagcggctcaagaacagctcctcggcctcgtcgccggcggccaccgactgcgcgtcgccggagcctaacagcaaggtcgccggcttcgacgtcagcggcgccgccagctgcccggacctcgccggcctggatcatc

SEQ ID NO: 31424 - protein, 170 aa, Panicum virgatum
  misc_feature: Ceres CLONE 1905307
  misc_feature (79)..(124): Pfam Name: Myb_DNA-binding Pfam Description: Myb-like DNA-binding domain
  misc_feature (26)..(73): Pfam Name: Myb_DNA-binding Pfam Description: Myb-like DNA-binding domain
  misc_feature: Useful for making plants with altered lignin content
  misc_feature: Useful for making plants with altered cell wall content and/or composition
  misc_feature: The sequence is a functional homolog of SEQ ID NO 2574 in the 10/374,780 US patent application
  misc_feature: The sequence is a functional homolog of SEQ ID NO 278 in the 10/225,066 US patent application
  misc_feature: The sequence is a functional homolog of SEQ ID NO 504 in the 10/666,642 US patent application
  misc_feature: The sequence is a functional homolog of SEQ ID NO 896 in the 11/435,388 US patent application
  misc_feature: Useful for making plants with modulated biomass
  misc_feature: The sequence is a functional homolog of SEQ ID NO 1065 in the 10/374,780 US patent application
  misc_feature: The sequence is a functional homolog of SEQ ID NO 1307 in the 10/412,699 US patent application
  misc_feature: The sequence is a functional homolog of SEQ ID NO 986 in the 11/435,388 US patent application
  misc_feature: The sequence is a functional homolog of SEQ ID NO 1004 in the 11/435,388 US patent application
  misc_feature: The sequence is a functional homolog of SEQ ID NO 1068 in the 10/374,780 US patent application
  misc_feature: The sequence is a functional homolog of SEQ ID NO 984 in the 11/435,388 US patent application
  misc_feature: The sequence is a functional homolog of SEQ ID NO 1010 in the 11/435,388 US patent application
  misc_feature: The sequence is a functional homolog of SEQ ID NO 156 in the 10/412,699 US patent application
  misc_feature: The sequence is a functional homolog of SEQ ID NO 164 in the 10/412,699 US patent application
  misc_feature: The sequence is a functional homolog of SEQ ID NO 1754 in the 10/412,699 US patent application
  misc_feature: The sequence is a functional homolog of SEQ ID NO 1978 in the 10/374,780 US patent application
  misc_feature: The sequence is a functional homolog of SEQ ID NO 353 in the 11/479,226 US patent application
  misc_feature: The sequence is a functional homolog of SEQ ID NO 369 in the 11/479,226 US patent application
  misc_feature: The sequence is a functional homolog of SEQ ID NO 40 in the 10/374,780 US patent application
  misc_feature: The sequence is a functional homolog of SEQ ID NO 776 in the 10/225,066 US patent application
  misc_feature: The sequence is a functional homolog of SEQ ID NO 569 in the 10/374,780 US patent application
  misc_feature: The sequence is a functional homolog of SEQ ID NO 200 in the 10/666,642 US patent application
  misc_feature: The sequence is a functional homolog of SEQ ID NO 830 in the 10/412,699 US patent application
  misc_feature: The sequence is a functional homolog of SEQ ID NO 1002 in the 11/435,388 US patent application
  misc_feature: The sequence is a functional homolog of SEQ ID NO 116 in the 11/375,241 US patent application
  misc_feature: The sequence is a functional homolog of SEQ ID NO 1648 in the 11/479,226 US patent application
  misc_feature: The sequence is a functional homolog of SEQ ID NO 2566 in the 10/374,780 US patent application
  misc_feature: The sequence is a functional homolog of SEQ ID NO 632 in the 10/225,066 US patent application
  misc_feature: The sequence is a functional homolog of SEQ ID NO 650 in the 11/435,388 US patent application
  misc_feature: The sequence is a functional homolog of SEQ ID NO 826 in the 10/412,699 US patent application
  misc_feature: The sequence is a functional homolog of SEQ ID NO 1626 in the 10/412,699 US patent application
  misc_feature: The sequence is a functional homolog of SEQ ID NO 979 in the 10/666,642 US patent application
  misc_feature: The sequence is a functional homolog of SEQ ID NO 266 in the 10/374,780 US patent application
  misc_feature: The sequence is a functional homolog of SEQ ID NO 536 in the 11/435,388 US patent application
  misc_feature: The sequence is a functional homolog of SEQ ID NO 640 in the 10/225,066 US patent application
  misc_feature: The sequence is a functional homolog of SEQ ID NO 856 in the 10/412,699 US patent application
  misc_feature: The sequence is a functional homolog of SEQ ID NO 1681 in the 10/374,780 US patent application
  misc_feature: The sequence is a functional homolog of SEQ ID NO 112 in the 10/412,699 US patent application
  misc_feature: The sequence is a functional homolog of SEQ ID NO 267 in the 11/479,226 US patent application
  misc_feature: The sequence is a functional homolog of SEQ ID NO 1565 in the 10/374,780 US patent application
  misc_feature: The sequence is a functional homolog of SEQ ID NO 2570 in the 10/374,780 US patent application
  misc_feature: The sequence is a functional homolog of SEQ ID NO 634 in the 10/225,066 US patent application
  misc_feature: The sequence is a functional homolog of SEQ ID NO 832 in the 10/412,699 US patent application
  misc_feature: The sequence is a functional homolog of SEQ ID NO 160 in the 10/412,699 US patent application
  misc_feature: The sequence is a functional homolog of SEQ ID NO 214 in the 10/225,068 US patent application
  misc_feature: The sequence is a functional homolog of SEQ ID NO 2270 in the 10/374,780 US patent application
  misc_feature: The sequence is a functional homolog of SEQ ID NO 361 in the 11/479,226 US patent application
  misc_feature: The sequence is a functional homolog of SEQ ID NO 462 in the 10/225,066 US patent application
  misc_feature: The sequence is a functional homolog of SEQ ID NO 482 in the 11/435,388 US patent application
  misc_feature: The sequence is a functional homolog of SEQ ID NO 1564 in the 10/374,780 US patent application
  misc_feature: The sequence is a functional homolog of SEQ ID NO 116 in the 10/412,699 US patent application
  misc_feature: The sequence is a functional homolog of SEQ ID NO 280 in the 11/479,226 US patent application
  misc_feature: The sequence is a functional homolog of SEQ ID NO 124 in the 10/412,699 US patent application
  misc_feature: The sequence is a functional homolog of SEQ ID NO 1742 in the 10/412,699 US patent application
  misc_feature: The sequence is a functional homolog of SEQ ID NO 1966 in the 10/374,780 US patent application
  misc_feature: The sequence is a functional homolog of SEQ ID NO 299 in the 11/479,226 US patent application
  misc_feature: The sequence is a functional homolog of SEQ ID NO 1074 in the 10/412,699 US patent application
  misc_feature: The sequence is a functional homolog of SEQ ID NO 590 in the 10/374,780 US patent application
  misc_feature: The sequence is a functional homolog of SEQ ID NO 726 in the 11/435,388 US patent application
  misc_feature: The sequence is a functional homolog of SEQ ID NO 170 in the 10/412,699 US patent application
  misc_feature: The sequence is a functional homolog of SEQ ID NO 1756 in the 10/412,699 US patent application
  misc_feature: The sequence is a functional homolog of SEQ ID NO 1980 in the 10/374,780 US patent application
  misc_feature: The sequence is a functional homolog of SEQ ID NO 750 in the 10/225,066 US patent application
  misc_feature: The sequence is a functional homolog of SEQ ID NO 2 in the 10/225,068 US patent application
  misc_feature: The sequence is a functional homolog of SEQ ID NO 22 in the 10/225,068 US patent application
  misc_feature: The sequence is a functional homolog of SEQ ID NO 230 in the 10/225,066 US patent application
  misc_feature: The sequence is a functional homolog of SEQ ID NO 258 in the 10/374,780 US patent application
  misc_feature: The sequence is a functional homolog of SEQ ID NO 442 in the 11/435,388 US patent application
  misc_feature: The sequence is a functional homolog of SEQ ID NO 842 in the 10/412,699 US patent application
  misc_feature: The sequence is a functional homolog of SEQ ID NO 98 in the 11/375,241 US patent application
  misc_feature: The sequence is a functional homolog of SEQ ID NO 1072 in the 10/412,699 US patent application
  misc_feature: The sequence is a functional homolog of SEQ ID NO 1073 in the 10/412,699 US patent application
  misc_feature: The sequence is a functional homolog of SEQ ID NO 588 in the 10/374,780 US patent application
  misc_feature: The sequence is a functional homolog of SEQ ID NO 589 in the 10/374,780 US patent application
  misc_feature: The sequence is a functional homolog of SEQ ID NO 730 in the 11/435,388 US patent application
  misc_feature: The sequence is a functional homolog of SEQ ID NO 1434 in the 10/666,642 US patent application
  misc_feature: The sequence is a functional homolog of SEQ ID NO 1850 in the 10/412,699 US patent application
  misc_feature: The sequence is a functional homolog of SEQ ID NO 848 in the 10/412,699 US patent application
  misc_feature: The sequence is a functional homolog of SEQ ID NO 1540 in the 10/374,780 US patent application
  misc_feature: The sequence is a functional homolog of SEQ ID NO 1634 in the 10/412,699 US patent application
  misc_feature: The sequence is a functional homolog of SEQ ID NO 2696 in the 10/374,780 US patent application
  misc_feature: The sequence is a functional homolog of SEQ ID NO 344 in the 10/225,066 US patent application
  misc_feature: The sequence is a functional homolog of SEQ ID NO 126 in the 10/412,699 US patent application
  misc_feature: The sequence is a functional homolog of SEQ ID NO 796 in the 11/435,388 US patent application
  misc_feature: The sequence is a functional homolog of SEQ ID NO 1031 in the 11/479,226 US patent application
  misc_feature: The sequence is a functional homolog of SEQ ID NO 1804 in the 10/412,699 US patent application
  misc_feature: The sequence is a functional homolog of SEQ ID NO 2050 in the 10/374,780 US patent application
  misc_feature: The sequence is a functional homolog of SEQ ID NO 444 in the 10/412,699 US patent application
  misc_feature: The sequence is a functional homolog of SEQ ID NO 598 in the 10/225,066 US patent application
  misc_feature: The sequence is a functional homolog of SEQ ID NO 620 in the 11/435,388 US patent application
  misc_feature: The sequence is a functional homolog of SEQ ID NO 1541 in the 10/374,780 US patent application
  misc_feature: The sequence is a functional homolog of SEQ ID NO 1635 in the 10/412,699 US patent application
  misc_feature: The sequence is a functional homolog of SEQ ID NO 176 in the 10/412,699 US patent application
  misc_feature: The sequence is a functional homolog of SEQ ID NO 385 in the 11/479,226 US patent application
  misc_feature: Useful for making plants with modulated nitrogen use efficiency
MRKPEGPVAANSCNAGAAAAAAKLRKGLWSPEEDEKLVAYMLRSGQGSWSDVARNAGLQRCGKSCRLRWINYLRPDLKRGAFSRQEEELIVSLHAILGNRWSQIAARLPGRTDNEIKNFWNSTIKKRLKNSSSASSPAATDCASPEPNSKVAGFDVSGAASCPDLAGLDH

SEQ ID NO: 31425 - DNA, 1841 bp, Panicum virgatum
  misc_feature: Ceres CLONE 1905329
  misc_feature: Encodes the peptide sequence at SEQ ID NO. 31426
gaatatatcaaacatgaagatacgctaacatgcatatgtcatatgtgtgagcatagctcagtaagtagctcactcatctctctttgcagctgaggtctgctcactctcatggcgcaaggtggcgagagttcgtgatggatgacaagtgatcatggtagagctccaccattcagacaagcacttgcatgtggaatccaaagccatgggagttgcaaccttcagctactgctttctttggtgagttggagaaggcccttatccatggcaattgtacttctgttgattctaccgtgatcagaagtgatgtggacacagagtttaagacagcaggataccttgcagctaggccccccacactggagatcttcccttcatggccaatgagtcatctacagcagctgtacagtggtaactcgcactcagtagggagcaccactgactcgagctcaggtcagaaaaatatgccgcaggccgagttggtgtcctcggggagtattagggccgactatgagcagcaacatgaggttttgatggtgaccgttgatgactacaactacgagcagggacttggagcggcagcaaccactgctccaatctttcagcagcatacagcgggccaagacaggaggaagaatggatccacaaggaaagatggcaagttgttagacgccaagactgaaaggcgattggctcaaaaccgagaagctgcaagaaagagtaggctgagaaaaaaggcctatgtgcagcaattagagacaagtcggattaggctgcaacaaatcgagcgagaactacagggtgcacgttcgcagggcctgttcgcaggaggcggcggcagcgcatcgggagatacgagttcaggcgctgtgatgtttgacatggagtacgcccgatggctagaagatgacagcaagctcatgacggagctccagggcattctgcaggctcaaaatctcgacgcaaacctcggggccattgttgaagagtgcatgcggcattacgatgagctgttccacctgagggctatgcttgcaagatccgacgtgttccacctgatgactggcttgtgggtgacgactgctgagcgatgcttcctctggatgggcgggttccgtccttctgaaatcctcaagatgctgatacctcagcttgatccacttacggagcagcagctgctggggatgtgccacctgcaacggtcatcgttgcagaccgaggaggcgctcgtgcaggggctccagcagctgcaccagtcactggcggacgcggtgggcgcgagtcctctcagcgacggcgcaagtgttgccaactacaccgctctcatggccctagcacttgacaggctcgacaccctcgagagcttttatcgtcaggcggacaacctgaggcagcagaccttgcagcacatgcggcggctcctgaccacccggcaggcggcgcggtgcttcctctccatcggcgagtaccgccgccgcctgcgcgccctcagctccgcctgggcttcctcccgtccccgcgagagcttcgtcgcggcagcgggggacgtcagccctacagctacaggggcggccgagcaagccgtccgtccgtacagcaaccacagccagtaagtagttttccggcttctgaagctttatctctgtctctctggtattcgggcgcggcggcgcggattctgccgtcgtctgcggcggcgaggggacagattgtggtaacgctctcccctgtggttgacgttgtaattcgtcgagaatggaacatcgaatccgtattcttcggtggcatcacttcggaaagaaaagagagagctcatggctctcgatcttgatttggcttgcttt

SEQ ID NO: 31426 - protein, 474 aa, Panicum virgatum
  misc_feature: Ceres CLONE 1905329
  misc_feature: Useful for making plants with modulated biomass
  misc_feature: The sequence is a functional homolog of SEQ ID NO 1498 in the 10/374,780 US patent application
  misc_feature: The sequence is a functional homolog of SEQ ID NO 1568 in the 10/412,699 US patent application
  misc_feature: The sequence is a functional homolog of SEQ ID NO 1792 in the 10/412,699 US patent application
  misc_feature: The sequence is a functional homolog of SEQ ID NO 2030 in the 10/374,780 US patent application
  misc_feature: The sequence is a functional homolog of SEQ ID NO 206 in the 10/225,068 US patent application
  misc_feature: The sequence is a functional homolog of SEQ ID NO 356 in the 10/412,699 US patent application
  misc_feature: The sequence is a functional homolog of SEQ ID NO 831 in the 11/479,226 US patent application
  misc_feature: The sequence is a functional homolog of SEQ ID NO 934 in the 11/435,388 US patent application
  misc_feature: The sequence is a functional homolog of SEQ ID NO 1496 in the 10/374,780 US patent application
  misc_feature: The sequence is a functional homolog of SEQ ID NO 1566 in the 10/412,699 US patent application
  misc_feature: The sequence is a functional homolog of SEQ ID NO 1794 in the 10/412,699 US patent application
  misc_feature: The sequence is a functional homolog of SEQ ID NO 2032 in the 10/374,780 US patent application
  misc_feature: The sequence is a functional homolog of SEQ ID NO 380 in the 10/412,699 US patent application
  misc_feature: The sequence is a functional homolog of SEQ ID NO 534 in the 10/225,066 US patent application
  misc_feature: The sequence is a functional homolog of SEQ ID NO 936 in the 11/435,388 US patent application
  misc_feature: The sequence is a functional homolog of SEQ ID NO 1788 in the 10/412,699 US patent application
  misc_feature: The sequence is a functional homolog of SEQ ID NO 2026 in the 10/374,780 US patent application
  misc_feature: The sequence is a functional homolog of SEQ ID NO 354 in the 10/412,699 US patent application
  misc_feature: The sequence is a functional homolog of SEQ ID NO 823 in the 11/479,226 US patent application
  misc_feature: The sequence is a functional homolog of SEQ ID NO 930 in the 11/435,388 US patent application
  misc_feature: Useful for making plants with modulated flowering time
  misc_feature: The sequence is a functional homolog of SEQ ID NO 1878 in the 10/412,699 US patent application
  misc_feature: The sequence is a functional homolog of SEQ ID NO 2138 in the 10/374,780 US patent application
  misc_feature: The sequence is a functional homolog of SEQ ID NO 372 in the 10/225,066 US patent application
  misc_feature: The sequence is a functional homolog of SEQ ID NO 878 in the 11/435,388 US patent application
  misc_feature: Useful for making plants with altered lignin content
  misc_feature: The sequence is a functional homolog of SEQ ID NO 1786 in the 10/412,699 US patent application
  misc_feature: The sequence is a functional homolog of SEQ ID NO 2024 in the 10/374,780 US patent application
  misc_feature: The sequence is a functional homolog of SEQ ID NO 352 in the 10/412,699 US patent application
  misc_feature: The sequence is a functional homolog of SEQ ID NO 819 in the 11/479,226 US patent application
  misc_feature: The sequence is a functional homolog of SEQ ID NO 928 in the 11/435,388 US patent application
  misc_feature: The sequence is a functional homolog of SEQ ID NO 1492 in the 10/374,780 US patent application
  misc_feature: The sequence is a functional homolog of SEQ ID NO 1562 in the 10/412,699 US patent application
  misc_feature: The sequence is a functional homolog of SEQ ID NO 1494 in the 10/374,780 US patent application
  misc_feature: The sequence is a functional homolog of SEQ ID NO 1564 in the 10/412,699 US patent application
  misc_feature: The sequence is a functional homolog of SEQ ID NO 1495 in the 10/374,780 US patent application
  misc_feature: The sequence is a functional homolog of SEQ ID NO 1565 in the 10/412,699 US patent application
MWNPKPWELQPSATAFFGELEKALIHGNCTSVDSTVIRSDVDTEFKTAGYLAARPPTLEIFPSWPMSHLQQLYSGNSHSVGSTTDSSSGQKNMPQAELVSSGSIRADYEQQHEVLMVTVDDYNYEQGLGAAATTAPIFQQHTAGQDRRKNGSTRKDGKLLDAKTERRLAQNREAARKSRLRKKAYVQQLETSRIRLQQIERELQGARSQGLFAGGGGSASGDTSSGAVMFDMEYARWLEDDSKLMTELQGILQAQNLDANLGAIVEECMRHYDELFHLRAMLARSDVFHLMTGLWVTTAERCFLWMGGFRPSEILKMLIPQLDPLTEQQLLGMCHLQRSSLQTEEALVQGLQQLHQSLADAVGASPLSDGASVANYTALMALALDRLDTLESFYRQADNLRQQTLQHMRRLLTTRQAARCFLSIGEYRRRLRALSSAWASSRPRESFVAAAGDVSPTATGAAEQAVRPYSNHSQ

SEQ ID NO: 31427 - DNA, 1528 bp, Panicum virgatum
  misc_feature: Ceres CLONE 1905330
  misc_feature: Encodes the peptide sequence at SEQ ID NO. 31428
accgaagcacacgtctccactccagctagtccggcgcagggtctccctctgttccgccgctgttattcgaccaggccaccggcggcggcgcgctcatagtatccggcaatgtcggcgcaggcggggacagggacgtactccccggcggctgccgcgggggacaagcggcgggagaagagggaggagctgcggcgccacctcgccgaggatgccaactggccccgcgccgacggacgctccttccacgactgccggccagcgtgtaactcccctctccccagcctcggctgtatttttgctcccgtgtagtggccacctcgttagaatgcttgtgctaaaggattgtgccctcggtctgctctcgccaaacccgtacatatggtgttcgacgttatgcgtgaggagtgggggcatgtctgatgccacgcggatatgccattcatccggttttaacccttttttttgttaatctgttgtcaaatggttggattccatgcctcttcaagttcgctgcactgagtcatttatcctaatgtagtttcctgcgcctgcctctgcaattctgcatcaatcttgatatgaaattatgaatgaagctgtgttctatggggtttaaattagtcagtttgatttgcgcgtaggatacatttatgatttaaaatgtgtcttgcagttatgcaaacagggccaactacggctgcatcagggtctgcttatgcggaatttgggaagacgaaggtcattgtatcagtgtttgggccaagagaaagtaagaaagcaatgctgtacagtgatgtcggtaggctcaattgcaacgtgagctatacaacatttgccactccagtgcgtggacagggagcagacaacaaagagtactcatcaatgcttcataaagctttggaaggcgcagtaatgctacacacttttccaaagaccactgttgatgtttttgccttggttcttgagtctggtggcagtgatctacccatcattatatcatgtgctagtcttgcactggcagatgctggaatcatgatgtatgaccttgttacatctgtatccgtgtcttgttttggaaagaacatcatcatcgatccaacctcagatgaggaagcatggcaagatggaagcctcgtggtagctttcatgccagcccgcaaggagatcacccaactcacactcactggagagtggagtgatggcaaaatcaccaatgcggtagagctctgcatggatgcttgcagtaagcttggtgacatactgcgcgaccgcttgaaggatactgccactttgacaagcgaatgacattgttgaggcaacacttgcaccaacatccttagctgtacaaaaaaattgtaggcaagggaggttgatagtccagatgcttgagtgagcatacatggttatggtgattggctgattatttccatcatggcaaaagagtgaactttcaaaccgggaagaagttgcagggcggtgttatcatgtaatgtactcctgacctctatcgaaccttttggttttcacg

SEQ ID NO: 31428 - protein, 214 aa, Panicum virgatum
  misc_feature: Ceres CLONE 1905330
  misc_feature (5)..(125): Pfam Name: RNase_PH Pfam Description: 3' exoribonuclease family, domain 1
  misc_feature: SWISSPROT Homolog: EC 2.7.7.56 tRNA nucleotidyltransferase
MCLAVMQTGPTTAASGSAYAEFGKTKVIVSVFGPRESKKAMLYSDVGRLNCNVSYTTFATPVRGQGADNKEYSSMLHKALEGAVMLHTFPKTTVDVFALVLESGGSDLPIIISCASLALADAGIMMYDLVTSVSVSCFGKNIIIDPTSDEEAWQDGSLVVAFMPARKEITQLTLTGEWSDGKITNAVELCMDACSKLGDILRDRLKDTATLTSE

SEQ ID NO: 31429 - DNA, 419 bp, Panicum virgatum
  misc_feature: Ceres CLONE 1905337
  misc_feature: Encodes the peptide sequence at SEQ ID NO. 31430
ggcggatgtagcccagtggatcaaggcagtggattgtgaatcggaaccctaagccgagcaacgcagagaacggcgtcttcgtactcgcctctctccgcgactcgaagctttccccccaacccccggattccccaccgccgccgccgccccacccttccgtcgacaccatgagggagtgcatctcgatccacatcggtcaggccggtatccaggccggaaacgcgtgctgggagctctactgcctcgagcatggcattcaggctgatggacagatgcctggtgacaagaccattggaggaggtgatgatgctttcaacaccttcttcagtgagactggcgctgggaagcacgtcccccgtgctgtatttgttgaccttgagcccactgtgattgatgaagtgaggactggcacttaccgc

SEQ ID NO: 31430 - protein, 83 aa, Panicum virgatum
  misc_feature: Ceres CLONE 1905337
  misc_feature: Useful for making plants with altered cell wall content and/or composition
MRECISIHIGQAGIQAGNACWELYCLEHGIQADGQMPGDKTIGGGDDAFNTFFSETGAGKHVPRAVFVDLEPTVIDEVRTGTY

SEQ ID NO: 31431 - DNA, 685 bp, Panicum virgatum
  misc_feature: Ceres CLONE 1905348
  misc_feature: Encodes the peptide sequence at SEQ ID NO. 31432
ttcccttcccttcgcgtcccctctgctcccatctagccagcccatctgctctccgccctctccgtaaggaagcaaaaacgcaaacccctcgtccccccaaaaaccctaaccctcgcgcgcccgcttcggggactccccggccgcgctcgctgccccctcaacgccgccttgggctccaatgcaaacttggaggactacggattcaagtactcggacaaggagccggaggagcaggacgtcaacttcaaaaaccattactacaactccaaaggtatggttgaaacaaacccaaagggtgcacttgttggttttgatcaagtagtcaaaatggagccaaaaaaggctgaagggggatttaaagctcttaaacaaactgtcaagttttactataagctggggaaatacaaagaaatgatggatgcctacagggagatgttaacatacataaaatctgctgtgacccgaaactacggtgagaaatgtataaacaacataatggattttgtttctggatcagctagtcaaaatttttctcttttacaaaatttctaccaaacaacactgaaagttcttgaaaaagcaaaaaatgagagattatggttcaggacaaacctgaacctttgcaaaatttggtttgatatgggggagtatggccgcatgaccaagatcctgaaggacttgctta

SEQ ID NO: 31432 - protein, 137 aa, Panicum virgatum
  misc_feature: Ceres CLONE 1905348
  misc_feature: Useful for making plants with modulated light quality sensitivity
  misc_feature: Useful for making plants with modulated low light sensitivity
MVETNPKGALVGFDQVVKMEPKKAEGGFKALKQTVKFYYKLGKYKEMMDAYREMLTYIKSAVTRNYGEKCINNIMDFVSGSASQNFSLLQNFYQTTLKVLEKAKNERLWFRTNLNLCKIWFDMGEYGRMTKILKDLL

SEQ ID NO: 31433 - DNA, 1036 bp, Panicum virgatum
  misc_feature: Ceres CLONE 1905383
  misc_feature: Encodes the peptide sequence at SEQ ID NO. 31434
atggattccgagctggaggaggcggtctgcaaactcgcgtggctcaacttcgcgtgcgcgagggacgacctcgactccggcgccgccctgctcgccgagctcaaggtgctcctcacaaggttacctagcttgccaccattatttgagaagacgcctaaagcagtagaagagctgaaaattgcaagggctatctacgagaatgctgttatcttgagcttgaaaattaaagaccgggaggcatttgagagaagcttgtgccagctaaaagaattttacatcaatacatgcggtataattgctccatcaccagatgagtacccatttctgggccttaatcttctcaggctgttggccgagaacagaattgctgaattccatactgagctggaacttctgcccctggaagctttaagtcatccttgtatcaagtatgcagtggagcttgagcaatcctttatggaaggtgcctataaccgattaatcaatgctcaccaagctgtaccacatgagacatatgtttaccttatggaccttcttgctgaaactattcgagatgaagtagccgaatgcagcgttgaggcttatgactacttgccaatcagtgttgcaaagaaaatgctaatgtttacatcagatcaagaacttctcgagtacatatcagaggaacaaccagaatgggaaatcaaggattattcagtccattttgacatggcaaaacccaaatctcacatggacttgtcatcgttcaagctgatcaggcaagctcttagctatgcgcgggagctggagcacgttgtgtagcttgcaatgcaaagttgactccggatgtaggcagccaaatgcagttgtctaatggtaaaagtgcaatgtttagtggttaggcgcatcatattaaaaaaaaggatgctaggtggatcttttgttgatttgttccattttgttgtttgaggcgtgaaactacagtagtttaaaatggccctgaggagtggggagtgctccgtagtttcagaactttgcgatgtgttcgtgtcagttc

SEQ ID NO: 31434 - protein, 266 aa, Panicum virgatum
  misc_feature: Ceres CLONE 1905383
  misc_feature (24)..(209): Pfam Name: SAC3_GANP Pfam Description: SAC3/GANP/Nin1/mts3/eIF-3 p25 family
MDSELEEAVCKLAWLNFACARDDLDSGAALLAELKVLLTRLPSLPPLFEKTPKAVEELKIARAIYENAVILSLKIKDREAFERSLCQLKEFYINTCGIIAPSPDEYPFLGLNLLRLLAENRIAEFHTELELLPLEALSHPCIKYAVELEQSFMEGAYNRLINAHQAVPHETYVYLMDLLAETIRDEVAECSVEAYDYLPISVAKKMLMFTSDQELLEYISEEQPEWEIKDYSVHFDMAKPKSHMDLSSFKLIRQALSYARELEHVV

SEQ ID NO: 31435 - DNA, 482 bp, Panicum virgatum
  misc_feature: Ceres CLONE 1905387
  misc_feature: Encodes the peptide sequence at SEQ ID NO. 31436
attaattttccgcgctgcgcttgtagacatctatccagcagagcgcagcaggatggtgtacgcgctcctgctggtcgccttggcggccgtcgccgccgcggcggtgctccgccactacctcccgctgctccgcggcggcctccccaagggcagcttcggctggcccctcatcggcgagaccatcggcttcctccacgcgcacccgtccaacaccgccggcggcttcctcaaggagcacgtcgccaggtacgggacggtgttcaagtcgcacctcttcggctcgccggcggtggtctcctgcgacgaggagctcaaccacttcgtgctgcacaacgaggagcgcctgttcgagtgcagctaccccggcgccatccgcaccatcctctcctagtccaccgcgctggtggtggcgggccagcgccaccgccagatccagatcatgttcctcgccctcgtcgcctccacgctgctcagggcctcct

SEQ ID NO: 31436 - protein, 112 aa, Panicum virgatum
  misc_feature: Ceres CLONE 1905387
  misc_feature: SWISSPROT Homolog: EC 1.14.13.77 Taxane 13-alpha-hydroxylase
  misc_feature: Useful for making plants with modulated oxidative stress sensitivity
MVYALLLVALAAVAAAAVLRHYLPLLRGGLPKGSFGWPLIGETIGFLHAHPSNTAGGFLKEHVARYGTVFKSHLFGSPAVVSCDEELNHFVLHNEERLFECSYPGAIRTILS

SEQ ID NO: 31437 - DNA, 652 bp, Panicum virgatum
  misc_feature: Ceres CLONE 1905390
  misc_feature: Encodes the peptide sequence at SEQ ID NO. 31438
ccgtttcgttgtcgcagggtctcacacgatcgtcgagccctctccgcagaagctgacgacgcttcgctcgtttgttaaaacgttgctggggttgcagcatgtgtagttgggcatatagagagattgcattgagttagtgctctgctctcggctgtagggacgcaatgggcgtcctaaaagctggttcgctttgctggctgttccatgtgctggttcttgtctgtgccttgtgtcagatactttatgttggatcaattggggctcaaactgctcagttgagtgtggatgcttcacctcagaatgctcaggtgatccctggaaatatgtttggcatcttcttcgaggagatcaaccatgctggagctggtggattgtgggcagagcttgtaagcaacagaggttttgaagctggtggtcctaatactccttcaaacattgacccatggttgaccattggggatgaatccaatattatcgtggcaacagatcggtcatcctgttttgctggtaacccaattgcacttcgaatggaagtacattgtgaaactagtggaactaatgcctgcccatcaggaggtgttgggatctacaatcctggttactggggcatgaacattgagagaagaaaagtttatagagctaccatgtacat

SEQ ID NO: 31438 - protein, 162 aa, Panicum virgatum
  misc_feature: Ceres CLONE 1905390
  misc_feature: SWISSPROT Homolog: EC 3.2.1.55 Alpha-N-arabinofuranosidase
  misc_feature: Useful for making plants with altered carbohydrate content
  misc_feature: Useful for making plants with altered cell wall content and/or composition
MGVLKAGSLCWLFHVLVLVCALCQILYVGSIGAQTAQLSVDASPQNAQVIPGNMFGIFFEEINHAGAGGLWAELVSNRGFEAGGPNTPSNIDPWLTIGDESNIIVATDRSSCFAGNPIALRMEVHCETSGTNACPSGGVGIYNPGYWGMNIERRKVYRATMY

SEQ ID NO: 31439 - DNA, 708 bp, Panicum virgatum
  misc_feature: Ceres CLONE 1905391
  misc_feature: Encodes the peptide sequence at SEQ ID NO. 31440
aaaaaaaaaaaaccggctcttcttcctcttgttcgtacgcccgcgcgccccctcctctgcagtgaccctctccgcatctccctccattgctcaaggctctgggccatccagcagccatggggacccaagcgcccgcgagctatcctcctcctgccaaggatgacagcaagacggcggaggagaagaagctcgaggagtggctccccatcaacggctccaggaacgccaagtggtggtactccgccttccacaatgtcaccgccatggtcggtgccggcgtcctcggcctcccctacgccatgtccgagctcggatggggccccggcatcgtggtgatgatcctgtcgtgggtcatcacgctgtacacgctatggcagatggtggagatgcacgagatggtgcccgggaagcgcttcgaccgctaccacgagctcggccagcacgtcttcggcgagaagctgggcctctggatcgtcgtgccgcagcagctcgtcgtcgaggtcagcctcaacatcatctacatggtcaccggcggccagtccctcaagaagttccacgacgtcatctgcgacggcaagtgcaaggacatcaagctctcctacttcatcatgatcttcgcctccgtccacttcgtcctctcccagctccccaacttcaactccatctccggcgtctccctcgcccgcgccgtcatgtcaatcagttact

SEQ ID NO: 31440 - protein, 197 aa, Panicum virgatum
  misc_feature: Ceres CLONE 1905391
  misc_feature: Useful for making plants with altered oil content
MGTQAPASYPPPAKDDSKTAEEKKLEEWLPINGSRNAKWWYSAFHNVTAMVGAGVLGLPYAMSELGWGPGIVVMILSWVITLYTLWQMVEMHEMVPGKRFDRYHELGQHVFGEKLGLWIVVPQQLVVEVSLNIIYMVTGGQSLKKFHDVICDGKCKDIKLSYFIMIFASVHFVLSQLPNFNSISGVSLARAVMSISY

SEQ ID NO: 31441 - DNA, 673 bp, Panicum virgatum
  misc_feature: Ceres CLONE 1905392
  misc_feature: Encodes the peptide sequence at SEQ ID NO. 31442
tacgagaagctttttgattacataaactctaatccccatcttaatgctgaagtcaactttggtaccctggaggattacttctccacactgagagatgaagctgaaaagataaactattcacgcccaggtgaattgggttctgctgagttgctaggttttccaacactttcaggagatttctttacgtatgctgatagaaatcaagattactggagtggttactatgtgtcaaggccattcttcaaagctgttgaccgtgtactagaacaaacgctccgtgcctcatagattctgggttcatttgttctagggtactgtcagaagtttcagtgagctaaactccccatcagcttctcacacaaactgacagcagcaaggaggaatttggcgctttttcagcatcatgatggggtaactggcacagctaaagatcatgttgtggtggactatggcactagaattcacacttcactgcaagatctacagttatttatgtccagggcgggtgaagtgcttttaggagatttccatgatagatctgaccctacattgctatcgcattttgaaacagtgcaggaacgttcatagtatgatgttcagccggagcatagggttcttgaccctcgtgaatggaaggcacaatcgattgtcttttttaacccattagaacaaa

SEQ ID NO: 31442 - protein, 95 aa, Panicum virgatum
  misc_feature: Ceres CLONE 1905392
  misc_feature: SWISSPROT Homolog: EC 3.2.1.114 Mannosyl-oligosaccharide 1,3-1,6-alpha-mannosidase
YEKLFDYINSNPHLNAEVNFGTLEDYFSTLRDEAEKINYSRPGELGSAELLGFPTLSGDFFTYADRNQDYWSGYYVSRPFFKAVDRVLEQTLRAS

SEQ ID NO: 31443 - DNA, 578 bp, Panicum virgatum
  misc_feature: Ceres CLONE 1905399-R
  misc_feature: Encodes the peptide sequence at SEQ ID NO. 31444
tataataataaccgcatctttttgtcacttaaagatgtaaagccaaatccatcagtaggtgctttggaagcagtcattggtgaggacttatcactaggtggaactcttgaacctgtacaggcagattttgagcggcctgaggtggatgcccttatggaggagatgcgaaaaatagaggatgtaagagatgtttataaaggaagattcttccaaagcccagggttagctccaacctttcaggtttacatggcgcctgtggttggtctcaaatacaagctgctcgcacggtatgggaacaatgtgcaagaggtgatggtggagacgacactggacaaagagcggttgaaggaggctattttgacgtgcacaaatagggttagctgattagctaggatctcggtgctgcacattggacgggaccctcccggtgacaattttgagtcattttgatttgttttcctttctcttcctttttctcccccctgctctttctgggccggaggactggcaaattaaggcctgtctgtacagaaatactgtactgtggctgttgagaatgcgtttcagtcttctaggct

SEQ ID NO: 31444 - protein, 127 aa, Panicum virgatum
  misc_feature: Ceres CLONE 1905399-R
  misc_feature: Useful for making plants with altered terpenoid content
YNNNRIFLSLKDVKPNPSVGALEAVIGEDLSLGGTLEPVQADFERPEVDALMEEMRKIEDVRDVYKGRFFQSPGLAPTFQVYMAPVVGLKYKLLARYGNNVQEVMVETTLDKERLKEAILTCTNRVS

SEQ ID NO: 31445 - DNA, 1318 bp, Panicum virgatum
  misc_feature: Ceres CLONE 1905399
aatttcagctaaacccccactttggctgccttcccccaccgctccggccatggaatccttcgccggcgccgcccccgcggccggcgtattcgcgggctccggagccgccgcggcgcgccccttcttcctccgccgccgcgtaggctcctcttgctccggccccggacggctgcgcctcctccgggtgccgccgccgcgcgtaggcggggacggaggggacctgccgccgctggacaagtgggacatgatggagatggatttcggacgcttcctcggagaggaccccaagctcaccctcgcaaagattctgtttaagaaatcagacccagatgcctcatccctcgatgtagagaaactgattgccactaaaaaggacaagctggatgatattttgagggagttcatggatgccaataagaaggatcaggctttcaaaacaccagaaagtgtatccccgatgaatacgagacaaccgacaataagcaagccagttgaaggaaagagttctttgaatatttcaaggcctgtgatggggaaaccgaaacaagacgggcctccgttgactttactgcgaccagcaggaagcaaaccgaagcaagacgagccttctctgtctcagttgcgaccagtagggagcaaagcaaaggaagatattccaccgctgaccttgtcacggccaattgggagcaagccaatagtacggggcactccggtacaagatagttggcctagcaaagagagtttagctgctgcaacaaataacagtgaagtggggagcatctcaagaacagctgatgtggatgtcaccttgcggaaacccaccgtgcatcacagtgaggatgatgatttgaagtcaaagctgaaaatgaagccaaacattaacctgaaaatgaggaaagatatgaatgaggacttaacaaacatttctcttcttcaaaaaccagatgttacaaaagatattgctaatccagaccaggaccatgcctcagctagctctgccactatttctgctgcagaggatagccgcgaatttgagctcgaaactaatggtcctggcacaaaattagttactgaaaacattcatgaatcatctgggcttgatgacgattctagtgcaggactacagccatccagtcaaactgtcattcaagaaactaataattctgctggttcagtggataaccaatcggctactagcaacaatttctctatgcaggctttcttacagggaaaacctaaaagagaaaatctatctgtattgccatctccagttgatgaaaagatgaatgctactgataataggaattatgttgatgat

SEQ ID NO: 31446 - DNA, 1798 bp, Panicum virgatum
  misc_feature: Ceres CLONE 1905407
  misc_feature: Encodes the peptide sequence at SEQ ID NO. 31447
cttcttttcttttcttttcttttctaactacagataattcttcatttgctcgggggcattccacccgcccgcccctggatcccgctcgatcgagggtggtgcgattcgggccggagtgggtcgggggcgaggaggcggagcgggatggacgagttcgagctggaggacaacctcgagttcatcctccagagcatccaggggctcatggaggaccagggggagaacaacgccttcggcgacgccaaccagaacgagctcttcgccagcctcgtcaactacgaccacgagaacatgctgccggatgtgtccgtggcggacgtcgctgccgggaaggacatgcaggggatcccgtgggagaagatgctcttcgggagggatcagtaccgggagatgaagatgaagaactacaggaattaccagaacctaagttacgcccgggaggatgctttgcaggagtgcaaacaagtggagaaggatagcccttactatgatttccactacaacacaaggcgtgctcggccatctattgtacattttcagctgaggaacctggtatgggcaacaaccaagcatgatgtttatacaatgcatgaccaatcagtgacacactggtcctcactggaccagttaagcactgagctgatcaatgccgatgattgcattgttccaaaacagagagggcatggttcacagtcagttgcaatggttcaggtcacaacaatggctgtggatagtaatttattggtagttggtggcttccagggtgaggttatatgcaagcgtctggatgatgatggagttgttttcagcacgagggttacagatgatgaaaatgccatcactaactctttagagatatatcaggatcccagcggatctagaaggttggtggctgctaacaatgactgctccatcaggattttcgacaccgagtattttgacctcctcaagcactatgtcttcccttggtccgtgaatagtgtttctgtgagcccaaatggtaaactctttgctgtccttggagatcatgaggatggcttggtagtggatcctaagtgtggcaaggcaattggttctcttaggggccacttggattattcatttgcatcagcctggcatcctgacggcaacattgtggccacggggagtcaagacactacatgcaggctgtgggacataagaaacctatcacagtcggtagctgtgcttggaggcaggatgggctccatacgctgtgtcaagttctcttcggacgggagattcctggcaactgccgagcctgtggatttcgtccacatatacgactcctttgcggactacgggaaatctcacgagattgatctgttcggcgagattggtggtttgtcgttcagcccggacaccgaggccttctacgttggcctcgcggaccagacgtacggtggcctgatcgagttcaccaagaggcaccaacatcattacttgaactccttgtggtgataccgaccactcgttgagcatactttggtctcgcagctggtggatgctgttgtggcgcaccgcgtgctgcgagaggtgcatgccctgtagaggaagatttcatggaagcgtttgctgcttttagttgtttagctgcagcaccgggcggggcttctcatctgaaagtgtataaaattcttggggggttttgtttcttggtagtaatctgggtttgccgttcgtccccagggaactgatggcggtagcataatgtatagcctctctttgttgttaccctgaatcaatgtacatatagttctatctagaaatcgtctcattc

SEQ ID NO: 31447 - protein, 444 aa, Panicum virgatum
  misc_feature: Ceres CLONE 1905407
  misc_feature (306)..(344): Pfam Name: WD40 Pfam Description: WD domain, G-beta repeat
MDEFELEDNLEFILQSIQGLMEDQGENNAFGDANQNELFASLVNYDHENMLPDVSVADVAAGKDMQGIPWEKMLFGRDQYREMKMKNYRNYQNLSYAREDALQECKQVEKDSPYYDFHYNTRRARPSIVHFQLRNLVWATTKHDVYTMHDQSVTHWSSLDQLSTELINADDCIVPKQRGHGSQSVAMVQVTTMAVDSNLLVVGGFQGEVICKRLDDDGVVFSTRVTDDENAITNSLEIYQDPSGSRRLVAANNDCSIRIFDTEYFDLLKHYVFPWSVNSVSVSPNGKLFAVLGDHEDGLVVDPKCGKAIGSLRGHLDYSFASAWHPDGNIVATGSQDTTCRLWDIRNLSQSVAVLGGRMGSIRCVKFSSDGRFLATAEPVDFVHIYDSFADYGKSHEIDLFGEIGGLSFSPDTEAFYVGLADQTYGGLIEFTKRHQHHYLNSLW

SEQ ID NO: 31448 - DNA, 726 bp, Panicum virgatum
  misc_feature: Ceres CLONE 1905422
  misc_feature: Encodes the peptide sequence at SEQ ID NO. 31449
gcgtagcacgcggaaccctcgaggggccaggacgcgaaaaggtagagcgcacacagccacgcgcggcggcggcaggccggcggcgaggcgagggctctgctcccggcggcggcggcggcgtcctgggcgagggcggaggagccgatcgtgcgcgccattgggggcacacggcgccgtgttgacccccgctccgcgaccggcgcgcgcggttcgtgcggcgcgtggcccctccccgcgcttcgggggcgcctgcggatttctccgccgtcctactcgccgtcctcggcacgatggaggccggctactgcaaccgcaagaagacggacatctgcgagggcgtctgcgacaccgagtatggttcgaagtcagttctgagcatgtcaaggctgaagtgcgcactgcggggatttgatttgagggctctcttgatcatactgattggtgttcctattctgatcttcctcatatacgtgcatggacagaaggtcacttacttcctccgtccgatctgggaaaagcccccaaagcccttcaaaatacttcctcactactatcatgagaatgtctctatggataacctctgcaagttgcatggatggaaagtcagggagactcctcgccgtgtctttgatgctgtgctcttcagcaacgaactggacattcttgacatccgttggcatgagctgagtccgtatgtagatgaatttgtgctgcttgagtccaatt

SEQ ID NO: 31449 - protein, 145 aa, Panicum virgatum
  misc_feature: Ceres CLONE 1905422
  misc_feature (27)..(145): Pfam Name: Glyco_transf_17 Pfam Description: Glycosyltransferase family 17
  misc_feature: SWISSPROT Homolog: EC 2.4.1.144 Beta-1,4-mannosyl-glycoprotein 4-beta-N-acetylglucosaminyltransferase
  misc_feature: Useful for making plants with altered carbohydrate content
MEAGYCNRKKTDICEGVCDTEYGSKSVLSMSRLKCALRGFDLRALLIILIGVPILIFLIYVHGQKVTYFLRPIWEKPPKPFKILPHYYHENVSMDNLCKLHGWKVRETPRRVFDAVLFSNELDILDIRWHELSPYVDEFVLLESN

SEQ ID NO: 31450 - DNA, 694 bp, Panicum virgatum
  misc_feature: Ceres CLONE 1905432
  misc_feature: Encodes the peptide sequence at SEQ ID NO. 31451
ctggctggctggcttggcatcggccatcggcacccggcaggcggcgggcggcagcagcgcaggatggccacccacgctgctctcgccgcgtcgcgcatccccacaggcacccggctgcacagcagggcggcgtccaggcagagggtggacttcgccgacttctccgggctgaggccgggatcatgctccgtcagcaccgccgccagggaggcgtcattctccgacgtgctcggtgcgcagctcgtcgccagggccaccggagagaacgcggtgagggcgcccgctgaggccaagctcaaggtggcgatcaacgggttcggccgcatcggccggaacttcctccggtgctggcacggccgcaaggactccccgctcgatgtcgtcgtcgtcaacgacagcggaggcgtcaagaacgcgtctcacctcctcaagtacgactcgatgctcggcaccttcaaggccgacgtcaagatcgtcgacgacaccaccatcagcgtcgacggcaagctcatcaccgtcgtctccaacagggacccgctcaagctcccatgggccgagctcggcatcgacattgtcatcgaggtaccgcaccaccatccgtgtgaaatgtccaagcatgcttcggttgcctaacacggcgggtgctcaactgctgtgccgtgcgtgaagggtaccggagtcttcgtcgacggcc

SEQ ID NO: 31451 - protein, 189 aa, Panicum virgatum
  misc_feature: Ceres CLONE 1905432
  misc_feature (78)..(189): Pfam Name: Gp_dh_N Pfam Description: Glyceraldehyde 3-phosphate dehydrogenase, NAD binding domain
  misc_feature: SWISSPROT Homolog: EC 1.2.1.13 Glyceraldehyde-3-phosphate dehydrogenase (NADP(+)) (phosphorylating)
MATHAALAASRIPTGTRLHSRAASRQRVDFADFSGLRPGSCSVSTAAREASFSDVLGAQLVARATGENAVRAPAEAKLKVAINGFGRIGRNFLRCWHGRKDSPLDVVVVNDSGGVKNASHLLKYDSMLGTFKADVKIVDDTTISVDGKLITVVSNRDPLKLPWAELGIDIVIEVPHHHPCEMSKHASVA

SEQ ID NO: 31452 - DNA, 1594 bp, Panicum virgatum
  misc_feature: Ceres CLONE 1905443
  misc_feature: Encodes the peptide sequence at SEQ ID NO. 31453
ttggcctcgccactcgcaattccagcacgattcgaacgtcatctccttcctcccgtctccagtctcctcacctcttccgccgccgtctcagccgccgccgccgccgcggcgaaaccctaggcctcgctgagcaaagcccacgcgggtcgcactgcggtagcctctcaggagatggagtacggcgtcgcctctcacggcgccctcctcgccgccgcgccgctcgcgagccagcggccccgtctacctctctcgccgccgccatcaccgccgtctattcagatccagaatcgtctttattccatgtcgtcactcccactaaaggctaggccagtgagaagatgcggagcttctgtggcaagtaactactcgcaaacaactgaaatagttgatttggactgggagaaccttggttttgggcttgttcaaactgactacatgtatattgcaaaatgcgggcaggatgggaaattttctgagggtgaattggcgccgtttggacccatagcactgaacccatcttctggagtcctaaactatggacagggattgtttgagggcctaaaggcatataggaaacctgatgggtccatcttattatttcgcccagaggaaaatgctttgaggatgcaaactggtgctgagaggatgtgcatgcctgccccttccgttgagcagtttgttgatgctgtaaaacaaaccgttctagcaaataagagatgggtgcctcctactggtaaaggttctctgtatattagacccctacttatgggaagtggggctgtccttggtctggcacctgctccggagtatacattcattatatttgcatcccctgttggcaactactttaaggaaggtttagcaccaataaatttgatagttgaagacaagtttcaccgcgccactcctggtggaactggaagtgtgaagaccattggaaattatgcttcggtgttgatggcacagaaaattgcaaaggagaaaggttattctgatgttctctacttggatgtggttcacaaaaaatatcttgaagaagtttcttcatgtaatatttttgttgtcaaggttgaggagcggcttgtgtcagtggatgaattgcttgatgctgatgaagtgttctacacgggaactgctgttgtagtgtctcctgttgggagtatcacatatcaagggaaaagggtggaatatgggcaccaaggtgttggcgtcgtgtctcagcagctgtatacttcactgacgagtctccagatgggtcaaacagaggactggatggagtggaccatgcaactgaactagcatcaggccgttaacatatcgaatctgccttcctcgcatagatgggtttgcaagatctccgtctagatcaatgatatggtcataagtagctctgtacccttcagttttgtagcatctgtcgaagtgtggctcgtgcaatatattccgtaggtgttggtgcatggcgtcagcttaaactataattgcgtgtacccgtcagttctgtttttggactagcattgcagtggcataaaaagaattatatactgtgtaatctgcagtgggattcaaaaaatcaaggcgctcaaattttagc

SEQ ID NO: 31453 - protein, 332 aa, Panicum virgatum
  misc_feature: Ceres CLONE 1905443
  misc_feature (59)..(314): Pfam Name: Aminotran_4 Pfam Description: Aminotransferase class IV
  misc_feature: SWISSPROT Homolog: EC 2.6.1.42 Branched-chain-amino-acid transaminase
  misc_feature: Useful for making plants with modulated nitrogen use efficiency
  misc_feature: Useful for making plants with modulated biomass
  misc_feature: Useful for making plants with modulated flowering time
MSSLPLKARPVRRCGASVASNYSQTTEIVDLDWENLGFGLVQTDYMYIAKCGQDGKFSEGELAPFGPIALNPSSGVLNYGQGLFEGLKAYRKPDGSILLFRPEENALRMQTGAERMCMPAPSVEQFVDAVKQTVLANKRWVPPTGKGSLYIRPLLMGSGAVLGLAPAPEYTFIIFASPVGNYFKEGLAPINLIVEDKFHRATPGGTGSVKTIGNYASVLMAQKIAKEKGYSDVLYLDVVHKKYLEEVSSCNIFVVKVEERLVSVDELLDADEVFYTGTAVVVSPVGSITYQGKRVEYGHQGVGVVSQQLYTSLTSLQMGQTEDWMEWTMQLN

SEQ ID NO: 31454 - DNA, 621 bp, Panicum virgatum
  misc_feature: Ceres CLONE 1905462
  misc_feature: Encodes the peptide sequence at SEQ ID NO. 31455
aagaaccagctgtcagccaaactctcccccgtccgccctctcctcgcgctcgcgccacctctcccccgcgccgccgcgcccgcaccctgccctccgcggctgctccagctcctgcggcggcgcctgccgatctgcctctgcgcgcgcgccgcggaggcgagcttggcggcgtcgcgcctgcgcacgggaggcgctgcggacgaggaagccgtcgagcaggctgtcgtcggcgcaggcggcgcggaggaacgcttgctgacgaggagagcgagaaggaaaccaccctccgccgcgggcgacgcctgagacgaggcctgcagaccttcgtgaagaccctcctccgccagaccatcaccctcgaggtggagtcctccgacacccttgacaacgtcaaggccaagatccaggacaaggacggcatccccccagaccagcagaggctcatcttcaccaacaagcagctcgaggaccggcgcacgcttgctgactacaacatccagaaggaaagcaccctccacctggcgctacgcctgaggcgaggcatgcagatctttgtgaagaccttgaccggcaagacgatcacccttgaggttgagtcttccgacaccattgacaacgcga

SEQ ID NO: 31455 - protein, 206 aa, Panicum virgatum
  misc_feature: Ceres CLONE 1905462
  misc_feature (110)..(178): Pfam Name: ubiquitin Pfam Description: Ubiquitin family
  misc_feature: Useful for making plants with modulated cold sensitivity
EPAVSQTLPRPPSPRARATSPPRRRARTLPSAAAPAPAAAPADLPLRARRGGELGGVAPAHGRRCGRGSRRAGCRRRRRRGGTLADEESEKETTLRRGRRLRRGLQTFVKTLLRQTITLEVESSDTLDNVKAKIQDKDGIPPDQQRLIFTNKQLEDRRTLADYNIQKESTLHLALRLRRGMQIFVKTLTGKTITLEVESSDTIDNA

SEQ ID NO: 31456 - DNA, 644 bp, Panicum virgatum
  misc_feature: Ceres CLONE 1905474
  misc_feature: Encodes the peptide sequence at SEQ ID NO. 31457
attgcaattcttgcagaagcatatcctcttctattcttctcgtactaccttccaaaaatttccttgccgagtgttcggtgttctgggctctttatgcagacttctgccgatcaaactgaagtcttccactgatcagttaatctgcaggtagctaccaacatctcttttgtatgtctgaagatctcaattccaagtacgagaggttgtaaagaatagcaatgggttgcttctgtgtgttccggaggaagaagaattccagaagccagattgtgcagcatgaccaagacatccttatcactggcaacgtgaaaatctactcgttcaagaagctaagaaaagccacaagaaatttctgcccaggaaacaagcttggacagggttccttcggccgtgtctatctgggaaagctgaataacggcgagaaagttgccatcaaggtgctctcctcagagtcaaggcaaggaacaaaggagttcctgaatgagctgagtgtcatatccaacataacccatcacaaccttgtcaaactgcatggctgctgcgtcgatggaggccagaagatgctggtctacaattatgtggagaataacagccttgcacagaccctttttggtaattctcgcagtggcatcatctttgactgg

SEQ ID NO: 31457 - protein, 141 aa, Panicum virgatum
  misc_feature: Ceres CLONE 1905474
  misc_feature: SWISSPROT Homolog: EC 2.7.11.1 Non-specific serine/threonine protein kinase
MGCFCVFRRKKNSRSQIVQHDQDILITGNVKIYSFKKLRKATRNFCPGNKLGQGSFGRVYLGKLNNGEKVAIKVLSSESRQGTKEFLNELSVISNITHHNLVKLHGCCVDGGQKMLVYNYVENNSLAQTLFGNSRSGIIFD

SEQ ID NO: 31458 - DNA, 634 bp, Panicum virgatum
  misc_feature: Ceres CLONE 1905486
  misc_feature: Encodes the peptide sequence at SEQ ID NO. 31459
ggcggaaaggggaggcgacgaggagggcgacgaggcacagacaaccgcggcaggcgcgagcgcgcgcacgcacgtacgcctcctttactctccccgcgcaggagctcgcggccgccgggtggccggaggagtgcgtgtgtgaggagcaagggagtgcctcgagggggcgggagcgggatcggggatggcggcaacgggaaagggaggggcggcgcgggtcgccgccggcttcctcttcctcctgcatctcgttgcggcgatcgccgggaagagctactacgacgtgctgcaagtgcccaagggcgcgtcggaggatcagatcaagaggtcgtaccgcaagcttgccctcaagtaccaccccgacaagaaccccgacaatgaagaggccaacaagcgcttcgcggagatcaacaacgcgtatgaggtgctcacggaccaggagaagaggaagatctatgaccggtacggcgaggagaggctgaagcagttccaaggccggggaggtggcggtggtggaatgaacattcaggacatctttagcagcttttttggtggtggtggtggagcggaagaggaggaagaacagatcttaaaaggtgatgaagtggttgatgaactggaggcttcactaaag

SEQ ID NO: 31459 - protein, 149 aa, Panicum virgatum
  misc_feature: Ceres CLONE 1905486
  misc_feature (30)..(92): Pfam Name: DnaJ Pfam Description: DnaJ domain
MAATGKGGAARVAAGFLFLLHLVAAIAGKSYYDVLQVPKGASEDQIKRSYRKLALKYHPDKNPDNEEANKRFAEINNAYEVLTDQEKRKIYDRYGEERLKQFQGRGGGGGGMNIQDIFSSFFGGGGGAEEEEEQILKGDEVVDELEASL

SEQ ID NO: 31460 - DNA, 767 bp, Panicum virgatum
  misc_feature: Ceres CLONE 1905501-R
  misc_feature: Encodes the peptide sequence at SEQ ID NO. 31461
cggcattccgaccttgtgccggcgttaagtgccggcgaacacttaccgtgacctgcgcgctcccggagaaagaacggccgccggcgttcagcatcccgcccaccgctctgctgtgccccgtgccgccgccggacgggaaggagcggtgggacatcaaggaggaggaggaccgcgtcacgctgtggctccaggtgcccgggctgtcggcgagcgacatcgaggtgaccaccggcgaggacgtcctggagatcaagcggaaggtcgcagcccagcagcccgcggcgcccgtggacgcgcacggcgtgggcgcgttccacatccggctgctcatgaccaaggagtacgacggggccagggtcacggccgacctcaaggccggcatgctggaggtcaccatccccaagaaccttcaacgcgagggtgaacgcgtcgagctggggaagcctgcgccccggggaaaagcgggcacgaacaccaagaaaggctcggaggacgcgaaaccggccggaccaaaccccgggcagacaaaagacaggggactagctggctgaggggttgtgcagtctccgtcggccccctctgtttccttttgtgttgaaacaagtctcttattttgagttcccgatcgatatgggatgacggagatagactcaagccagcaatcggcttagatcgctggcccgaagtgagctcttgcgcagtttgtcgtatcttgtgtttttcctggaagagcatttctctatttctttacgaggatcgtttccttt

SEQ ID NO: 31461 - protein, 182 aa, Panicum virgatum
  misc_feature: Ceres CLONE 1905501-R
  misc_feature (50)..(146): Pfam Name: HSP20 Pfam Description: Hsp20/alpha crystallin family
AFRPCAGVKCRRTLTVTCALPEKERPPAFSIPPTALLCPVPPPDGKERWDIKEEEDRVTLWLQVPGLSASDIEVTTGEDVLEIKRKVAAQQPAAPVDAHGVGAFHIRLLMTKEYDGARVTADLKAGMLEVTIPKNLQREGERVELGKPAPRGKAGTNTKKGSEDAKPAGPNPGQTKDRGLAG

SEQ ID NO: 31462 - DNA, 1150 bp, Panicum virgatum
  misc_feature: Ceres CLONE 1905501
tgcctcaactctcaacgggccagttttcttgctgttacgatgctaggacacacggccaatggcaagaagagcagcaagttcgaggactcggacagtcgcatgtcgaggcccaggtatagtccgagtccggcactatttcttctagcaatttttcacgctccgatcaaatccgaagccttttctgctccgatatccggaggcgatcggattcacgagcaactctgcttcagggccgtgtctgagctgccgcagcgtccagtgcagcgtctgaaatcggcggcggcggcgggcgcggaggcaaccggcggcgcggcgcggcgcgctctcggcgtccgggccatggcgccgcgcagcccgttgcacgagaagaagcccgccggtgctggttgtggcgccggcgcgggcccacgggcggcggagctggaggcgaagctggagaaggcgcacgggcagcttatggggatgcgggaccagctcgcggcggccgagaaggccaggaaggacgcgcgcgccgcgctcgccgacgccaagaagcgcctggccgcgaagaagagggacgatgacgcggcctcttcggcggcgccgccgccggtcgagcacgatggcggcaaggcgccggcgccggcggacggggctgctggtggcgcggagggtgcgaacggggaggaaggctacatgaggatgaggtcgccgtcgccggccgccgaggccggcttcgaggctgtcgtgtcgggcgagtcggggaacaacgagggcccggtcgtcgaggagggcaacaagactggcgatgaggaggaggcgagaaacgccgttgccgatgacgatagcaagaaggggatgagcccgggggttgagctgctgagggcgaagctgacggccaaggacatggagggctacgagctgagggcgaagctgatggtgatcgacacggaggtcgacgatctgaagaagatggtggtagccaagagcacggagctcgaggagctgaaggcgaggctgatgctgaacaatgagctcgtcgacaagctcacggcggatctgatggtgaaggacgcggagatcgccgccctcgaggccgacaacgccgacctgagcaggatggccgaggaggctgccgaggccgcgaaggcggcgtccgcgagggcgcggg

SEQ ID NO: 31463 - DNA, 1615 bp, Panicum virgatum
  misc_feature: Ceres CLONE 1905514
  misc_feature: Encodes the peptide sequence at SEQ ID NO. 31464
ctgttgctgctgctccaatctagcagtggagtcgaatcgatggcggcgtggtcgtcgtcgccgtcgcttcgccacctcctcctcctccgcccgcgcgtacctctcggccccacctgcctcgcgggctccttctcccgccgccacgtccacagccacagccgccgccgcctcttctcctccgcatcctcctcgacgctgacccacggcgacgaggcctcgacccatgttgatgctgacggcgtcgtcgacgtcaacccgccgcgcggcacccgggacttcccgccggaggacatgcgcctccgcacctggctgttcgaccaattcagggaggtctcccgcctcatgaccttcgaggaggtggacttccccgtcctcgagtcggaggcgctcttcatccggaaggcaggggaggagatcacgcagcagctctacaacttcgaggataaaggaggtcgccgtgttgttctcaggcctgaaatcaccccttccctcgcgcgcctagtcatcaagcaaggaaaatcagtctcccttccactgaaatggtttactataggacaatgttggcgatatgagcgaatgaccagaggaagaagacgggagcattaccaatggaatatggatatctttggtgtgcctaaagttcgggccgaggctgagcttcttcaggctattgttctcctatttcaacgccttggaattacatcttcagatgtggggatcagggtgtccagcaggaaggttcttcaggctgtgttgaacatgtattccataccagaacatttattcactgaagtttgtgttattgttgataagttgggaaaattgactagggaagaaattgagaaggaactgatgtcaactgggctgtcatctgaagctgtccagggtatcattgaagtgctttcgctcaagtcattgtccaagcttgaagaggtgctaggctctggtgttgaagctgttgctgacttgaagaaactcttctcatttgcggagcaatatggttatgctgattggatttgttttgacgcatcagtggtccgtggccttgcatactacacaggaattgtatttgaggcatttgatagagaaggaaaacttagagcaatttgcggtggtggaaggtacgatagattgctttcaacatttggaagtgaagatattccagcttgtggctttggatttggagacgctgttatagtggaactgctgaaagaaaagggtctgttgcctgatatgtcacgtcagatagatgacattgtcttccctttggatgaagagcttgaaggaccagcatccagtattgcttcttcgctaaggaagaaaggacgagctgttgaccttgtagaagacaagcgtctcaaatgggtatttaagcacgcggagaggatcaatgctagcaggctgatattggttggaaattctgagtgggagcgtggtatggttcgtgtaaaaatactatcaacaagggaagaatttgaggttaaggcaggcgacctagagtgagcttttgctgattagaggacttaagttccgaacatcatgttttcttgctaagttgtgtagatgcatatatacgtggaatagatacagctcatgatatgaacctttgctgtcg

SEQ ID NO: 31464 - protein, 487 aa, Panicum virgatum
  misc_feature: Ceres CLONE 1905514
  misc_feature (87)..(252): Pfam Name: tRNA-synt_2b Pfam Description: tRNA synthetase class II core domain (G, H, P, S and T)
  misc_feature: SWISSPROT Homolog: EC 6.1.1.21 Histidine--tRNA ligase
MAAWSSSPSLRHLLLLRPRVPLGPTCLAGSFSRRHVHSHSRRRLFSSASSSTLTHGDEASTHVDADGVVDVNPPRGTRDFPPEDMRLRTWLFDQFREVSRLMTFEEVDFPVLESEALFIRKAGEEITQQLYNFEDKGGRRVVLRPEITPSLARLVIKQGKSVSLPLKWFTIGQCWRYERMTRGRRREHYQWNMDIFGVPKVRAEAELLQAIVLLFQRLGITSSDVGIRVSSRKVLQAVLNMYSIPEHLFTEVCVIVDKLGKLTREEIEKELMSTGLSSEAVQGIIEVLSLKSLSKLEEVLGSGVEAVADLKKLFSFAEQYGYADWICFDASVVRGLAYYTGIVFEAFDREGKLRAICGGGRYDRLLSTFGSEDIPACGFGFGDAVIVELLKEKGLLPDMSRQIDDIVFPLDEELEGPASSIASSLRKKGRAVDLVEDKRLKWVFKHAERINASRLILVGNSEWERGMVRVKILSTREEFEVKAGDLE

SEQ ID NO: 31465 - DNA, 2346 bp, Panicum virgatum
  misc_feature: Ceres CLONE 1905571
  misc_feature: Encodes the peptide sequence at SEQ ID NO. 31466
cttccggcctcctcggtcaaaccgcctttctctctcctactcttctccccctccctccctctccggctctccctctccctctctaaaaaaaaagtagcgcccggagaaccagaggctgcagaaagaggcggaaagaggcagcaaaatctcactttgttgagaattctttcctctgttcttttagggttcttggttggtggaatggaagctcggcatccccatttgtgcccccgagatcttcgtcgttcccctcgtgtgtagcctttaggaaggaggaatttcgtttcacatgatccgtttctgttcctgacggcgttgtcgcgctctgctccagtccgcgcaccctgctactgcttcgctttttggggagagaagaggaagcaaatcattggtctttggagacgttgtccagcccagttcagttgacatatattactggcaagcatgaccggcactggcaaccatggatccctcatggaggaatggttcccgcccctcacaccaagcccaagaacactcatgccaagtttcctgaatgaagaattcagctctggtccattctctaatcttttcagtgaacatggcactaacaagcctcatgatcaatgcgaaaagagcagagaacttgtgagtatgggcgaggaggtgcctgctcaagctgtcaaagacagatttcataagggtttttccctggagccgaatttgttcagtgctactcagaaatcaaactcacatggtggtttggcggagcgcagggctgcaagagcaggtttcagtgtttcaaaaattgatacttctcgagttggttcatctgcagttattcggtcacccgtgtcaattccacctggtcttagtccaactacacttcttgagtcacctgtttttctttacaataagatggcacagccttctccaactactggcacattgccatttttgatggcaacgaatgataagtcaacaataccactagctgctaagataactgaagattctacatttgataatgatgttttttctttccaaccacacttgggttctaaacaaccaagcttatctactgcagaaatggactacggtgtttatcatcaaaaccagtccgtgtcaagctttcctgtagttaaggataacagcaatgcaacaattgttaaagcaaaggcatctgactccatttttggcaatagtcccaattcaactgaccaaaagcaagattatgagacaaaccaaaatgcacaaggcgaaggtgttgaggctagaacagctgcttgcttccctgtatcaactcatggtgatgcgtctctaatgggctctcaagatgcagttgatgtctcatcaacgctgtctaacgaggaggatgagagggcaacacatggcaccgtttctatagaatgtgagggtgatgatgatgagactgaatctaaaagaaggaagctggatgctttaggaacttctactattgctactgctgttgccaccagtaccattgacatgggagctgcagcctctagagctgtccgggagcctagggtggttgttcagaccacaagcgaggtcgacatccttgacgatgggtatcggtggcgcaagtatggtcagaaggtcgttaaaggcaatccaaatccaaggagctactacaaatgtacgcaccctggctgttcagtgcgcaagcatgtggaaagagcatctcatgatctgaaatccgtcatcactacatatgaaggaaagcacaaccatgaagttccggcagccagaaacagtgggcaagccggttctagttctgccaacgctccatctgcctcacaaggtagtagttctcaccgtaggcatgaaccagcacaagccagttttgctcattttggtgctagccctcctttcggctcctttggccatttgggaccagcaacaggcaatttccgcttcgggatggttccaccgggcatggcgattccgatgccctctctaggatctcttgctccaacaaagattgttggaaattcatcagctatgcagggatacccaggcctcatgatgccagtggaaccgaaggcggagccagtatcgcaaccgggcttcccaacaacaaatgcagccccatcagcctaccaacagatgatgagcaggcctccttttggtcatcagatgtaaataataggaaagaggaaaagggatagatttgcttcagcttgtatacatgatagtgacgctgcaacattgctttgttctactagtttttttccccatccctttgcgcatttctttgaagcaaagaatgctgaagatggtgccttatcgtcatgtaatcgtctatgaaaattggaaatcaatcaatcaaaccttctggttgcg

SEQ ID NO: 31466 - protein, 566 aa, Panicum virgatum
  misc_feature: Ceres CLONE 1905571
  misc_feature (373)..(432): Pfam Name: WRKY Pfam Description: WRKY DNA -binding domain
  misc_feature: The sequence is a functional homolog of SEQ ID NO 1390 in the 10/412,699 US patent application
  misc_feature: The sequence is a functional homolog of SEQ ID NO 514 in the 10/374,780 US patent application
  misc_feature: The sequence is a functional homolog of SEQ ID NO 1389 in the 10/412,699 US patent application
  misc_feature: The sequence is a functional homolog of SEQ ID NO 513 in the 10/374,780 US patent application
  misc_feature: The sequence is a functional homolog of SEQ ID NO 515 in the 10/374,780 US patent application
  misc_feature: The sequence is a functional homolog of SEQ ID NO 1640 in the 11/479,226 US patent application
  misc_feature: The sequence is a functional homolog of SEQ ID NO 2 in the 10/225,066 US patent application
  misc_feature: The sequence is a functional homolog of SEQ ID NO 254 in the 10/374,780 US patent application
  misc_feature: The sequence is a functional homolog of SEQ ID NO 30 in the 10/714,887 US patent application
  misc_feature: The sequence is a functional homolog of SEQ ID NO 30 in the 11/435,388 US patent application
  misc_feature: The sequence is a functional homolog of SEQ ID NO 808 in the 10/412,699 US patent application
  misc_feature: The sequence is a functional homolog of SEQ ID NO 86 in the 10/412,699 US patent application
  misc_feature: The sequence is a functional homolog of SEQ ID NO 202 in the 10/714,887 US patent application
  misc_feature: The sequence is a functional homolog of SEQ ID NO 202 in the 11/435,388 US patent application
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
MTGTGNHGSLMEEWFPPLTPSPRTLMPSFLNEEFSSGPFSNLFSEHGTNKPHDQCEKSRELVSMGEEVPAQAVKDRFHKGFSLEPNLFSATQKSNSHGGLAERRAARAGFSVSKIDTSRVGSSAVIRSPVSIPPGLSPTTLLESPVFLYNKMAQPSPTTGTLPFLMATNDKSTIPLAAKITEDSTFDNDVFSFQPHLGSKQPSLSTAEMDYGVYHQNQSVSSFPVVKDNSNATIVKAKASDSIFGNSPNSTDQKQDYETNQNAQGEGVEARTAACFPVSTHGDASLMGSQDAVDVSSTLSNEEDERATHGTVSIECEGDDDETESKRRKLDALGTSTIATAVATSTIDMGAAASRAVREPRVVVQTTSEVDILDDGYRWRKYGQKVVKGNPNPRSYYKCTHPGCSVRKHVERASHDLKSVITTYEGKHNHEVPAARNSGQAGSSSANAPSASQGSSSHRRHEPAQASFAHFGASPPFGSFGHLGPATGNFRFGMVPPGMAIPMPSLGSLAPTKIVGNSSAMQGYPGLMMPVEPKAEPVSQPGFPTTNAAPSAYQQMMSRPPFGHQM

SEQ ID NO: 31467 - DNA, 2649 bp, Panicum virgatum
  misc_feature: Ceres CLONE 1905577
  misc_feature: Encodes the peptide sequence at SEQ ID NO. 31468
aacacatatacagaggcacagagcaacgacgaaaccgtggaggagcgaacaggcgaacgacgaaaccgagcccacgccaccgcacgcacgcgcagagcgcaggcgcgtcccaccaccacctcctcctcgcccgatccgcccgccccgccgctccctgatgtcggccgccgatccctccgcggcgccgcccgccgacccggacggccccgacgccgtccgcctcacctggaacgcctggccgcgctccaaggtcgaggccagccgctgcgtcgtgccgctcgccgccaccgtctcgcccgcccgcgtcccggacccctcagccgcgtccccgccgccgctcccctacccgccgctccgctgcaagccgccttgctcggcccttctcaaccccttcgcgcgcgtcgacttcgccgccaagatctggatctgcccactctgcttctcccggaaccacttcccgccgcactacgccgccatctctgagtccaacgtccccgccgagctcttcccgcagtgctccaccgtcgagtacatcgttggtggtgcccccggcgctcccggggccgccggcgccccgccggcgcccgtcttcctcttcgtcatcgacacatgcgtcattgatgaggagctagagtacgtcaagatggccatgcggaaggccgtcgcgctcctacccgagcacgcgctcgtcggcctcgttaccttcggcacgcaggtccacctgcacgagctcggattctctgatctcagcaagatctacgtcttccggggtacaaaggagatttccaaggagcaaattttggatcagctggggctggctggtgcaagccgtccgggcttccccaagatgccgcagcagccaggtgggccacaggtgaacgggatgcatccggcagcaacggccggggtgaataggttcctgctcccggtgtcggagtgcgagtgcactctcagcacgttgctggatgagttgcagcccgatcaatggccagtggaggctgggaaccgtgcaatccggtgcacgggtgttgccctgagcgtggccgctgggttgcttggtgcttgcatgcctgggacaggtgctaggatcattgcattgctcggtgggccatgtaccgaaggccctggaatgattgtttccaaggatttgtcggagccagttagatcgcataaggatctcgacaaggatgcagctcctcacttccagaaagctgtcaaattttatgatagtcttgccaagcagttggtcagtcaaggccacgtgttagatgttttcgcatctgctcttgatcaggttggactagctgagatgaaggttgctattgagagaacaggtggccttgttgtcttatctgaaagttttgggcattccgtattcaaggattctttcaaacgcatttttgagggaggtgaacagtctctaggtctttcgttcaatggaacaattgaaataaactgttcaaaagacattaaggtccaaggtattattggaccatgtacatctttagagaagaaaggagctttgtgtgctgacacagttgtcggtcaaggaaatacaacggcatggaaaatgtgtggtctcgataggaatacttcattgactgtgttttttgatgtctcacctagtgagcgatcgagccaaccaggacatcaaaatccacatttgtatatacaatttgtaacaagttaccaacacccagaaggccaaatgaggataagagttactaccatatgcaggaaatgggtggatggttccactaatactgaggaattagttgaaggttttgaccaggaaactgcagctgttgtgttggcaagatatatctctttgaaaatggaaatggaggaagagttcgatgcaacacggtggcttgatagatctctgatacggctttgttcacgatttggggattatcgaaaggatgaccctacttcatttagcctgcattcaaatttctcattgttccctcaatttatgtttaatctccggcgttcacaatttgtccaggttttcaataatagtccagatgagacagcttatttccggatgttactcaaccgtgaaactgtcaacaactccgttgcaatgatccagccttcattaatatcattttcttttgattcacctccttcgccagtattccttgatgtggcatcaatagcagcagaccggatactgcttcttgatgcatactttagtgttgtcatcttccatggcatgacaattgctcagtggcgaaacatgggctaccagaaccaacctgagcatgagcaatttgcacaactattacaagcaccccatgaggaggcgcagatgataataaaaggccgatttccagttccaagactagttgtatgcgaccaacatggctcgcaggcaaggttcttattggctaagctgaatccgtcggccacatataactcagctcacgatgtcgcccctggttctgacatcattttcactgatgatgttagcttccaggtcttctgtgagcaccttcaaaggctggctgttcagtcttgaggacatgtatgcaaaaaattgtacaccctatttgatagttgctgataatttacagggtctgtaggttggagttgtgggaaaatttgccttgctgtttttttggtcatatatccttacattgtgac

SEQ ID NO: 31468 - protein, 788 aa, Panicum virgatum
  misc_feature: Ceres CLONE 1905577
  misc_feature (140)..(415): Pfam Name: Sec23_trunk Pfam Description: Sec23/Sec24 trunk domain
  misc_feature (425)..(530): Pfam Name: Sec23_BS Pfam Description: Sec23/Sec24 beta-sandwich domain
  misc_feature (545)..(645): Pfam Name: Sec23_helical Pfam Description: Sec23/Sec24 helical domain
  misc_feature (654)..(744): Pfam Name: Gelsolin Pfam Description: Gelsolin repeat
  misc_feature (64)..(104): Pfam Name: zf-Sec23_Sec24 Pfam Description: Sec23/Sec24 zinc finger
MSAADPSAAPPADPDGPDAVRLTWNAWPRSKVEASRCVVPLAATVSPARVPDPSAASPPPLPYPPLRCKPPCSALLNPFARVDFAAKIWICPLCFSRNHFPPHYAAISESNVPAELFPQCSTVEYIVGGAPGAPGAAGAPPAPVFLFVIDTCVIDEELEYVKMAMRKAVALLPEHALVGLVTFGTQVHLHELGFSDLSKIYVFRGTKEISKEQILDQLGLAGASRPGFPKMPQQPGGPQVNGMHPAATAGVNRFLLPVSECECTLSTLLDELQPDQWPVEAGNRAIRCTGVALSVAAGLLGACMPGTGARIIALLGGPCTEGPGMIVSKDLSEPVRSHKDLDKDAAPHFQKAVKFYDSLAKQLVSQGHVLDVFASALDQVGLAEMKVAIERTGGLVVLSESFGHSVFKDSFKRIFEGGEQSLGLSFNGTIEINCSKDIKVQGIIGPCTSLEKKGALCADTVVGQGNTTAWKMCGLDRNTSLTVFFDVSPSERSSQPGHQNPHLYIQFVTSYQHPEGQMRIRVTTICRKWVDGSTNTEELVEGFDQETAAVVLARYISLKMEMEEEFDATRWLDRSLIRLCSRFGDYRKDDPTSFSLHSNFSLFPQFMFNLRRSQFVQVFNNSPDETAYFRMLLNRETVNNSVAMIQPSLISFSFDSPPSPVFLDVASIAADRILLLDAYFSVVIFHGMTIAQWRNMGYQNQPEHEQFAQLLQAPHEEAQMIIKGRFPVPRLVVCDQHGSQARFLLAKLNPSATYNSAHDVAPGSDIIFTDDVSFQVFCEHLQRLAVQS

SEQ ID NO: 31469 - DNA, 1933 bp, Panicum virgatum
  misc_feature: Ceres CLONE 1905586
  misc_feature: Encodes the peptide sequence at SEQ ID NO. 31470
gaaaaattgaacacaccgaaagctcccggacgggaagacgacttggtggttggtgctcgtgctgccgcgagatctaaccaaaccccgcgccctcctcaccgtccggcgagccccgaccctgcagatcaccggcgctcgagtggtacccagaggcgcgcggtggaaccggcgccgagataagggcggcgccagacgctcggtccgcgggcgacgatgccggtgacggcgtcggccatctacttcctcaacctccgtggggacgtcctcatcaaccgcctctaccgcgacgatgtcgggggaaatatggttgatgcgttcaggatgcatattatgcaaacaaaagaacttggcacatgtcctgttcggcaaataggaggctgttccttcctttacatgaggatcagtaatgtttatattgtgattgtggttagcagcaatgctaatgttgcttgtgctttcaagtttgtagtcgaggcagtggctctctttaagtcctactttggtggagcttttgatgaagatgccataaggaataactttgttttaatatacgaacttcttgatgagattatggattttggttatcctcaaaatctgtcacctgaaatcttgaagctgtatataactcaagaaggtgtccggtcaccattttcctcaaaggcctcagacaagcctgttccaaatgcgacccttcaagtcactggtgctgttggttggagaagagagggtcttatgtacaagaagaatgaggttttcttggacatagttgagagtgtaaaccttctcatgtcttcgaaagggagtgttctgcgatgtgatgtgacaggaaagattcttatgaagtgcttcctttctggaatgcctgatctgaagctgggattaaatgacaagattgggcttgaaaaggaagcccaactgaagtccaggcctacaaaaagtggaaagaccatagaacttgatgatgtcacgttccatcagtgtgtcaacttaacaagatttaactcagaaaagacagtcagctttgtgccaccagatggtgaatttgaattgatgaagtaccgaatcacagagggtgtaaaccttccattccgtgttcttccgacaattaaggaattgggtcgaacgcggatggagattaatgtgaaagtcaagagtgtttttggtgctaagatgttcgcactaggtgtcgttgtcaaagtaccagttccaaagcagacagcgaagactagcttccaaacaacatcaggcaaagcgaaatacaatgcttcgattgattcactggtgtggaagatcaggaaattccctggacagactgaggcaactatgagtgcagaggttgagttgatctctaccatgggtgaaaagaagtcatggaacagaccacctattcagatggaattccaggttccaatgttcactgcttctggtctacgtgttcggttccttaaggtctgggagaagagcggttacaacactgttgagtgggttcgctacatcacgagagcaggatcatacgagataaggtgttagtgacagataaatctttcaagctccatcgaacagttatttcaatgatccacagagatctctgtacggtgtcatgcatgattataaagcgtgtatactgtgatgactatcttcaaacctcgtacttcagcagagggggcaggccagggcagaccagacagttttcctttatgttcttctattcactgtagtctgggatatctattctccccctcgtgccctgtttgtttggtagggagtatttttgtttgtatatttggcgccagcgttccttgttgatcaatatacaccccttatcagtttgtattatttttcgccttaaatggatgagtggtttcacttggcataacagtgtacaaacattagatgcataagattcgtataattgcagagcagtgttttggcg

SEQ ID NO: 31470 - protein, 438 aa, Panicum virgatum
  misc_feature: Ceres CLONE 1905586
  misc_feature (166)..(438): Pfam Name: Adap_comp_sub Pfam Description: Adaptor complexes medium subunit family
MPVTASAIYFLNLRGDVLINRLYRDDVGGNMVDAFRMHIMQTKELGTCPVRQIGGCSFLYMRISNVYIVIVVSSNANVACAFKFVVEAVALFKSYFGGAFDEDAIRNNFVLIYELLDEIMDFGYPQNLSPEILKLYITQEGVRSPFSSKASDKPVPNATLQVTGAVGWRREGLMYKKNEVFLDIVESVNLLMSSKGSVLRCDVTGKILMKCFLSGMPDLKLGLNDKIGLEKEAQLKSRPTKSGKTIELDDVTFHQCVNLTRFNSEKTVSFVPPDGEFELMKYRITEGVNLPFRVLPTIKELGRTRMEINVKVKSVFGAKMFALGVVVKVPVPKQTAKTSFQTTSGKAKYNASIDSLVWKIRKFPGQTEATMSAEVELISTMGEKKSWNRPPIQMEFQVPMFTASGLRVRFLKVWEKSGYNTVEWVRYITRAGSYEIRC

SEQ ID NO: 31471 - DNA, 718 bp, Panicum virgatum
  misc_feature: Ceres CLONE 1905645
  misc_feature: Encodes the peptide sequence at SEQ ID NO. 31472
gtctgctaaaggctaaagctcaccccctccgccccccaacgcgccccctccgccccccaacgcgcccgacctcacccaaatccccccacctccctcccacccctgctccgcggcgttctatggcatacacctcctccctccacctccccaagcacctgctcctgcccaacccccgccggaccaggcacaggtcctcctcctccgtctccttcgtccccgccgccgcggccagggccaacggcgtggacgggcgcgcgcccgagaagaagccgccgccgcccaaaggcaaggcgcgcatcaacggcgtgaacggcaagaagggggcgaacgggcacgtcaacagcaacaagggggtgaacgggcacgtcaacggcaacaagggcgtcaacggccatgccgaccggatccacctctcggtgagcacgggcggcggcggcgcgggggcacaggacggctccgggctccgcgtggcgttccagggcgcgcccggcgcgtacagcgagttcgcggccaagacggcgctgcccgggtgcgacacggtcccgtgccggaccttcgcggacgcgctggcggccgtggagcggggcgccgccgaccgcgccatcctccccgtggagtccaccatggagggcaccacgctacggaactacgacctgctgctgcggcacggcctggtggtggcgcaggagatcaacctcttcgtgcactactgcctccc

SEQ ID NO: 31472 - protein, 199 aa, Panicum virgatum
  misc_feature: Ceres CLONE 1905645
  misc_feature (117)..(199): Pfam Name: PDT Pfam Description: Prephenate dehydratase
  misc_feature: SWISSPROT Homolog: EC 4.2.1.51 Prephenate dehydratase
MAYTSSLHLPKHLLLPNPRRTRHRSSSSVSFVPAAAARANGVDGRAPEKKPPPPKGKARINGVNGKKGANGHVNSNKGVNGHVNGNKGVNGHADRIHLSVSTGGGGAGAQDGSGLRVAFQGAPGAYSEFAAKTALPGCDTVPCRTFADALAAVERGAADRAILPVESTMEGTTLRNYDLLLRHGLVVAQEINLFVHYCL

SEQ ID NO: 31473 - DNA, 1023 bp, Panicum virgatum
  misc_feature: Ceres CLONE 1905663-R
  misc_feature: Encodes the peptide sequence at SEQ ID NO. 31474
aataacgcccagatgcacatgccattggatgaccttacgccactaccgatgagaaacatgatgatcacggcccctgctatgcatggtaatatgacgagatgcctacagcgtttagtggatgcagcgaggaattcttccggtgtcatcctcaacaccttccaagaccttgaggattcagatatccaaaagatcaccagtggcctcggtgttctggtgtacacgatagggccgcttcacaagatttcgtcaggcactgagagcagcttgctagcacaagaccagacttgcttgaagtggttggacaagcaagaggctgactctgttctttatgtgagcttggggagcttggcgtctatggatgagaaggaactgttggagacagcatggggcttggccaacagccagaggccgtttctgtgggtgatccgccataacatggtcaagtcctcatcacacgaggtgagcctgccggatggctttgaggaggcgacccatggtaggggaatggtggtgccatgggcccctcagcaagaggttcttgctcaccatgccattggcggcttttggactcacaatggatggaactcgactctggagagcatttgcgagggtgttccaatgatatgcaggccccaatttgccgaccagatgataaacatgaggtacgtccaagaagtgtggaagataggatttgagctagaaggggagttggagagggggaagatcgagatggccattaccaagctactgtgttcggaagaaggtagacagatgagacagagggccgaggatctgagggacaaagctgcaaagtgcattgaggaagaaggctcttcccaatctgcaatagagttgctgctgaagcgcataatgtcattttagatatattttttcattcatgtatatgaagaaactattgttgttattagatgtattatgttgttcccataaattgagaagctagttcttctgcttgcattgattcgttaaaataaataaagtcacaggatgacatacttttat

SEQ ID NO: 31474 - protein, 289 aa, Panicum virgatum
  misc_feature: Ceres CLONE 1905663-R
  misc_feature: SWISSPROT Homolog: EC 2.4.1.115 Anthocyanidin 3-O-glucosyltransferase
MHMPLDDLTPLPMRNMMITAPAMHGNMTRCLQRLVDAARNSSGVILNTFQDLEDSDIQKITSGLGVLVYTIGPLHKISSGTESSLLAQDQTCLKWLDKQEADSVLYVSLGSLASMDEKELLETAWGLANSQRPFLWVIRHNMVKSSSHEVSLPDGFEEATHGRGMVVPWAPQQEVLAHHAIGGFWTHNGWNSTLESICEGVPMICRPQFADQMINMRYVQEVWKIGFELEGELERGKIEMAITKLLCSEEGRQMRQRAEDLRDKAAKCIEEEGSSQSAIELLLKRIMSF

SEQ ID NO: 31475 - DNA, 825 bp, Panicum virgatum
  misc_feature: Ceres CLONE 1905663
aaaccccaacgcaattccttgcgatccccccccccccctttggttcgatcgatcccgttccctgatcccgtctcgatgtgacgcatcatcgatccatgtggtccttatcccgatcgcctcgagtcaaatcattttataatacgcacccacctgctgcgctccaaggcagcacgcacgcaaagctagtttcttgagcagccatggcgacggcgggggaggcggcgtctccggcgggctccggcggtgggcgccggcggcgcgtgctgctgttcccggttccgttccagggccacctcaccccgatgctgcagctggccggggcgctgcacgcgcggggcggcggcggcctgggcgtcaccgtgttccatgccgccttcaacgcgcccgacccggcgcgccaccccgcggggttccgcttcgtccccgtcggggagggcgtgccgtcggccgacctggtcccgtccggcagcgacgcggacttcgccggcgcgctgctgcggatcgacgaccgcctccgggaaccgttccgggagtgcctgcgccaggcgctcgccgaggaggaggaggaggaggagggcggcggggcggcggcggcgtgcctggtggtggactccaacctgcgcgggatgcagctggtggcggaggagctcggcgtgccgacgctggtcctgcgcaccggcggcgccgcctgcctcttcgcctacatggcgttcccggtgctctgcgacaagggcctcctcccgccggcgtcccaagataaggcccagttggacatgccattggatgagcttacaccactacggttgagagacgtggtgttctcgc

SEQ ID NO: 31476 - DNA, 1631 bp, Panicum virgatum
  misc_feature: Ceres CLONE 1905669
  misc_feature: Encodes the peptide sequence at SEQ ID NO. 31477
attcactggcactgcaggaggctctgacctctgcaatcccggggttccaacagcgcaactaatgctaaaccccgcttcaatccaccggattaaaccctagccaccggcggctccgtctccgcgcctccccccatgccgctctgccactcccccacctccgccgccgtcgcggcggcggcgtctcccatcgccgcccgcagcgggggactccttcgccgctcgcgcccagcccccgccgtcgtgagatgtaaaaaggttgattctctgagggcaatcaatggatcaccgccatgcattccagtgtccgacatgtcactattgactcctgtaaccttgccggttttccgggatccaagcatgaggaacgacacaaggttgcgcatcttctcaggcacagccaatccttccctttcccaggagatagcaagctacttgggtctagaactcgggaagattaacataaaaaggttcgcggatggtgaaatatatgtccaattacaagaaagtgtgcggggctgtgatgttttccttgtgcaaccaacgtgccctccagcaaatgagaatctcatggaacttctgatcatgatcgatgcctgtaggagagcatccgctaagaatattactgcagtcatcccttattttggttatgcaagggctgacaggaagtctcaaggccgggaatctatagctgcaaagcttgtagctaatatgattacagaagctggtgcaaaccgtgtccttgtttgtgatcttcattccagtcaagcaatgggatacttcgacatcccagtagatcatgtttatggccagcctgttatccttgattatctcgccagcaagacaatctgttcaaatgacttggtggttgtatctcctgatgttggaggtgttgccagggcacgtgcttttgccaaaaagctttcagatgcacctctagctattgtagataaaagaaggcatggacacaatgtcgctgaggtaatgaatcttattggagatgttagaggaaaagtggctgttatgatggacgatatgattgacacagcaggaactattgccaaaggagctgagctactgcatcaggaaggagctcgagaagtatatgcttgctgtacacatgctgttttcagcccacctgccattgaaaggttatcaagtggtttgtttcaagaagtaatcatcacaaacactatccctcttaaggaggagaagacttttccgcagctgaccattctttcagttgctaacctcttaggtgaaacaatctggcgtgttcacgatgattgctcagttggtcatgagccatactccagcttggatattgactaacgcttaaggtgtattactcatgccgcgcccttcatgcctaggaatagtttttcatcttattttgggtgggccttagtttttattttcttgtgtgtgtactctgtaataagcggccctatgttatgtctgattccttcagcaaagaagcaaagaacctaagaacctcaaacatgtattttcttgtgtgtgtcctctgtaataagcggccctatgttatgtgtggttcctttagcaaagaagcaaagaacctcaaacatgtatttgaatgacagtacagtacataatttggaattttgggttgt

SEQ ID NO: 31477 - protein, 339 aa, Panicum virgatum
  misc_feature: Ceres CLONE 1905669
  misc_feature (158)..(291): Pfam Name: Pribosyltran Pfam Description: Phosphoribosyl transferase domain
  misc_feature: SWISSPROT Homolog: EC 2.7.6.1 Ribose-phosphate diphosphokinase
  misc_feature: Useful for making plants with modulated biomass
MSLLTPVTLPVFRDPSMRNDTRLRIFSGTANPSLSQEIASYLGLELGKINIKRFADGEIYVQLQESVRGCDVFLVQPTCPPANENLMELLIMIDACRRASAKNITAVIPYFGYARADRKSQGRESIAAKLVANMITEAGANRVLVCDLHSSQAMGYFDIPVDHVYGQPVILDYLASKTICSNDLVVVSPDVGGVARARAFAKKLSDAPLAIVDKRRHGHNVAEVMNLIGDVRGKVAVMMDDMIDTAGTIAKGAELLHQEGAREVYACCTHAVFSPPAIERLSSGLFQEVIITNTIPLKEEKTFPQLTILSVANLLGETIWRVHDDCSVGHEPYSSLDID

SEQ ID NO: 31478 - DNA, 676 bp, Panicum virgatum
  misc_feature: Ceres CLONE 1905677
  misc_feature: Encodes the peptide sequence at SEQ ID NO. 31479
tccagaggctctcaaggctgtcccttgtttatcattgcaagatatccccaaaaatcctattcatataccaatggaggttggagagataaatggtgtcaaggttttgcaacacgatctcttcaccaatgatgttgtctactctgaagttgtatttgacatgggctcaatgaagaaagagcacctacagttgctaccattgttctgccaatccttgctggagatgggcacaaaagacatggactttgtgcaacttaatcaattaattggaagaaaaactggaggcatatcagtttacccgttcacatcgtcagttaggggtaaagaagatactcttactcgcattattgttcggggaaaggcaatggcaccacgagtagaagatttgtttaatctgatgtacaccattcttcaagacgttcagttcacagaacaacagaggttcaagcagttcgtttgtcaaagtaaagcaagaatggagaatcgcttgaggggcagcggccatggcatagcagctgctagaatggatgctaagttaaatgcagctggatggattggtgaacaactgggtggtgttagttatctcgagtatctgcgggacctggaaactaagattgatcaagactgggacagcatatcatcttcacttgaggagatgagaaaatcactcttttccaag

SEQ ID NO: 31479 - protein, 224 aa, Panicum virgatum
  misc_feature: Ceres CLONE 1905677
  misc_feature (1)..(200): Pfam Name: M16C_assoc Pfam Description: Peptidase M16C associated
PEALKAVPCLSLQDIPKNPIHIPMEVGEINGVKVLQHDLFTNDVVYSEVVFDMGSMKKEHLQLLPLFCQSLLEMGTKDMDFVQLNQLIGRKTGGISVYPFTSSVRGKEDTLTRIIVRGKAMAPRVEDLFNLMYTILQDVQFTEQQRFKQFVCQSKARMENRLRGSGHGIAAARMDAKLNAAGWIGEQLGGVSYLEYLRDLETKIDQDWDSISSSLEEMRKSLFS

SEQ ID NO: 31480 - DNA, 527 bp, Panicum virgatum
  misc_feature: Ceres CLONE 1905685
  misc_feature: Encodes the peptide sequence at SEQ ID NO. 31481
gttaaattgattctcctctcctttcatatcctgctgtacttacattagacatggatgcaacgttctttctgctttctagggcgccggaaaggcgcttgccgaccagcaaggcctgcgttgcgttgtgtaactacgaggagtcgatgacggtgggccccgacgtgcctaggctgtcggatgactactatctgatcgagtacgggccccccttccccccccagcgcttcccgaagcgggcggcgccgccgagcggctcctccccgacgggcttcttccatactccaacgacgtgtcggacctcacctgcgtcgactacctccgcgccctctgcgcccgcaagccggtgatcgtcctcttgtccacgctgatccatctgcgcgcgctccctgagacgatcctcgaccacggcgggactcgccgtgctgttctccacgcgggagggcaactgggacctgctgggcaacaacttccccgtcttcttcatccgccacagcatcaagatccacaacgtgaaccacgccttcaag

SEQ ID NO: 31481 - protein, 98 aa, Panicum virgatum
  misc_feature: Ceres CLONE 1905685
  misc_feature: SWISSPROT Homolog: EC 1.11.1.6 Catalase
MDATFFLLSRAPERRLPTSKACVALCNYEESMTVGPDVPRLSDDYYLIEYGPPFPPQRFPKRAAPPSGSSPTGFFHTPTTCRTSPASTTSAPSAPASR

SEQ ID NO: 31482 - DNA, 2428 bp, Panicum virgatum
  misc_feature: Ceres CLONE 1905688
  misc_feature: Encodes the peptide sequence at SEQ ID NO. 31483
aatttccccatccttccctttgaatcagaaaccctagcttcagaaggccgggatggccgcatccgctaccgccgatgggacttctccggcgcccaccttgacggagggagaaacccaagcagcggagcatgttgggagagggcgaggagagggcgaggagatccatgtgggggtggcggctgcaattgaggaggatggtgaggtggagcctgtggaggatcctgacgagcaggcggaagatgaggaggaagtggaaggggatgcaggggaggtagaggctggggatgtgatgggggcatcgttgatggagcccctggtggcgttgaagcctggggaggaggacgaacccgaagagctggagggggcgaaggaagagctggatgaggaatccgatgagactacgccttcggaagaggagcccgaggaggtggaagagggcaaggaggaatgcgacgatattgtggagaaaggcctgttggatcgatctgcggcgaacgatgcgaatgaagtatccaaacaggaacatggtaaatgtggcggcacaaataaggataaagttgctgatcgattcatgaaagtcagttatagctgtggaagcaaaagaaatgatgcgcagaactctgaacttgctggaggtcttgaaatacttgttgaccaattgcctaaagattgtgttgaggaagacattgcaatggttttttctcaatgcggggatgttaaatctgttaggataattaaaaattcatcatccaaaaagaacaatgatattgcatttgtctgttatgcaagcattgaagctgcaaagaaagctcttgttgaatttaaggagggaattgaggttaaaggaggaaaggtcagggtatcttcttgtcaagataataatgtcctttacctgggaaacatatgtaagggctggaccaaagatcaggtgctgaccaccttaaaaagtatagggattcaagactacgagataaattttcccacttccaagagaagaggcagagggtttgcttttcttaaatttgcctcacattactatgccagagcagcatttcaacagttaattaaaacagatgctatttttggcactgatagaagtgctaaagtatcattttgtcaaacccatgtaaaaccaagtgagaatcttatagaggctaaaaaagtatacctggaatgtatccctctttcttgggatgaagataaaattaaagaatgctgtcaacaatacgggaagattctgaaagttgaccttctccagatatcaaagaacataaaaattgaaaccttttcttttgttgaattctcctccagcatgagtgcattagcttgtgtggaaggaataaacaatgctaatattgtcgatgcaggcttcaagttgtctgcgtgtcttgttcgacctaaaagtagtttaaaggccagtagtggtgaaacatcagaaggtgctactacatctaagaaggataaagcccacacagggagggttgttgtagacaaggattcaccacataaattgccaaaaggcaaaaagaagcttaccactctcacaaaggagatcattgtgaagatgaattcaccaagtgaattaccaaatgattctgatgtaaagctaacctcacatggtgctgcagaagtactgcaaacatccaatccttctgaatggaagaggaaagttgggaattacaaaaatgcctctgtaaaccaaaaaccatcacagaaagcggaaaatgatagtaatgttgatgagagccagggaacctatcaacgtgctgcagtattgaaaacatctaacagttccagaagaaaaaggaaagctggcaagaacaaaaatatctatataaatgaaagatcactgaagagagcacataacaatagtaatatggatggaagttcgagatctaaagcatatgcctctgatctggcacctcatgctggattcatccctcctgcaagtcaagttcacagcacccatgcatatgatcggcaaagaattgcagaatatggtgtccatccaatagatcgtcatccttatgctagagaaactgcagcttcacgatcagcttactatggtcatacaagctatgctgactatgaggctggatatacatatgtatacccgcccccgccacctcctagtgcatcttattatccaaggaatggttcatacacccctcgaagagactattaaataaaatcaagtggcagctgctcatctccgtgcttccatttgatattttgatccacatgataacgaggacctgagttcattccagtgtatatatttagatgcctcacctagttgttcaaacttcaaaacctaatcttaacagaaataagaactctgtgccttcctattttgctgaaagaaaatcaacgatacggaagtgcagtcttgcacaccggtttggatgttaaagaagaatgcccgccc

SEQ ID NO: 31483 - protein, 710 aa, Panicum virgatum
  misc_feature: Ceres CLONE 1905688
  misc_feature (198)..(270): Pfam Name: RRM_1 Pfam Description: RNA recognition motif. (a.k.a. RRM, RBD, or RNP domain)
MAASATADGTSPAPTLTEGETQAAEHVGRGRGEGEEIHVGVAAAIEEDGEVEPVEDPDEQAEDEEEVEGDAGEVEAGDVMGASLMEPLVALKPGEEDEPEELEGAKEELDEESDETTPSEEEPEEVEEGKEECDDIVEKGLLDRSAANDANEVSKQEHGKCGGTNKDKVADRFMKVSYSCGSKRNDAQNSELAGGLEILVDQLPKDCVEEDIAMVFSQCGDVKSVRIIKNSSSKKNNDIAFVCYASIEAAKKALVEFKEGIEVKGGKVRVSSCQDNNVLYLGNICKGWTKDQVLTTLKSIGIQDYEINFPTSKRRGRGFAFLKFASHYYARAAFQQLIKTDAIFGTDRSAKVSFCQTHVKPSENLIEAKKVYLECIPLSWDEDKIKECCQQYGKILKVDLLQISKNIKIETFSFVEFSSSMSALACVEGINNANIVDAGFKLSACLVRPKSSLKASSGETSEGATTSKKDKAHTGRVVVDKDSPHKLPKGKKKLTTLTKEIIVKMNSPSELPNDSDVKLTSHGAAEVLQTSNPSEWKRKVGNYKNASVNQKPSQKAENDSNVDESQGTYQRAAVLKTSNSSRRKRKAGKNKNIYINERSLKRAHNNSNMDGSSRSKAYASDLAPHAGFIPPASQVHSTHAYDRQRIAEYGVHPIDRHPYARETAASRSAYYGHTSYADYEAGYTYVYPPPPPPSASYYPRNGSYTPRRDY

SEQ ID NO: 31484 - DNA, 691 bp, Panicum virgatum
  misc_feature: Ceres CLONE 1905692
  misc_feature: Encodes the peptide sequence at SEQ ID NO. 31485
attccaacagcttcttcccctcaaagaccactccggcgagattcttcccagaccggccggcgaatcacagctcgatcgatcgttctccggcgagctagcaaccactccctgatcggaatggacttcggaggggcgctgcagctgccgccggggttccggttccacccgacggacgaggagctggtgacgcactacctcctgcgcaagtgcggcgggctggcgccggcggcgccggtgatcgcggaggtggacctgtacaagttcgacccgtggagcctgccggagcgggcggccggcggggagaaggagtggtacttcttctcgccgcgggaccgcaagtaccccaacgggtcgcgccccaaccgcgccgccggcgccgggtactggaaggccaccggcgccgacaagcccgtgggcgcgccgcgccccgtcgccatcaagaaggcgctcgtcttctacgccggcaagccgcccaggggcgtcaagaccaactggatcatgcacgagtaccgcctcgccgacgtcgaccgctccgccgccgcccgcaagaagacggccaataacaacgcgctcaggcgtgctcgagctgtccctttcgtgacagcccgcggctacttgcagacggctggcccgggcgctctagagacctgtaaagctcgggcggcatggcgtcacggctcacgcaccggcg

SEQ ID NO: 31485 - protein, 191 aa, Panicum virgatum
  misc_feature: Ceres CLONE 1905692
  misc_feature (9)..(134): Pfam Name: NAM Pfam Description: No apical meristem (NAM) protein
  misc_feature: The sequence is a functional homolog of SEQ ID NO 890 in the 10/374,780 US patent application
  misc_feature: The sequence is a functional homolog of SEQ ID NO 104 in the 10/225,068 US patent application
  misc_feature: The sequence is a functional homolog of SEQ ID NO 2014 in the 10/374,780 US patent application
  misc_feature: The sequence is a functional homolog of SEQ ID NO 22 in the 10/286,264 US patent application
  misc_feature: The sequence is a functional homolog of SEQ ID NO 314 in the 10/412,699 US patent application
  misc_feature: The sequence is a functional homolog of SEQ ID NO 734 in the 11/479,226 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: The sequence is a functional homolog of SEQ ID NO 853 in the 10/374,780 US patent application
  misc_feature: The sequence is a functional homolog of SEQ ID NO 854 in the 10/374,780 US patent application
  misc_feature: The sequence is a functional homolog of SEQ ID NO 891 in the 10/374,780 US patent application
  misc_feature: Useful for making plants with modulated oxidative stress sensitivity
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: Useful for making plants with modulated water use efficiency
  misc_feature: The sequence is a functional homolog of SEQ ID NO 851 in the 10/374,780 US patent application
  misc_feature: The sequence is a functional homolog of SEQ ID NO 1157 in the 11/479,226 US patent application
  misc_feature: The sequence is a functional homolog of SEQ ID NO 1416 in the 10/666,642 US patent application
  misc_feature: The sequence is a functional homolog of SEQ ID NO 30 in the 10/286,264 US patent application
  misc_feature: The sequence is a functional homolog of SEQ ID NO 430 in the 11/435,388 US patent application
  misc_feature: The sequence is a functional homolog of SEQ ID NO 518 in the 10/412,699 US patent application
  misc_feature: Useful for making plants with modulated light quality response
  misc_feature: The sequence is a functional homolog of SEQ ID NO 1012 in the 11/435,388 US patent application
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: The sequence is a functional homolog of SEQ ID NO 852 in the 10/374,780 US patent application
  misc_feature: Useful for making plants with altered terpenoid content
  misc_feature: The sequence is a functional homolog of SEQ ID NO 1064 in the 10/225,066 US patent application
  misc_feature: The sequence is a functional homolog of SEQ ID NO 2838 in the 10/374,780 US patent application
  misc_feature: The sequence is a functional homolog of SEQ ID NO 682 in the 11/435,388 US patent application
  misc_feature: The sequence is a functional homolog of SEQ ID NO 612 in the 11/435,388 US patent application
  misc_feature: The sequence is a functional homolog of SEQ ID NO 326 in the 10/412,699 US patent application
  misc_feature: The sequence is a functional homolog of SEQ ID NO 760 in the 11/479,226 US patent application
  misc_feature: The sequence is a functional homolog of SEQ ID NO 320 in the 10/374,780 US patent application
  misc_feature: The sequence is a functional homolog of SEQ ID NO 850 in the 10/225,066 US patent application
  misc_feature: The sequence is a functional homolog of SEQ ID NO 2592 in the 10/374,780 US patent application
  misc_feature: The sequence is a functional homolog of SEQ ID NO 288 in the 10/225,066 US patent application
  misc_feature: Useful for making plants with altered lignin content
  misc_feature: Useful for making plants with altered carbohydrate content
  misc_feature: The sequence is a functional homolog of SEQ ID NO 1729 in the 11/479,226 US patent application
  misc_feature: The sequence is a functional homolog of SEQ ID NO 162 in the 10/225,068 US patent application
  misc_feature: The sequence is a functional homolog of SEQ ID NO 2414 in the 10/374,780 US patent application
  misc_feature: The sequence is a functional homolog of SEQ ID NO 428 in the 11/435,388 US patent application
  misc_feature: The sequence is a functional homolog of SEQ ID NO 508 in the 10/412,699 US patent application
  misc_feature: The sequence is a functional homolog of SEQ ID NO 728 in the 10/225,066 US patent application
  misc_feature: Useful for making plants with altered alkaloid content
  misc_feature: The sequence is a functional homolog of SEQ ID NO 2168 in the 10/374,780 US patent application
  misc_feature: The sequence is a functional homolog of SEQ ID NO 370 in the 10/666,642 US patent application
  misc_feature: The sequence is a functional homolog of SEQ ID NO 240 in the 10/225,068 US patent application
  misc_feature: The sequence is a functional homolog of SEQ ID NO 368 in the 10/374,780 US patent application
MDFGGALQLPPGFRFHPTDEELVTHYLLRKCGGLAPAAPVIAEVDLYKFDPWSLPERAAGGEKEWYFFSPRDRKYPNGSRPNRAAGAGYWKATGADKPVGAPRPVAIKKALVFYAGKPPRGVKTNWIMHEYRLADVDRSAAARKKTANNNALRRARAVPFVTARGYLQTAGPGALETCKARAAWRHGSRTG

SEQ ID NO: 31486 - DNA, 751 bp, Panicum virgatum
  misc_feature: Ceres CLONE 1905700
  misc_feature: Encodes the peptide sequence at SEQ ID NO. 31487
acgcagtggtgtgccgtgccgcactgcctgccctgccatctcccaccataactctctcacccgccccgcacgcctgcctgtctgtccctcccgctctgctccgcacactcggcgcaggtgcagcgtccctgctctgctccccacccagcgcccgcattgctgccggagagcggaggcggaccaccggccgcggcggcggaaccaggaggaggaggggcaggaagagaggcggcaggatgttcgggcgggacccgtggggcgggccgctggagatctccaacgccgactcggcgacggacgacgaccggagccgggacctggaccgggcggcgctgatgcggcagctggacgagacgcagcagagctggctcctagccggcccgggcgaccaggcgggcaagaagaagaagaagtacgtcgacctcggctgcgtcgtcctcgaccgcaagatcttcatgtggaccgtcggcaccatcctcggcctcggcgtcttcatcggcttcatcatgatgatagtcaagctcgtcccgcacaagcgcccgccgccgccgccgcccgaccagtacacgcaggcgctgcacaaggcgctcatgttcttcaacgcccagcgatctggtccgctgcccaagcacaacggcgtcagctggagggacaattcctgcatgaaggacggcctctcggacagcaccgtccggcggagcttggtcggaggcttctacgatgcaggggacgctatcaagttcaactaccc

SEQ ID NO: 31487 - protein, 171 aa, Panicum virgatum
  misc_feature: Ceres CLONE 1905700
  misc_feature: SWISSPROT Homolog: EC 3.2.1.4 Cellulase
  misc_feature: Useful for making plants with altered cell wall content and/or composition
  misc_feature: Useful for making plants with altered carbohydrate content
MFGRDPWGGPLEISNADSATDDDRSRDLDRAALMRQLDETQQSWLLAGPGDQAGKKKKKYVDLGCVVLDRKIFMWTVGTILGLGVFIGFIMMIVKLVPHKRPPPPPPDQYTQALHKALMFFNAQRSGPLPKHNGVSWRDNSCMKDGLSDSTVRRSLVGGFYDAGDAIKFNY

SEQ ID NO: 31488 - DNA, 661 bp, Panicum virgatum
  misc_feature: Ceres CLONE 1905718
  misc_feature: Encodes the peptide sequence at SEQ ID NO. 31489
cttcctgcttctcgatcggattgggttgggggttctgggtaggtgtggtgtgctcgggagttggggcttcttcgttgctttgcttcgctcgtgcgcaagggagagagaagagggaggagaagtaggcggggaggcagatggcatcgaagcggatcctcaaggagctcaaggacctgcagaaggatcctcccacctcctgcagcgcaggcccagtcgcggaagatatgttccactggcaagcgaccataatgggtccatcagatagcccatacttcggcggcgtctttttggtcacaattcacttccctccagactacccattcaaaccgcctaaggttgcattcaagacaaaggtcttccatccgaatatcaacagcaatgggagcatctgtcttgatatcttgaaggaacaatggagcccagcattgacagtttctaagattagcggaatcagcccctgcactgtagcctattcaagtttggttcttcagttgcatcatcatctcagaaaacatgcttgctgttttcaggtactactctcaatttgctcccttttgacggacccaaaccctgatgacccattggttccggagattgctcacatgtacaagagtgatcgggcgaaatatgagtccactgctaggagctggacccagaaata

SEQ ID NO: 31489 - protein, 174 aa, Panicum virgatum
  misc_feature: Ceres CLONE 1905718
  misc_feature (5)..(172): Pfam Name: UQ_con Pfam Description: Ubiquitin-conjugating enzyme
  misc_feature: SWISSPROT Homolog: EC 6.3.2.19 Ubiquitin--protein ligase
  misc_feature: Useful for biocontainment applications
MASKRILKELKDLQKDPPTSCSAGPVAEDMFHWQATIMGPSDSPYFGGVFLVTIHFPPDYPFKPPKVAFKTKVFHPNINSNGSICLDILKEQWSPALTVSKISGISPCTVAYSSLVLQLHHHLRKHACCFQVLLSICSLLTDPNPDDPLVPEIAHMYKSDRAKYESTARSWTQK

SEQ ID NO: 31490 - DNA, 726 bp, Panicum virgatum
  misc_feature: Ceres CLONE 1905726
  misc_feature: Encodes the peptide sequence at SEQ ID NO. 31491
attccccaattcagcagcagcagcagcagcagcacgaggcgcctctgcgaattccgacagcgagagcgggaagaggaaactcgaaacccggcgagcggcatggccaccggcgaggagcacgtggcggcggcggcggtcgaggagacgccggagaagaaggaggccggcgtaaccgacctccccgcgccctccggctggacgaagaagcttgccccaattagaggtggaaagtttgaggttatttttgtttccccaactggtgaggagatcaagaccaagagacagctgacccagtacctgaaagctcatcctggaggccctgcatcttcggagttctattggggaaccagtgatactcctagacgatcagcacgcataagcgagaaagtcaaggcaactgagagcccagaaggtgagaagacccctaaacgtggaagatcaagctctaagaggggcaaaaaggagaaaaaagaagatgcagatgcagatgcagtggatgccaatgaaactgtagaccgtggcactttggaaggcactgatgtggagaagaaagaggaggtccccagtgcagatattgacgagaagactgaaggagttgaagagaagaaagaggaggcccctggtgcagatgccacagagaagactgaacaaggcgctgaaggccaggagcaggctaataatgtcgctgccccagaatcagagatcaaatcagatgcgaaaccagct

SEQ ID NO: 31491 - protein, 208 aa, Panicum virgatum
  misc_feature: Ceres CLONE 1905726
  misc_feature (19)..(89): Pfam Name: MBD Pfam Description: Methyl-CpG binding domain
  misc_feature: Useful for making plants with modulated drought sensitivity
MATGEEHVAAAAVEETPEKKEAGVTDLPAPSGWTKKLAPIRGGKFEVIFVSPTGEEIKTKRQLTQYLKAHPGGPASSEFYWGTSDTPRRSARISEKVKATESPEGEKTPKRGRSSSKRGKKEKKEDADADAVDANETVDRGTLEGTDVEKKEEVPSADIDEKTEGVEEKKEEAPGADATEKTEQGAEGQEQANNVAAPESEIKSDAKP

SEQ ID NO: 31492 - DNA, 609 bp, Panicum virgatum
  misc_feature: Ceres CLONE 1905758
  misc_feature: Encodes the peptide sequence at SEQ ID NO. 31493
agagtcgacgcgcttgtgtgcgtggccggacccgaaagcctccttctcccccgaccccggcgcccctccccccccccccccccccgccgccacctcccaccggccggcgcatcccgtcccctctccaccagcttgtgatacgcggaccgatccacccccagctggtgcccgattcgtggggagcggaaggggagatcggagcttgagtagagggagccaaaatggtgaaggacacgggctactacgacgtgctgggcgtccacccgtccgccaccgagtctgagatcaagaaggcgtactacatcaaggcgaggcaggtccacccggataagaacccgaacgatccgaaggcggccgagaagttccaggcactaggagaagcataccaagtgctcagtgaccccacacagcgccaggcttatgacttgcatgggaaatccggcatctcaatggaaggaataattgatccagcagcaatttttgcgatgctatttggtagtgagctttttgaggattacattgggcaactggcaatggcatcaatggcttcacttgataattttggtgaagatgaatatattgaagcaaggaagctgcaagagaaaatgc

SEQ ID NO: 31493 - protein, 129 aa, Panicum virgatum
  misc_feature: Ceres CLONE 1905758
  misc_feature (6)..(68): Pfam Name: DnaJ Pfam Description: DnaJ domain
MVKDTGYYDVLGVHPSATESEIKKAYYIKARQVHPDKNPNDPKAAEKFQALGEAYQVLSDPTQRQAYDLHGKSGISMEGIIDPAAIFAMLFGSELFEDYIGQLAMASMASLDNFGEDEYIEARKLQEKM

SEQ ID NO: 31494 - DNA, 717 bp, Panicum virgatum
  misc_feature: Ceres CLONE 1905762
  misc_feature: Encodes the peptide sequence at SEQ ID NO. 31495
agtactattctctcgttaataaatcatccgcagccaagcgaacgccgcagtaggagtagtatgcttatctgattctctatctctggcaggcagacagcagcagcctaccccgatctgcccccgcccgccgccgccgattcaccgccagcatcagcaagcgacgactccggtcgagatggcggcgtcatttgtctcctcgctcacggcgcccctcatctccgccgtcctcggtggcgccatcgccctcgtcttcctcgccggctacctccgccgcaagcgcgccgccatcgcccacatccctccctccgccaccgccgccgccccggaccagcccaagcacgtccgcccctccaaccaggcccagcacaagaagggccacccccgcccgcatcacaacgccgccgataaggatgctgccaagaagcaccaccatcttggtgttaacaccttgagggggcacactgactcagtcactgcactccacttctccaatgatggcgccaacttatccaccgtgtgtgctgatggagctgtaagggtattcaggatcgatgatacatcaagcaaaagctttaagattctgaggataaacttgcctgctggagcacatcctaccggtgttgctttctcggagggctcttcatctgttgttgtggcagcacaggctcttctgggctcatctctctatatgtatgcggatgtcagtgctcctcccac

SEQ ID NO: 31495 - protein, 180 aa, Panicum virgatum
  misc_feature: Ceres CLONE 1905762
  misc_feature (86)..(124): Pfam Name: WD40 Pfam Description: WD domain, G-beta repeat
MAASFVSSLTAPLISAVLGGAIALVFLAGYLRRKRAAIAHIPPSATAAAPDQPKHVRPSNQAQHKKGHPRPHHNAADKDAAKKHHHLGVNTLRGHTDSVTALHFSNDGANLSTVCADGAVRVFRIDDTSSKSFKILRINLPAGAHPTGVAFSEGSSSVVVAAQALLGSSLYMYADVSAPP

SEQ ID NO: 31496 - DNA, 735 bp, Panicum virgatum
  misc_feature: Ceres CLONE 1905766
  misc_feature: Encodes the peptide sequence at SEQ ID NO. 31497
ggcatccaatccagccactagcccagtgtgccactgggagtagagtacctggtctgaggccaagccagagagagagagggccggcgggagacgatggcggccgcgcggtggctgctggtggccgcggtggcggcgacggtggcggcgctggcggcgacgcgtgcggcggcggcggcgccgcggaagccggtggacgtgccgttccagcggaactacgtgccgacgtgggcggcggaccacatccgctacgtggacggcgggcgggaggtgcagctctacctcgacaagtccaccgggacgggcttccagacgcggggctcctacctcttcggccacttcagcatgcacatgaagctcgtcggcggcgactccgccggcaccgtcaccgccttctacctgtcgtcacagaactcggagcacgacgagatcgacttcgagttcctgggcaaccggacggggcagccctacatcctgcagaccaacgtgttcaccggcggcaagggcgaccgcgagcagaggatctacctctggttcgaccccaccaaggagtaccactcctactccgtcctctggaacctctacatgatcgcgttcttcgtggacgacgtgccgatccgggtgttcaggaacagcagcggcgacctcggcgtccggtacccgttcagccagccgatgaagctctactcgagcctgtggaacgccgacgactgggcgacgcgcggcgggcgggagaag

SEQ ID NO: 31497 - protein, 213 aa, Panicum virgatum
  misc_feature: Ceres CLONE 1905766
  misc_feature (37)..(212): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
  misc_feature: Useful for making plants with altered carbohydrate content
  misc_feature: Useful for making plants with altered cell wall content and/or composition
  misc_feature: Useful for making plants with altered lignin content
MAAARWLLVAAVAATVAALAATRAAAAAPRKPVDVPFQRNYVPTWAADHIRYVDGGREVQLYLDKSTGTGFQTRGSYLFGHFSMHMKLVGGDSAGTVTAFYLSSQNSEHDEIDFEFLGNRTGQPYILQTNVFTGGKGDREQRIYLWFDPTKEYHSYSVLWNLYMIAFFVDDVPIRVFRNSSGDLGVRYPFSQPMKLYSSLWNADDWATRGGRE

SEQ ID NO: 31498 - DNA, 558 bp, Panicum virgatum
  misc_feature: Ceres CLONE 1905767
  misc_feature: Encodes the peptide sequence at SEQ ID NO. 31499
cttctcgcgccgccggacctgaagtctactcgcccccgcgcggagcagagcggaggagaggagatggtggagaagaatggagctgtggttaggaaggaggaggtggtcgcctgggagtacaccttctacctccacaagtgtctctctggttgcacattccagatgatggcacccaatgccatcttggatatcatgaggttcgcacatgaggctatgggctcctcctctgtccgggttgatgtgatgctctccacgctcatctggagctgcgggatcagaagcgttccgcggagggtgcgtgtgagaatcgcccgtaggaggaacgatgaggaggatgccaaggaggaactctgctccctcgtctctgtcgctgagatcccgtctgacggtttgaccgggctggcaacctccgtcatccacgaagctgattaatctctcacattctttacatctttagaacgagtgtagcttgtattggcaaccgccaaccttttgtgccccacttaagttttgacctcttgtactgtgatgcaacatcacaatgttctctctttcctt

SEQ ID NO: 31499 - protein, 122 aa, Panicum virgatum
  misc_feature: Ceres CLONE 1905767
  misc_feature (10)..(104): Pfam Name: Ribosomal_L31e Pfam Description: Ribosomal protein L31e
MVEKNGAVVRKEEVVAWEYTFYLHKCLSGCTFQMMAPNAILDIMRFAHEAMGSSSVRVDVMLSTLIWSCGIRSVPRRVRVRIARRRNDEEDAKEELCSLVSVAEIPSDGLTGLATSVIHEAD

SEQ ID NO: 31500 - DNA, 505 bp, Panicum virgatum
  misc_feature: Ceres CLONE 1905771
  misc_feature: Encodes the peptide sequence at SEQ ID NO. 31501
ctgagtttgataacaaggcattaagactattcaagatggaagatgtcagtatgggcatgtgggttgagaagttcaataccactcgtcagcctgtagagtatttgcatgatgtcaggttctaccaacctggttgctttgatggttacttcaccgcgcactaccaatccccacagcacatgatttgtttgtggagaaagttgcaagctggaagcgctcagtgctgcaatgtgagatgacaacggctaacacatcactggagaacagattgatcattgtgcgcttcagtctgaacagcctgtttgggatcatcgagagacagacagcacaaggatgagtttgaggcataactctctgaacttttgtcagttgtcaccatttattcgttcattcttttggtcagtggttgattcagctgctgatgctaacactggagatccattttcctaaaactgtttctgtacatgtcaaatttatttgacctagctacgataagagcctgattgtt

SEQ ID NO: 31501 - protein, 77 aa, Panicum virgatum
  misc_feature: Ceres CLONE 1905771
  misc_feature: SWISSPROT Homolog: EC 2.4.1.134 Galactosylxylosylprotein 3-beta-galactosyltransferase
EFDNKALRLFKMEDVSMGMWVEKFNTTRQPVEYLHDVRFYQPGCFDGYFTAHYQSPQHMICLWRKLQAGSAQCCNVR

SEQ ID NO: 31502 - DNA, 725 bp, Panicum virgatum
  misc_feature: Ceres CLONE 1905780
  misc_feature: Encodes the peptide sequence at SEQ ID NO. 31503
aggtgagccacagctagccggtgcgcgcacccaccaccaccgccggtccaccgccgcgtccgcgtgcccctccagatcccccgccggcggcggccaccatgcggagcgaggcggcggcggcggcggccaccatgcggagcgaggcggcggcggcggcggccacggtgacgcgcgtggcgcagcgggtggtggccccgtcggcgcccacgccccgcggcgagctgccgctctcctggctcgaccgctacccgacgcagcgcgcgctcattgagtccctccacgtcttcaagggccgcgccggcaacgacggcgacgccgaggtgcccgcccgggtcatcgagcgcgcgctggccaccgcgctcgtgagctactaccccatcgcaggccggctcgcggtctccggcgagggggacctggtggtggactgcacgggcgagggcgtctggttcgtcgaggccacggcgagctgcaccctcgaggacgtggactacctcgagtacccgctcatggtgcgcaaggacgagctcctgccgcaccccacctacccggcctccgaccccctccccgaggactcgctcatcctccttgtccaggtgacgcagttcgcgtgcggcggcttcgtggtggggttccggttcagccacgccgtcgccgacgaccccggcgcggcgcagttcatggcggccatgggcgacgtcgcgcgcgggacgcggcggcgctgttgg

SEQ ID NO: 31503 - protein, 208 aa, Panicum virgatum
  misc_feature: Ceres CLONE 1905780
  misc_feature: SWISSPROT Homolog: EC 2.3.1.167 10-deacetylbaccatin III 10-O-acetyltransferase
  misc_feature: Useful for making plants with altered carbohydrate content
MRSEAAAAAATMRSEAAAAAATVTRVAQRVVAPSAPTPRGELPLSWLDRYPTQRALIESLHVFKGRAGNDGDAEVPARVIERALATALVSYYPIAGRLAVSGEGDLVVDCTGEGVWFVEATASCTLEDVDYLEYPLMVRKDELLPHPTYPASDPLPEDSLILLVQVTQFACGGFVVGFRFSHAVADDPGAAQFMAAMGDVARGTRRRC

SEQ ID NO: 31504 - DNA, 501 bp, Panicum virgatum
  misc_feature: Ceres CLONE 1905800
  misc_feature: Encodes the peptide sequence at SEQ ID NO. 31505
aaggcctcgtacagttcatcaagtaaatccacatcagatcacacacaagctagctgcaaaaatggcgtcgacggtggcgagcctctctaccccggcgacggccttcgcggccgcggacgtggacccgaggaggaaggccgccgaaggccgcgtctggttccccgtggcgcgccgcggcagcttcgcggtgaggtcgagcgggccggggacgccgccggggatctccgacaaggtgtcggagagcatcaagaaggcggaggagacgtgcgcggacgagaaggtctccggggagtgcgcggcggcgtgggacaagctcaaggacagcagcgacccgctcgagaactactgcaaggagaaccccgagaccgacgagtgccgcatctacgacaactagagcaagcctgctgtatatatcgatttgtgtatcagcaatcaaagacgttaaatttgttatagatatagataattaataaaggaataaaggatatttgaccgcgggtc

SEQ ID NO: 31505 - protein, 110 aa, Panicum virgatum
  misc_feature: Ceres CLONE 1905800
  misc_feature (54)..(110): Pfam Name: CP12 Pfam Description: CP12 domain
  misc_feature: SWISSPROT Homolog: EC 1.2.1.13 Glyceraldehyde-3-phosphate dehydrogenase (NADP(+)) (phosphorylating)
MASTVASLSTPATAFAAADVDPRRKAAEGRVWFPVARRGSFAVRSSGPGTPPGISDKVSESIKKAEETCADEKVSGECAAAWDKLKDSSDPLENYCKENPETDECRIYDN

SEQ ID NO: 31506 - DNA, 1407 bp, Panicum virgatum
  misc_feature: Ceres CLONE 1905813
  misc_feature: Encodes the peptide sequence at SEQ ID NO. 31507
gacggcgggtaactgctcccctgctcgtcgccggtcgacgggcagctactttttagggtttcggttcgatctcatcccaccaccaccaccaccagcataggaggagagtgcaccttgggccgacggtcgcgatgctgaccgcccgaaatccctcgccgagcttccacgcgcacgaccgccctcctccgccggcacatgacatcgcggagcgcctcagccatctacgcgatcttcgcagggaaccgctccccagacgcgtcgcccgcatcgccgacctccacaccgatgaggccagccccgtgcgcaagcatgcagccgagattattggtgaggtcgggtccaaacacatggagtacctaccagatatcatcccttgtttgctgcaccttctgaatgatgaggcgcctgcagttgtcaggcaagctatcaaaacaggaactgccttgtttgccaagctgctccaacatctagttatccagtgattattttccaccagggggattgatgatgcccttaaatcatcatgggagtggctgctcaaattcaaatctgctgtctctctcatggcatttcagaccactggcatgaaggtgccaggttactggccgttaagtttgttgaaaaaacagttcttatgtacacaccggatcctaatatcccatcagatccaacaagcgaagctacgaaagatatgggattcaatgtagcatggttacgaggaggtcaccctttgcttaatgtcggggatctagccatggaagccagccagaacctcggattgttgctagagcagctcaagtctcctaaagtaaaatcactcagtacttccatgatcattgtcttcattactagtctctcagctattgcccaaagaaggccttccttttacggacgcatactgccagttttactttccttggatccagcaagttcaatcattaaattgcgagtcccaggtgcattccatgctttgaagagtgccttttctgcgtgcctagaatgtacacattcaagtgctgagccgtggcgagcacgtctattggaagctcaaaatattatcaaccaggggggttcaatagaagatacaacaaatgctggtaagaattttggggacacatcaaacagggaagaatcgtggcctctgatggagagaagcactgacagtagtaacaagcgtagtctggctgaggacatgaatcatatgacagaagatgatggtcactccagtaaaagaatcagacattcacttgatattcaagaacatagtgaagaggcaagcaagagaaatgttgaaatcacctctgttaatatctcatctagccagcccatctctataagaactgggaattctgaagctgtgtatcaattaattggtatgtttgcggctctagctgcacaaggtgacag

SEQ ID NO: 31507 - protein, 116 aa, Panicum virgatum
  misc_feature: Ceres CLONE 1905813
  misc_feature (73)..(109): Pfam Name: HEAT Pfam Description: HEAT repeat
MLTARNPSPSFHAHDRPPPPAHDIAERLSHLRDLRREPLPRRVARIADLHTDEASPVRKHAAEIIGEVGSKHMEYLPDIIPCLLHLLNDEAPAVVRQAIKTGTALFAKLLQHLVIQ

SEQ ID NO: 31508 - DNA, 794 bp, Panicum virgatum
  misc_feature: Ceres CLONE 1905813-R
ctcagcgacgaggccaaagatctgcttcaaaaagaatcatttttgcgtattcttgagagtgataagcaagaagcaactggtggctcaattgctcgccttccgctgcttgctcacttgggtgttgagtttcctctggaattggacccatgggagcttctccaaaagcatgtcctctctgactatgcaaataatgaggggcacgagttgactctatgcatcctgaaccggttatatcgtgaggccgagcaggatcaagattttctttcatctagaactgctacatcagtttatgaatcctttcttctgactgtagctgaaaatcttcgagacatgtttccggcttcagataaatcacttggcaaattgctttgtgaggtaccatacttaccagaagatgtgttgaaacttctagaaggtttatgttctcctggaagtaatgagaagcaggacaaggatatccagagtggtgatagggtaacacaaggtctcagtgctgtctggaaccttatcatgctaagacctttaaatcaggacagatgtctggaaattgctttgcaggtgcttttctgatgtcaggaaatatttcttaatattgttacatgcttgcatgtgtctttcaacaaaattttgagtgcttggtgttagagtatattaggcaactccagatatggtagtttagaattgatgtaatcccgtgatagtcttttttatctctaggggaggtgccttgccctccaagccttgtactcctatataccgcccaaggggctcattgcaatacaatcgaccacatt

SEQ ID NO: 31509 - DNA, 1904 bp, Panicum virgatum
  misc_feature: Ceres CLONE 1905847
  misc_feature: Encodes the peptide sequence at SEQ ID NO. 31510
atttttcaaatcccaccaccaccacccacgccgcccccaaacggtcacccgtcacgcacgcttcgctgcgccgcgcacaccggcggaccccctcgccgtcgagccggcgcggccaccgccccgaccgaccatccgatccggcaggcggagggcgcggcatggcctcccccaaccccgacgccgcggcggggctgcagtccgtggccgcggcgggggcaggggagggcggctcgtcctcgtcgctcggcgccgtcgcggccggggagcaggcgcccaggagggtcctggccgtgcggaaggagcgcgtgtgcacggccaaggagcgcatcagccgcatgccgccctgcgccgccgggaagcggagctccatctaccgcggggtcacccggcataggtggactggtcgatacgaggctcacctctgggacaaaagcacgtggaaccagaatcagaacaaaaaggggaaacaaggtatgcatggatttccaatacagagttgtggcagttgttcgtgttcttgaaattctgaacatattggaactggaagatatgcattcttgtttcttacaacttgattacattgaatagatagtttggttggatttatgttgagatcaggtttaaacagattaatcttctgtgaactagtaacttctccctaatatcatacattttggttgcatgtaccgtgtagtcaaaattttaatactttcctattgatatcttcttgaatattgtgttcgaacatttaaatgatccgagcacattttcctctggttctataatattgcagtttgcttacattttataaattaacctggcagagtcaaacctcaaacctacatcttggagaccttgccatgtccaaaacgacatttcttttggtgacagaaagtagtctttttttttctatctaacacttgacatcaaacatgctttccacctttcccgcagcagtgtgaatcaattgggttgttagagaataatgattattcttgcattatgccataatcactgcaagacatggatggaagtaaagaactatgcctgctgcggtttccgagttcctaccatttgtctgttttatttcatatctttggaaaatgcataactgtatgtacttagaaatatgattttccttctaatatttattgctgtctcattaatctgatttgatggaattgtttcttttgcatggaaaacaacatcactcaattgctattgcagtatatttaggtgcatatgatgatgaagaggcagcagcaagggcctatgaccttgctgcattaaaatactggggagctggaacacaaattaattttccagtctctgactatgcaagagaccttgaagaaatgcagatgatctccaaggaggactatctcgtgtctcttaggagaaagagcagtgccttctccagggggttgccaaaatatcgtgggcttcctaggcaactgcataattccagatgggatacgtctttgggacatttacttgggaatgactacttgaaccttagttgtggtaaggatatcatgttggatggaaaatttgctggaagctttgccttggagagaaaaattgatcttacaaattacattcggtggtggctacccaagaagacaaggcagtcagatacatcaaaagcagaagagattgctgatgaagtccgagctattgaaagttcaatgcaacagactgaaccatataagctgccctctcttggcctctgttctgcttcaaagccctcttcagcaggcttatcagcatgtagtatattatctcagtctgatgccttcaaaagcttcatggagaggtctacaaaattatctgaagaatgtaccctcagcaaagaaattgttgaaggaaaggctgttgcctcagcacctgctactggacatgat

SEQ ID NO: 31510 - protein, 242 aa, Panicum virgatum
  misc_feature: Ceres CLONE 1905847
  misc_feature: The sequence is a functional homolog of SEQ ID NO 139 in the 11/479,226 US patent application
  misc_feature: The sequence is a functional homolog of SEQ ID NO 2210 in the 10/374,780 US patent application
  misc_feature: The sequence is a functional homolog of SEQ ID NO 24 in the 10/412,699 US patent application
  misc_feature: The sequence is a functional homolog of SEQ ID NO 50 in the 11/375,241 US patent application
MELFLLHGKQHHSIAIAVYLGAYDDEEAAARAYDLAALKYWGAGTQINFPVSDYARDLEEMQMISKEDYLVSLRRKSSAFSRGLPKYRGLPRQLHNSRWDTSLGHLLGNDYLNLSCGKDIMLDGKFAGSFALERKIDLTNYIRWWLPKKTRQSDTSKAEEIADEVRAIESSMQQTEPYKLPSLGLCSASKPSSAGLSACSILSQSDAFKSFMERSTKLSEECTLSKEIVEGKAVASAPATGH

SEQ ID NO: 31511 - DNA, 208 bp, Panicum virgatum
  misc_feature: Ceres CLONE 1905847-R
tccatacttcataggacatgaatagatagcaagacaagtgcaagcatagttatgtaatatacagtggctagttccctgaaagtgagatttagttgtagagctgtttgtacatattgcggtgattgtttcagctaagtctcaacagatttgagaaagagatccaacaaaatgatgcagctttaatgctaaattagttatttttgtacac

SEQ ID NO: 31512 - DNA, 1359 bp, Panicum virgatum
  misc_feature: Ceres CLONE 1905852
  misc_feature: Encodes the peptide sequence at SEQ ID NO. 31513
gcctagcgaaaccgcatcgccgccgcgcctccgctccgcgcgccgcgctagggttttagagctcctccccattcgccctaaaagccagccgccctgccagggttttagccgcctcctccctccctccccaatccccctcgcccgccgccgccctgaaccctcccgcagcgacgccatgtgggccctccgccgtgccggcaaccccctcagggtctgtgcccaacaagttgtgagtgcctgtggttgcgcgagtcttgaggtgctgctaaatgctgatgcaaaggatgtagaggagcatcatgagggtaattgtcagaaagcttgctgccatcgtaacccaaagttgccagccttcctgttgtcattttcgtcaagccatttcgcattgagtaggagtttctcctctcaggcaggtgcaaattctggcaacaaagatgatgctttggaggatgggttttctgatctggaggttccaccagaagctgatacatctgaagatagttctgatgaggatgccactgatgaagttggcttgcctgatgtggatgctgctgcaaaacctgaggagtacatgaagagggactcgagcctccttaaagctatgattgaaactccgaggcgtgaagtcactaaagcacttgaaaaatgggctaatgatggcaattcactcgataggggtgaactctttttcgttcttcttagccttcggagacgaaagtggttcgacaaagccttgcagctcttggaatgggttgaacaatccaaactgtttgaatttggagagcgtgattacgcttcacgcgttgatttgacggctaaggtttatggtctttacaaagcagaacagtatattgaaaaaattcctgcacctcataggggtgagatagtgtatagaacacttttggccaattgtgtttatgaagcaaatgtcaagaaagcagagcaagtcttcaataagatgaaggatcttggattgccaattacagtattttctttcaaccagcttgtgctgctttacaaaagggtggacaagaagaagattgctgatgttctcgccatgatggagaaggagaatgtgaaaccatctctcttttcttacaagctccttgtagatgccaagggatcagctagggatatagaaggtatggaaaaggttgttgaacaaatggaaaccgaaggtattgagccagatcttatgtttcaagctacaattgcaaggcactacatttttgatggccagcgagagaaagcagaggcgcttttggagtcaatggaaggtgatgatatcaacacaaatcgtgctgcttgcaagattctgttacctttatatggttttctgggcaagagtcatgatgtgga

SEQ ID NO: 31513 - protein, 394 aa, Panicum virgatum
  misc_feature: Ceres CLONE 1905852
  misc_feature (306)..(340): Pfam Name: PPR Pfam Description: PPR repeat
MWALRRAGNPLRVCAQQVVSACGCASLEVLLNADAKDVEEHHEGNCQKACCHRNPKLPAFLLSFSSSHFALSRSFSSQAGANSGNKDDALEDGFSDLEVPPEADTSEDSSDEDATDEVGLPDVDAAAKPEEYMKRDSSLLKAMIETPRREVTKALEKWANDGNSLDRGELFFVLLSLRRRKWFDKALQLLEWVEQSKLFEFGERDYASRVDLTAKVYGLYKAEQYIEKIPAPHRGEIVYRTLLANCVYEANVKKAEQVFNKMKDLGLPITVFSFNQLVLLYKRVDKKKIADVLAMMEKENVKPSLFSYKLLVDAKGSARDIEGMEKVVEQMETEGIEPDLMFQATIARHYIFDGQREKAEALLESMEGDDINTNRAACKILLPLYGFLGKSHDV

SEQ ID NO: 31514 - DNA, 756 bp, Panicum virgatum
  misc_feature: Ceres CLONE 1905852-R
tgaagctatatgtccaagcaggagaagtggagaaagctgagtccctggtgcacaagttatctctgaagaataggatcagacctcagtacacaacatacctgatgctactcgatagttactcgaagaaaggagacatccacaactcagagagagtgttcaacaggctgcggcagattggctactctgggaggatcaggcagtaccagttgctgctccaggcatatctaaatgcaaaggccccagcttatgggttcaaagataggatgaaggctgacaacattttccccaacaatgttgtggcaactttgattgctgctactgatccattcgtcaagaagaaatcaatatctgacttgcttgattaagctcggggctagtgtgagatccatcatgtcaccgtgcaatgcatgtgctgcttttggcattctgctaaagtacatggtgtgataataacgtcttagtcttgtaatgaactactagtgtttgattgcattcggaatctcccgtgctttactgaaacttttgaatcataaattggattcactgccttggaatccttcctgtgtggtgagttaacccttcatattatttttgccctttttgttgatccactagcaaccaagatgagcctgtgcacatcatttgcttgtcaaaattccaaattcgtcctgcttaagctgaggttagccggcggcttctgtaaccttgagccgatttgtaacgtgataatgcagtctcgtgcacagttactttgac

SEQ ID NO: 31515 - DNA, 519 bp, Panicum virgatum
  misc_feature: Ceres CLONE 1905868
  misc_feature: Encodes the peptide sequence at SEQ ID NO. 31516
atcatcgcagcacacacagaagataagcaagcaggcaagagcaaagccactcccagtcccaaccctctcccacacgcaccgccgccagcccaaagccggaaagccagcagcgatggcccgcgccgccgtgttcctcgccgtgctcctcctcgccgccgtcgcggtggcgccgctcgcggccgaggcacgcgaagtcgtcgccgacgccgccgagggcaggtccctggcctccgacgcgccgtccgacgcccccgccccgagccccgactccgcgtccccttccgacgcgccgtcgagctcttccgacgcgtaaccgcggggctcgcgccgtccggagggtctgcagcggatgcatggcacgacccggggaaacaatttttttttctcttcataatctcttggaataatgtgcacctgatgatacgtgggtgcttgtccaattaattttttcccgtcttcttttgtacaccagtcaccttgctcttttgtggtgacatatatatattttttccttttttt

SEQ ID NO: 31516 - protein, 66 aa, Panicum virgatum
  misc_feature: Ceres CLONE 1905868
  misc_feature: Useful for making plants with altered terpenoid content
MARAAVFLAVLLLAAVAVAPLAAEAREVVADAAEGRSLASDAPSDAPAPSPDSASPSDAPSSSSDA

SEQ ID NO: 31517 - DNA, 421 bp, Panicum virgatum
  misc_feature: Ceres CLONE 1905878
  misc_feature: Encodes the peptide sequence at SEQ ID NO. 31518
attgtcccctctttctctttatctccacacctcgttcgccgtcgcgcgcgccggacgcaccagccgcagagatgggcgccctcgccgcctcctccttggccgccttccccgccaagccgcgcctgccccgcgcgcgcctctccgtggcctgctccgcgaccggcggccccggcagcagcagaaacaccaacagcggtgtctcgctcacctcctccgtcaggaccttctcggccgcgctggcgctgtcgacggtgatcctctcctcggccgccacctcccctccggccgcggccgccgacctcgccggcctctccccgtgcaaggagtccaatgccttcactaggcgcgagagaaactccatcaagaagctcaccgtctcgctcttctggtacgccctcgactgcgcccccgtgctcgccgt

SEQ ID NO: 31518 - protein, 116 aa, Panicum virgatum
  misc_feature: Ceres CLONE 1905878
  misc_feature (51)..(114): Pfam Name: PSI_PsaF Pfam Description: Photosystem I reaction centre subunit III
MGALAASSLAAFPAKPRLPRARLSVACSATGGPGSSRNTNSGVSLTSSVRTFSAALALSTVILSSAATSPPAAAADLAGLSPCKESNAFTRRERNSIKKLTVSLFWYALDCAPVLA

SEQ ID NO: 31519 - DNA, 659 bp, Panicum virgatum
  misc_feature: Ceres CLONE 1905923
  misc_feature: Encodes the peptide sequence at SEQ ID NO. 31520
  misc_feature (569)..(569): n is a, c, t, g, unknown, or other
acccacctcagcaactaggctctcttcacacgagcgcaaccaccaccccccaccactacaagcggaagcgagcggcagcggcggcggcggcggcgatgtcgggcaggggcaagggcggcaaggggctcgggaagggcggcgcgaagcgtcaccggaaggtgctccgcgacaatatccagggcatcacgaagccggcgatccggaggctggcgaggaggggcggagtgaagcgcatctccgggctgatctacgaggagacccgcggcgtgctcaagatcttcctcgagaacgtcatccgcgacgccgtcacctacacggagcacgcccgccgcaagaccgtcacagccatggacgtcgtctacgcgctcaagcgccagggccgtaccctctacggcttcggcggctaggttaggggtctgtcgatgtggttcggttccatgggtagccttatcgccttacatgttttccggtagttgctgtagcggagtagtagctggttgcttggtccctttggcgtcgggtgtgtcgatgtaagaaccgctggttcgaagcaattggtctggatgcangatgctgatgtaggaaatctgcagttcactttcaattgttattctacgaatactgtttgtctcgaagtaaactctgcacaaaattgtccc

SEQ ID NO: 31520 - protein, 103 aa, Panicum virgatum; identical to SEQ ID NO: 12044
  misc_feature: Ceres CLONE 1905923
  misc_feature (25)..(94): Pfam Name: Histone Pfam Description: Core histone H2A/H2B/H3/H4

SEQ ID NO: 31521 - DNA, 695 bp, Panicum virgatum
  misc_feature: Ceres CLONE 1905924
  misc_feature: Encodes the peptide sequence at SEQ ID NO. 31522
actccagtccgtcctctcccaccaccccactcctgagccgccgcgagctcgctcggctgcagctccagcctcctgcagcgcctcttcctcctccggcgccccctctccctctcctcccagcagccttgcagcgacctgccaacagtgcgctagctctccccgggcagaatgaccaaagatgaggagttcaagctggtcaagatccagaaccatctgctgagggtgaacatacactgcgacgggtgcaagcacaaggtcaagaagctgctccagaagattgaaggcgtgtactcggtggccatcgatgtggacaaccacaaggtctcggtgacgggggacgtggacgccgagacattgatccggaagctcaccagaggcggcaagcatgccgagctgtggtcgccgcagaaggtcggcggcaaccagggccacaagggcaataaccagcagaagcagcagcagaaccaccagcaccagcaccagcagcatcagcagaagcaaggtgccaatctgagcaaggatggccacaacaacaagaacaacaacggcgggcagaaggagcagggcgggcaggggggaggggttggaagcctcatgcagggcctcaaggcgttcaagagccagcacaacaacaagcaccagctcgctgagctcagctccgaggatgatgacctgtatgatgatgaggatgacga

SEQ ID NO: 31522 - protein, 175 aa, Panicum virgatum
  misc_feature: Ceres CLONE 1905924
  misc_feature (16)..(76): Pfam Name: HMA Pfam Description: Heavy-metal-associated domain
MTKDEEFKLVKIQNHLLRVNIHCDGCKHKVKKLLQKIEGVYSVAIDVDNHKVSVTGDVDAETLIRKLTRGGKHAELWSPQKVGGNQGHKGNNQQKQQQNHQHQHQQHQQKQGANLSKDGHNNKNNNGGQKEQGGQGGGVGSLMQGLKAFKSQHNNKHQLAELSSEDDDLYDDEDD

SEQ ID NO: 31523 - DNA, 1799 bp, Panicum virgatum
  misc_feature: Ceres CLONE 1905961
  misc_feature: Encodes the peptide sequence at SEQ ID NO. 31524
tctctttctctctctcgtcttcttgggcgtcggcctccccttccagccaggaggaggcaggaggcaaggctcccataccctcttccatccctccctcctccccggccgtcatgggcaccacgtacaagtgctgcctcatcttcaagcgccgcttccactcccgggacgcccccccgcccgacgacgtccgcgccctcttctccctccactccggcggcgggccccacatgggcgccgacggcctccgccgctacctcaacgcctcgggccacgaggaccccctggacgacgccgaggtggaccgcctgctcgaccagatccgcctacagcagccgggccgcgcccgcctcccgcgcctcgcccgaccgctgcttgccctcgacgacttccaccgctacctcttctcccacgacctcaacccgcccatccgccacccgcaggtgcaccacgacatgtcccgcccgctatcacactacttcatctacacgggccacaactcctacctcaccggcaaccagctcagcagcgactgcagcgacgtccccatcatcaaggcgctgcagagaggggttagggtcatcgagctggacatgtggccaaattcagccaaggacgacatcaacatcctacacggcaggaccttgaccaccccggtttcactgatcaaatgcttgagatccatcaaagaatatgcatttgtcgcgtccccctatcctgtcatcataacgctcgaagaccaccttccggctgacctccaggaaaaagttgccaagatggttcttcaagtatttggcaacatactgtactatcctgacaccgatcaactcaaggaattcccatcacccgaagagctcaagggtcgtgtcctcctctcaacaaagccccccaaagagtaccttgaagccaaggttggtcccatgaaagagggtgatgctgacctcctccttggcaaaggagccgctgatgatgctgcgtggggtaaagaagtaccggattttcatactgagatcaagtctgctaaaaagcatgatgatgatgtctcggaacaccaaagagacgacgaagacgatgacgacgacgacgatgacgaggaggaacagaaaatgcagccacatattgctccacagtataaacaccttattactattagagcagggaagccaaaaggctctctagctgatgccttgaagagtgatccagataaagttaggcgcctcagtctgagcgagcaacaacttgccaaagtggcagaggatcatggcactgaaattgtgaggttcacacagagaaacatactgaggatatacccgaagggcactcgcgttacttcatccaactacaatccatttcttggttgggtgcatggtgctcaaatggtggccttcaatatgcagggatacggaagagccctttggctaatgcatggattttataaagccaatggtgggtgtggctatgtgaagaaaccagatttcttgatgcaaactgaaccgggagtctttgacccaagggaaccccagcctgtgaagaaaaccttgaaggtcaaggtgtacatgggcgatgggtggcggatggactttaagcagacacactttgatcagtattctcctccagatttctatgcacgggtcggcatagctggagtcccagcagactcggtgatgaagaagacaaaggcgatcgaagacaactgggtgccagtacgggaggaagagttcagcttccccctgaccgtcccggagattgctctgctgcgggtggaggtgcacgagtacgacatgtcggagaaggacgacttc

SEQ ID NO: 31524 - protein, 562 aa, Panicum virgatum
  misc_feature: Ceres CLONE 1905961
  misc_feature (115)..(258): Pfam Name: PI-PLC-X Pfam Description: Phosphatidylinositol-specific phospholipase C, X domain
  misc_feature (339)..(457): Pfam Name: PI-PLC-Y Pfam Description: Phosphatidylinositol-specific phospholipase C, Y domain
  misc_feature (476)..(560): Pfam Name: C2 Pfam Description: C2 domain
  misc_feature (25)..(111): Pfam Name: efhand_like Pfam Description: Phosphoinositide-specific phospholipase C, efhand-like
  misc_feature: SWISSPROT Homolog: EC 3.1.4.11 Phosphoinositide phospholipase C
  misc_feature: Useful for making plants with modulated water use efficiency
MGTTYKCCLIFKRRFHSRDAPPPDDVRALFSLHSGGGPHMGADGLRRYLNASGHEDPLDDAEVDRLLDQIRLQQPGRARLPRLARPLLALDDFHRYLFSHDLNPPIRHPQVHHDMSRPLSHYFIYTGHNSYLTGNQLSSDCSDVPIIKALQRGVRVIELDMWPNSAKDDINILHGRTLTTPVSLIKCLRSIKEYAFVASPYPVIITLEDHLPADLQEKVAKMVLQVFGNILYYPDTDQLKEFPSPEELKGRVLLSTKPPKEYLEAKVGPMKEGDADLLLGKGAADDAAWGKEVPDFHTEIKSAKKHDDDVSEHQRDDEDDDDDDDDEEEQKMQPHIAPQYKHLITIRAGKPKGSLADALKSDPDKVRRLSLSEQQLAKVAEDHGTEIVRFTQRNILRIYPKGTRVTSSNYNPFLGWVHGAQMVAFNMQGYGRALWLMHGFYKANGGCGYVKKPDFLMQTEPGVFDPREPQPVKKTLKVKVYMGDGWRMDFKQTHFDQYSPPDFYARVGIAGVPADSVMKKTKAIEDNWVPVREEEFSFPLTVPEIALLRVEVHEYDMSEKDD

SEQ ID NO: 31525 - DNA, 306 bp, Panicum virgatum
  misc_feature: Ceres CLONE 1905961-R
atccgagcggtggcgctcttcgaccgcaaagggaacaagtacaaccacgtcaagcttctcatgcgcttcgagtttgcgtagagtgagccgacgattgcattgcaggtgtgagcccgtctccctttcctgtatgtatatgctagtgcgaatatatgcgtgtgaatgacagtttggtgagctgtttcatggcttctccgtgtatagattggattggaattgccgaattggatgatgcaacagtcttgctatgtaacatgttactattatacaataataataaaaataacaaggcatcgtgcctaaacc

SEQ ID NO: 31526 - DNA, 1999 bp, Panicum virgatum
  misc_feature: Ceres CLONE 1905965
  misc_feature: Encodes the peptide sequence at SEQ ID NO. 31527
acagacagacagaccaacaccgtgacctctccccccggtctctctctctctcctcctcaagctctccctctcccccccgcggcgcggccgaatgccgcgagctgggcggagctgaccccgcccgccggcgaccccgctaggccgccgccaccgcagcggcatggattcggctgccgagcgcggaatgcccgtggagggagggcactgacctgaggcgcccagattcgggagcacgggagcagcctcgcttggggtcccggggattcgcctcgccggggcggcggaggtggtttgggggcggaggcttctccggattccagcgtgtgggacctcaacgcaatggtcgccgccggctgcggcggcggcggcggcgccgccgaggccaagtacaactcgtacaaggcgccgggcttgcgcggggccttcctggaggcggtgcacgtctcgtgcctcgaggaccgctacgcgctcgggccgcagctcgggtggggccagttcggcgtcatccgctcctgctccgacctggtcaccggcgaggcgctcgcctgcaagtccatcgccaaggaccgcctcgtgtcccccgacgacgtgagggacgtcaagctcgagatcgaggtcatggcgcgcctctcgggccaccccaacgtcgttgacctcaaggcggtgtacgaggacgaggactccgtccacctcgtcatggagctctgcgccggcggggagctcttccaccgcctcgaggagcgcggctgcttctcggagcacgaggctgccgtgctcttccggtacctcatggaggtcgtggcccattgccatagcaaggggatcgtgcaccgggacctcaagccggagaacatcctcctggtcagcaagtcactgtcctcgccgatcaaactcgcggactttggcctcgccacgtacatccagcctggtcgaagcttgagcggcatggttggaagcccgttctacattgcgccggaggtgctttccggtggatacaatgaagctgctgatgtgtggagtgccggggttatactctacatcctcctcagcggcatccccccgttttgggggaaaaccaagtcgaagatattcgagtgcataaggtcgacagagctgcggttcccttctgatccatgggatagggtttctgattcaggaaaggagctggtcactgggatgctgcggcgtgatcctaggcaacgactaaccgccaagcaggttctagagcatttgtggatgcgagagcacgcggaccaatcacaagattcctgcagccattgccacgggatcaacctcaggaaggaggacctcggctcgtgctcctccacgccgctggcgacgcggagcagggacgtgagcttcaacaccggcggccccgtctcttgccagggcatgacggatgacgaagcgtgctcgcccaccttcgcctgcaggtcgtccttctcggcatttgtcgccgactcggccccgtcttgctggatgtccgggttctcgttcggccaggcgagcaagcccagtggcggcgcggcgttcctgccgccgccggtggcttccatgccgagcttctcattcttctgcgcgcaagagtgcggcgagcctgagccgtcggcatcacaaggggtgtcggttgctgctgctgctgctccttccatgtctcggaggatgtcggaggtcatggggacggcaaggcctatgacgaaccagtcgcgggtcgccggcatcaacagcaggcggaaccacacgatcggcaccggcgagcgggagcccctggacgtggcggtggcggagtccgtcatacggtgggcgtcgtgcacgaacctgtcgacgacgcactcgctccgggcgtcgctcgtgtgctagcataaagtgtttcggccgcctttacctgtaacgcgatgcaagctgtgctgagtgttgagatgagagtgacagtcagaggtagagaatgtaacctggacccgatatatatgatgttgttattatagtaaagcagtagatt

SEQ ID NO: 31527 - protein, 506 aa, Panicum virgatum
  misc_feature: Ceres CLONE 1905965
  misc_feature (42)..(300): Pfam Name: Pkinase Pfam Description: Protein kinase domain
  misc_feature: SWISSPROT Homolog: EC 2.7.11.1 Non-specific serine/threonine protein kinase
  misc_feature: The sequence is a functional homolog of SEQ ID NO 2 in US patent 7084323
MVAAGCGGGGGAAEAKYNSYKAPGLRGAFLEAVHVSCLEDRYALGPQLGWGQFGVIRSCSDLVTGEALACKSIAKDRLVSPDDVRDVKLEIEVMARLSGHPNVVDLKAVYEDEDSVHLVMELCAGGELFHRLEERGCFSEHEAAVLFRYLMEVVAHCHSKGIVHRDLKPENILLVSKSLSSPIKLADFGLATYIQPGRSLSGMVGSPFYIAPEVLSGGYNEAADVWSAGVILYILLSGIPPFWGKTKSKIFECIRSTELRFPSDPWDRVSDSGKELVTGMLRRDPRQRLTAKQVLEHLWMREHADQSQDSCSHCHGINLRKEDLGSCSSTPLATRSRDVSFNTGGPVSCQGMTDDEACSPTFACRSSFSAFVADSAPSCWMSGFSFGQASKPSGGAAFLPPPVASMPSFSFFCAQECGEPEPSASQGVSVAAAAAPSMSRRMSEVMGTARPMTNQSRVAGINSRRNHTIGTGEREPLDVAVAESVIRWASCTNLSTTHSLRASLVC

SEQ ID NO: 31528 - DNA, 746 bp, Panicum virgatum
  misc_feature: Ceres CLONE 1905975
  misc_feature: Encodes the peptide sequence at SEQ ID NO. 31529
atccaactcaaagttcacacttcaaacacccactgccatctggtaagcaaaacgaagcagaacatggctgccggatgggcagaggtgacagttaactgcctcatgcattacttcaagcagccggcgaaactgaaactagccgtgattatagtagtaccatttctcttgctgtgttatggagttggcgacgtccatagctccatagttcatgagaacagagaggatcttcgctcactgctcgacttcaagcagggtatcaccagcgatccatatagagccttgggcaactggaatacaagcacccacttctgtcattggaatggagtgaactgcaccttaaatcgaccatggcgtgtcatggtactcaatctcaccatgcaaaacttggttggccaaatctccccgtctcttggaaacctaacctttcttaacacgcttgatctatcccaaaaccttttgcagggaatcatacccgattcgcttacaaactgttccaatttgaaccgtttattcctatcttacaacaaccttacgggtgcgattcccactagcataggctttctttcaaaactaatagtcatgaacttccacagaaataatctcgttggcgtcatcccgcctgcgataggaaacattagcactttaaaaacacttgaccttggagaaaatcaattgaacgggcccattccccgacagctttggcacctacggaacatgatatacttttacctagatggaaatagtct

SEQ ID NO: 31529 - protein, 227 aa, Panicum virgatum
  misc_feature: Ceres CLONE 1905975
  misc_feature (51)..(91): Pfam Name: LRRNT_2 Pfam Description: Leucine rich repeat N-terminal domain
  misc_feature: SWISSPROT Homolog: EC 2.7.11.1 Non-specific serine/threonine protein kinase
MAAGWAEVTVNCLMHYFKQPAKLKLAVIIVVPFLLLCYGVGDVHSSIVHENREDLRSLLDFKQGITSDPYRALGNWNTSTHFCHWNGVNCTLNRPWRVMVLNLTMQNLVGQISPSLGNLTFLNTLDLSQNLLQGIIPDSLTNCSNLNRLFLSYNNLTGAIPTSIGFLSKLIVMNFHRNNLVGVIPPAIGNISTLKTLDLGENQLNGPIPRQLWHLRNMIYFYLDGNS

SEQ ID NO: 31530 - DNA, 704 bp, Panicum virgatum
  misc_feature: Ceres CLONE 1905986
  misc_feature: Encodes the peptide sequence at SEQ ID NO. 31531
gctttgaaagcttcaaaaacaatagctttgagcagttctgcattaactttgcaaatgaaaaactacagcaacactttaatgagcatgtattcaagatggaacaggaggagtacaaaagtgaggaaattaattggagctacattgagttcattgacaatcaggatgtgctggatttgattgaaaagaaaccgattggaattattgcactgctggatgaagcttgcatgtttccaaaatctactcatgagacattcgcaacaaagatgttcagaaacttctcttcccatcctaggcttgagaggacaaaattctcagaaacagattttaccatctcacactatgctgggaaggttacatatcaaacggattcttttctggaaaagaatcgagattatattgttgcagagcactgcaatcttctatcatcttcaaggtgcccatttgtttctggacttttcacttcgttgccagaagaatctataagatcctcctacaagttttcgtcagttgcttccagatttaagctacaactacaagccctcatggaaactctaaactcaacggaacctcactatgtacgttgtgtgaagcctaactctgccaatcgacctcagctttttgaaaatcaaagcgtcttgcatcaactgcgttgtggaggtgtcttagaggctgtccgtattagtcttgctggctatcctaccaga

SEQ ID NO: 31531 - protein, 233 aa, Panicum virgatum
  misc_feature: Ceres CLONE 1905986
  misc_feature (1)..(233): Pfam Name: Myosin_head Pfam Description: Myosin head (motor domain)
  misc_feature: SWISSPROT Homolog: EC 2.7.11.1 Non-specific serine/threonine protein kinase
FESFKNNSFEQFCINFANEKLQQHFNEHVFKMEQEEYKSEEINWSYIEFIDNQDVLDLIEKKPIGIIALLDEACMFPKSTHETFATKMFRNFSSHPRLERTKFSETDFTISHYAGKVTYQTDSFLEKNRDYIVAEHCNLLSSSRCPFVSGLFTSLPEESIRSSYKFSSVASRFKLQLQALMETLNSTEPHYVRCVKPNSANRPQLFENQSVLHQLRCGGVLEAVRISLAGYPT

SEQ ID NO: 31532 - DNA, 2703 bp, Panicum virgatum
  misc_feature: Ceres CLONE 1905992
  misc_feature: Encodes the peptide sequence at SEQ ID NO. 31533
aggataggctgctgggaaggtagattgtattggcagcgcgatgaaggtcagctcgggctttgagagcgcgagcgcgagcagcgccggcggctctgctggctcgggctccggcagcagctccggctggggctcgggctccttcaacctccggaacctatccaaggtcatcctgccgccgctcggcgggccctccggccacagccagctccatgccggctccgacaagtgggtcatctcgccgctcgactccagatacaggtgctgggagacgttcatggtggtcctggtggcgtactcggcgtgggtgtacccgttcgaggtggcgttcatgaacgcgtcccccaagggcggcctggaggtggcggacatcgtcgtcgacctcttcttcgccgtcgacatcgtgctcaccttcttcgtcgcctacatcgaccccaggacccagctgctcgtccgcgacaggaagaagattgccctcaggtacctgtcgacgttcttcatcatggacgtggcgtcgacgatcccgttccagggcctggcctacctcatcaccggcgaggtccgggagggcgccgcctacagcctgctcggcgtcctccgcctctggcggctccgcaaggtcaagcagttcttcaccaggctcgagaaggacatccgcttcagctacttctgggtccgctgcgctcgcctcgtcgcggtgacgctgttcctggtgcactgcgccggctgcctctactacctgatcgccgaccggtacccggaccgggacaagacgtggatcggcgcggccatccccaacttccggcaggccagcctgcggatccgctacatctcctccatctactggtccatcaccaccatgaccaccgtcggctacggcgacctccacgccgagaacaccgtcgagatggtcttcaacatcctctacatgctcttcaacctcggcctcaccgcctacctcatcggcaacatgaccaacctcgtcgtcgagggcacccgccgcaccatggagttcaggaacagcgtcagggcggcgtccaacttcgtgggccggaaccgcctgctgccgcggctcaagcagcagatcctggcctacatgtgcctcaagttcagggccgatagcctgaaccagcagcagctcatggaccagctgcccaagtccatctacaagagcatctgcgagcagctcttcctcccggtcgtcagggacgtctacctcttcaggggcgtctccagggaggggctcctctgcctcgtcaccaagatgaagcccgagtacatcccgccgcgggaggacgtgatcgtgcaggacgaggcgcccgaggacgtgtacgtcgtcgtctccggcgaggtggaggccgtgcggctcgacggcgccgacgagcgggtgcaggccacgctgggggcgcgggacatcttcggcgaggccagcgcgctgagcgaccgcgcgcagggcttcacgttccggaccaggacgctcagccagctgctgcgcctcaagcaggccacgctcaaggaggccatgcagaccaggcccgaggacagcgtcgtcatcatcaacaacttcctcaagcatcaggtcgagatgcatggcatgaaggtcgaggacttgctgggagagaacactggcgagccacagggcgatgctagtaatgtgctcacggtcgccgcgatggggaacagcgccttgctcgaggacctcctcagggccgggaaggacgccgacgtcggcgacgccaagggcaggacagcactgcacatcgcggcggccaaggggtacgaggactgcgtgctggtgctcctcaagcacggctgcaacgtcaacatccgggacgcgcagggtggcacggcgctgtggcacgccgtcgcggcggggcaccacaggatctccaacatcctctaccacttcgcgcgcgtgtcgagcccgcgcgccggcggcgacgtcctgtgcctcgcggcgcgccgcaacgacgacggcgcgctccgggagctgctcaggctcggcgtggacgcggacgcggaggaccacgacggcgccaccgcgctgcgcgccgcggtggccgagggccacgccgacgcggccaggttcctgatcatgaacggggccagcgtcgacaaggccggcctcgacgacgacggcggctccggccccggcggcgcgcggctgacgatgtcgccggtcgagctgcgcgagctcctgcgaaagcgggagctcgtccaccagatcaccatcctcgacccgccagcggttgtcccggtgaacggcggcggctcgtcgtcggggcacagccgccagggcaggttcccgagcgcaagcccgccggacagcgcccgctgtcctcgccctcgcgtgagcatatacaagggccacccgttggccagaacccagagctcggaagccggcaagctgatcaacctgcccggcacgatggaagagctcagagccatcatccgcgagaagctgaaggtcgtcgacgcggagaaggcgctgatcgtgaacgacgaaggagcggaggtcgactccgtcgacgtgatcagggacaacgacaagctgttcgtggtcaccgaagaggatctgaggcggctggcagcaatggaaccggtgtccgcgtcgtcgtaacatctgtagattcgggtgtgttccactagtagtgtcacgcaaggtagatgtgcatccaatcaaggagtgagttgaataaccgagtc

SEQ ID NO: 31533 - protein, 858 aa, Panicum virgatum
  misc_feature: Ceres CLONE 1905992
  misc_feature (108)..(310): Pfam Name: Ion_trans Pfam Description: Ion transport protein
  misc_feature (566)..(598): Pfam Name: Ank Pfam Description: Ankyrin repeat
  misc_feature (663)..(695): Pfam Name: Ank Pfam Description: Ankyrin repeat
  misc_feature (219)..(316): Pfam Name: Ion_trans_2 Pfam Description: Ion channel
  misc_feature (410)..(499): Pfam Name: cNMP_binding Pfam Description: Cyclic nucleotide-binding domain
  misc_feature: SWISSPROT Homolog: EC 2.7.11.1 Non-specific serine/threonine protein kinase
MKVSSGFESASASSAGGSAGSGSGSSSGWGSGSFNLRNLSKVILPPLGGPSGHSQLHAGSDKWVISPLDSRYRCWETFMVVLVAYSAWVYPFEVAFMNASPKGGLEVADIVVDLFFAVDIVLTFFVAYIDPRTQLLVRDRKKIALRYLSTFFIMDVASTIPFQGLAYLITGEVREGAAYSLLGVLRLWRLRKVKQFFTRLEKDIRFSYFWVRCARLVAVTLFLVHCAGCLYYLIADRYPDRDKTWIGAAIPNFRQASLRIRYISSIYWSITTMTTVGYGDLHAENTVEMVFNILYMLFNLGLTAYLIGNMTNLVVEGTRRTMEFRNSVRAASNFVGRNRLLPRLKQQILAYMCLKFRADSLNQQQLMDQLPKSIYKSICEQLFLPVVRDVYLFRGVSREGLLCLVTKMKPEYIPPREDVIVQDEAPEDVYVVVSGEVEAVRLDGADERVQATLGARDIFGEASALSDRAQGFTFRTRTLSQLLRLKQATLKEAMQTRPEDSVVIINNFLKHQVEMHGMKVEDLLGENTGEPQGDASNVLTVAAMGNSALLEDLLRAGKDADVGDAKGRTALHIAAAKGYEDCVLVLLKHGCNVNIRDAQGGTALWHAVAAGHHRISNILYHFARVSSPRAGGDVLCLAARRNDDGALRELLRLGVDADAEDHDGATALRAAVAEGHADAARFLIMNGASVDKAGLDDDGGSGPGGARLTMSPVELRELLRKRELVHQITILDPPAVVPVNGGGSSSGHSRQGRFPSASPPDSARCPRPRVSIYKGHPLARTQSSEAGKLINLPGTMEELRAIIREKLKVVDAEKALIVNDEGAEVDSVDVIRDNDKLFVVTEEDLRRLAAMEPVSASS

SEQ ID NO: 31534 - DNA, 668 bp, Panicum virgatum
  misc_feature: Ceres CLONE 1905997
  misc_feature: Encodes the peptide sequence at SEQ ID NO. 31535
ccatcccatcgacccgacgccgcgccgcacccctcttctgcgccctttcctctccattggcggcgaagaggttttctccaaaccggcgaggggagaggaactagccagtgaattcggtccctccaacccaacgagaagatgccgcggatccctctgatcaagttccccaagcggaatctcaaagccccatccccatccgcaccagcatcgcagcccgcggatcagcacgcgaccctcatgtcccgcttgggggctaaagtagaggcaccatcttctggagagattaaaaattaccgttttagatctgatgtgccatccccaccttctcatactgctgttggaggtccagcttcactccttcctaagcgcaaaccattgactgaagaagagattgaggccatcatgcttggtggctccatctgatatggcctcgcatggatcggaaacgtaggaggtatcaataagatcatatacccaaacttgccttgactggaaggggtgttattccagccatgttgatatggaatttgtttttttctctctgtctgggagtcagctgttgtgccattctgaaacgtcccctcatgagataaagacttaaatgtgatacaaacatcagtcccaggaggctgatgacacatttattacatcagatggttcatcaccgc

SEQ ID NO: 31535 - protein, 61 aa, Panicum virgatum
  misc_feature: Ceres CLONE 1905997
  misc_feature: Useful for making plants with modulated heat sensitivity
MSRLGAKVEAPSSGEIKNYRFRSDVPSPPSHTAVGGPASLLPKRKPLTEEEIEAIMLGGSI

SEQ ID NO: 31536 - DNA, 715 bp, Panicum virgatum
  misc_feature: Ceres CLONE 1906002
  misc_feature: Encodes the peptide sequence at SEQ ID NO. 31537
agaaatggcggggctccacttcctgctcgtgccgctggtggcgcagggccacatcatcccgatggtggacctggcgcgcctcctcgccggccgcggcgcgcgcgccaccgtggtcacgacgcccgtcaacgccgcgcgcaaccgggccgtcgtcgagagcgccaggcgagcgaggctcgacgtcgagctcgccgagatcgctttcccggggcccgggctcggcctgccggagggaatggagaacgtcgacatggtggtggagaaggagcacttcatggccttcttccagtccctctggaagatggacgcgccgctggaagagtacgtgcggtcgctgcccaggcgcccggactgcctcgtcgccgactcgtgcaacccgtgggcggcgggggtgtgcgcccgtcacggcatcccgcgcctggtgctgcactgcccgtcggcctactacctcctcgccacgcgcaacctggccaagcacggcgtctacgaccgcgtcgccgacgatctggagacgttcgaggtgccggacttcccggtgcgagccgtcggtagcaaggccacgttccggggtttcttccagtggcccggtttggagagcttgcagcgtgatgtggacgacgctgaggccaccgccgacggcctggtcatcaacacgttccgcgacatcgagggcgtcttcgtcgaccgctacgcggcggcgctcggccggaagacg

SEQ ID NO: 31537 - protein, 236 aa, Panicum virgatum
  misc_feature: Ceres CLONE 1906002
  misc_feature: SWISSPROT Homolog: EC 2.4.1.238 Anthocyanin 3'-O-beta-glucosyltransferase
  misc_feature: Useful for making plants with altered carbohydrate content
MAGLHFLLVPLVAQGHIIPMVDLARLLAGRGARATVVTTPVNAARNRAVVESARRARLDVELAEIAFPGPGLGLPEGMENVDMVVEKEHFMAFFQSLWKMDAPLEEYVRSLPRRPDCLVADSCNPWAAGVCARHGIPRLVLHCPSAYYLLATRNLAKHGVYDRVADDLETFEVPDFPVRAVGSKATFRGFFQWPGLESLQRDVDDAEATADGLVINTFRDIEGVFVDRYAAALGRK

SEQ ID NO: 31538 - DNA, 1118 bp, Panicum virgatum
  misc_feature: Ceres CLONE 1906021
  misc_feature: Encodes the peptide sequence at SEQ ID NO. 31539
aacacatggtaataaaaataacatattggatctcatctcgccgcaatcttccgcccgattcccgccgccgccacgcgccgctgcctcgctccatcgcactcccgtgccgccaccccgccagcgctccctcaccacgcgctgcccggccgcagaatgcagcaggcaaaaccctaggctagggtttccgctgggatttgtcgtgcccgctcgtcgattcgccatcttcggccgctgcgcctcggcttcctcacctccggccagaggcacggcatttgggcccgcccgagctcggattttgggccggatcaaacacggcgccaggaacgcccgccgccgtaccagcaaccgcagctcgctagggtttccaccaccgccgaagccgccgacgtggccgtcaagttcaagtctttggcgtcgcaataaaaaaataaaatctttggcgtcctccctcccagcccagccgctccgcgctcgcgctccgcttcctccaccaccgctcgcctaattcgccgccgccgcccgcttctgaagcctctcgcgcacgctcgcgcacgctcgcgcaggcagccatggcgaaggaggatctggccgcggaggccggcgagaagcaggagccgacgccgcgcctggcgtcgacgttcgcggagctgggcatctgcaaggagctggtggaggcgtgcgacctcatggggtggaaggagcccaccaggatccaggccgagtccatcccccacgccctccaagggaaggacctcatcgcgctggcgcagacggggtcggggaagacgggcgcgttcgcgctgcccattctgcaggagctgctcgagaaccgcgacgtgcagcatcctttcttcgcctgcgtgctgtccccaacgagggagctgacgattcagattgcggagcagtttgaggcgctcggagcagcaatcggtttgcgatgcttagtgcttgttggtggagtggatcggatgcagcaggtgttagccattggaaaacgtcctcatattgttgttggaactcctgggcgtcttttggatcatttgacagatactaaaggttttagccttaagaaaatcaagtatttggtattggatgaagctgataaattacttaatgtg

SEQ ID NO: 31539 - protein, 182 aa, Panicum virgatum
  misc_feature: Ceres CLONE 1906021
  misc_feature (46)..(182): Pfam Name: DEAD Pfam Description: DEAD/DEAH box helicase
MAKEDLAAEAGEKQEPTPRLASTFAELGICKELVEACDLMGWKEPTRIQAESIPHALQGKDLIALAQTGSGKTGAFALPILQELLENRDVQHPFFACVLSPTRELTIQIAEQFEALGAAIGLRCLVLVGGVDRMQQVLAIGKRPHIVVGTPGRLLDHLTDTKGFSLKKIKYLVLDEADKLLN

SEQ ID NO: 31540 - DNA, 368 bp, Panicum virgatum
  misc_feature: Ceres CLONE 1906021-R
agatgaaatcatgatacttaaagagcccatatcagatgcaaagagaattgctctaacgaaaatgaaggattccggtggccgcaagaagcggagaaaggtgggagatgacgatgacgaggtagaagaccatgctcattctaaaagatcaaaacccttcaagaaatctaacagacgatgaaagctctggagtttgccctgctgagttggaatccatgtgtacagctcctcgaatgttagtccattttgcatttttgtgcgacaccgtttcagtgccaaccctgtggattggctgtgatgcacctgcaagtcgtccaattttgtcgcctcaaaccatgttatgaagaaaagaaaactagttatatttgttc

SEQ ID NO: 31541 - DNA, 699 bp, Panicum virgatum
  misc_feature: Ceres CLONE 1906038
  misc_feature: Encodes the peptide sequence at SEQ ID NO. 31542
gcttctacctcctctctccacacgacttgctcccgccgccgccgccgccgccgccgccgtcgcagcagtcaccgtgaccagcaaccggacaaagtatggatacccaggttaagcttgctgttgtggtgaaggtgatgggccgcactggctccaggggtcaggtgacccaggtcagggtgaagttcctggacgaccagaaccgtctcatcatgaggaacgtcaagggccctgtccgtgagggtgacatcctcaccctcctcgagtctgagagggaggccaggaggctgcgctgaagcagctggtggttacgccagttgttggccattcctgttttaaacaagttaaatgatgaattgaatccccccttgcctagtgtactgctttcgtatcaagttattgaacaatgctactttgtcctttgagtaggctatggagaatgggcttaagcaatggaattgtaatttgagtactcgtcttgttgcaagttttggtctgttaaaaaaaaaaaaccacgagccctcggcccctcacgaagccagagcaggccgctgctccgccgccgcgccatggcttcgccgtcgccctcctcgcccctccacccgcaccagcaccagcatcagcacccgcttcctcctaatgctcacccccaattccaagtcccaccgccttcgatgccgccgccatcgccagcggcgcccg

SEQ ID NO: 31542 - protein, 65 aa, Panicum virgatum; identical to SEQ ID NO: 9766
  misc_feature: Ceres CLONE 1906038
  misc_feature (1)..(65): Pfam Name: Ribosomal_S28e Pfam Description: Ribosomal protein S28e

SEQ ID NO: 31543 - DNA, 694 bp, Panicum virgatum
  misc_feature: Ceres CLONE 1906045
  misc_feature: Encodes the peptide sequence at SEQ ID NO. 31544
ccgacggggaacaactgcctccacatctcctccacccatggccaccaggggttctgtatggacgccgtggccctgaaccggtctcttctctccgctgtcaacacagatgaggagacgcccctcatcaccgcggtggcaggtggccacaccagcttagcttcgttccttctcaggtgctgccgtgatctcaagctgagcgaggtaatcttgaagcaggataagcgcgggcacaacgcgctgcaccacgccatccgaagcggccacaaggagctcgcgctggagctgatagcagcagagcctgccttgtcaaaagcggtgagtcaaaaagaagagtcaccaatgttcatggcagtgatgagaaattatgcagatgtcttggagaaactgttggaggttcctgactctgctcacaggggagcctgtggctggaatgctctgcatgctgcagtgagaaatggtaattcagctatcgctaaaaagattgtggagacacgtctattgctggccagagaagaggaaaagactaatcacaatactccaatgcatcaggccgtcctttggaacaagattgacgtgctaagagtgttgttggaacatgatcggtctttggggtatgtagtcacctcggattacggtacccctctccttaatagtgctgcatatcgaggcccacctggggttgctcgagagcttc

SEQ ID NO: 31544 - protein, 231 aa, Panicum virgatum
  misc_feature: Ceres CLONE 1906045
  misc_feature: SWISSPROT Homolog: EC 2.7.11.1 Non-specific serine/threonine protein kinase
PTGNNCLHISSTHGHQGFCMDAVALNRSLLSAVNTDEETPLITAVAGGHTSLASFLLRCCRDLKLSEVILKQDKRGHNALHHAIRSGHKELALELIAAEPALSKAVSQKEESPMFMAVMRNYADVLEKLLEVPDSAHRGACGWNALHAAVRNGNSAIAKKIVETRLLLAREEEKTNHNTPMHQAVLWNKIDVLRVLLEHDRSLGYVVTSDYGTPLLNSAAYRGPPGVAREL

SEQ ID NO: 31545 - DNA, 414 bp, Panicum virgatum
  misc_feature: Ceres CLONE 1906072
  misc_feature: Encodes the peptide sequence at SEQ ID NO. 31546
actacactatcaaaaacaaaaccatcgccgcccctcccactcacctgctgccaatcaaccaaaaagcccgcgcagccacaccaagtcagggagaaagccatggccggcgtgaactcaaccagcgtcgtcgggctcaaacccgccgcgggggtgccgcaggccgccacctcctcgccggcggcgaagcgggtcccgggcgcgcccaaggaccgggcggccgacggccggagcgcgaggctcctccgcctggcggccgtcttcgccttcacggccaccaccaggtcggccaaggccgggatcatcaacaagtacctcgacacgaccacggccgaccaggagctgaacgacaagaagaggctggctacgagcggcgccaacttctcccgcgcctacatggacgagttcggcagccgt

SEQ ID NO: 31546 - protein, 104 aa, Panicum virgatum
  misc_feature: Ceres CLONE 1906072
  misc_feature (9)..(104): Pfam Name: PsaN Pfam Description: Photosystem I reaction centre subunit N (PSAN or PSI-N)
MAGVNSTSVVGLKPAAGVPQAATSSPAAKRVPGAPKDRAADGRSARLLRLAAVFAFTATTRSAKAGIINKYLDTTTADQELNDKKRLATSGANFSRAYMDEFGS

SEQ ID NO: 31547 - DNA, 1487 bp, Panicum virgatum
  misc_feature: Ceres CLONE 1906103
  misc_feature: Encodes the peptide sequence at SEQ ID NO. 31548
aggccgatccaaaacgaggaagcgcaacggaagccgggggcgctctccgctggggcgaggagacgacaggggaggggagggagatccaaatctccgccccgcgaccacgctcacgcacacatcgtcctcctccctccctttccccaatccccaccgcctcgcctcgcgcctgcgtgcgtgcccgtctcctcctcctcctgccagcctgcctgcgcgactagtagaaatataggcgcgcgtgccgccccggcctcccgctcctccggttaatccccccggccgctcacattatccacgcgcgcgcaggcgtctggggcggacgtcgcgtgtgccgtcgccgtgcggtctctgttggtggcggtgcgcggcgcgtgagcgacgacggggtgcgccgcccagcgggggaggaggtcgtccgtccggcggcggcgatggtgggggtcagcggcgcggaggcggtgtccgtcgcggtcctcttctccttcgccttcatctgcgcccgcttcctgctcgaccgcctcgtctacaagccattggcagtttacctattcagtaccaaagcttctaagttgatgaatgatgaggtcaggcaagcaaagattgtcaagttctcagagtccatttggaaacttacatactatgcttctgttcaagcatgggtcctcatgataataaagcaggaaccatggtcattggataagatgcaatacttcaatggctggccgaatcaacccattccgaggatattgatgcttttctacatgtgccagtgtggattttatgtctacagcattggtgctcttgttgcttgggaaacccgcagaaaagattttgctgtaatgatgtctcatcatgtgataacatctgctctaatcggagtttcgtatctgaccggctatcattccatcacattcttgaggaagctggatgaattccctacaactctgtactatatcttgaacacaatgcttctcacattgcttgtgttccatgtgtactgggggaaactcatatgtttgatgataatgagacaattgaataataaaggacaagttacagatgatgttcgatctgattccgaggacgacgagtaatagggagaatcattctttgacgtctgcaatgtgtcatttcttcgctgatacttttctatgcctgcttccacaatagattgttttggtcttggcaagttcggggcacggataggaaagttgatatctgtatattgccttatgatatcaaacgtggctagatcgagaatggagcaggtcgtatacatgacgggtatagctagcagcttacttgaaggttccttcacaaatttttggttcaccttttttgatatgggaaaagacatgagagggcgtgttccgtagctttttttctcgaagcttacagaacccctctgtaccatgttcagtatacttcacctgtgagtagatttagttctaattcatggtaataaattgattcttttgatcgggagc

SEQ ID NO: 31548 - protein, 220 aa, Panicum virgatum
  misc_feature: Ceres CLONE 1906103
  misc_feature (78)..(220): Pfam Name: LAG1 Pfam Description: Longevity-assurance protein (LAG1)
  misc_feature: SWISSPROT Homolog: EC 2.3.1.24 Sphingosine N-acyltransferase
MVGVSGAEAVSVAVLFSFAFICARFLLDRLVYKPLAVYLFSTKASKLMNDEVRQAKIVKFSESIWKLTYYASVQAWVLMIIKQEPWSLDKMQYFNGWPNQPIPRILMLFYMCQCGFYVYSIGALVAWETRRKDFAVMMSHHVITSALIGVSYLTGYHSITFLRKLDEFPTTLYYILNTMLLTLLVFHVYWGKLICLMIMRQLNNKGQVTDDVRSDSEDDE

SEQ ID NO: 31549 - DNA, 511 bp, Panicum virgatum
  misc_feature: Ceres CLONE 1906107
  misc_feature: Encodes the peptide sequence at SEQ ID NO. 31550
gaacctaatctgtcctccacgctagctactcctctactcgccgagtggtccgccggcgccgcctccctcgacctcccctcgacctcgtgcccgcggcggccgctgctcgtctgctccgatggctactgtgccaatcaaccctaaacctttcttgaacaacctaacggggaagcctgtaattgtcaaacttaagtggggtatggagtacataggttatcttgtttctgaggactcctacatgaatcttcagcttgctaacacagaggagtacattgatgggcaattctctgggaacttgggatagattttgatcaggtgcaactatgttctgtacctccgaggtgttccagaggatgctgagaaagaggatgcggattgagaagacttgaaccatgtttagattgactgatgtgatatttctgacgtgtgttcgggtgtgccgggtacaacctattctgccgaatcctgagctttgaactttatgattgatgaagcgtatccttctgctttc

SEQ ID NO: 31550 - protein, 61 aa, Panicum virgatum
  misc_feature: Ceres CLONE 1906107
  misc_feature (10)..(60): Pfam Name: LSM Pfam Description: LSM domain
MATVPINPKPFLNNLTGKPVIVKLKWGMEYIGYLVSEDSYMNLQLANTEEYIDGQFSGNLG

SEQ ID NO: 31551 - DNA, 297 bp, Panicum virgatum
  misc_feature: Ceres CLONE 1906111
  misc_feature: Encodes the peptide sequence at SEQ ID NO. 31552
tggacgccattccgtgcttcagctccccctcgtgcggcgcccgcaaggagatgtagaagaaggtcatgatcgtgaccggctccgtccccgtcagcttctccttcgcggccgtcttggacggcgccgccgccttcaccgctgtccagtccctcaaggacaagctgtacaatgtatgcgtgaccgccgtggtcggcgtttcggtgttcatgaccctgattctggaggctttcgcggccttcctccaccccgcctttttcgcggtcgaatcatggatgttgaagtggttcgatgcgatgg

SEQ ID NO: 31552 - protein, 77 aa, Panicum virgatum
  misc_feature: Ceres CLONE 1906111
  misc_feature: SWISSPROT Homolog: EC 3.1.3.16 Phosphoprotein phosphatase
MIVTGSVPVSFSFAAVLDGAAAFTAVQSLKDKLYNVCVTAVVGVSVFMTLILEAFAAFLHPAFFAVESWMLKWFDAM

SEQ ID NO: 31553 - DNA, 647 bp, Panicum virgatum
  misc_feature: Ceres CLONE 1906126
  misc_feature: Encodes the peptide sequence at SEQ ID NO. 31554
caagttggcccgtccgtcggcatttccgccggtgaccaggtgtgggttgctcgctacattcttgagaggatcaccgagatcgccggagtggtggtgacattcgacccgaagcccatcccgggcgactggaacggtgccggtgcccacacgaactacagcaccaagtccatgaggaacgagggcgggtacgaggtgatcaaggccgcgatcgagaagctgaagctgcggcacaaggagcacatcgccgcctacggcgagggcaacgagcgccggctgaccggcaggcacgagaccgccgacatcaacaccttcagctggggagtggccaaccgtggcgcgtcggtgcgcgtgggccgggagacggagcagaacggcaagggctacttcgaggaccgccggccggcgtccaacatggacccctacgtggtgacctccatgatcgccgagaccaccatcatctggaagccctgaagcgtcgctgcctgaattccatccagctccacgtctcgtctcggtcggtccgccgccatggctgcctccggcgaccgcattgagctgggcacggcaattgtcaaatgaatccgttccgttccatttgcatctgtccgattatacgctgctgctgctgccactactacttctgcatt

SEQ ID NO: 31554 - protein, 156 aa, Panicum virgatum
  misc_feature: Ceres CLONE 1906126
  misc_feature (1)..(155): Pfam Name: Gln-synt_C Pfam Description: Glutamine synthetase, catalytic domain
  misc_feature: SWISSPROT Homolog: EC 6.3.1.2 Glutamate--ammonia ligase
  misc_feature: Useful for making plants with modulated water use efficiency
QVGPSVGISAGDQVWVARYILERITEIAGVVVTFDPKPIPGDWNGAGAHTNYSTKSMRNEGGYEVIKAAIEKLKLRHKEHIAAYGEGNERRLTGRHETADINTFSWGVANRGASVRVGRETEQNGKGYFEDRRPASNMDPYVVTSMIAETTIIWKP

SEQ ID NO: 31555 - DNA, 560 bp, Panicum virgatum
  misc_feature: Ceres CLONE 1906153
  misc_feature: Encodes the peptide sequence at SEQ ID NO. 31556
agccaactcaacacgtagcatttcaatggctgcctacacctcggtcgtcgtcttctttctcctcgctgccttcgcggccggtgctagtagcgcggccacgttcaccatcaccaacaggtgcagcttcacggtgtggccggcggcgacccccgtgggcgggggcgcgcagctcaacccgggtgggacctggaccatcaccgtgcccgccggcacccagtccggcagggtgtggggccgcacggggtgctccttcagcggcgggagggggcggtgcgcgaccggcgactgcggcggcgccttctcctgcaccctctccgggcagcctccgatgacgctggccgagttcaccatcggcggcgccatggactcgtacgacatctcggtgatcgacggcttcaacgtcggcatggccttctcctgcagcaccggcgtgggcctggtgtgccgggacgccggctgccccgacgcgtaccaccagcccccggacaggaagacccacacctgcgcccgcaacagcaactaccaggtcaccttctgcccgtgatagatggggcacaggc

SEQ ID NO: 31556 - protein, 172 aa, Panicum virgatum
  misc_feature: Ceres CLONE 1906153
  misc_feature (30)..(172): Pfam Name: Thaumatin Pfam Description: Thaumatin family
MAAYTSVVVFFLLAAFAAGASSAATFTITNRCSFTVWPAATPVGGGAQLNPGGTWTITVPAGTQSGRVWGRTGCSFSGGRGRCATGDCGGAFSCTLSGQPPMTLAEFTIGGAMDSYDISVIDGFNVGMAFSCSTGVGLVCRDAGCPDAYHQPPDRKTHTCARNSNYQVTFCP

SEQ ID NO: 31557 - DNA, 1617 bp, Panicum virgatum
  misc_feature: Ceres CLONE 1906156
  misc_feature: Encodes the peptide sequence at SEQ ID NO. 31558
atagcctatactctcttcccctcaagaactgcaccaccacgcgacgccattgattgagcagggaggagaggcacaaggggaggagaaaagaggaaggggatccgcggtggctgcgctcgccggcggggaagaggggacgcgggcggcgagcctccagtcttcacctccgtgctctccgggctcttcggacagggcgaggacgaggaagagatggccacgcgcgaccgcaacgccgccgccgccgccgccgctccgcagctcaaccgaggtggtgttcccgctctgggaaagcagaaggccgtcgcggccggccgagctgacgccatgaaccggcgagcccccctgggcgacatcggcaacttcgtcgccgtccgcgcgaccgaagggaagccgcaggagcaggtcagccgccccgtcacgagaagcttcggtgctcaacttgtcaagagcgcgcaggcgaatgccgccgcaatcaagaatgcggccatcccacctgcgaggcctgcgccgaggctggagaggaaggctcctttcaagcctcctcctcctgagcatgtaatagagatcagctccgactctgaccagagcaacacgcagcccgagagaagcgacagctccgtccgctcgaggaagaaggtcatcaacaccctcacttctgttctctcggctcgctcaaaggttgcctgtggaatcactgacaagcctcgagaagtgattgaagacatcgacaagttggacgccaataatgagctcgcggtcgtggaatatgttgaggacatctacaccttctacaggactgcacagcatgagagccggccatgtgactacattgaagctcaggtggagatcaactcaaagatgagggctatcctggccgattggataattgaagtacaccacaagtttgaactgatgcccgaaactctctacttgacgatgtacatcatcgaccaatatctctcgctgcaaccagtccggcgaagggaactgcagcttgtgggtgtttcagccatgctgatcgcttgcaaatacgaggagatttgggcccccgaggtcaacgatttcatcctaatatcagatagtgcatacagtagggagcagattctttcaatggagaagggaatactaaataggcttgagtggaacttaactattcctacatcatacatgttcctcgttcgctttctcaaggcggcgtcttcgggtatcaaaactgacaaagagatggagaacatggtcttctttttcgcggagttatcactgatgcaatacggcttggtgacgtacctgccttcgatggttgctgcctctgctgtctatgcggcaaggctcactctcaagagggctccactttggactgacactctcaagcatcacacaggcttcagagagtcagagctaatggaatgcacaaaaatgctcgtgagcgcacatttgaccgcaccggagagcaagttaagggtcgtctacaagaagtattccagcgagcagtatggaggggtcgcactgcgtccaccggcagaggagatctgcaaataaacaaagataaatccgtcctgatagttatgcttgcttttgttttcgagagtgtaatgaaaggcaagtctgacattcgct

SEQ ID NO: 31558 - protein, 442 aa, Panicum virgatum
  misc_feature: Ceres CLONE 1906156
  misc_feature (189)..(314): Pfam Name: Cyclin_N Pfam Description: Cyclin, N-terminal domain
  misc_feature (316)..(441): Pfam Name: Cyclin_C Pfam Description: Cyclin, C-terminal domain
MATRDRNAAAAAAAPQLNRGGVPALGKQKAVAAGRADAMNRRAPLGDIGNFVAVRATEGKPQEQVSRPVTRSFGAQLVKSAQANAAAIKNAAIPPARPAPRLERKAPFKPPPPEHVIEISSDSDQSNTQPERSDSSVRSRKKVINTLTSVLSARSKVACGITDKPREVIEDIDKLDANNELAVVEYVEDIYTFYRTAQHESRPCDYIEAQVEINSKMRAILADWIIEVHHKFELMPETLYLTMYIIDQYLSLQPVRRRELQLVGVSAMLIACKYEEIWAPEVNDFILISDSAYSREQILSMEKGILNRLEWNLTIPTSYMFLVRFLKAASSGIKTDKEMENMVFFFAELSLMQYGLVTYLPSMVAASAVYAARLTLKRAPLWTDTLKHHTGFRESELMECTKMLVSAHLTAPESKLRVVYKKYSSEQYGGVALRPPAEEICK

SEQ ID NO: 31559 - DNA, 1480 bp, Panicum virgatum
  misc_feature: Ceres CLONE 1906171
  misc_feature: Encodes the peptide sequence at SEQ ID NO. 31560
tggattacatgagcttgcaaaaatatctgaaactcaagatataaattggttaaatagggtacccactgcaaggtttgctacaatgagattccgaaggctgttagtgagcaaacaaaaagattctgagcatccaggaagattgtctccactggcaccatctccttctgaacccatttcaccctctcctgcatcaccccccatagagcataccccaagccaagagaacaagaacaaccattctccaacaatatatgcatcgattggagcagcagctggttttttggtggtagccttatcagctgtatgcttcttttactactcccgcaggaagactagcactgttgtacccttgtttgcagccacttcaagcaggcaattacagataactgccatggaagggataactttattcagacggtccgaacttgaaacagcctgtgaaggttttagcaacataattggcacgctacctagatttacactgtataaaggaactctctcatgtggagcggaaatagctgtggtgtctacaacggtggcttgtgcaggaagttggtccgctatagctgaaacacgttacatgaataaggttgaagccttatcaaaggtaaaccataagaatcttatgaaccttgtgggttactgtgaagatgaaaaaccatttgtccggatgatggtgttcgagtatgtttcaaatggatcactgttcgagcgcttgcatgttaaagaagccgagcacttggattggcagtcacgcctacggatagttatgggagtagtgtactgtctgggctacaggcatcagcagaacgctcctgtaactctaaggaatctaaacagttcatgcatatacttgactgaagacaatgccgcaaaggtttcagacatcagctttggcgttggcaagaaagaagatgaagatgaagatgatgctcctgatgagtacaacacagtgtataagttcgctctgctactgcttgagacgatctctggaaggcgtccatattctgaagatgacggcctccttgttctatgggcacacagatatcttaatggtgttagccccgtgatgggtatggtcaacccaacgctaaattcagtcccggaagagcatgtcagagcattctcagagctaattcgtttatgcataagcgaggaccgaaggcagaggccgacaatggcagagcttaccaagaggatgcaggaaatcaccgggatcactcaagatcaggcgattccgaggaaaagtgctctgtggtgggctgaacttgaaatcattacagcttagggagtcaattgtgctgacttgcagcaactctgcaattctgatcgtttgctaggagaaatggagaagattgtacagtttagcgcttttaggcagggcaatagttgtacagatatgcctggttacaccattcttttttgtttttattaccaagcattctttcattctttgatctatgaaaagcaaataaaattc

SEQ ID NO: 31560 - protein, 428 aa, Panicum virgatum
  misc_feature: Ceres CLONE 1906171
  misc_feature (159)..(400): Pfam Name: Pkinase_Tyr Pfam Description: Protein tyrosine kinase
  misc_feature: SWISSPROT Homolog: EC 2.7.11.1 Non-specific serine/threonine protein kinase
GLHELAKISETQDINWLNRVPTARFATMRFRRLLVSKQKDSEHPGRLSPLAPSPSEPISPSPASPPIEHTPSQENKNNHSPTIYASIGAAAGFLVVALSAVCFFYYSRRKTSTVVPLFAATSSRQLQITAMEGITLFRRSELETACEGFSNIIGTLPRFTLYKGTLSCGAEIAVVSTTVACAGSWSAIAETRYMNKVEALSKVNHKNLMNLVGYCEDEKPFVRMMVFEYVSNGSLFERLHVKEAEHLDWQSRLRIVMGVVYCLGYRHQQNAPVTLRNLNSSCIYLTEDNAAKVSDISFGVGKKEDEDEDDAPDEYNTVYKFALLLLETISGRRPYSEDDGLLVLWAHRYLNGVSPVMGMVNPTLNSVPEEHVRAFSELIRLCISEDRRQRPTMAELTKRMQEITGITQDQAIPRKSALWWAELEIITA

SEQ ID NO: 31561 - DNA, 703 bp, Panicum virgatum
  misc_feature: Ceres CLONE 1906175
  misc_feature: Encodes the peptide sequence at SEQ ID NO. 31562
ccactactcctcaccaccgcgccgccgccgcgaagaaggcgaagcggcaccggaaggagaagaagcgaagcgaggcccttacccgcccgacgcccgtgcccaccgaagcaagccgaatccggaaacgagtgaagaggaagagagagcggcgcgaggatgccgacggtgacctgcaacgcgtgcaacgcggggttcgacgacgaggagcagcagcggctccactaccgctccgagtggcaccgctacaacctcaagcgcaaggtggctggagttcctggtgtgaccgaagctctgtttttggctagacaaactgttttagcggaggggaacaagcctgcaagcacccctatgctatacagctgtgctctctgtggaaaggagtacaggagctccaaagctcatgcacaacatcttaactcgcggtcacatcttatgagagcctctcaggagcccaatgcctcaattgctggaattactatagtcaagccacttcctgagcgggttccacgtagagctccatctgcagtagaggaggatgaagatgaagatgaggaggaagagtgggttgaagttgacccaaatgaaatggagttggctgatgaatctacttcaaacatgcaagtagatgagcagtcatccaaatcagatgatgaaatggatgatcttgaagagttggatatctcgttgtgtttcatgtgtgatc

SEQ ID NO: 31562 - protein, 182 aa, Panicum virgatum
  misc_feature: Ceres CLONE 1906175
  misc_feature: The sequence is a functional homolog of SEQ ID NO 512 in the 11/479,226 US patent application
MPTVTCNACNAGFDDEEQQRLHYRSEWHRYNLKRKVAGVPGVTEALFLARQTVLAEGNKPASTPMLYSCALCGKEYRSSKAHAQHLNSRSHLMRASQEPNASIAGITIVKPLPERVPRRAPSAVEEDEDEDEEEEWVEVDPNEMELADESTSNMQVDEQSSKSDDEMDDLEELDISLCFMCD

SEQ ID NO: 31563 - DNA, 699 bp, Panicum virgatum
  misc_feature: Ceres CLONE 1906196
  misc_feature: Encodes the peptide sequence at SEQ ID NO. 31564
gtgaacgggcggtgggcgatgctgggcgtggccgggatgctgatcccggaggtgctgaccaaggctgggctcatcaacgcgccgcagtggtacgacgccggcaagtcggagtacttcgcgtcgtcgtccacgctgttcgtcatcgagttcatcctcttccactacgtcgagatccggcggtggcaggacatcaagaaccccggcagcgtcaaccaggaccccatcttcaagagctacagcctgccgccccacgagtgcggctaccccggcagcgtcttcaaccccctcaacttcgcccccacgctcgaggccaaggagaaggagctcgccaacgggaggctggcgatgctggcgttcctgatccagcacaacgtcaccggcaaggggcccttcgacaacctgctgcagcacctgtccgacccatggcacaacaccatcatccaaaacatctccggttgagtcgatgacggagagcgatcgtcaatttggcggtggtgctagctgatggggatcgattgggagacaaacattgagacgcggtcgagtcgatcgatgtgagttccttcctgtggatcgatcatcagtatgtgatgtgtgcagtgttcagtctggagaggagaattcagggcgtgttgtaatgatgtgtacgcatggtgaggaggagagtgtgaggagtgattggtatgtacattaatgaca

SEQ ID NO: 31564 - protein, 152 aa, Panicum virgatum
  misc_feature: Ceres CLONE 1906196
  misc_feature (1)..(124): Pfam Name: Chloroa_b-bind Pfam Description: Chlorophyll A-B binding protein
VNGRWAMLGVAGMLIPEVLTKAGLINAPQWYDAGKSEYFASSSTLFVIEFILFHYVEIRRWQDIKNPGSVNQDPIFKSYSLPPHECGYPGSVFNPLNFAPTLEAKEKELANGRLAMLAFLIQHNVTGKGPFDNLLQHLSDPWHNTIIQNISG

SEQ ID NO: 31565 - DNA, 646 bp, Panicum virgatum
  misc_feature: Ceres CLONE 1906211
  misc_feature: Encodes the peptide sequence at SEQ ID NO. 31566
acaccccacatcgctgctcggcttctctcctccccgagcacttcgtctccgcctcgagccggcgccaccacagccgcaggccccgccggaagcgaggagctgcggaagcaggggaggggcgacgcggcgacgccaccgtcggcgtcctctcgcgatggcgcctctcacggcccccaagtccggcgacgccctcttcgccagcgtcgatcgcgtcaacgcggagctgttcacgctcacgtatggcgccatcgtgcggcagctgctcacggatctggaggaggtcgaggaggtcaacaagcagctagatcagatgggttacaacattggaacacggttgattgatgagttcttagcaaagtcaaacgtatcaaggtgtgttgacttcaaggagactgctgatgttatcgcaaagcttggatttaagatgttcttgggtgtgactgcaactgtaaccaattgggatgccgagggtacaagctgcagctttatattggaggacaatcctcttgttgattttgttgagctccctgacacttgccaaggccttcagtattgcaatgtgttaagtggagtaatcaggggagcattggaaatggtgtctatgaagacagaggtgacatgggtccgtgacatgctccgtggggat

SEQ ID NO: 31566 - protein, 163 aa, Panicum virgatum
  misc_feature: Ceres CLONE 1906211
  misc_feature (24)..(161): Pfam Name: TRAPP_Bet3 Pfam Description: Transport protein particle (TRAPP) component, Bet3
MAPLTAPKSGDALFASVDRVNAELFTLTYGAIVRQLLTDLEEVEEVNKQLDQMGYNIGTRLIDEFLAKSNVSRCVDFKETADVIAKLGFKMFLGVTATVTNWDAEGTSCSFILEDNPLVDFVELPDTCQGLQYCNVLSGVIRGALEMVSMKTEVTWVRDMLRG

SEQ ID NO: 31567 - DNA, 2184 bp, Panicum virgatum
  misc_feature: Ceres CLONE 1906220
  misc_feature: Encodes the peptide sequence at SEQ ID NO. 31568
aacaccacaaacagatagccttcttcagcggccacgagtgcccggacgcccgccaccagtaaccatggcctcgtccctggccgctttccactccgccgccggccacgtcccccgcccacgcaggcagcagggcgccgcccaagggcgcgcctcctccctcctccggctgctccaccttccgccggagccgctgcccggccgccgctcccgaagggtcgccgccgagttcgtgactgggggcgctgacatcaccaccggcgatggcggcggcggccgcaggacgtcgggaagcgcgggcgtcgacgtcgccgcggtcaccgcgatgctccgtgaggccagaacggccgacgacgtggagcttctggtgaagggtttcttggaagaccgcggcggcgagggcggcctcctgcccctccaagtgtacaccaccgtgattcgggggctcggcaaggagaagtgcctggacgccgcgttcgccgttgttgagcgtctcaagcggagaggggtcaagctcaaccaattcctgtacaactgcctcctcggcgcggtcaagaactgcggcgagttcgggcggattgaggctgttctcgctgacatggaagcgcagggaatctccccaaacattgtgactttcaataccctgatgtccatctatgttcaacagggcaagactgacgatgtcttcagggtgtacgccgaaattgaaggccggggacttgtgccgactacagcaacatactccactctgatgtcggcctacaagaaggccggggatgcatttgcagccatcaagttctttgtgacgctcagggagaggtacaagaagggtgagctggtggggaaccatgacgaatgggagcaggagtttgtcaagtttgagaagctcactgtccgggtgtgttacatgtcaatgcagcggtccctcgtcagtgggcagaatccggtcggtgaggtgttgaaggttctccttgccatggatgaagcagatgtcaggccagaaaggagcgattatgagcggcttgtctgggcgtgcactggggaggaacattacgccattggcaaggagctgtatcagaggattcgtgagcgtcatggggagataagcctgtctgtctgcaaccatctgatttggctgatgggcaagtctaagaaatggtgggcagctcttgagatttatgaggatttattggacaaagggccaaagccgaacaatttgtcttatgagctgatcatgtcacatttcaacattctgctgaatgctgcgaagagaaggagcatttggaggtggggtgttaggctgcttgacaagatgcaagagaagggattgaagcctggaagcaaagagtggaatgcagttctacttgcatgttcaagggcttctgaaacatcggctgcagtggatattttcaagaaaatgatagagaaagggttgaaaccagatatagtttcctatggagcattgctgagtgcacttgagaaaggcaagctgtatgatgaggctttgagagtctgggaacacatgtgcaaagttggcattaaaccaaacctgtatgcatatacaattttggtgtcgatttacattggtaagggcaatcatgctatggtagatgctgttcttgacgatatggtgtcaaaacagattgagccaactgttgtaaccttcaacgcaataatcagcgcatgtgtgaggaacaatataggcggcactgcttttgagtggtttcacaggatgaaaatgcggagcattgaaccaaatgaaattacatatcagatgttgattgaagctcttgtacaagatggtaaaccaaaacttgcctatgagatgtacatgagggcttgcagccaaggtcttgaacttcctgcaaagtcatatgacactgtaatggaggcatgcaaagcttatggttccctcatagatctaactactctgggtcctcgccctccgaaaagggaggagcccatcaggttagagaataacttttcgagtttttctcaaatcaaggagctgcctaacagtactcaacattttgggagcactggaatgtatggatttttcagatacagaatggaaagatcatgattttagcatgctaccactcccttgtatagttgtcttcaccctccaaaacctattgaacattaaaaaaacggtcactgacatattccataagttccccaaactgt

SEQ ID NO: 31568 - protein, 671 aa, Panicum virgatum
  misc_feature: Ceres CLONE 1906220
  misc_feature (188)..(222): Pfam Name: PPR Pfam Description: PPR repeat
  misc_feature (461)..(495): Pfam Name: PPR Pfam Description: PPR repeat
  misc_feature (531)..(565): Pfam Name: PPR Pfam Description: PPR repeat
  misc_feature (118)..(152): Pfam Name: PPR Pfam Description: PPR repeat
  misc_feature (426)..(460): Pfam Name: PPR Pfam Description: PPR repeat
  misc_feature (496)..(530): Pfam Name: PPR Pfam Description: PPR repeat
  misc_feature (349)..(383): Pfam Name: PPR Pfam Description: PPR repeat
MASSLAAFHSAAGHVPRPRRQQGAAQGRASSLLRLLHLPPEPLPGRRSRRVAAEFVTGGADITTGDGGGGRRTSGSAGVDVAAVTAMLREARTADDVELLVKGFLEDRGGEGGLLPLQVYTTVIRGLGKEKCLDAAFAVVERLKRRGVKLNQFLYNCLLGAVKNCGEFGRIEAVLADMEAQGISPNIVTFNTLMSIYVQQGKTDDVFRVYAEIEGRGLVPTTATYSTLMSAYKKAGDAFAAIKFFVTLRERYKKGELVGNHDEWEQEFVKFEKLTVRVCYMSMQRSLVSGQNPVGEVLKVLLAMDEADVRPERSDYERLVWACTGEEHYAIGKELYQRIRERHGEISLSVCNHLIWLMGKSKKWWAALEIYEDLLDKGPKPNNLSYELIMSHFNILLNAAKRRSIWRWGVRLLDKMQEKGLKPGSKEWNAVLLACSRASETSAAVDIFKKMIEKGLKPDIVSYGALLSALEKGKLYDEALRVWEHMCKVGIKPNLYAYTILVSIYIGKGNHAMVDAVLDDMVSKQIEPTVVTFNAIISACVRNNIGGTAFEWFHRMKMRSIEPNEITYQMLIEALVQDGKPKLAYEMYMRACSQGLELPAKSYDTVMEACKAYGSLIDLTTLGPRPPKREEPIRLENNFSSFSQIKELPNSTQHFGSTGMYGFFRYRMERS

SEQ ID NO: 31569 - DNA, 1442 bp, Panicum virgatum
  misc_feature: Ceres CLONE 1906243
  misc_feature: Encodes the peptide sequence at SEQ ID NO. 31570
tctcagatataattattcgcagcacacaaaaagagggggcgcaagcaagagaaggattaggacacgagaactagcggaagagagaaaagaaaagcttagagagagagagagagagagagagagaggcgtggttcccgtgccgtggtggtggagttggatcggcctgtgcggatcggaggaggtcatgaacagctaatgcccatttatttattatggacttgcaccaggtattaaagtacagattagctggtgctaacatcttctacgagtttcctacagaaaacaacttagcaaacactccctggccagctacgcccctgaagtccgagttcagtaactccccatacactcctctttcagcccagcttgagtgtgacaatttgtctgctattagcaacactccagataatcagagctccacagaaaccatttcagcacaaccaatatcaccactggaagttgacagttcatacagacagtcaggcatccttcgagaaaacacccaagtgagacctgatcaattgtacacaacatcaagacataatatgcaacacgctttacgggaaatagagactgttctgatggctcctgatgctgatgatgcagccaatagcaccaagcatgagtttgaggaacacaaacctactcagttgatgaggcagcggtcaaggacatggagtgaatcaagacagccatcaccaggaattgtccgcacacaatttggatctggataccccacagcaagctatgacttccgcccagaaaagcggcaaagggagttaagggaggatccgcagagcatggtgaagcagctattaaccaagtgtgctgaagcattaagtgaggagaggatagatgagttcctcaagcttgttcagcaagctcgcggagttgtatcaattactggggagccaatacagcggttaggtgcttaccttcttgagggtttggttgctagacatggaaactcgggtacgaacatatatcgtgctctgaagtgccgtgagccggagagtaatgaacttttgtcctacatgaagattttatacagtatctgtccgtacttcaagtttggctatatggctgccaatggggcaattgcagaggcattgagaaatgaggacaaaatccatataattgatttccagattgctcaggggacacaatggataacactgatccaagcactagctgcaaggcctgggggtcctccacatgtgcggatcactggaatagatgatccagtgtcagagtacgctcgtggtgaaggtctggaccttgtagggaagatgttgaagagcatgtccgaagaattcaggataccattggagtttacccctctacctggtgtctatgccactcgagtcacaaaagaaatgctagacatcaggccaggcgaagcacttgctgtcaacttcactctgcagctacaccacacacca

SEQ ID NO: 31570 - protein, 409 aa, Panicum virgatum
  misc_feature: Ceres CLONE 1906243
  misc_feature (170)..(409): Pfam Name: GRAS Pfam Description: GRAS family transcription factor
MDLHQVLKYRLAGANIFYEFPTENNLANTPWPATPLKSEFSNSPYTPLSAQLECDNLSAISNTPDNQSSTETISAQPISPLEVDSSYRQSGILRENTQVRPDQLYTTSRHNMQHALREIETVLMAPDADDAANSTKHEFEEHKPTQLMRQRSRTWSESRQPSPGIVRTQFGSGYPTASYDFRPEKRQRELREDPQSMVKQLLTKCAEALSEERIDEFLKLVQQARGVVSITGEPIQRLGAYLLEGLVARHGNSGTNIYRALKCREPESNELLSYMKILYSICPYFKFGYMAANGAIAEALRNEDKIHIIDFQIAQGTQWITLIQALAARPGGPPHVRITGIDDPVSEYARGEGLDLVGKMLKSMSEEFRIPLEFTPLPGVYATRVTKEMLDIRPGEALAVNFTLQLHHT

SEQ ID NO: 31571 - DNA, 719 bp, Panicum virgatum
  misc_feature: Ceres CLONE 1906243-R
  misc_feature: Encodes the peptide sequence at SEQ ID NO. 31572
ccacgggacagcaaggagaggataaatgtggagcagcactgccttgccaaggacattgtgaacattatcgcctgtgaggggaaggaccgtgtggagcggcatgagctcctaggcaagtggaagtcgaggctgaccatggctgggttcaagccgtacccgctaagctcgtatgtgaactcggtgatcaggaagctcctcgcgtgctattctgacaagtacaccctggaagagaaggacggcgcgatgctgctcggctggaagaataggaaattgatatcagcttctgcgtggcactgacaataagttttcagaagaacataagtaaacaccttctcttacatataaatatatatatagtgaattccctggtctgctttcccagaaaagatgctctttgttgtacatgtagaggatgttgtatccttcgtttttccctaaattgtagaccaggataaatattgacattagattgtagctgtatgataattacagttttcttttgtttgccctgtcagagtcatatggtatcttggatcggatatatctctccaagctaactcacgctgatcggtaaacatgctgagatgcttaacttttaatgttgttgagtatgcagtgtgtgtgtattggtaacatgcccctgggaaggaaggtaaagagtttcagtcttagcgcataggaatggtttattactgcgagatcgaattttgtaccggcag

SEQ ID NO: 31572 - protein, 98 aa, Panicum virgatum
  misc_feature: Ceres CLONE 1906243-R
  misc_feature: The sequence is a functional homolog of SEQ ID NO 474 in the 10/666,642 US patent application
  misc_feature: Useful for making plants with modulated light quality sensitivity
  misc_feature: Useful for making plants with modulated low light sensitivity
  misc_feature: The sequence is a functional homolog of SEQ ID NO 1018 in the 10/225,066 US patent application
  misc_feature: The sequence is a functional homolog of SEQ ID NO 2712 in the 10/374,780 US patent application
  misc_feature: Useful for making plants with altered alkaloid content
  misc_feature: Useful for making plants with altered lignin content
PRDSKERINVEQHCLAKDIVNIIACEGKDRVERHELLGKWKSRLTMAGFKPYPLSSYVNSVIRKLLACYSDKYTLEEKDGAMLLGWKNRKLISASAWH

SEQ ID NO: 31573 - DNA, 1803 bp, Panicum virgatum
  misc_feature: Ceres CLONE 1906247
  misc_feature: Encodes the peptide sequence at SEQ ID NO. 31574
aagggaaggggattgggcgccccccttctccctcgcagaaaggcggcagcaccctcctctcctcggaccctctcctctcctgtccggttcagggagcagcgcaaggcgggggaggaagccgccgccggccgccgctccactcctccggcctccgccaccgccagcccgcctgctatccacgcggggccgaaggaaacggggagaggcgcccgccctgtccagcttccggagcggctgcaacctgaggttgagccagacctatattttctaagcaatggcggcaacgatggtggcgatgacggccaagagcaagaacagcgtattagccgtggagaagaagcagggctggtctattcagccccccgagctccggttcccatgggattctcgtgatgacaagggcttctctctaagcctgcaaggcactgggcctgctcatggcgggctgtttgctagcgttggtcttaaagtgtcgacgggcgcgccagcagtggcacccagtccgggggagaaggacattaagattcccttcgctgatcattgcgtaaagtatgtttctgaggcggttgggtaccaagttattagcaccgaggctgagccagtagaggaggaggtggttgatggtaaggcaaagaagaaggccaagaagcatgggctgaagctcaaaatcaagattgggaacccacatttgaggcggctggttagtggagcagttgcgggggctgtttccaggacttgcgtggcaccgttagagacgattaggactcacttgatggtcgggagcaatgggaactcgatgacggaggtgttccagtcgatcatgaacactgaggggtggactgggctgttccgtgggaatcttgtcaatgttatccgtgttgcgccaagcaaagcaattgagttgtttgctttcgatacagccaagaaattcttaactccaaaggctgatgagtccccaaaaacattcctccctccgtcacttcttgctggagcacttgctggagtcagctcaacattgtgcatgtatcctttggaattgattaagaccagattgacaatagagaaagatgtctacaacaacttccttcatgcctttgtcaagattctacgagaggaaggcccatcagaactgtaccgtggtctgacaccgagtctgataggagtggtgccatatgccgcaactaactactacgcgtatgacaccctgaagaagctctacaggaagacattcaagcaggaggagatcagcaacattgctactctcttcatcggctcagccgctggtgccatctcaagcagtgccactttcccgctcgaggtggcccgcaagcaaatgcaggttggagcagttggtgggaggcaagtctacaagaacgtgttccatgccctctactgcataatggagaaggaagggattggcgggctgtacaagggacttgggcccagctgcatcaagctgatgcctgcggcaggcatctcgttcatgtgctacgaggcctgtaagaagatcctggtagaagatgatgaggagagcgagtgaagcatttgaccctgatgagttctggaaggtggaggtggagatatatcatcatttttctttctatcgagaattggagtatcaactcatgaaaatttaggtctaatacttgggagtgtgttaggtcaatttttggctcaaattagttttgtgtcgaaatccataaacaatatttgcagttcatggtgcatgttgctgaagaagttttgtcatggccatgtctggttccctcactgctacttttgttgtctgaattctttctgctt

SEQ ID NO: 31574 - protein, 421 aa, Panicum virgatum
  misc_feature: Ceres CLONE 1906247
  misc_feature (325)..(417): Pfam Name: Mito_carr Pfam Description: Mitochondrial carrier protein
  misc_feature (231)..(319): Pfam Name: Mito_carr Pfam Description: Mitochondrial carrier protein
  misc_feature (137)..(224): Pfam Name: Mito_carr Pfam Description: Mitochondrial carrier protein
MAATMVAMTAKSKNSVLAVEKKQGWSIQPPELRFPWDSRDDKGFSLSLQGTGPAHGGLFASVGLKVSTGAPAVAPSPGEKDIKIPFADHCVKYVSEAVGYQVISTEAEPVEEEVVDGKAKKKAKKHGLKLKIKIGNPHLRRLVSGAVAGAVSRTCVAPLETIRTHLMVGSNGNSMTEVFQSIMNTEGWTGLFRGNLVNVIRVAPSKAIELFAFDTAKKFLTPKADESPKTFLPPSLLAGALAGVSSTLCMYPLELIKTRLTIEKDVYNNFLHAFVKILREEGPSELYRGLTPSLIGVVPYAATNYYAYDTLKKLYRKTFKQEEISNIATLFIGSAAGAISSSATFPLEVARKQMQVGAVGGRQVYKNVFHALYCIMEKEGIGGLYKGLGPSCIKLMPAAGISFMCYEACKKILVEDDEESE

SEQ ID NO: 31575 - DNA, 524 bp, Panicum virgatum
  misc_feature: Ceres CLONE 1906248
  misc_feature: Encodes the peptide sequence at SEQ ID NO. 31576
ctcggactctcacctccctttgctcttccttccctggcgacggcgactgggcgagcggcggcgccatttgtcctgtcttcgcccagccctttgacggcaacaagcgcatcctccaggtcatggcagagatcatagatttatcaggggacggaggtgttcttaagacggtggtccggaaagcaaaggatgatgctatagcgccatctgatagtctgcccttggttgatgttcattacgaaggcacacttgctgagaatggtgaagtttttgacaccacccatgaagactactctattttctcatttgaaattggacagggggctgtcatcaaagcatgggatatagccttaagaactatgaaggttggcgaggttgcaaaaattacatgcaagccagaatatgcatatggaactgcgggttcaccactggagatacctcctaagcgagtttcctttttcacccatcgttagattgataatttgagctttcccagttcgataatgttagtaaccgttggaactttg

SEQ ID NO: 31576 - protein, 116 aa, Panicum virgatum
  misc_feature: Ceres CLONE 1906248
  misc_feature (15)..(115): Pfam Name: FKBP_C Pfam Description: FKBP-type peptidyl-prolyl cis-trans isomerase
  misc_feature: SWISSPROT Homolog: EC 5.2.1.8 Peptidylprolyl isomerase
  misc_feature: Useful for making plants with modulated biomass
MAEIIDLSGDGGVLKTVVRKAKDDAIAPSDSLPLVDVHYEGTLAENGEVFDTTHEDYSIFSFEIGQGAVIKAWDIALRTMKVGEVAKITCKPEYAYGTAGSPLEIPPKRVSFFTHR

SEQ ID NO: 31577 - DNA, 1854 bp, Panicum virgatum
  misc_feature: Ceres CLONE 1906255
  misc_feature: Encodes the peptide sequence at SEQ ID NO. 31578
ctggcccccttacacctcccaccgacgctgccgccgctggcacgcatttccctcctcgtcgtcttccccttcctcggcgcggcgcggcgcggagcctggtggaaaccgcgcggatgaggatccgctgctagagcgagaggagcaagtatcgtgcgccagcgtcggccgtggcggcggcggaaggggagcaggaggcgatggaggcgagcgccgggctggtggccggctcccacaaccgcaacgagctcgtcgtcatccgccgcgacggcgatcccgggccgaagccgctgcggcagccgaatgggcaggtgtgccagatttgcggcgacgacgtcggcctcgcccccggcggggagcccttcgtggcctgcaacgagtgcgccttccccgtctgccgggactgctacgagtacgagcgccgggagggcacccagaactgcccccagtgcaagacccgctacaagcgcctcaagggctgcgctcgtgtgcccggggatgaggaagaggatggcgtcgacgacctggagaacgagttcaactgggacggcaatgagtcgcagtatggcgccgagtcactccacggccacatgacctacggccgtggaggcgaccttaacggcgtccagcagcctttccagctgaaccccaatgttcccctcctcaccaatgggcagatggtggatgacatcccaccggagcagcacgctctggtcccgtctttcatgggcggtgggggcaagaggatccacccacttccatatgcggatcccagtttacctgtccaaccaaggtccatggacccatccaaggatcttgctgcgtatggctatggtagtgttgcatggaaggagaggatggagagctggaagcagaagcaggagaggatgcaccagatgaggaatgatgccggtggtgatgatggtggtgatgacgatcttccactaatggatgaagcaagacaaccactgtccaggaaaattccaattccatcaagccagattaatccatttaggatgattatcattattcggcttgtggttttggggttcttcttccactatcgagtgatgcatccagtgaacgatgcatttgctttgtggctcatatctgttatctgtgaaatttggtttgccatgtcttggatccttgatcaattcccaaaatggttccctattgagagagagacatacttagaccggctgtcattgaggttcgacaaggaaggccagccatctcaacttgctccaatcgatttctttgtcagtacagtcgatccattaaaggaacctcctttggtcacagcaaatactgttctatctatccttgcggtggattatccagttgataaggtgtcttgctatgtttctgatgatggtgctgcaatgctaacatttgaagcgctgtctgaaacatccgaatttgcaaagaaatgggttcctttctgcaaaaggttcaatattgaacctcgtgctccagagtggtacttccaacagaaaatagactacttgaaagacaaggtggcggcaagctttgttggtgagaggagagcgatgaagagagagtatgaggaattcaaggtcagaatcaatgccttggttgctaaagcccagaaagttcctgaagaaggatggacaatgcaagatgggaccccctggcctggaaacaatgttcgtgatcatcctggaatgattcaggtcttccttggccaaagtggaggtcttgattgcgagggaaatgagctaccacgattggtttatgtttcaagagaaaaacgacctggctataaccatcataagaaagctggtgctatgaatgcattggtcagagtctctgctgtactaacaaatgctcccc

SEQ ID NO: 31578 - protein, 552 aa, Panicum virgatum
  misc_feature: Ceres CLONE 1906255
  misc_feature (256)..(552): Pfam Name: Cellulose_synt Pfam Description: Cellulose synthase
  misc_feature: SWISSPROT Homolog: EC 2.4.1.12 Cellulose synthase (UDP-forming)
  misc_feature: The sequence is a functional homolog of SEQ ID NO 26 in US patent 7312377
  misc_feature: Useful for making plants with modulated biomass
  misc_feature: Useful for making plants with altered cell wall content and/or composition
  misc_feature: Useful for making plants with altered carbohydrate content
  misc_feature: The sequence is a functional homolog of SEQ ID NO 6 in US patent 7285702
MEASAGLVAGSHNRNELVVIRRDGDPGPKPLRQPNGQVCQICGDDVGLAPGGEPFVACNECAFPVCRDCYEYERREGTQNCPQCKTRYKRLKGCARVPGDEEEDGVDDLENEFNWDGNESQYGAESLHGHMTYGRGGDLNGVQQPFQLNPNVPLLTNGQMVDDIPPEQHALVPSFMGGGGKRIHPLPYADPSLPVQPRSMDPSKDLAAYGYGSVAWKERMESWKQKQERMHQMRNDAGGDDGGDDDLPLMDEARQPLSRKIPIPSSQINPFRMIIIIRLVVLGFFFHYRVMHPVNDAFALWLISVICEIWFAMSWILDQFPKWFPIERETYLDRLSLRFDKEGQPSQLAPIDFFVSTVDPLKEPPLVTANTVLSILAVDYPVDKVSCYVSDDGAAMLTFEALSETSEFAKKWVPFCKRFNIEPRAPEWYFQQKIDYLKDKVAASFVGERRAMKREYEEFKVRINALVAKAQKVPEEGWTMQDGTPWPGNNVRDHPGMIQVFLGQSGGLDCEGNELPRLVYVSREKRPGYNHHKKAGAMNALVRVSAVLTNAP

SEQ ID NO: 31579 - DNA, 551 bp, Panicum virgatum
  misc_feature: Ceres CLONE 1906255-R
  misc_feature: Encodes the peptide sequence at SEQ ID NO. 31580
tcagagctatatacattcaagtggacaaccttactaatacctccaaccactctgctcttgttgaacttcattggtgtggttgctggtgtttcaaatgctatcaacaacggatatgaatcatggggccctctattcgggaagctcttctttgcattctgggtgattgtccatctgtatccgttcctgaaaggtttggttggaaggcaaaacaggacaccaacaattgtcattgtctggtccattctgctggcttcaatcttctcactcctttgggtccggatcgatcctttcctagcaaaaaatgatggcccgtttcttgaggagtgtggtttggattgcaactaggaggtcagcatatcagctcccccagcgccgaatgcttgaaaataaaaaccatttacaatgtcccctctgtaaataaaaatccatggtggtagttcagcctcatgccttcagatatatactgggcagaatggaggctatggcaatccttgtgcagttgagccgtggaatagaacatatgcaaagtgttcgattgttcagcattcttc

SEQ ID NO: 31580 - protein, 114 aa, Panicum virgatum
  misc_feature: Ceres CLONE 1906255-R
  misc_feature: SWISSPROT Homolog: EC 2.4.1.12 Cellulose synthase (UDP-forming)
  misc_feature: The sequence is a functional homolog of SEQ ID NO 26 in US patent 7312377
  misc_feature: Useful for making plants with altered cell wall content and/or composition
  misc_feature: Useful for making plants with modulated biomass
  misc_feature: Useful for making plants with altered carbohydrate content
  misc_feature: The sequence is a functional homolog of SEQ ID NO 6 in US patent 7285702
  misc_feature: The sequence is a functional homolog of SEQ ID NO 2 in US patent 7049481
  misc_feature: Useful for making plants with modulated plant growth and development
SELYTFKWTTLLIPPTTLLLLNFIGVVAGVSNAINNGYESWGPLFGKLFFAFWVIVHLYPFLKGLVGRQNRTPTIVIVWSILLASIFSLLWVRIDPFLAKNDGPFLEECGLDCN

SEQ ID NO: 31581 - DNA, 729 bp, Panicum virgatum
  misc_feature: Ceres CLONE 1906263
  misc_feature: Encodes the peptide sequence at SEQ ID NO. 31582
gacttggcaagcctctgatattttgcaggactgagagtgatagccccatggaaaatggttatgcccgtcctgtggaaggaattcatgttgttgttgatatgcagaataatactgtaatagagtttgaagataggaagttggttcctctccccccaccagatcatttgaggaattatactcctggggaaacaagaggtggtgttgatcgaagtgatgtaaaaccacttattatcaatcagcccgagggtccaagtttccgcatcaatggctattttgtggaatggcagaagtggaacttccgtattggcttcacccccaaagagggtttggttatctattctgttgcgtatgttgatggtagccgtggacgtcgacctattgcgcataggctgagctttgttgagatggttgttccttatggagatccaaatgaaccacattatcgcaagaatgcatttgatgctggagaagatggacttggcaaaaatgctcattctcttaagaagggatgtgattgcttgggatacataaaatattttgatgcacatttcacaaacttcactggtggtgttgagacaattgagaactgtgtttgtttgcatgaggaggaccatggaatcctctggaaacaccaagactggagaactggtttagcagaagtaaggcggtcaaggaggctcactgtctcatttatctgtactgttgcaaactacgaatatgggttttacg

SEQ ID NO: 31582 - protein, 242 aa, Panicum virgatum
  misc_feature: Ceres CLONE 1906263
  misc_feature (70)..(242): Pfam Name: Cu_amine_oxid Pfam Description: Copper amine oxidase, enzyme domain
  misc_feature: SWISSPROT Homolog: EC 1.4.3.6 Amine oxidase (copper-containing)
LGKPLIFCRTESDSPMENGYARPVEGIHVVVDMQNNTVIEFEDRKLVPLPPPDHLRNYTPGETRGGVDRSDVKPLIINQPEGPSFRINGYFVEWQKWNFRIGFTPKEGLVIYSVAYVDGSRGRRPIAHRLSFVEMVVPYGDPNEPHYRKNAFDAGEDGLGKNAHSLKKGCDCLGYIKYFDAHFTNFTGGVETIENCVCLHEEDHGILWKHQDWRTGLAEVRRSRRLTVSFICTVANYEYGFY

SEQ ID NO: 31583 - DNA, 1198 bp, Panicum virgatum
  misc_feature: Ceres CLONE 1906273
  misc_feature: Encodes the peptide sequence at SEQ ID NO. 31584
agtcagccaccccccgcgctccccgctcgtctccagctcgatggactattcgagcaccaaggagttgcctccggccggggcctggtggtcgagggagacggtggccgtggtgacgggcgcgaaccggggcatcgggcacgccctcgccgcgcgcctggccgagcacgggctcaccgtggtgctcaccgcacgggacggcgcgcgcggggaggccgccgcggccccgctccgcgcgcgcgggctcgccgtcgccttccgcaggctcgacgtctccgacgccgcctccgtcgccgagttcgccgcctggctccgcgacgccgtcggcggcctcgacatcctggtgaacaacgcggccgtgtccttcaacgagatcgacaccaactcggtggagcacgccgagacagtcctcaggaccaacttccacggcgccaagatgctcacggaagcgctgctgccgctgttccggcagtccccggccaccagcaggatcctcaacatcagctcgcagcttggccttctcaacaaggtgagcgactcgtccctgaaggcgctgctcctggacgaggagaccctgacggaggcggcgatcgacgccatggtgtcgcggttcctggcgcaggtgaaggacgggacgtggggcgctcagggctggcccaaggtgtggacggactactcggtctccaagctggccctgaacgcctactcccggctgctggcgcggcggctgcaggcgcgcggcgcccgcgtgagcgtcaactgcttctgccccgggttcacgcgcaccgacatgaccaggggctgggggaagcgcaccgccgaggaggtggccgacgtcggcgcgcggctcgcgctgctgccgcccggcgagctccccacgggggccttcttcaagtggtgcacgccgcagctctactccaagctgtgacctgccgggagctagccacgccgccggccggcgcgccccggccatggcggcagtgggagtatatgtatgtagcgttggtttagctgctcctagtgacttgactccccatgcaaacaagaagtcgatcgagtagttagtgcctctggcagtctggctttctgccaaggtgctatggttgaagcaatgcaacctaaccatgtcagcaatcaatgtactatgcctagttagccgtgtaagatttaaagttaacttctgaacatgggaagaatcatg

SEQ ID NO: 31584 - protein, 294 aa, Panicum virgatum
  misc_feature: Ceres CLONE 1906273
  misc_feature (20)..(173): Pfam Name: adh_short Pfam Description: short chain dehydrogenase
  misc_feature (17)..(282): SWISSPROT Homolog: EC 1.1.1.184 Carbonyl reductase (NADPH)
  misc_feature (13)..(46): SWISSPROT Homolog: EC 1.1.1.206 Tropine dehydrogenase
MDYSSTKELPPAGAWWSRETVAVVTGANRGIGHALAARLAEHGLTVVLTARDGARGEAAAAPLRARGLAVAFRRLDVSDAASVAEFAAWLRDAVGGLDILVNNAAVSFNEIDTNSVEHAETVLRTNFHGAKMLTEALLPLFRQSPATSRILNISSQLGLLNKVSDSSLKALLLDEETLTEAAIDAMVSRFLAQVKDGTWGAQGWPKVWTDYSVSKLALNAYSRLLARRLQARGARVSVNCFCPGFTRTDMTRGWGKRTAEEVADVGARLALLPPGELPTGAFFKWCTPQLYSKL

SEQ ID NO: 31585 - DNA, 1612 bp, Panicum virgatum
  misc_feature: Ceres CLONE 1906278
  misc_feature: Encodes the peptide sequence at SEQ ID NO. 31586
attactccagatagccacttctgcatctccgccgccacgccatggcgggagaaggatctcctccgaccaatccgccgccggcgaaacgccaaaagaaatcgagcgcgaccaccgccgcctccctcggcttcgacgtcctgctcgacatcttcatgcgcctcccctcccacgccacgctcgtccgggccgcccacacctgccgcgcgtggcgccgcgcggtggcctcctcccgggacttccgccgccgcttccgggagacgcacccggcgcccctgctcggcctcttcttcgaccctcccggcgccgcccaggtccctgctctccccgtcttcccctccttcgccccctcccgcggcgccgacagggaccaggccgccgccgtccgtggcggcgacttcttccttacctccctccaggagcgcccgggcggcctccacggctggcacatccacgactgccgtggcgggtacatcctcgtcggtaacagtgagaagaaaacaatggcagtactgaaccccatggcgcgacgaagcgaaaggttccttgatcttggccatgaccatcatgtggacacccttcatggtacgcgcggcttcccccttgtgtcccacgacacttgccacctctgctgctccaactccgaggtgtccctcgacggacgcttgctctgctccgaggaagaccccatgtcgttccgcgtggtcactgttgcccacgacaagccgtccagcagggtacaagcgacggtcttctcctctcggacaccggcgagtgatccgttcatccctgggtggatgtcccgctgacaccactgccagagggcttcaagctgtggcctctcaacagcaacattcaggcgaacgggatgctgtgttgggcttacaacgatctgacacagatgctcacacttgacacggcgacaatggagttctcggtggccgagctccctcgatgcgtgaaggcactggactgcagcttcgttgttggcgagacgatcaacggcacgccctgtgttgtctatactatgaagttcagagtctgcctgttcttgcagacattggacggtgatggtgtcaagaggtgggcaagggacaaggccacctccttagacccacaacttgatggggtcctgggaaaactgaagggcaggtacagcgagctcaaggttgtggcagtcagggatgggtttgcatacttggcaacatcaatgaagtaccgttccgacatgatcccgagctgggtgttgtccctctgcttggaaacgatgcagttggagaagatgtttcagaggccttatgagtgttgtgtgcacccctatattatgtcatggcctctttcattagttggtaactacggttgtttcgccctcagagatggcccatgaactatccctccatagaagccactgtaaagcttgctagttcagtttacacgcagtgcatgtggcgaaagcatcaattgtttggtaaacagagaagcctatgaaagaggaataattattcttcagataaactcattctgtgtttttatttatgtgcaactttcaaccagcagagtagccgttttcaaatttgttaatgggaattcagttgaaatctatgtatccaagttt

SEQ ID NO: 31586 - protein, 254 aa, Panicum virgatum
  misc_feature: Ceres CLONE 1906278
  misc_feature (23)..(71): Pfam Name: F-box Pfam Description: F-box domain
MAGEGSPPTNPPPAKRQKKSSATTAASLGFDVLLDIFMRLPSHATLVRAAHTCRAWRRAVASSRDFRRRFRETHPAPLLGLFFDPPGAAQVPALPVFPSFAPSRGADRDQAAAVRGGDFFLTSLQERPGGLHGWHIHDCRGGYILVGNSEKKTMAVLNPMARRSERFLDLGHDHHVDTLHGTRGFPLVSHDTCHLCCSNSEVSLDGRLLCSEEDPMSFRVVTVAHDKPSSRVQATVFSSRTPASDPFIPGWMSR

SEQ ID NO: 31587 - DNA, 1714 bp, Panicum virgatum
  misc_feature: Ceres CLONE 1906288
  misc_feature: Encodes the peptide sequence at SEQ ID NO. 31588
cttcgattccctcgcggaggtacactacgcaccccaccccacccaacccctgctccgaatccgcctctcccctgctcccgcggaaattccgcgtccaagtactcggatcttctcctgccgcttcccccgattttcctcacaacccgtttcgtctcctctcgcgtccgccgccgccgcgctgtctcctctcgcgtccgccgccgccgcgctgtctcctctcgcgtccgccgccgccgcgctccaggaccggagtcttctctcctcggggatcgtcggcgccctcttatccgccgctctctaccggtgctggactgccgtggggtggagatcggcttgaatcaactcttcgtttagtttgttggtggtgcgaaaatgagtgacaacctgatggacaaggttagcgcctttggcgagcgcctcaagatcaccgggacggaggtcagcaagaagatgacggccggcatgagctccatgagcttcaagatgaaggaattgttccaggggcagactccggccgacaagatcgtcgaggacgccacttctgagaaccttgatgggcctgactggaacttgaacttggagatatgtgacatgattaacaccgagaaggttaacaatgtggagctcatccgtggcatcaagaagcggatcatgctgaaggatgcaaggatccagtacctctccttgatcctgctcgagactattgtgaagaactgcgagaaggccttctcagaggttgcggctgaacgggttcttgatgagatggttaggctgattgatgaccctcagacagttgtcaataacaggaacaaggcccttatgctgattgaagcatggggggagtctggtgatgaactacgctacctgccagtctatgaggaaacctacaagagcttgaaatcaagaggagtgcggtttcctggacgtgacaatgagagcttggctcccatatttactcccccacgatcagttgctgaagctgacattcatgcaaacttgccccagcaggcttttgaagacgtgcatgttcatacatatactgccgaagaaacaaaagaagcatttgatgttgctcgtaacagcatagaacttctttcaactgttctttcctcttcccctgagcaggatgctttgcaggatgacttaacagccactcttgtgcaacaatgctaccaatctcagcacactatccagagaatcattgagacagttggtgacaatgaagctgtgctctttgaggccttgagtgtgaatgatgagatccagaaagtgctatccaaatatgaagagatgaagcaacccatggcctcggagcaagcagaacagcgtccagtggtcataccgattgccacagaacacgaggattccactgctgctggcactgaagatgccctggtcagaaaaccagctgctgctagggcaaggtcaggtggagatgacgatatccttgatgatctcgacgagatgatatttggcaagaaggggggtagcagttcgcatgaagcgcccaaaaagccggatccgaagaaagatgacctgatcagcttttaaggaccttcccgtaatcgcacctcgaacttgctattttatggtgctgtactcagttggtagaagattgcagattctgtaggatttggatcgcttgtttattctgatacgatcatacctgccccttttctcagtttgtccagttgttaagttgctgcactctctc

SEQ ID NO: 31588 - protein, 392 aa, Panicum virgatum
  misc_feature: Ceres CLONE 1906288
  misc_feature (42)..(179): Pfam Name: VHS Pfam Description: VHS domain
  misc_feature (222)..(316): Pfam Name: GAT Pfam Description: GAT domain
MSDNLMDKVSAFGERLKITGTEVSKKMTAGMSSMSFKMKELFQGQTPADKIVEDATSENLDGPDWNLNLEICDMINTEKVNNVELIRGIKKRIMLKDARIQYLSLILLETIVKNCEKAFSEVAAERVLDEMVRLIDDPQTVVNNRNKALMLIEAWGESGDELRYLPVYEETYKSLKSRGVRFPGRDNESLAPIFTPPRSVAEADIHANLPQQAFEDVHVHTYTAEETKEAFDVARNSIELLSTVLSSSPEQDALQDDLTATLVQQCYQSQHTIQRIIETVGDNEAVLFEALSVNDEIQKVLSKYEEMKQPMASEQAEQRPVVIPIATEHEDSTAAGTEDALVRKPAAARARSGGDDDILDDLDEMIFGKKGGSSSHEAPKKPDPKKDDLISF

SEQ ID NO: 31589 - DNA, 1043 bp, Panicum virgatum
  misc_feature: Ceres CLONE 1906315
  misc_feature: Encodes the peptide sequence at SEQ ID NO. 31590
gttttgagtcgagctcctcccctctgctctcctctcctctccgatctccgctcgcgcacggggtgccctcaccatcgcgcctcgttcccctcctacgcgggagcgcctgctcctctctccccaccaccggcgccgcaccccctcctcatactccccctcccaagaaaccggctgaagcgagtgaaagcggacaagatgatcggcgtcgggaaggcgaagcagtacgccaacgtcctcgacaagcccctcagccgcggcaggcaggaggtcagtttgagtgcatttgcgttcttgttctcagagttggttcagtacaaccaaacacaagttgacaacattgcggagctggagcggagactggaggatgctggttatgctgttggtgcaagggtgcttgaacttctctgtcacagagagaaggggaataggcgagaaacacgacttctggggattttatcattcattcacagcactgtatggaaggtcctatttggaaaggtggctgactcacttgagaagggaacagagcatgaagatgaatacatgattagtgaaaaggagcttcttgttaaccggttcatttcggttccaaaagatatgggagcattcaactgcggagcctttgttgcaggaattgtaaagggtgtattagataatgctggctttcctgcagtagttactgcacactttgtgccgattgaaggccagcaaaggccaaggacaacaatcttgattaagtttgctgaggaggttttacaccgagaagcaagacttggctgagctttaagctatggttatgtacaccaaagctctttttatggtctatttatgaggtgaattgttacagggtagtttggtggtttcttgtacttgatttatgtaatagtagttggagaatgcaagtgatgatggtgggattgcaggggcttcatcattcttgttgaaattctaaatgtaaggcattgctttgtctaccaaatctgctcctgtattagatacctttcctggactttcaaaattatacaaaaggaatctttcatctt

SEQ ID NO: 31590 - protein, 194 aa, Panicum virgatum
  misc_feature: Ceres CLONE 1906315
  misc_feature (29)..(185): Pfam Name: TRAPP_Bet3 Pfam Description: Transport protein particle (TRAPP) component, Bet3
MIGVGKAKQYANVLDKPLSRGRQEVSLSAFAFLFSELVQYNQTQVDNIAELERRLEDAGYAVGARVLELLCHREKGNRRETRLLGILSFIHSTVWKVLFGKVADSLEKGTEHEDEYMISEKELLVNRFISVPKDMGAFNCGAFVAGIVKGVLDNAGFPAVVTAHFVPIEGQQRPRTTILIKFAEEVLHREARLG

SEQ ID NO: 31591 - DNA, 1249 bp, Panicum virgatum
  misc_feature: Ceres CLONE 1906320
  misc_feature: Encodes the peptide sequence at SEQ ID NO. 31592
aacaaccactgcaactttgagctgcaccaggcccacaggaacgcccccgagccgcgcagctcgaaccgtctcgactggacccgacgacgacccgatccgaccggctcgcggcgtcctcctcgcggccgaaccctagccccatcctcaccgccggccggctctcctcccgcccacgccggggccgtctcttcatcgccgccgcacgagtccttgcccagcgccaccgcccgtaccaccctccccgccgcccgcctcagcctgcgtggtcaccggcggcgccatggatgcttccaagaataaaaagctcaaggatgtggagatcagtttcccgattgtctatggaaccatttctttctggcttggtaaaaaggcaagcgagtacaactctcacaagtggactgtttatgtccgttcggcaaacaacgaggacctgagtgtcatagttaagcgcgtggtgtttcaacttcacccaagttttcaaaacccaacaagagtggtagagcagccacctttcgagttgtctgaatctggatggggagagtttgaaatagccataaccctttatttccacagcgatgtctgtgagaagcgcttggatctgtttcatcagcttaagctgtatccagaagaagaagctgggcctcaatcaaccaaaaagccagttgttgtggaaacatatgatgaaattgtcttccctgagcctacagaggccttttttcagcgtgtgcaaaatcatccagcagctaacgtgcccaagctccctcctggcataaccttgcctccaccaggctctatggaaattgttccatatgaaaagaagcgtggtgacactaaggatcatcctttgagccagtggttctcgaatttctctgaggcagatgagcttttaaaactaactgcggctcggcaacaggtgcaggctcacattgccaaactgagaaggcagttaaccatgatagagggaatgccccagcaatcaaaagttttttctggtcctggacaacagttcgggcacatataatgtagcatatgctacaaagtgtacgtacctggttgcaaggaagatcttggaacatggaacctctcaacaactgcttaacatatagggggtgtgcgtatctctgtatctcattgacgtgtctgccttaggctttgcaagttgcaactgatggactactaatcagcagtttggtgtgtatattctagaattctggtgacttatgcttcctaagagaacattgttcgtgtc

SEQ ID NO: 31592 - protein, 246 aa, Panicum virgatum
  misc_feature: Ceres CLONE 1906320
  misc_feature (36)..(119): Pfam Name: YEATS Pfam Description: YEATS family
MDASKNKKLKDVEISFPIVYGTISFWLGKKASEYNSHKWTVYVRSANNEDLSVIVKRVVFQLHPSFQNPTRVVEQPPFELSESGWGEFEIAITLYFHSDVCEKRLDLFHQLKLYPEEEAGPQSTKKPVVVETYDEIVFPEPTEAFFQRVQNHPAANVPKLPPGITLPPPGSMEIVPYEKKRGDTKDHPLSQWFSNFSEADELLKLTAARQQVQAHIAKLRRQLTMIEGMPQQSKVFSGPGQQFGHI

SEQ ID NO: 31593 - DNA, 536 bp, Panicum virgatum
  misc_feature: Ceres CLONE 1906358
  misc_feature: Encodes the peptide sequence at SEQ ID NO. 31594
gcgaaggccctggccgcgcgggcggggtcctccctcctcggccgactcctcgcgtccccgtccatgcccctcctccgcgcggggctgccgcagctcgccaggctgcaggcgaacgccccgccgccggcgccgtctgtggatgcctacgaggcggaggcggtcgcgaggctgacgtcggtccccggcgagatctcgttcccctgcggcctcccctcgctccgcttcttcatcgacgacgttgagaatcctgttgttaatgaaccccttctgctaataaagagaacttaccagcccagtaccatcaagcggaagagaacccatggatttcttacacgtaagtcgaccaagggtgggcgcaaggtgatcgcacggaggatcgccaaaggcaggcacaggctttccgtgtagtgagatcccgtagcagctctggacgttgttttcttcacagcagatttgtactattccttgtatgaaaccttagagtttcagtctatgtatgcttaacgagtaccaaccctctgctaaaggcgagcccc

SEQ ID NO: 31594 - protein, 135 aa, Panicum virgatum
  misc_feature: Ceres CLONE 1906358
  misc_feature (92)..(135): Pfam Name: Ribosomal_L34 Pfam Description: Ribosomal protein L34
AKALAARAGSSLLGRLLASPSMPLLRAGLPQLARLQANAPPPAPSVDAYEAEAVARLTSVPGEISFPCGLPSLRFFIDDVENPVVNEPLLLIKRTYQPSTIKRKRTHGFLTRKSTKGGRKVIARRIAKGRHRLSV

SEQ ID NO: 31595 - DNA, 465 bp, Panicum virgatum
  misc_feature: Ceres CLONE 1906384
  misc_feature: Encodes the peptide sequence at SEQ ID NO. 31596
tgctctctccgaggtgggttggcttctccccctcctacccagtcctccgttctagggttttagttggaaggggagatggcggcggcggatgtggagtaccgctgcttcctccgcggcctcccctgggccaccgaccacccgtccctcccgcaggccttcgcctcctacggcgacgtcctccactccaaggtcatcaccgaccgtgagacggggaggtcccgcgggttcggcttcgtcaccttctcaaccgagcagtcgatgctcgacgccatcgaagccatgaacggcaaggagctcgacggccgcaacatcaccgtcaaccaggcccaatcccgcggcggtggcggcggcggcggcggcggcggttaccgcggcggtcgccagggaggctacggcggcggcggcggcggctacggccgccgtcgccccgagggccgctaccgcgccggtcgccaccacagcggc

SEQ ID NO: 31596 - protein, 129 aa, Panicum virgatum
  misc_feature: Ceres CLONE 1906384
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with altered lignin content
  misc_feature: Useful for making plants with modulated nitrogen use efficiency
  misc_feature: Useful for making plants with altered alkaloid content
  misc_feature: Useful for making plants with modulated flowering time
  misc_feature: Useful for making plants with modulated biomass
  misc_feature: The sequence is a functional homolog of SEQ ID NO 1042 in the 10/374,780 US patent application
  misc_feature: The sequence is a functional homolog of SEQ ID NO 852 in the 10/666,642 US patent application
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
MAAADVEYRCFLRGLPWATDHPSLPQAFASYGDVLHSKVITDRETGRSRGFGFVTFSTEQSMLDAIEAMNGKELDGRNITVNQAQSRGGGGGGGGGGYRGGRQGGYGGGGGGYGRRRPEGRYRAGRHHS

SEQ ID NO: 31597 - DNA, 736 bp, Panicum virgatum
  misc_feature: Ceres CLONE 1906413
  misc_feature: Encodes the peptide sequence at SEQ ID NO. 31598
aggtgtgtgccatgcacctgctgtagctagtccactatagggctgcaagcaaggcgcactgcctaccctttgcatctcttcacacacccacccaccgagactacgcatacatatctgcccaatcaacccattagcggtcgtctccgctcctacttgcagaactgaaacgcagtagctcatagcagagcagctagtgcaatggatcttcaatctgcgagcatgttgcagagcatccatggccgtatcagcaacatggggccgctggctccgcctcttgttgtcgtgggtgcgaccctgatgtgcatttggttagcccactaccttctcaaaaagataaaccacagacgacgcctgcaggcggtgctgccgcctggttctatgggactgccactcctcggagaaacgctcgagttcttcgctcggagtccttcaatggacctgctgcctttcttcaagcgacgaatggagaggttcggtcctattttcaagacaaacttggtcggtaaggacctgattgtctctcttgacccggacatcaaccactacgtgctccagcaagaggagaaggcgttccacatatggtttccggaatcgttcatgagactcctgggcgaggagaacatcgccaaagtttacgggtccctgcacaagaacactaggaacatgatccgccgagtctttggcccagagaacctcaggctggtgctgctccatgatatgcaaaggtgccgtggag

SEQ ID NO: 31598 - protein, 179 aa, Panicum virgatum
  misc_feature: Ceres CLONE 1906413
  misc_feature: SWISSPROT Homolog: EC 1.14.13.77 Taxane 13-alpha-hydroxylase
MDLQSASMLQSIHGRISNMGPLAPPLVVVGATLMCIWLAHYLLKKINHRRRLQAVLPPGSMGLPLLGETLEFFARSPSMDLLPFFKRRMERFGPIFKTNLVGKDLIVSLDPDINHYVLQQEEKAFHIWFPESFMRLLGEENIAKVYGSLHKNTRNMIRRVFGPENLRLVLLHDMQRCRG

SEQ ID NO: 31599 - DNA, 360 bp, Panicum virgatum
  misc_feature: Ceres CLONE 1906417
  misc_feature: Encodes the peptide sequence at SEQ ID NO. 31600
ctccgtcccgtggtcctcctccccctccccttccccctcgagctcgcgtcgcctcgaccagcctccgcagccctcgccggcagctggctggctctctcgcggctagccgggagccgggctctgggggatggccttccactacccggaccacgcgctggcgatggaccccgcggccgcggccggggtcggggtcggggcggcggtcaaccctagcttcctgtcccccggcggcggcggcggcgggggtgggtgggagcgggagaaggcggccatcgcggcgcccccgctgtaccagcgcctgctcgaggcccacgtcgcctgcctccgcgtctccacccccgtcgaccagcccccgcgcct

SEQ ID NO: 31600 - protein, 77 aa, Panicum virgatum
  misc_feature: Ceres CLONE 1906417
  misc_feature (43)..(77): Pfam Name: KNOX1 Pfam Description: KNOX1 domain
  misc_feature: The sequence is a functional homolog of SEQ ID NO 710 in the 10/374,780 US patent application
  misc_feature: The sequence is a functional homolog of SEQ ID NO 711 in the 10/374,780 US patent application
MAFHYPDHALAMDPAAAAGVGVGAAVNPSFLSPGGGGGGGGWEREKAAIAAPPLYQRLLEAHVACLRVSTPVDQPPR

SEQ ID NO: 31601 - DNA, 746 bp, Panicum virgatum
  misc_feature: Ceres CLONE 1906436
  misc_feature: Encodes the peptide sequence at SEQ ID NO. 31602
atgtctccacagcccgacctgagcgcgtcgcctcccctgtcgctgtcagcctgtcccctcccctcccctttcccctctggttccggcggccatggcggtggcggctcccggccagctcaacctcgacgaagccccgtcatggggttcccgcagcgtcgactgctttgagaagctcgagcagatcggcgagggcacctatgggcaagtgtacatggccaaggagacgggcaccaacgagatcgtggcgcttaagaagatccgaatggacaacgagcgggaaggcttcccaattactgctatacgcgagatcaagatcctgaagaagcttcaccaccaaaacgtcatcaagctcaaggagattgtcacctccccaggcccagagcgagatgagcaagggaagcagatcgatggtaacaagtacaaggggagcatttacatggtcttcgagtatatggatcatgacctcactggtcttgctgataggccaggaatgcggtttactgtgccacagattaagtgttacatgaggcagctgcttacgggcctgcactattgccatgtcaatcaagtgctgcatcgagatattaaaggatctaaccttttgattgacaatgagggcaacttgaagctggctgattttggccttgcaagatcattctcgagtgatcataatggacaccttactaaccgtgtgatcactttgtggtatagacctcccagaatgctgcttggaagcacgaagtacg

SEQ ID NO: 31602 - protein, 218 aa, Panicum virgatum
  misc_feature: Ceres CLONE 1906436
  misc_feature (25)..(218): Pfam Name: Pkinase Pfam Description: Protein kinase domain
  misc_feature: SWISSPROT Homolog: EC 2.7.11.22 Cyclin-dependent kinase
MAVAAPGQLNLDEAPSWGSRSVDCFEKLEQIGEGTYGQVYMAKETGTNEIVALKKIRMDNEREGFPITAIREIKILKKLHHQNVIKLKEIVTSPGPERDEQGKQIDGNKYKGSIYMVFEYMDHDLTGLADRPGMRFTVPQIKCYMRQLLTGLHYCHVNQVLHRDIKGSNLLIDNEGNLKLADFGLARSFSSDHNGHLTNRVITLWYRPPRMLLGSTKY

SEQ ID NO: 31603 - DNA, 674 bp, Panicum virgatum
  misc_feature: Ceres CLONE 1906449
  misc_feature: Encodes the peptide sequence at SEQ ID NO. 31604
acggacggggatacctcggcggcttaccgctccccaccaccaccgcaaaggcacccagcagaggggactcctctgcccccgcctgcgcgctctgcgccccggccggctgtcgctgctcggccccgcgcgtgcctcagtttccatcctacggcggctgcttcgatgtacctcacacccgcagccgccttttcgtcctcatccctgcagctgctgcccaggccggccagggtcgtcccccgccgccgcctggtggtgcgggcagacgtcaaggttatatctaccggcgaggcctgccgccgcgggctcgccgccggcatcgacaagctcgccgacgccgttgcggtcaccctcggcccgaaagggaggaatgttgttattgaccaggatgatatccctaaagtaattaatgatggcgtcacaattgccaaggcaatagagctcccaaatgctcttgagcatgcgggtgcctcactacttcaagagatagcatccaagacaaatagtgctgttggtgatggaactacaacagctattgttttggctcgggaaatcatcaatcttgggttgttggcagttgctactggtgctaatccagttgccttgagaaggggtattgacaaagctgttcatgatctaatcaagatcttgaagagtaaatgtattcctgtgagtac

SEQ ID NO: 31604 - protein, 170 aa, Panicum virgatum
  misc_feature: Ceres CLONE 1906449
  misc_feature: Useful for making plants with modulated nitrogen use efficiency
MYLTPAAAFSSSSLQLLPRPARVVPRRRLVVRADVKVISTGEACRRGLAAGIDKLADAVAVTLGPKGRNVVIDQDDIPKVINDGVTIAKAIELPNALEHAGASLLQEIASKTNSAVGDGTTTAIVLAREIINLGLLAVATGANPVALRRGIDKAVHDLIKILKSKCIPVS

SEQ ID NO: 31605 - DNA, 357 bp, Panicum virgatum
  misc_feature: Ceres CLONE 1906449-R
gatgtagaggagacaacaagttcctatctaaaagaaaggttttctgcaagaattgctaaactctcacgtggtgttggagttattaaggttggggcagccactgaagctgaactcgaggataggaagctgagagtggaggatgcaaagaatgcaacttttgctgccattagtgaaggcattactcctggtggtggtgtgacatatgttcatttatcaaagcatattcccagcatcatggatcttgtggatgacccggaggagaagatgggtgtaaatatagttgggaaggttagtttggctgtccactgacatttgctgcttgtttaacacactttgaaaataacgaatcctatctcc

SEQ ID NO: 31606 - DNA, 1196 bp, Panicum virgatum
  misc_feature: Ceres CLONE 1906475
  misc_feature: Encodes the peptide sequence at SEQ ID NO. 31607
aaccctagcgtccgccgccctcaagtccggccgagcccgtcctaaaaccctcggacccacgagccaatcatgtcgctctccacgctcaactacccggccgccgccgccgccgccggcgggagcgggaagcccctgtccccggctgcttgcccggcggcgccgcgctcggtgcgcctgccgcctaagccgcgcctcccggcccctgtctctgccgcggccgcggccgccgcgaccgcgtccgcccgcgcgggccccgcggaggatagggtttccgcgctgagccaggtccccggcgtgctggggtcgcagtggggggacgaggggaagggaaagctcgtcgacgtgctcgccccgcgcttccacatcgacccgcgctgccagggcggagcacatgctggacacaccatcgataactctgaaggcaagaaatttgcccttcatcttgttccatctggtatcctccatgaagggacactttgtgttgttggcaacggagcggtgatccatgttccagggttctttgaagaaattgatggtcttgagtccaatggagtctcctgtgatggaagaattctggtctctgatcgggcacatctgctgtttgatctgcaccaggttgtagatggacttagggaagctgagctggaaaattcctttatagggacaactaagagaggcattggaccttgttactcaagcaaggtaactcgaaatggactgcgagtttgtgatctaaggaacatggacacttttggggataagcttgatgtcttatttaaagatgccgcttcgagatttcaaggctttgagtacagaaaaaacatgctcaagcaagaggttgagaggtacaagaggtttgcagagcgcttggagcccttcattgctgatactgtccatgtattaaatgaatctatccagcagaagaagaaaattctagttgaaggtggccaagcaacaatgctggatattgattttggtacctatccatttgtgacttcttctagcccttcagctggtgggatatgcactggccttgggattgccccaagggtaatcggtgacctgattggagtggtcaaagcttacacatcaagagttggctctggtcctttcccaccgaactatttggagaggaaggtgatcgccttaggaaagctgggaatggaatttggcacgacaacggggcgtccaaggcg

SEQ ID NO: 31607 - protein, 375 aa, Panicum virgatum
  misc_feature: Ceres CLONE 1906475
  misc_feature (73)..(375): Pfam Name: Adenylsucc_synt Pfam Description: Adenylosuccinate synthetase
  misc_feature: SWISSPROT Homolog: EC 6.3.4.4 Adenylosuccinate synthase
MSLSTLNYPAAAAAAGGSGKPLSPAACPAAPRSVRLPPKPRLPAPVSAAAAAAATASARAGPAEDRVSALSQVPGVLGSQWGDEGKGKLVDVLAPRFHIDPRCQGGAHAGHTIDNSEGKKFALHLVPSGILHEGTLCVVGNGAVIHVPGFFEEIDGLESNGVSCDGRILVSDRAHLLFDLHQVVDGLREAELENSFIGTTKRGIGPCYSSKVTRNGLRVCDLRNMDTFGDKLDVLFKDAASRFQGFEYRKNMLKQEVERYKRFAERLEPFIADTVHVLNESIQQKKKILVEGGQATMLDIDFGTYPFVTSSSPSAGGICTGLGIAPRVIGDLIGVVKAYTSRVGSGPFPPNYLERKVIALGKLGMEFGTTTGRPR

SEQ ID NO: 31608 - DNA, 739 bp, Panicum virgatum
  misc_feature: Ceres CLONE 1906489
  misc_feature: Encodes the peptide sequence at SEQ ID NO. 31609
aaaaatcattccccactcgcatctcgcctgatctggaccatggaggaggagaaggaggagggatctaagaaggacaactctctggtgtcggaagcagaggcggaggcggaggcggcggcggcggcggcggccagcctcctcacggacgacctcatcatggagatcctgtcacggctccccgtcaggtcagtccaccgcttcaagtgcgtctgcaagcgctggcgcgacctcatcgcctgcccggcccaccgcgaaaagctgccccaaacccttgccggcttcctctacaccacctaccccggcggctaccgccaccacctggccgccgtctcggcagccacggtcatcgattccgtcgacgcttccctcgctttcctgcggcctatgaattacaccaagatccgcctggtagacacctgcaacggcctcctcctctgctcctgctacaacaacaacaacgaggaacgtctggtcgtctgcaatcccgccacccagaggtggaccgagctgcccccacctccgcagccgcagccaaccacagattactgtgcccaacacctggctttcgatccggcagttagcccatcccatttctgcgtcctcgatttcgaagccactgtcaaggaatggcatctcacaggagtgagcatctactcatccagaaccagagcctggactcatagggatattggcttggttgacaaaattgtgctggtctccggaagtgtcttttgtggcg

SEQ ID NO: 31609 - protein, 233 aa, Panicum virgatum
  misc_feature: Ceres CLONE 1906489
  misc_feature (29)..(76): Pfam Name: F-box Pfam Description: F-box domain
MEEEKEEGSKKDNSLVSEAEAEAEAAAAAAASLLTDDLIMEILSRLPVRSVHRFKCVCKRWRDLIACPAHREKLPQTLAGFLYTTYPGGYRHHLAAVSAATVIDSVDASLAFLRPMNYTKIRLVDTCNGLLLCSCYNNNNEERLVVCNPATQRWTELPPPPQPQPTTDYCAQHLAFDPAVSPSHFCVLDFEATVKEWHLTGVSIYSSRTRAWTHRDIGLVDKIVLVSGSVFCG

SEQ ID NO: 31610 - DNA, 1636 bp, Panicum virgatum
  misc_feature: Ceres CLONE 1906492
  misc_feature: Encodes the peptide sequence at SEQ ID NO. 31611
agggcgagatccagatccggggccccagatccaccgccggcggccgccatgaacccgacgcggcccgcgcaggcgtcgttccgcgaccgcaccaacgagttccgcgccgccgtcgagagcgcgcgccgccacgccgtcccttcctcctccgcggcgagcagcagcgggagcggcggcgccgggcccctcgacgggtcgatcgcggccacgtcggcgcgctcggagttcaacaaccgcgcgtccaagatcgggctcgggatccaccagacctcccaaaagctagcccgcctcgccaaattggcaaagaggacatcagtttttgatgaccctaccgtggagattcaagagctgactgcagttatcaagaaggatatcactgctttgaatactgctgttgtagacctacaagctctctgcaattcacaaaatgagagtgggaatctatccaaggacacaacgaatcattccactacagtcgtggacaacctgaaaaaccgtttgatgagtgcaacaaaagaatttaaagaagttctcaccatgcgaacagagaatttgaaggttcatgaaaatagaaggcagatgttctcctcgtcagctggaaaggatgcgtcaaatccattcattcgtcaacgtccccttgttactagggacccatctgagccctctgtgcccccagcaccatgggccagcgactctgcatctaccccattgttccagaggaagaagactaatggagaccatggagcatcatcatcatcatcccagcctttcatgcagcagcaacaactagcagtacagcaggacagttacatgcagagcagagctgaagctctacagaatgtggaatcaaccatccatgagctgagcaatatatttacacagttggcaaccatggtttctcaacagggagagctagcaatcagaattgatgagaacatggatgacacgttggctaacgttgagggagcacagggccagctcctgaagtacctcaacagcatctcatcgaacaggtggctgatgatgaagatattctttgtactgatggtgtttctcatgatcttcatattcttcgtcgcttgattccttgtgtagcatctctcagctcatgctatgcgtagacagctgcaatgcgaagtattctttaatttttgctcatactactataccatgtacacaattttcaccccggatgataagcaaccgttcacccttctgtggtcatgtaaattgggacagctcccgcactgatctgttgctcttgagtgtcgatgtttcctcaatatgtttgatgtattatctcgggaccaaaccaaacagtaataggtgataacaatgtttcagaatcgctgctcatcattgttggatcgccactacgtgtttgtgtcatgtacgccttcagggctgaggcatgttcacctggaatatgtcttcacgataaacatggatgaatcctggcatcttgaattagggcatgtctgaatggactaaagttactttagcactcatatttttgctaaagtttttgagtcttgactaaacagtagcccattctattagcactcttgtttggatttggatgaactaatgctaaagtttagcattttcacctattagtgcttgattatttggatcc

SEQ ID NO: 31611 - protein, 344 aa, Panicum virgatum
  misc_feature: Ceres CLONE 1906492
  misc_feature (56)..(162): Pfam Name: Syntaxin Pfam Description: Syntaxin
  misc_feature (257)..(319): Pfam Name: SNARE Pfam Description: SNARE domain
MNPTRPAQASFRDRTNEFRAAVESARRHAVPSSSAASSSGSGGAGPLDGSIAATSARSEFNNRASKIGLGIHQTSQKLARLAKLAKRTSVFDDPTVEIQELTAVIKKDITALNTAVVDLQALCNSQNESGNLSKDTTNHSTTVVDNLKNRLMSATKEFKEVLTMRTENLKVHENRRQMFSSSAGKDASNPFIRQRPLVTRDPSEPSVPPAPWASDSASTPLFQRKKTNGDHGASSSSSQPFMQQQQLAVQQDSYMQSRAEALQNVESTIHELSNIFTQLATMVSQQGELAIRIDENMDDTLANVEGAQGQLLKYLNSISSNRWLMMKIFFVLMVFLMIFIFFVA

SEQ ID NO: 31612 - DNA, 1772 bp, Panicum virgatum
  misc_feature: Ceres CLONE 1906502
  misc_feature: Encodes the peptide sequence at SEQ ID NO. 31613
cttcgcctcctcttcctcctcccgtcgtctcctcttcctccccctttcctcccccccgcgttcccctccgtccctccggatccgcatggcgcctccacaatccgtgccgcgcggtctcccatagccgcggctccgccccggcccagctcccgccgcgccgctcgctcccgtcccaggctcatcatttgcattgtgcgtgatgttagggatggttttgggagcttgtctcgaagagggttcgaggtgaagcttctgggccaccgcagagggaaatctcatggtgctgtccacgagttgcatgatccagccccggtgatccagagcagttgctgggctaatttgccccctgaattgcttcgagatgtgatcgagaggttggaaaccagtgaagcaacatggcctaataggaagaatgtggtttcttgcgcggctgtttgtcgaacctggagagagatgtgcaaagagattgttaagaatccagaattttctggaaaaatcactttccctgtgtccctgaagcagcctgggcctcgagatgcaactatccagtgcttcatcaaaagggataaatctacccaaacatactacctgtatctgtgtcttagcacagctgtgcttgttgaaagtggcaagttcctcctatgcgcaaaacgaacctcccgtccaacctgtacagaatatacaatatttatgaattctgaaaatatatctaggtcaagcaaaatgtacattggaaaactgaggtcaaatctcctcggcacaaagtttgcaatatatgatatccagcctccatgcaatgtagcacagacagggaaaacaagccgtaggttctactccaggaaggtatcaccaaaagtctcttgcagcacctacaacatagcacaggtttcatatgagctgaatgtcttgggaactcggggtcctaggcggatgaactgtgttatgcactccattcccgcctcatcccttgaggctggaggcactgttccatgccagccagacagtatcctcacccgctcccttgacgagtcatttggtagcatttccttctcgaagtcatctgttgtggatcattccatgcgtttcgggagcacaagattctctgaagtctcgatgagcagccaaaggattggagacatggcattgggtgacaatgatgaatgcaaggagaggccattggttctccgtaacaaggccccaagatggcacgagcaattgcagtgctggtgcctcaattttaggggcagagtgactgtcgcatccgtcaagaacttccagcttgtagctgcaacacagcctgctgctggagccccaaccccgtcgcaggctgtcccagcaccgccaccagagcatgaaaaggtgatcctgcaattcgggaaggtggccaaggatatgttcacaatggactaccgttatccgctctcagccttccaggccttcgcaatctgcctgagcagtttcgacacgaaactggcctgcgaataaagctatcgtggccgaaggatctgtttcgtgatgacggcggccccgaattttgctgggccaccatattctcttgtatgttgttgatgccttcttaacttccctagaaagctgtgtttagccatttccacctgatctacagctgctgctgtgctatgtcctgattgctttgttccgtggagtagcatcatggcctgcctgcccttaactagttgacatatttaaattgtttttttttcatactatggttgtattaactatgaagggagtatgacattttcgttgtgccc

SEQ ID NO: 31613 - protein, 494 aa, Panicum virgatum
  misc_feature: Ceres CLONE 1906502
  misc_feature (175)..(488): Pfam Name: Tub Pfam Description: Tub family
  misc_feature (109)..(164): Pfam Name: F-box Pfam Description: F-box domain
  misc_feature: The sequence is a functional homolog of SEQ ID NO 130 in the 10/225,068 US patent application
  misc_feature: The sequence is a functional homolog of SEQ ID NO 2896 in the 10/374,780 US patent application
  misc_feature: The sequence is a functional homolog of SEQ ID NO 458 in the 10/666,642 US patent application
LRLLFLLPSSPLPPPFLPPAFPSVPPDPHGASTIRAARSPIAAAPPRPSSRRAARSRPRLIICIVRDVRDGFGSLSRRGFEVKLLGHRRGKSHGAVHELHDPAPVIQSSCWANLPPELLRDVIERLETSEATWPNRKNVVSCAAVCRTWREMCKEIVKNPEFSGKITFPVSLKQPGPRDATIQCFIKRDKSTQTYYLYLCLSTAVLVESGKFLLCAKRTSRPTCTEYTIFMNSENISRSSKMYIGKLRSNLLGTKFAIYDIQPPCNVAQTGKTSRRFYSRKVSPKVSCSTYNIAQVSYELNVLGTRGPRRMNCVMHSIPASSLEAGGTVPCQPDSILTRSLDESFGSISFSKSSVVDHSMRFGSTRFSEVSMSSQRIGDMALGDNDECKERPLVLRNKAPRWHEQLQCWCLNFRGRVTVASVKNFQLVAATQPAAGAPTPSQAVPAPPPEHEKVILQFGKVAKDMFTMDYRYPLSAFQAFAICLSSFDTKLACE

SEQ ID NO: 31614 - DNA, 2041 bp, Panicum virgatum
  misc_feature: Ceres CLONE 1906503
  misc_feature: Encodes the peptide sequence at SEQ ID NO. 31615
agcgttttcctacacccaacccgatctaaccaattcctgaggaagcctgagccacccccaatccgccatcgccgccgccgccgccggaccgcaatgggcttcgacgtgggcttcgtcccctacaatcccgatgggtggggcccgcctgaggccgccgccgcgccgtcctccctgggcggtggctccgcgtccgtccccttcgcccctttctcccgctccgacaagctgggccgcatcgctgactggacccgcaacccgccgggccagggggcgttcgccgccgctcgcgacaccgtcttcgacttcgcggggctcgaggactccgtcgggctcgcgtccgcggacgacgcctccttccgcctcgtcgacggcaagccgccgccgcggcacccgcggttcgggccccgctggcgcttccagcagcgcccccagctcccgcagcgccgcgacgaggaggtcgaggcccggcgccgcgaggccgagaaggagcgcgcccgccgcgaccgccactggcagcagaaccggcgcacgcaccaccagttcaaccgcggcgggccctcctcgtccgccaagccgtccgtcgacatccagcccgagtggtcggtgaaggagcagatccccttctcgtccttctccaagctctccttcgctgtagccgaccagcctgaggatctcctggtctgcggcgccgtcgagttctacgatcgcgcctttgaccgcgtcacccccagggcggagcgccgcttggagcgcttcaagtcgcgcaacttcttcaaggtcaccaccactgacgaccccgtcatccgccgccttgcagagaatgacacggccacggtctttgccactgacaccatcctggcagcgctcatgtgtgcgccccgcagtgtccagtcctgggacattgtcattcagcgcgtgggcaacaaactgttctttgacaagcgtgatggttctcagcttgatctgctcaccgtcaatgaaaccgcccaggagccactccctgaggccaaggaagacatcaactctgcacattcgctcgcagttgaggccacatacatcaaccagaacttctcgcagcaggtgctgctccgcaatggtgagaaggtcactttcgatgagcctaacccgtttgccactgaaggggaggaagctgcttctgttgcttatcgctaccgccgctggaagcttgatgacgagaccagtttggttgctcgctgtgaggttcacgctgtgaatgttgatccacgtggtgagcgccagttccttacactcaatgctttgaatgagtttgatcccaaggttactggtgttgactggagaaagaagcttgagacccagaggggagctgcgcttgctactgagctcaagaacaatgccaacaagcttgcgcgctggactgcccaggcattgcttgccggtgcagatatgatgaagttgggttatgtgtcacgtctgcacccccgcgatcactacaaccattccatactcagtgtaattgggtacaagccaagggattttgctgcacagatcaatctcaacaccgcaaatatgtggggaattgtgaagtcgattgtggatgtctgcatgaagcttggagagggcaagtatgtgcttgttaaggacccagtgaagcctcaggtccggctttatgaagtgccaaatgacgcttttgagaatgactatgtcgaggagccactgcctgaggaggagcaagtgcgtccgttttccgaagatgttgatgctaccgcacaggaaatggatgctgctgcagaggcggaggctactggtacaactgcgggtgcagatggagatgcggagaagagcggtgaagcggctgctgcgtgaaggcagaaaggctacagagcagaggtctctttggaccttgaataaaggtagccttggctatctatttacaatcaagggctgcttgaaagaggtttgaggtttctactatcataggttatgctattgttgttatggtgtaccaaaccagtgaattgtttatctattgtttcttatgtacctgtcctaatttcctttt

SEQ ID NO: 31615 - protein, 583 aa, Panicum virgatum
  misc_feature: Ceres CLONE 1906503
  misc_feature (2)..(539): Pfam Name: eIF-3_zeta Pfam Description: Eukaryotic translation initiation factor 3 subunit 7 (eIF-3)
MGFDVGFVPYNPDGWGPPEAAAAPSSLGGGSASVPFAPFSRSDKLGRIADWTRNPPGQGAFAAARDTVFDFAGLEDSVGLASADDASFRLVDGKPPPRHPRFGPRWRFQQRPQLPQRRDEEVEARRREAEKERARRDRHWQQNRRTHHQFNRGGPSSSAKPSVDIQPEWSVKEQIPFSSFSKLSFAVADQPEDLLVCGAVEFYDRAFDRVTPRAERRLERFKSRNFFKVTTTDDPVIRRLAENDTATVFATDTILAALMCAPRSVQSWDIVIQRVGNKLFFDKRDGSQLDLLTVNETAQEPLPEAKEDINSAHSLAVEATYINQNFSQQVLLRNGEKVTFDEPNPFATEGEEAASVAYRYRRWKLDDETSLVARCEVHAVNVDPRGERQFLTLNALNEFDPKVTGVDWRKKLETQRGAALATELKNNANKLARWTAQALLAGADMMKLGYVSRLHPRDHYNHSILSVIGYKPRDFAAQINLNTANMWGIVKSIVDVCMKLGEGKYVLVKDPVKPQVRLYEVPNDAFENDYVEEPLPEEEQVRPFSEDVDATAQEMDAAAEAEATGTTAGADGDAEKSGEAAAA

SEQ ID NO: 31616 - DNA, 1495 bp, Panicum virgatum
  misc_feature: Ceres CLONE 1906521
  misc_feature: Encodes the peptide sequence at SEQ ID NO. 31617
tctccccgcgctcgcttcccgcgaaatccccatcggcatccatcccccaaaaccatcgatttccctccgtcctctactctcatcttcccaatccccctcgggcggaggaattccttcccgattcgcgccggatctaatccgaccggggaccccgaaacctagcagcacccggtccccgagcgaggggcgggagcaagcaagccgacctcgcgatggcgccgctgtcgtggcggcaccacaccctgctgcaggcgctgctcacccgcggccccctctccgagcgcgacttccacgccgtcttcgccgccgtctccggcaagaaccccgcaactcatcaacaactgttcaatgatacacttctcaagatcaacaaggaactcgcatttctgcagtttgagttgcgagcatgcataaaccagtatgatggaatggtgtactacggagtggctaataaccttgctgacgaagaatcaaagcttgggacaaagtattctgtgccccagattgcattctacaagggactgttagaagcaattgttcaggaagctggaaatgatgggagcataaccagtattgacgctctcaatgtccggctggacaaccaggtcataattgtagacggttcacaggacagccaatctcttcttcctacttccataaagaacttctcacttagccagaaagagaaaaccctggatgagctgatacgggatcgttggttgtcatacacctccacaggcaagattggtctgggcaccagatcatttcttgatctccgaagctggttctgtggtaatgacatcccatcatgtgtggtctgtaacgaagcttgtataaaggcatcaagttgtcccaatgaggaatgcaatgtaagaattcacgagtactgtctgaggaagaaattttcacagcgaaaggcttcaagagcttgtcccggttgcagtactgaatggccccgccaggatggtgaagccaatggcgatgatgatgtgaatgagcctggtgaggatgaagccccttcagctaaccattcatcaaggaagaggtgcaagcaagtcaaagctgagctggtggaagaaaataacaatgcaggcccatcaacagcagtgcctaggagtaggacccttagaagcgctaaagccgaagcggttgaggctgctctagaggcgtcttctgcagcagctttgcaggcaaccaggacttccaaaagaaggaagaagtgatgctgctgtctaatgaatgataggtagtgagattggcaggctctctcttatgtctgtacatatggaagctggtgtgtgatggtagtagatggttattttgaagcggcaatgctgcagcttctattgccggcaggccttaagatgatggtgttagaaactcctagagattatttatctgacagtttatcaatctagctagacgggtacactttactggtttggaagtggagaacctatctgagcactgaagcatgttgaagtcggtttcaagc

SEQ ID NO: 31617 - protein, 336 aa, Panicum virgatum
  misc_feature: Ceres CLONE 1906521
  misc_feature (6)..(188): Pfam Name: SMC_Nse1 Pfam Description: Nse1 non-SMC component of SMC5-6 complex
  misc_feature (200)..(243): Pfam Name: zf-RING-like Pfam Description: RING-like domain
MAPLSWRHHTLLQALLTRGPLSERDFHAVFAAVSGKNPATHQQLFNDTLLKINKELAFLQFELRACINQYDGMVYYGVANNLADEESKLGTKYSVPQIAFYKGLLEAIVQEAGNDGSITSIDALNVRLDNQVIIVDGSQDSQSLLPTSIKNFSLSQKEKTLDELIRDRWLSYTSTGKIGLGTRSFLDLRSWFCGNDIPSCVVCNEACIKASSCPNEECNVRIHEYCLRKKFSQRKASRACPGCSTEWPRQDGEANGDDDVNEPGEDEAPSANHSSRKRCKQVKAELVEENNNAGPSTAVPRSRTLRSAKAEAVEAALEASSAAALQATRTSKRRKK

SEQ ID NO: 31618 - DNA, 557 bp, Panicum virgatum
  misc_feature: Ceres CLONE 1906525
  misc_feature: Encodes the peptide sequence at SEQ ID NO. 31619
aatcttggggcctgtctcttcctccctggtagctagctagagcgccaccatgcagctcgtggagctctgcaccgaccccgtcgtgctctcctgcaccttcctctgcctcctcctccacctcgcgctccgctcctcctccggccgaggtggcggcccgcccctccctccggggcctcctgttctcttgatttgcgcctgatgttagggagggttttgggagcttgtctcgaagacggttcgaggtgaacgcttctgggccaccgcacagggaaatctcatggtgctgtccacgagttgcatgatccagccccggtgatccatagcagttgctgggctaatttgccccctgaattgcttccagatgtgatccagaggttgcaaaccagagaaccaacatggcctaataagaagaatgtggtttcttgcgcggctgtttgtcgaacctggagagagatgtgcaaagagattgttaacaatccagaattttctggaaaaatcactttccctgtgtccctgaagcagtctgagcctcgagatgcaactatcctgtgcttcat

SEQ ID NO: 31619 - protein, 34 aa, Panicum virgatum
  misc_feature: Ceres CLONE 1906525
  misc_feature: The sequence is a functional homolog of SEQ ID NO 458 in the 10/666,642 US patent application
  misc_feature: The sequence is a functional homolog of SEQ ID NO 130 in the 10/225,068 US patent application
  misc_feature: The sequence is a functional homolog of SEQ ID NO 2896 in the 10/374,780 US patent application
  misc_feature: The sequence is a functional homolog of SEQ ID NO 460 in the 10/666,642 US patent application
  misc_feature: The sequence is a functional homolog of SEQ ID NO 462 in the 10/666,642 US patent application
MCKEIVNNPEFSGKITFPVSLKQSEPRDATILCF

SEQ ID NO: 31620 - DNA, 1662 bp, Panicum virgatum
  misc_feature: Ceres CLONE 1906548
  misc_feature: Encodes the peptide sequence at SEQ ID NO. 31621
gttggtacacgcgcagcccgcgagtagacgacacataccgcgcgttgcttgccacaccgggggaagcggccgcgagcgcacgcgcggggcgagcgggcgaagctagctagctatctagtgcccgtcggccggccgcgagcccgcccgccatgtcggcgctagtggacgcgctgtgcgcgccgccaggcgacgccgcggcgctcatctacgacaccttcaacgccgccagcttcctcttcgacgggcccgcggcggcggcggcgctatacgacggcgccggcattgtcgagtgcccgccgccgccgcccgcgcagcagcagcaggcggccgaggccgcgggggagacgacgcaggcggcgacgtcgtcggcgccggccagggtcaggaagcggcgccggtgggcgcggagctgcaagtccagggaggagaccgagacccagcggatgatgcacatcgccgtggagcgcaaccgccgccgccagatgaacgagtacctcgccgtgctccgctccctcatgccggagccctacgtccagaggggcgaccaagcttccattgtcggaggggccatcgagttcgtgaaggagctcgagcagcagctgcagtgcctcgagacgcagaagcgaacgctgctggttcatcagcacaaggcggccaagcccgacgcgacgccgatgcatcactccaccaccaccaccagcagcaccaaggccgcagccggcaccacggcctgcgtggagcccgcggcggcggcgacgacgacgagcaactgcagcagcagcgtgaccgaggacgcggccgaccacgcgccgccgcccccgttcgctcagttcttctcgtacccgcagtacgtgtggtgccactcgccgcgcgaccccgcgtcgtcgtcggcggcggaggacggcggcgggcggccgggggtggccgacatcgaggtgaccctggtggagacgcacgccagcctccgcgtgatgacgccgcggcggcccgggcagctgctcggcctcgtcgccgggctgcaggcgctccgcctcggcgtgctccacctaagcgtcaccgcgctcgagtccctggtcctctactccatcagcgtcaaggtggaggaagggtgcggcctggcgacggtggaggacatcgccgccgccgcgcaccacgtgctctgcctcatcgacgccgccgagcccgccgagcagcaggtgctcgccgcctcggacccgcgatagggccgcctccccgcgaggggagccggccgacgacgacgtccccggcgatcgaggagacaggagatcgagagccatttgatgcaggtgccgtggctccggtcacgcacacggccgggtcctttcggccgaggcggccaagcgggcttgtgagcgagcgatgccgagcgcgcctcgtgtgtttgccgtgcgtgcgtgtccccccgtttttgctgtggacggaactcccgttctgcagggttcggtggaacgcctcgaggtaactgtgtagtttgtttttttttgttttctttcttcacttttttttgtttttcaagtagatgtccaagcgtgttgttagtgtcgtcgcattgtttcgcctctcattttttatgtgtaaggttagcttctccagctccgtattgctcacaagaatccacattccacagctcttcgaacagtc

SEQ ID NO: 31621 - protein, 357 aa, Panicum virgatum
  misc_feature: Ceres CLONE 1906548
  misc_feature (97)..(148): Pfam Name: HLH Pfam Description: Helix-loop-helix DNA-binding domain
  misc_feature: The sequence is a functional homolog of SEQ ID NO 1500 in the 10/374,780 US patent application
MSALVDALCAPPGDAAALIYDTFNAASFLFDGPAAAAALYDGAGIVECPPPPPAQQQQAAEAAGETTQAATSSAPARVRKRRRWARSCKSREETETQRMMHIAVERNRRRQMNEYLAVLRSLMPEPYVQRGDQASIVGGAIEFVKELEQQLQCLETQKRTLLVHQHKAAKPDATPMHHSTTTTSSTKAAAGTTACVEPAAAATTTSNCSSSVTEDAADHAPPPPFAQFFSYPQYVWCHSPRDPASSSAAEDGGGRPGVADIEVTLVETHASLRVMTPRRPGQLLGLVAGLQALRLGVLHLSVTALESLVLYSISVKVEEGCGLATVEDIAAAAHHVLCLIDAAEPAEQQVLAASDPR

SEQ ID NO: 31622 - DNA, 535 bp, Panicum virgatum
  misc_feature: Ceres CLONE 1906551
  misc_feature: Encodes the peptide sequence at SEQ ID NO. 31623
ctctgctaatccgttgtgcatttggttcccaaaaaatatcgcctgccaaattcaggcgcgccgggtgccaaatccacaggctcgccggcccggcgctcgacgcagcagcggcggtcggtcgcgttcgcgcagccgcgattcaagcaacggaaccgcggcccgtgcggagccaagccgagccgccctccgcggcggcgcgccgagatgagcctctcccaccgcctcccgccgggggcgccggcggtggacccctactacgtgtacgcgccgcgcccggaccctcaccggcacggcgtcctcacgctcttcgtcgccggcctccccgacgacgtgaagccccgcgagatccacaacctcttctcgcaccgccccggcttcgaccactgcctcctcgagtataccggccgcggcaaccaggcggttgcttttgtgacgttcttcactcatgacgcggccctgtcggcaatgacttctttaaatggaacaatttttgatccagatactggtgaccgtttgcacattgagctagctaaat

SEQ ID NO: 31623 - protein, 110 aa, Panicum virgatum
  misc_feature: Ceres CLONE 1906551
  misc_feature (34)..(106): Pfam Name: RRM_1 Pfam Description: RNA recognition motif. (a.k.a. RRM, RBD, or RNP domain)
MSLSHRLPPGAPAVDPYYVYAPRPDPHRHGVLTLFVAGLPDDVKPREIHNLFSHRPGFDHCLLEYTGRGNQAVAFVTFFTHDAALSAMTSLNGTIFDPDTGDRLHIELAK

SEQ ID NO: 31624 - DNA, 564 bp, Panicum virgatum
  misc_feature: Ceres CLONE 1906557
  misc_feature: Encodes the peptide sequence at SEQ ID NO. 31625
cgagaacccgggagccccacccgcccgaggcagcaaacgacgagacccgtttcccccccttgtcccctcggtttccccgccgcttcccggcgatctccgcgatcccgccgccgcagatctcgccgaggaggtggggatcagtccccccgacccgctgcgaggcccttcgctcccggttgagttctcgaggcgctacactccgagggtttcggcacccttggttccccatatggctgcttccccatctcagcatgtactctcatccatcaagttgtggtccaacagcagcttcagtcatgagaagagaacttgtcatgtgcattctgtttcagtagggcgtcgctgccccagtgcccgtaatttgagtctagtttgtgcttcaaagtcacaatcttcagtggttgagccagttcagctaccggggagccctaaaagtggcacaaccccaaagaagtcaagtgaaagtgcactcatactgatacggcatggcgaatcgttgtggaatgagaagaacctgtttactggatgtgttgatgttccactgacccctaagggtgttgagga

SEQ ID NO: 31625 - protein, 111 aa, Panicum virgatum
  misc_feature: Ceres CLONE 1906557
  misc_feature: SWISSPROT Homolog: EC 5.4.2.1 Phosphoglycerate mutase
MAASPSQHVLSSIKLWSNSSFSHEKRTCHVHSVSVGRRCPSARNLSLVCASKSQSSVVEPVQLPGSPKSGTTPKKSSESALILIRHGESLWNEKNLFTGCVDVPLTPKGVE

SEQ ID NO: 31626 - DNA, 703 bp, Panicum virgatum
  misc_feature: Ceres CLONE 1906592
  misc_feature: Encodes the peptide sequence at SEQ ID NO. 31627
agactaccacttgcttccctgaccgtccgtccgtctcccttccctcaaaaatctctccgcaatcaaaccgcggtcgctcggacccatcgcgaaaccgccgggcggagcgcgaacgccacccgctgctgccggggagatccatccggccctggtttcttcttccttttgtcgcggctcagcactgaagatcgatcggccaattaaatttgcgctgagaagaattgagaggtccaggcatgagcttccgggaccaggagagtggcggggaggatggggtccggacgtcctccgcgtcggacctgcggaagccgctcctcaacaccgggagctggtaccggatgccgccgccggggggcataatgggctcacggcaatccagcctcatggagcgcctaggctcctccgccttctccatccgcgacgtctctgtctcggccacgctctgcacgctcatcgtcgcgctaggtcccatccaatttggcttcacctgcggatactcctcgcccacccaggacgccgtgattgctgacctcggtctctccctctccgagttttccctgttcggatcactgtccaacgtcggggcgatggtgggagccattgccagtgggcagattgcagagtatatcggacgcaaggggtctctcatgatcgctgcgatcccgaatattatagggtggcttgcgatatcttttgcaaaaga

SEQ ID NO: 31627 - protein, 155 aa, Panicum virgatum
  misc_feature: Ceres CLONE 1906592
  misc_feature: Useful for biocontainment applications
MSFRDQESGGEDGVRTSSASDLRKPLLNTGSWYRMPPPGGIMGSRQSSLMERLGSSAFSIRDVSVSATLCTLIVALGPIQFGFTCGYSSPTQDAVIADLGLSLSEFSLFGSLSNVGAMVGAIASGQIAEYIGRKGSLMIAAIPNIIGWLAISFAK

SEQ ID NO: 31628 - DNA, 1970 bp, Panicum virgatum
  misc_feature: Ceres CLONE 1906606
  misc_feature: Encodes the peptide sequence at SEQ ID NO. 31629
gcgtcaccgccgcgcctccttcctcctccccccagcaagtgcgggcggggcgcgggtgctccgcggtgaggtgcggcgccggcgtggccggcaggctgcgccgagagttacctatttcctcaggaacccttggtctctaaactctctagcaactgggcgcacctcctactaactactctctaccagctcgcacgcaaggtgtttgtgggaatgttccttcggcagctgcagcgccaagcgcggcggcagtgcgcaccccatccgcctcgggatctccccggcctccttcacctcttccactcgccgtccatcgtccctcctgaagcctcgaccacgcccccgcgccggtctccacctgtgcgagtacaaggctcgccttgctccagttctggcccccttggctcctgcttccgcattgatgtggtcgactccgacctatggcccgcatccctgggttttctgccggagcctgcacctggcagcgagttcacagatgactttcagcaacacgagggtgatgagatacatgattcggatgacgagatcgatgacatgaggcaccgcaagaagctgttctacaagctggacaggggctcgcgggagtttgaggagaatagcgtgcccttgcgtcgcagcagaaagagggagaaagccaacaccaagaattcaaaggaatgcatgaacgtggagcctatcaagcctgtttctgccaatgttccaaagctgaaggcaaagcgttcagcacgcgacgacagcatagttgaggtgaagcgggaacgggtgccaacgttcaaccagatgaccgatccttaccaccaccctttctgccttgatatacatgtcaccaaagggtcagtgcgtgcttgcttcgtgcaccgagtgaccagcagggtggtggctgttgcacactccatatcaaaggatatgaagtttgatctgggttcaaggaagggtaagggtttgaaggcctgtgcggctgttggtgccgtgcttgcgaagcgtgccatagaggatgatattcacaatgcagtgtatacaccaaggaaaggagataggattgaaggaaaaattgaggttgtgttgcgtgcaataattgataatggagttgatgtgaaggtgaaactgaagcaaagaaagccaataaagaaaacactggtggtgcagcaagatcagtccccctgaaaggtcagcaattgttcagcaccatgagcccaaatgcttcaaaattcatgaaattatctagaaaactgatgactgaaagaggaacaggcagctgatgggaatgcgtgcagttctcctagatggccctaacgttcttgttccatgtactcacaaatcacctgcttcggtagtacttcacaacctcaacattcagccagtgctacacacataaactcagcatgtttaaagtctgcagtatgtactgaagggttatcattgccctgtgctcagtttgttgctgacaacccaagctccagtgagtaattcatatccctgaattaatgcacacaacttacagcatgtatgggcagttgagcactcacagccagttatagtgctacttgtgcaatggaaacgagcctctgcttgggcccgagaatcagaaatgttaactgtcaagtgccatcagaattcccttcgaaaaagtgccatcagaaagacaaacttgcctgcactgcacttgtgttcttcagaatgcttctgtctcgatgatggcgcagccttcacaataggcacagcacggtggcactgtgatggtattggtatgtgatgtccacattggtgtttctgatagccatttgtgccaagtccattgctgctcaccaaagcttgagccgtgtaattttggctcctgaactgaactgatgcacagaacacgaaggcacgcatagtcttgcttctggaacgaaaagcaaaaactcttgaatcgtttacggctttgtgtaaaaatgtttgcttaccttgcttcc

SEQ ID NO: 31629 - protein, 209 aa, Panicum virgatum
  misc_feature: Ceres CLONE 1906606
  misc_feature (60)..(187): Pfam Name: Ribosomal_L18p Pfam Description: Ribosomal L18p/L5e family
MRHRKKLFYKLDRGSREFEENSVPLRRSRKREKANTKNSKECMNVEPIKPVSANVPKLKAKRSARDDSIVEVKRERVPTFNQMTDPYHHPFCLDIHVTKGSVRACFVHRVTSRVVAVAHSISKDMKFDLGSRKGKGLKACAAVGAVLAKRAIEDDIHNAVYTPRKGDRIEGKIEVVLRAIIDNGVDVKVKLKQRKPIKKTLVVQQDQSP

SEQ ID NO: 31630 - DNA, 697 bp, Panicum virgatum
  misc_feature: Ceres CLONE 1906608
  misc_feature: Encodes the peptide sequence at SEQ ID NO. 31631
gagtccaccacccctcccacctctcctccccccgccgcgtcgcgagagcgcgctccgagagccgaatcggaccgcgaggtggtccccccggggcggatcgagcctagggctaggacatgggcggaggggacgccgacgccgacgccggcggcgagcacgcggccgcgcaggcgacgctgcacatccgttgcaccaacggctccaagttcgccgtgcgggccgacctgggcgccaccgtcggggcgttcaaggcgatcgtcgccgagagctgcgacgtgccggccccgcagcagcggctgatctacaagggccggatcttgaaggacgagcaaaccctagccagctacggtgtggagacagatcatacgattcacatggtacgaggtgctgcaccaccactagcatcaactgcacctgcagctaaccaagaaacttccactactgctcctgccagttccccagcagcaggattgggtggcttgttgccaggtctgggtgctacaggggctgctaatagttgagggttgggtttgtttgcatctggcctcccagaattagaccagatgcaacaacagctagccgactaccccaacttgatgagggaaataatgaatatgccactcatgcagaatttaatgaataatcctgatctcatacgcaatataataatgaacaatcctcaaatgcgtgagctcat

SEQ ID NO: 31631 - protein, 134 aa, Panicum virgatum
  misc_feature: Ceres CLONE 1906608
  misc_feature (24)..(92): Pfam Name: ubiquitin Pfam Description: Ubiquitin family
MGGGDADADAGGEHAAAQATLHIRCTNGSKFAVRADLGATVGAFKAIVAESCDVPAPQQRLIYKGRILKDEQTLASYGVETDHTIHMVRGAAPPLASTAPAANQETSTTAPASSPAAGLGGLLPGLGATGAANS

SEQ ID NO: 31632 - DNA, 1840 bp, Panicum virgatum
  misc_feature: Ceres CLONE 1906609
  misc_feature: Encodes the peptide sequence at SEQ ID NO. 31633
gttgctgaactcgatgatagttcaggatttttaccgtttggacagattccttgcagtgcttttttccttctccgttcttctttcgaattcggctggcgctttggtacttgtgcggttaaatttgacgcgcatttcgccgaaaagttgcagctttgtcctgcaatctgatgttactcgtcactgttgttctcaaatttggtgttgccttctgttccgtagctatcaattgctagcggttgcaaagatgggattgggataggtcgggcgtttcagtgcacacttcactaaaaagctgggatcttcttgtccgttccgttgtgattccagctttttttgttctaatttgacaatttgttggttcgattcgcctcctttcctctatttcacctattcggttcttcgtccgccccgccacatttcacctttcttcgttcttgctgcctcaccaactcatttcttctgctccagtccggtggattctctccagctaagctacgagcaatgcttcgcgggctagagaaacaccagcgcagcggcgatgacacatcaccggaggctaacgactccggcgagctcgacgaccgaaggagcttagagtgctccacctccatgtcgagcaacagtggtcacagatcaagaaaccgagctctggacgacgatagcttcgactccgagagcagctcatcgggaccgccgacggtgaagaggtcctcggcggtggctgcgttgctgccgccgttctcccggccaactccttcgaagtgggacgacgccgagaaatggatttccagcccgacgtcaaaccgtacaggccgcccggggcctgccactgggactgtgccaaagaagtcgtcattggcatttcctgaacatggaggccgcccaccagccgttgctaaggtggtcgcggatgcgcccattagcactggacccttggttaagaattcagatggtctcattcagttggatttatttaaacctgcacaaattcctccaatagtcgatgaaccagagactgcaattagatcagtctcgatgagggacatgggaacagaaatgactccaattgcgagccaggagccttctcggactgggacgcctatcatcgcatctagtccaacatcctctcggacaccaactccgcaacataccactgaattcagtttaagtaatattgattctaacaagaaggatatgtctgaggaggagctacaaatgaatacgagacaggaaattatggatcttggccaaaggttaggcaagactacaatagctgcatgggcaagtaaggaagagaaagccaccgcacatctcacaagtagtacaaccaataaggttgtcgatatcaacaaggaggctcgagctacagattggcaggaggcagagaaggcaaagtaccttgcaaggttccacagggaggaagcaaagatccaagcttgggaaaatcaccagaaagcgaaaattgaagctgaaatgaagaggatagaggccaagatagaacgaaaacgagcgcgggagaaggacaggctggccaacaagctggcagcagtaagccaccgagcagaggcgaagagggaggccgcggaggtgaggaggagccaagaggcagcgcggacagaggagctggcagctcagatccgggaaaccgggcacgcgccatcctccttctcctgctggtgctggtgcctctgaatgctcacctcgactcctatagcaatgatccgtcatgtctgggtgaggttgaaaatttgttggcccgcgcgaccttgtaatgcaacgcgagaaaatgggctcatctttctcagcaaggaatgccaagtgtttgtcgtcctgattcctc

SEQ ID NO: 31633 - protein, 396 aa, Panicum virgatum
  misc_feature: Ceres CLONE 1906609
  misc_feature (279)..(390): Pfam Name: Remorin_C Pfam Description: Remorin, C-terminal region
  misc_feature: The sequence is a functional homolog of SEQ ID NO 1041 in the 10/666,642 US patent application
  misc_feature: The sequence is a functional homolog of SEQ ID NO 1040 in the 10/666,642 US patent application
  misc_feature: The sequence is a functional homolog of SEQ ID NO 264 in the 10/666,642 US patent application
MLRGLEKHQRSGDDTSPEANDSGELDDRRSLECSTSMSSNSGHRSRNRALDDDSFDSESSSSGPPTVKRSSAVAALLPPFSRPTPSKWDDAEKWISSPTSNRTGRPGPATGTVPKKSSLAFPEHGGRPPAVAKVVADAPISTGPLVKNSDGLIQLDLFKPAQIPPIVDEPETAIRSVSMRDMGTEMTPIASQEPSRTGTPIIASSPTSSRTPTPQHTTEFSLSNIDSNKKDMSEEELQMNTRQEIMDLGQRLGKTTIAAWASKEEKATAHLTSSTTNKVVDINKEARATDWQEAEKAKYLARFHREEAKIQAWENHQKAKIEAEMKRIEAKIERKRAREKDRLANKLAAVSHRAEAKREAAEVRRSQEAARTEELAAQIRETGHAPSSFSCWCWCL

SEQ ID NO: 31634 - DNA, 688 bp, Panicum virgatum
  misc_feature: Ceres CLONE 1906617
  misc_feature: Encodes the peptide sequence at SEQ ID NO. 31635
ttatgtgccaatagcacatttgatggtgcttctgataagaaagaagcaaaatttcagacatttgcagaatattttgagaagaagtacagcatatttcttcgtcatccctcacagccattgctagtgttgaaacccactcataatcctcacaaccttctttcatcaaagatcagagatgaaggcaaccgtgtggaaaacaaaaatagggccaatagccttgttcacatgcctccagaactgctgattccccttgatttacctgctgatgttttgagagtattctatttgtttccgtctctgatgtatcgaattgagtcattaatgctagccagccaactaagaagtgatattgcatacacaggatctgatatatcaagcttcctgattctggaagctcttacaacccttagatgctgcgaggacttctctatggagcgtttagagttactgggggactctgtacttaagtatgcagtcagttctgatctcttcctcagatttcctaataaacatgaggggcagttatcgtccagaaggcaagaaattatatgtaatgcaacacttcataggtttggtattgaacgcaagatacagagttacatacgtgatgctgcattcgatcctcgtagatggtgtgcacctggacagctgtcaatctggccctgtccttgtgaatgcccagtaaact

SEQ ID NO: 31635 - protein, 229 aa, Panicum virgatum
  misc_feature: Ceres CLONE 1906617
  misc_feature (145)..(227): Pfam Name: Ribonuclease_3 Pfam Description: RNase3 domain
  misc_feature: SWISSPROT Homolog: EC 3.1.26.3 Ribonuclease III
LCANSTFDGASDKKEAKFQTFAEYFEKKYSIFLRHPSQPLLVLKPTHNPHNLLSSKIRDEGNRVENKNRANSLVHMPPELLIPLDLPADVLRVFYLFPSLMYRIESLMLASQLRSDIAYTGSDISSFLILEALTTLRCCEDFSMERLELLGDSVLKYAVSSDLFLRFPNKHEGQLSSRRQEIICNATLHRFGIERKIQSYIRDAAFDPRRWCAPGQLSIWPCPCECPVN

SEQ ID NO: 31636 - DNA, 621 bp, Panicum virgatum
  misc_feature: Ceres CLONE 1906639
  misc_feature: Encodes the peptide sequence at SEQ ID NO. 31637
gttcctcggctcgttcgcccaccaccggtcccgtgtcccgcgaggccacagcccgacccacccctccgcagggcccagcgatgccggccggccagccgcacgcgcacgaggccggcggcggcgggggcgggggcggcgccccgaaccactccaaccaccacccggcggcccactcgccgccgccgcccgcgctccccgcagaggtggtgccggcgtacccgccccccgagtcggaggacgaccagacctgggtctggacccagatcaaggcggaggcccgccgcgacgcggacgcggagccggcgctcgcctcgttcctctacgccaccgtgctgacccacccgtccctgccgcgctccctctccttccaccttgccaacaagctctgctcctccaccctcctctccacgctcctctacgacctcttcctcgccaccctcgccgcgcacccctccctccgcgccgccgtcgtcgccgacctcctcgccgcccgctcccgcgaccccgcctgcgtcggcttctcgcactgcctcctcaactacgagggcttcctctccatccaggcccaccgcgtcgcgcacgtgctctggacgcaccagcgccgccccctcgcgctctcgc

SEQ ID NO: 31637 - protein, 180 aa, Panicum virgatum
  misc_feature: Ceres CLONE 1906639
  misc_feature (58)..(162): Pfam Name: SATase_N Pfam Description: Serine acetyltransferase, N-terminal
  misc_feature: SWISSPROT Homolog: EC 2.3.1.30 Serine O-acetyltransferase
MPAGQPHAHEAGGGGGGGGAPNHSNHHPAAHSPPPPALPAEVVPAYPPPESEDDQTWVWTQIKAEARRDADAEPALASFLYATVLTHPSLPRSLSFHLANKLCSSTLLSTLLYDLFLATLAAHPSLRAAVVADLLAARSRDPACVGFSHCLLNYEGFLSIQAHRVAHVLWTHQRRPLALS

SEQ ID NO: 31638 - DNA, 741 bp, Panicum virgatum
  misc_feature: Ceres CLONE 1906659
  misc_feature: Encodes the peptide sequence at SEQ ID NO. 31639
acccctccttggctccttccttcctttccccccacctccgtccgtgaaggtaggcgtgagccaatcaatccccccgccgcccccgaaccccgcgaatccttccgccgcaagccagaggcgaaatcgggttcctcggccgccgccccggcgcggagcaccagcagcggcaccggggccatgaggtcgtcggactcgtcgcgcttcgtgcaggagctcgtgctctacgccgccagcgccgcgctcagctgcctcgtcctcttcgccggcctccgccagctcgaccccaaccgcgccgcgtcccagaaggccgcgcagcagaagaaggagatcgccaagcgcctcggccgcccgctcgtctccaccacgccctacgaggatgtgattgcgtgcgacgtcatcaaccccgacagcatcgacgtcgagttcgactccatcgggggcctcgaccacgtcaagcaggcgctctacgagctcgtcatcctgcccctgcgccgcccggagctcttcgccttcggcaagctcctcagcccccagaagggcgtcctcctctatggcccgcccggcaccgggaagaccatgctcgccaaggccatcgccagggagtcgggggcagtcttcatcaatgtcaggatctccaatctcatgagcaagtggtttggggatgcgcagaagctcgttgcggctgtgtttagccttgctcacaagctccagcctgctattatcttcatcgatgaggttgat

SEQ ID NO: 31639 - protein, 187 aa, Panicum virgatum
  misc_feature: Ceres CLONE 1906659
  misc_feature: SWISSPROT Homolog: EC 3.6.4.3 Microtubule-severing ATPase
MRSSDSSRFVQELVLYAASAALSCLVLFAGLRQLDPNRAASQKAAQQKKEIAKRLGRPLVSTTPYEDVIACDVINPDSIDVEFDSIGGLDHVKQALYELVILPLRRPELFAFGKLLSPQKGVLLYGPPGTGKTMLAKAIARESGAVFINVRISNLMSKWFGDAQKLVAAVFSLAHKLQPAIIFIDEV

SEQ ID NO: 31640 - DNA, 709 bp, Panicum virgatum
  misc_feature: Ceres CLONE 1906664
  misc_feature: Encodes the peptide sequence at SEQ ID NO. 31641
acctggccactagccactctcgcttcgtccgttctcgctcatcaccagagcaagctagcttccgtgggcttcgccggccgccccgatccatcctctccgtccggcgatcgcggcgcgttccggcccggccggtcggggatggggcggtcgccgtgctgcgagaaggaggccgggctgaagaagggcccgtggacgccggaggaggaccagaagctgctcgccttcatcgagcagcacggccacggctgctggcgctcgctgccggccaaggctgggctgcggcggtgcggcaagagctgccggctccggtggaccaactacctgcggccggacatcaagcggggcaagttcacgctccaggaggagcagaccatcatccagctccacgcgctcctcggcaacaggtgacgactcacggatcaccacgtacgaaccgcttgatcgatgcacttgccacacctctcgtgcgtgctcgcgccctgtgcatggaagctatccggcctgcatcgtctgcaagaacgtggtgaaattgaggcgtgaaagaaaaataccaagtcccgtgccaggttattttcctccgcatggttggacagttggtcacccaacccagtgggattggctagtcacgcttgccatcaatgctgccgagcccgctagcctcgctgtgcctcgccatccatgtcagggcgctggaccatcgtcaccgctc

SEQ ID NO: 31641 - protein, 89 aa, Panicum virgatum
  misc_feature: Ceres CLONE 1906664
  misc_feature (15)..(62): Pfam Name: Myb_DNA-binding Pfam Description: Myb-like DNA-binding domain
  misc_feature: The sequence is a functional homolog of SEQ ID NO 1040 in the 10/225,066 US patent application
  misc_feature: The sequence is a functional homolog of SEQ ID NO 2864 in the 10/374,780 US patent application
  misc_feature: The sequence is a functional homolog of SEQ ID NO 296 in the 11/479,226 US patent application
  misc_feature: The sequence is a functional homolog of SEQ ID NO 1684 in the 11/479,226 US patent application
  misc_feature: The sequence is a functional homolog of SEQ ID NO 2582 in the 10/374,780 US patent application
  misc_feature: The sequence is a functional homolog of SEQ ID NO 30 in the 11/375,241 US patent application
  misc_feature: The sequence is a functional homolog of SEQ ID NO 854 in the 10/412,699 US patent application
  misc_feature: The sequence is a functional homolog of SEQ ID NO 569 in the 10/374,780 US patent application
  misc_feature: The sequence is a functional homolog of SEQ ID NO 1052 in the 11/479,226 US patent application
  misc_feature: The sequence is a functional homolog of SEQ ID NO 456 in the 10/412,699 US patent application
  misc_feature: The sequence is a functional homolog of SEQ ID NO 2564 in the 10/374,780 US patent application
  misc_feature: The sequence is a functional homolog of SEQ ID NO 276 in the 10/225,066 US patent application
  misc_feature: The sequence is a functional homolog of SEQ ID NO 818 in the 10/412,699 US patent application
  misc_feature: Useful for making plants with altered alkaloid content
  misc_feature: Useful for making plants with altered lignin content
  misc_feature: Useful for making plants with modulated nitrogen use efficiency
  misc_feature: The sequence is a functional homolog of SEQ ID NO 824 in the 10/412,699 US patent application
  misc_feature: The sequence is a functional homolog of SEQ ID NO 2572 in the 10/374,780 US patent application
  misc_feature: The sequence is a functional homolog of SEQ ID NO 636 in the 10/225,066 US patent application
  misc_feature: The sequence is a functional homolog of SEQ ID NO 838 in the 10/412,699 US patent application
  misc_feature: The sequence is a functional homolog of SEQ ID NO 1041 in the 11/479,226 US patent application
  misc_feature: The sequence is a functional homolog of SEQ ID NO 112 in the 10/225,066 US patent application
  misc_feature: The sequence is a functional homolog of SEQ ID NO 20 in the 11/375,241 US patent application
  misc_feature: The sequence is a functional homolog of SEQ ID NO 2052 in the 10/374,780 US patent application
  misc_feature: The sequence is a functional homolog of SEQ ID NO 450 in the 10/412,699 US patent application
  misc_feature: The sequence is a functional homolog of SEQ ID NO 134 in the 10/412,699 US patent application
  misc_feature: The sequence is a functional homolog of SEQ ID NO 321 in the 11/479,226 US patent application
  misc_feature: The sequence is a functional homolog of SEQ ID NO 110 in the 10/412,699 US patent application
  misc_feature: The sequence is a functional homolog of SEQ ID NO 259 in the 11/479,226 US patent application
  misc_feature: The sequence is a functional homolog of SEQ ID NO 156 in the 10/412,699 US patent application
  misc_feature: The sequence is a functional homolog of SEQ ID NO 164 in the 10/412,699 US patent application
  misc_feature: The sequence is a functional homolog of SEQ ID NO 1754 in the 10/412,699 US patent application
  misc_feature: The sequence is a functional homolog of SEQ ID NO 1978 in the 10/374,780 US patent application
  misc_feature: The sequence is a functional homolog of SEQ ID NO 353 in the 11/479,226 US patent application
  misc_feature: The sequence is a functional homolog of SEQ ID NO 369 in the 11/479,226 US patent application
  misc_feature: The sequence is a functional homolog of SEQ ID NO 40 in the 10/374,780 US patent application
  misc_feature: The sequence is a functional homolog of SEQ ID NO 776 in the 10/225,066 US patent application
  misc_feature: The sequence is a functional homolog of SEQ ID NO 430 in the 10/412,699 US patent application
  misc_feature: The sequence is a functional homolog of SEQ ID NO 995 in the 11/479,226 US patent application
  misc_feature: The sequence is a functional homolog of SEQ ID NO 108 in the 10/412,699 US patent application
  misc_feature: The sequence is a functional homolog of SEQ ID NO 1740 in the 10/412,699 US patent application
  misc_feature: The sequence is a functional homolog of SEQ ID NO 1964 in the 10/374,780 US patent application
  misc_feature: The sequence is a functional homolog of SEQ ID NO 255 in the 11/479,226 US patent application
  misc_feature: The sequence is a functional homolog of SEQ ID NO 908 in the 11/435,388 US patent application
  misc_feature: The sequence is a functional homolog of SEQ ID NO 593 in the 10/374,780 US patent application
  misc_feature: The sequence is a functional homolog of SEQ ID NO 782 in the 11/435,388 US patent application
  misc_feature: The sequence is a functional homolog of SEQ ID NO 1070 in the 10/374,780 US patent application
  misc_feature: The sequence is a functional homolog of SEQ ID NO 992 in the 11/435,388 US patent application
  misc_feature: The sequence is a functional homolog of SEQ ID NO 168 in the 10/412,699 US patent application
  misc_feature: The sequence is a functional homolog of SEQ ID NO 377 in the 11/479,226 US patent application
  misc_feature: The sequence is a functional homolog of SEQ ID NO 1011 in the 11/479,226 US patent application
  misc_feature: The sequence is a functional homolog of SEQ ID NO 434 in the 10/412,699 US patent application
  misc_feature: The sequence is a functional homolog of SEQ ID NO 1002 in the 11/435,388 US patent application
  misc_feature: The sequence is a functional homolog of SEQ ID NO 1064 in the 10/374,780 US patent application
  misc_feature: The sequence is a functional homolog of SEQ ID NO 1306 in the 10/412,699 US patent application
  misc_feature: The sequence is a functional homolog of SEQ ID NO 990 in the 11/435,388 US patent application
  misc_feature: The sequence is a functional homolog of SEQ ID NO 1069 in the 10/374,780 US patent application
  misc_feature: The sequence is a functional homolog of SEQ ID NO 988 in the 11/435,388 US patent application
  misc_feature: The sequence is a functional homolog of SEQ ID NO 1068 in the 10/374,780 US patent application
  misc_feature: The sequence is a functional homolog of SEQ ID NO 984 in the 11/435,388 US patent application
  misc_feature: The sequence is a functional homolog of SEQ ID NO 1065 in the 10/374,780 US patent application
  misc_feature: The sequence is a functional homolog of SEQ ID NO 1307 in the 10/412,699 US patent application
  misc_feature: The sequence is a functional homolog of SEQ ID NO 986 in the 11/435,388 US patent application
  misc_feature: The sequence is a functional homolog of SEQ ID NO 1004 in the 11/435,388 US patent application
  misc_feature: The sequence is a functional homolog of SEQ ID NO 1072 in the 10/374,780 US patent application
  misc_feature: The sequence is a functional homolog of SEQ ID NO 996 in the 11/435,388 US patent application
  misc_feature: The sequence is a functional homolog of SEQ ID NO 822 in the 10/412,699 US patent application
  misc_feature: The sequence is a functional homolog of SEQ ID NO 2221 in the 10/666,642 US patent application
  misc_feature: The sequence is a functional homolog of SEQ ID NO 998 in the 11/435,388 US patent application
  misc_feature: The sequence is a functional homolog of SEQ ID NO 1000 in the 11/435,388 US patent application
  misc_feature: The sequence is a functional homolog of SEQ ID NO 2223 in the 10/666,642 US patent application
  misc_feature: The sequence is a functional homolog of SEQ ID NO 18 in the 11/375,241 US patent application
  misc_feature: The sequence is a functional homolog of SEQ ID NO 426 in the 10/374,780 US patent application
  misc_feature: The sequence is a functional homolog of SEQ ID NO 458 in the 10/225,066 US patent application
  misc_feature: The sequence is a functional homolog of SEQ ID NO 792 in the 11/435,388 US patent application
  misc_feature: The sequence is a functional homolog of SEQ ID NO 788 in the 11/435,388 US patent application
  misc_feature: The sequence is a functional homolog of SEQ ID NO 1067 in the 10/374,780 US patent application
  misc_feature: The sequence is a functional homolog of SEQ ID NO 1309 in the 10/412,699 US patent application
  misc_feature: The sequence is a functional homolog of SEQ ID NO 1071 in the 10/374,780 US patent application
  misc_feature: The sequence is a functional homolog of SEQ ID NO 994 in the 11/435,388 US patent application
  misc_feature: The sequence is a functional homolog of SEQ ID NO 1094 in the 10/225,066 US patent application
  misc_feature: The sequence is a functional homolog of SEQ ID NO 386 in the 10/374,780 US patent application
  misc_feature: Useful for making plants with altered carbohydrate content
  misc_feature: The sequence is a functional homolog of SEQ ID NO 1073 in the 10/374,780 US patent application
  misc_feature: The sequence is a functional homolog of SEQ ID NO 1010 in the 11/435,388 US patent application
  misc_feature: The sequence is a functional homolog of SEQ ID NO 1006 in the 11/435,388 US patent application
  misc_feature: The sequence is a functional homolog of SEQ ID NO 1008 in the 11/435,388 US patent application
  misc_feature: The sequence is a functional homolog of SEQ ID NO 116 in the 10/412,699 US patent application
  misc_feature: The sequence is a functional homolog of SEQ ID NO 280 in the 11/479,226 US patent application
  misc_feature: The sequence is a functional homolog of SEQ ID NO 1863 in the 10/374,780 US patent application
  misc_feature: The sequence is a functional homolog of SEQ ID NO 1074 in the 10/412,699 US patent application
  misc_feature: The sequence is a functional homolog of SEQ ID NO 590 in the 10/374,780 US patent application
  misc_feature: The sequence is a functional homolog of SEQ ID NO 726 in the 11/435,388 US patent application
  misc_feature: Useful for making plants with modulated low light sensitivity
  misc_feature: Useful for biocontainment applications
  misc_feature: The sequence is a functional homolog of SEQ ID NO 794 in the 11/435,388 US patent application
  misc_feature: The sequence is a functional homolog of SEQ ID NO 594 in the 10/374,780 US patent application
  misc_feature: The sequence is a functional homolog of SEQ ID NO 784 in the 11/435,388 US patent application
  misc_feature: The sequence is a functional homolog of SEQ ID NO 136 in the 10/412,699 US patent application
  misc_feature: The sequence is a functional homolog of SEQ ID NO 325 in the 11/479,226 US patent application
  misc_feature: The sequence is a functional homolog of SEQ ID NO 184 in the 10/412,699 US patent application
  misc_feature: The sequence is a functional homolog of SEQ ID NO 397 in the 11/479,226 US patent application
  misc_feature: The sequence is a functional homolog of SEQ ID NO 46 in the 10/374,780 US patent application
  misc_feature: The sequence is a functional homolog of SEQ ID NO 590 in the 11/435,388 US patent application
  misc_feature: The sequence is a functional homolog of SEQ ID NO 6 in the 10/225,068 US patent application
  misc_feature: The sequence is a functional homolog of SEQ ID NO 743 in the 10/666,642 US patent application
  misc_feature: The sequence is a functional homolog of SEQ ID NO 790 in the 11/435,388 US patent application
  misc_feature: The sequence is a functional homolog of SEQ ID NO 442 in the 10/412,699 US patent application
  misc_feature: The sequence is a functional homolog of SEQ ID NO 112 in the 10/412,699 US patent application
  misc_feature: The sequence is a functional homolog of SEQ ID NO 267 in the 11/479,226 US patent application
  misc_feature: The sequence is a functional homolog of SEQ ID NO 271 in the 11/479,226 US patent application
  misc_feature: The sequence is a functional homolog of SEQ ID NO 1031 in the 11/479,226 US patent application
  misc_feature: The sequence is a functional homolog of SEQ ID NO 1804 in the 10/412,699 US patent application
  misc_feature: The sequence is a functional homolog of SEQ ID NO 2050 in the 10/374,780 US patent application
  misc_feature: The sequence is a functional homolog of SEQ ID NO 444 in the 10/412,699 US patent application
  misc_feature: The sequence is a functional homolog of SEQ ID NO 598 in the 10/225,066 US patent application
  misc_feature: The sequence is a functional homolog of SEQ ID NO 620 in the 11/435,388 US patent application
  misc_feature: The sequence is a functional homolog of SEQ ID NO 592 in the 10/374,780 US patent application
  misc_feature: The sequence is a functional homolog of SEQ ID NO 786 in the 11/435,388 US patent application
  misc_feature: The sequence is a functional homolog of SEQ ID NO 1072 in the 10/412,699 US patent application
  misc_feature: The sequence is a functional homolog of SEQ ID NO 1073 in the 10/412,699 US patent application
  misc_feature: The sequence is a functional homolog of SEQ ID NO 588 in the 10/374,780 US patent application
  misc_feature: The sequence is a functional homolog of SEQ ID NO 589 in the 10/374,780 US patent application
  misc_feature: The sequence is a functional homolog of SEQ ID NO 730 in the 11/435,388 US patent application
  misc_feature: The sequence is a functional homolog of SEQ ID NO 1071 in the 10/412,699 US patent application
  misc_feature: The sequence is a functional homolog of SEQ ID NO 587 in the 10/374,780 US patent application
  misc_feature: The sequence is a functional homolog of SEQ ID NO 728 in the 11/435,388 US patent application
  misc_feature: Useful for making plants with modulated biomass
  misc_feature: The sequence is a functional homolog of SEQ ID NO 796 in the 11/435,388 US patent application
  misc_feature: The sequence is a functional homolog of SEQ ID NO 1066 in the 10/374,780 US patent application
  misc_feature: The sequence is a functional homolog of SEQ ID NO 1308 in the 10/412,699 US patent application
  misc_feature: The sequence is a functional homolog of SEQ ID NO 1660 in the 11/479,226 US patent application
  misc_feature: The sequence is a functional homolog of SEQ ID NO 840 in the 10/412,699 US patent application
  misc_feature: The sequence is a functional homolog of SEQ ID NO 263 in the 11/479,226 US patent application
  misc_feature: The sequence is a functional homolog of SEQ ID NO 478 in the 11/435,388 US patent application
  misc_feature: The sequence is a functional homolog of SEQ ID NO 54 in the 10/666,642 US patent application
  misc_feature: The sequence is a functional homolog of SEQ ID NO 58 in the 10/666,642 US patent application
  misc_feature: The sequence is a functional homolog of SEQ ID NO 1901 in the 11/479,226 US patent application
  misc_feature: The sequence is a functional homolog of SEQ ID NO 310 in the 10/374,780 US patent application
  misc_feature: The sequence is a functional homolog of SEQ ID NO 842 in the 10/225,066 US patent application
  misc_feature: Useful for making plants with altered cell wall content and/or composition
  misc_feature: The sequence is a functional homolog of SEQ ID NO 1917 in the 10/374,780 US patent application
  misc_feature: The sequence is a functional homolog of SEQ ID NO 148 in the 10/412,699 US patent application
  misc_feature: The sequence is a functional homolog of SEQ ID NO 2266 in the 10/374,780 US patent application
  misc_feature: The sequence is a functional homolog of SEQ ID NO 341 in the 11/479,226 US patent application
  misc_feature: The sequence is a functional homolog of SEQ ID NO 58 in the 11/375,241 US patent application
  misc_feature: The sequence is a functional homolog of SEQ ID NO 1680 in the 11/479,226 US patent application
  misc_feature: The sequence is a functional homolog of SEQ ID NO 202 in the 10/666,642 US patent application
  misc_feature: The sequence is a functional homolog of SEQ ID NO 852 in the 10/412,699 US patent application
  misc_feature: The sequence is a functional homolog of SEQ ID NO 428 in the 10/374,780 US patent application
  misc_feature: The sequence is a functional homolog of SEQ ID NO 54 in the 11/375,241 US patent application
  misc_feature: The sequence is a functional homolog of SEQ ID NO 870 in the 10/225,066 US patent application
  misc_feature: The sequence is a functional homolog of SEQ ID NO 836 in the 10/412,699 US patent application
  misc_feature: The sequence is a functional homolog of SEQ ID NO 1118 in the 10/225,066 US patent application
  misc_feature: The sequence is a functional homolog of SEQ ID NO 1396 in the 11/479,226 US patent application
  misc_feature: The sequence is a functional homolog of SEQ ID NO 2488 in the 10/374,780 US patent application
  misc_feature: The sequence is a functional homolog of SEQ ID NO 658 in the 10/412,699 US patent application
  misc_feature: The sequence is a functional homolog of SEQ ID NO 112 in the 11/375,241 US patent application
  misc_feature: The sequence is a functional homolog of SEQ ID NO 2398 in the 10/374,780 US patent application
  misc_feature: The sequence is a functional homolog of SEQ ID NO 466 in the 10/412,699 US patent application
  misc_feature: The sequence is a functional homolog of SEQ ID NO 580 in the 10/225,066 US patent application
  misc_feature: Useful for making plants with altered terpenoid content
  misc_feature: The sequence is a functional homolog of SEQ ID NO 122 in the 10/412,699 US patent application
  misc_feature: The sequence is a functional homolog of SEQ ID NO 126 in the 11/375,241 US patent application
  misc_feature: The sequence is a functional homolog of SEQ ID NO 148 in the 10/286,264 US patent application
  misc_feature: The sequence is a functional homolog of SEQ ID NO 34 in the 10/374,780 US patent application
  misc_feature: The sequence is a functional homolog of SEQ ID NO 438 in the 10/225,066 US patent application
  misc_feature: The sequence is a functional homolog of SEQ ID NO 1411 in the 11/479,226 US patent application
  misc_feature: The sequence is a functional homolog of SEQ ID NO 2492 in the 10/374,780 US patent application
  misc_feature: The sequence is a functional homolog of SEQ ID NO 52 in the 10/225,066 US patent application
  misc_feature: The sequence is a functional homolog of SEQ ID NO 2394 in the 10/374,780 US patent application
  misc_feature: The sequence is a functional homolog of SEQ ID NO 544 in the 10/225,066 US patent application
  misc_feature: The sequence is a functional homolog of SEQ ID NO 999 in the 11/479,226 US patent application
  misc_feature: The sequence is a functional homolog of SEQ ID NO 1681 in the 10/374,780 US patent application
  misc_feature: The sequence is a functional homolog of SEQ ID NO 2570 in the 10/374,780 US patent application
  misc_feature: The sequence is a functional homolog of SEQ ID NO 634 in the 10/225,066 US patent application
  misc_feature: The sequence is a functional homolog of SEQ ID NO 832 in the 10/412,699 US patent application
  misc_feature: The sequence is a functional homolog of SEQ ID NO 188 in the 10/412,699 US patent application
  misc_feature: The sequence is a functional homolog of SEQ ID NO 2274 in the 10/374,780 US patent application
  misc_feature: The sequence is a functional homolog of SEQ ID NO 704 in the 10/225,066 US patent application
  misc_feature: The sequence is a functional homolog of SEQ ID NO 1100 in the 10/225,066 US patent application
  misc_feature: The sequence is a functional homolog of SEQ ID NO 158 in the 10/412,699 US patent application
  misc_feature: The sequence is a functional homolog of SEQ ID NO 2268 in the 10/374,780 US patent application
  misc_feature: The sequence is a functional homolog of SEQ ID NO 357 in the 11/479,226 US patent application
  misc_feature: The sequence is a functional homolog of SEQ ID NO 480 in the 11/435,388 US patent application
  misc_feature: The sequence is a functional homolog of SEQ ID NO 1656 in the 11/479,226 US patent application
  misc_feature: The sequence is a functional homolog of SEQ ID NO 834 in the 10/412,699 US patent application
  misc_feature: The sequence is a functional homolog of SEQ ID NO 178 in the 10/412,699 US patent application
  misc_feature: The sequence is a functional homolog of SEQ ID NO 389 in the 11/479,226 US patent application
  misc_feature: The sequence is a functional homolog of SEQ ID NO 1572 in the 10/374,780 US patent application
  misc_feature: The sequence is a functional homolog of SEQ ID NO 2574 in the 10/374,780 US patent application
  misc_feature: The sequence is a functional homolog of SEQ ID NO 278 in the 10/225,066 US patent application
  misc_feature: The sequence is a functional homolog of SEQ ID NO 504 in the 10/666,642 US patent application
  misc_feature: The sequence is a functional homolog of SEQ ID NO 896 in the 11/435,388 US patent application
  misc_feature: The sequence is a functional homolog of SEQ ID NO 1033 in the 10/412,699 US patent application
  misc_feature: The sequence is a functional homolog of SEQ ID NO 540 in the 10/374,780 US patent application
  misc_feature: The sequence is a functional homolog of SEQ ID NO 116 in the 11/375,241 US patent application
  misc_feature: The sequence is a functional homolog of SEQ ID NO 1648 in the 11/479,226 US patent application
  misc_feature: The sequence is a functional homolog of SEQ ID NO 2566 in the 10/374,780 US patent application
  misc_feature: The sequence is a functional homolog of SEQ ID NO 632 in the 10/225,066 US patent application
  misc_feature: The sequence is a functional homolog of SEQ ID NO 650 in the 11/435,388 US patent application
  misc_feature: The sequence is a functional homolog of SEQ ID NO 826 in the 10/412,699 US patent application
  misc_feature: The sequence is a functional homolog of SEQ ID NO 1056 in the 11/479,226 US patent application
  misc_feature: The sequence is a functional homolog of SEQ ID NO 144 in the 10/374,780 US patent application
  misc_feature: The sequence is a functional homolog of SEQ ID NO 458 in the 10/412,699 US patent application
  misc_feature: The sequence is a functional homolog of SEQ ID NO 756 in the 10/225,066 US patent application
  misc_feature: The sequence is a functional homolog of SEQ ID NO 170 in the 10/412,699 US patent application
  misc_feature: The sequence is a functional homolog of SEQ ID NO 1756 in the 10/412,699 US patent application
  misc_feature: The sequence is a functional homolog of SEQ ID NO 1980 in the 10/374,780 US patent application
  misc_feature: The sequence is a functional homolog of SEQ ID NO 750 in the 10/225,066 US patent application
  misc_feature: The sequence is a functional homolog of SEQ ID NO 196 in the 10/225,066 US patent application
  misc_feature: The sequence is a functional homolog of SEQ ID NO 2900 in the 10/374,780 US patent application
  misc_feature: The sequence is a functional homolog of SEQ ID NO 2 in the 10/225,068 US patent application
  misc_feature: The sequence is a functional homolog of SEQ ID NO 22 in the 10/225,068 US patent application
  misc_feature: The sequence is a functional homolog of SEQ ID NO 230 in the 10/225,066 US patent application
  misc_feature: The sequence is a functional homolog of SEQ ID NO 258 in the 10/374,780 US patent application
  misc_feature: The sequence is a functional homolog of SEQ ID NO 442 in the 11/435,388 US patent application
  misc_feature: The sequence is a functional homolog of SEQ ID NO 842 in the 10/412,699 US patent application
  misc_feature: The sequence is a functional homolog of SEQ ID NO 98 in the 11/375,241 US patent application
  misc_feature: The sequence is a functional homolog of SEQ ID NO 2178 in the 10/374,780 US patent application
  misc_feature: Useful for making plants with modulated flowering time
  misc_feature: The sequence is a functional homolog of SEQ ID NO 1746 in the 10/412,699 US patent application
  misc_feature: The sequence is a functional homolog of SEQ ID NO 1970 in the 10/374,780 US patent application
  misc_feature: The sequence is a functional homolog of SEQ ID NO 452 in the 10/225,066 US patent application
  misc_feature: The sequence is a functional homolog of SEQ ID NO 584 in the 11/435,388 US patent application
  misc_feature: The sequence is a functional homolog of SEQ ID NO 160 in the 10/412,699 US patent application
  misc_feature: The sequence is a functional homolog of SEQ ID NO 214 in the 10/225,068 US patent application
  misc_feature: The sequence is a functional homolog of SEQ ID NO 2270 in the 10/374,780 US patent application
  misc_feature: The sequence is a functional homolog of SEQ ID NO 361 in the 11/479,226 US patent application
  misc_feature: The sequence is a functional homolog of SEQ ID NO 462 in the 10/225,066 US patent application
  misc_feature: The sequence is a functional homolog of SEQ ID NO 482 in the 11/435,388 US patent application
  misc_feature: The sequence is a functional homolog of SEQ ID NO 446 in the 10/412,699 US patent application
  misc_feature: The sequence is a functional homolog of SEQ ID NO 126 in the 10/412,699 US patent application
  misc_feature: The sequence is a functional homolog of SEQ ID NO 168 in the 10/225,066 US patent application
  misc_feature: The sequence is a functional homolog of SEQ ID NO 2718 in the 10/374,780 US patent application
  misc_feature: The sequence is a functional homolog of SEQ ID NO 1564 in the 10/374,780 US patent application
  misc_feature: The sequence is a functional homolog of SEQ ID NO 1625 in the 10/412,699 US patent application
  misc_feature: The sequence is a functional homolog of SEQ ID NO 978 in the 10/666,642 US patent application
  misc_feature: The sequence is a functional homolog of SEQ ID NO 1563 in the 10/374,780 US patent application
  misc_feature: The sequence is a functional homolog of SEQ ID NO 266 in the 10/374,780 US patent application
  misc_feature: The sequence is a functional homolog of SEQ ID NO 536 in the 11/435,388 US patent application
  misc_feature: The sequence is a functional homolog of SEQ ID NO 640 in the 10/225,066 US patent application
  misc_feature: The sequence is a functional homolog of SEQ ID NO 856 in the 10/412,699 US patent application
  misc_feature: The sequence is a functional homolog of SEQ ID NO 232 in the 10/225,066 US patent application
  misc_feature: The sequence is a functional homolog of SEQ ID NO 264 in the 10/374,780 US patent application
  misc_feature: The sequence is a functional homolog of SEQ ID NO 534 in the 11/435,388 US patent application
  misc_feature: The sequence is a functional homolog of SEQ ID NO 156 in the 10/225,068 US patent application
  misc_feature: The sequence is a functional homolog of SEQ ID NO 262 in the 10/374,780 US patent application
  misc_feature: The sequence is a functional homolog of SEQ ID NO 282 in the 10/225,066 US patent application
  misc_feature: The sequence is a functional homolog of SEQ ID NO 186 in the 10/412,699 US patent application
  misc_feature: Useful for making plants with modulated drought sensitivity
  misc_feature: The sequence is a functional homolog of SEQ ID NO 124 in the 10/412,699 US patent application
  misc_feature: The sequence is a functional homolog of SEQ ID NO 1742 in the 10/412,699 US patent application
  misc_feature: The sequence is a functional homolog of SEQ ID NO 1966 in the 10/374,780 US patent application
  misc_feature: The sequence is a functional homolog of SEQ ID NO 299 in the 11/479,226 US patent application
  misc_feature: The sequence is a functional homolog of SEQ ID NO 2556 in the 10/374,780 US patent application
  misc_feature: The sequence is a functional homolog of SEQ ID NO 272 in the 10/225,066 US patent application
  misc_feature: The sequence is a functional homolog of SEQ ID NO 528 in the 11/435,388 US patent application
  misc_feature: The sequence is a functional homolog of SEQ ID NO 36 in US patent 7193132
  misc_feature: The sequence is a functional homolog of SEQ ID NO 1566 in the 10/374,780 US patent application
  misc_feature: The sequence is a functional homolog of SEQ ID NO 1914 in the 10/412,699 US patent application
  misc_feature: The sequence is a functional homolog of SEQ ID NO 2174 in the 10/374,780 US patent application
  misc_feature: The sequence is a functional homolog of SEQ ID NO 956 in the 10/225,066 US patent application
  misc_feature: The sequence is a functional homolog of SEQ ID NO 1408 in the 11/479,226 US patent application
  misc_feature: The sequence is a functional homolog of SEQ ID NO 664 in the 10/412,699 US patent application
  misc_feature: The sequence is a functional homolog of SEQ ID NO 1626 in the 10/412,699 US patent application
  misc_feature: The sequence is a functional homolog of SEQ ID NO 979 in the 10/666,642 US patent application
  misc_feature: Useful for making plants with enhanced nutritional value
  misc_feature: Useful for making plants with modulated heat sensitivity
  misc_feature: The sequence is a functional homolog of SEQ ID NO 1688 in the 11/479,226 US patent application
  misc_feature: The sequence is a functional homolog of SEQ ID NO 1852 in the 10/412,699 US patent application
  misc_feature: The sequence is a functional homolog of SEQ ID NO 2094 in the 10/374,780 US patent application
  misc_feature: The sequence is a functional homolog of SEQ ID NO 1565 in the 10/374,780 US patent application
  misc_feature: The sequence is a functional homolog of SEQ ID NO 1540 in the 10/374,780 US patent application
  misc_feature: The sequence is a functional homolog of SEQ ID NO 1634 in the 10/412,699 US patent application
  misc_feature: The sequence is a functional homolog of SEQ ID NO 200 in the 10/666,642 US patent application
  misc_feature: The sequence is a functional homolog of SEQ ID NO 830 in the 10/412,699 US patent application
  misc_feature: The sequence is a functional homolog of SEQ ID NO 1015 in the 11/479,226 US patent application
  misc_feature: The sequence is a functional homolog of SEQ ID NO 138 in the 10/374,780 US patent application
  misc_feature: The sequence is a functional homolog of SEQ ID NO 436 in the 10/412,699 US patent application
  misc_feature: The sequence is a functional homolog of SEQ ID NO 60 in the 11/375,241 US patent application
  misc_feature: The sequence is a functional homolog of SEQ ID NO 1434 in the 10/666,642 US patent application
  misc_feature: The sequence is a functional homolog of SEQ ID NO 1850 in the 10/412,699 US patent application
  misc_feature: The sequence is a functional homolog of SEQ ID NO 848 in the 10/412,699 US patent application
  misc_feature: The sequence is a functional homolog of SEQ ID NO 1916 in the 10/412,699 US patent application
  misc_feature: The sequence is a functional homolog of SEQ ID NO 2176 in the 10/374,780 US patent application
  misc_feature: The sequence is a functional homolog of SEQ ID NO 1075 in the 10/412,699 US patent application
  misc_feature: The sequence is a functional homolog of SEQ ID NO 591 in the 10/374,780 US patent application
  misc_feature: The sequence is a functional homolog of SEQ ID NO 1692 in the 11/479,226 US patent application
  misc_feature: The sequence is a functional homolog of SEQ ID NO 1541 in the 10/374,780 US patent application
  misc_feature: The sequence is a functional homolog of SEQ ID NO 1635 in the 10/412,699 US patent application
  misc_feature: The sequence is a functional homolog of SEQ ID NO 1652 in the 11/479,226 US patent application
  misc_feature: The sequence is a functional homolog of SEQ ID NO 2568 in the 10/374,780 US patent application
  misc_feature: The sequence is a functional homolog of SEQ ID NO 60 in the 10/225,066 US patent application
  misc_feature: The sequence is a functional homolog of SEQ ID NO 828 in the 10/412,699 US patent application
  misc_feature: The sequence is a functional homolog of SEQ ID NO 1672 in the 11/479,226 US patent application
  misc_feature: The sequence is a functional homolog of SEQ ID NO 846 in the 10/412,699 US patent application
  misc_feature: The sequence is a functional homolog of SEQ ID NO 2696 in the 10/374,780 US patent application
  misc_feature: The sequence is a functional homolog of SEQ ID NO 344 in the 10/225,066 US patent application
  misc_feature: The sequence is a functional homolog of SEQ ID NO 176 in the 10/412,699 US patent application
  misc_feature: The sequence is a functional homolog of SEQ ID NO 385 in the 11/479,226 US patent application
MGRSPCCEKEAGLKKGPWTPEEDQKLLAFIEQHGHGCWRSLPAKAGLRRCGKSCRLRWTNYLRPDIKRGKFTLQEEQTIIQLHALLGNR

SEQ ID NO: 31642 - DNA, 370 bp, Panicum virgatum
  misc_feature: Ceres CLONE 1906667
  misc_feature: Encodes the peptide sequence at SEQ ID NO. 31643
acgagcgccagccagtcaccacctacccgaagccgccgcgaccgatcgagccgagcgccccgcccccacgccgccaccgaaaccctagctcctcctcctcctcagccatggccaccgtctcgctcacgccgcaggtggtcttctccaccgagtcgggcggcgccctctcctccgccacaatcctccgtttcccgccaaacttcgtgcgccagctcagcaccaaggcccgccgcaactgcagcaacatcggcgtcgcgcagatcgtcgccgcggcgtggtcggactgccccgccggccgcccccactccggcggcggcggcggccgcgcccgcggagtggcctccttccatgctgtggccgcttcaggtgc

SEQ ID NO: 31643 - protein, 87 aa, Panicum virgatum
  misc_feature: Ceres CLONE 1906667
  misc_feature: SWISSPROT Homolog: EC 2.5.1.48 Cystathionine gamma-synthase
MATVSLTPQVVFSTESGGALSSATILRFPPNFVRQLSTKARRNCSNIGVAQIVAAAWSDCPAGRPHSGGGGGRARGVASFHAVAASG

SEQ ID NO: 31644 - DNA, 636 bp, Panicum virgatum
  misc_feature: Ceres CLONE 1906672
  misc_feature: Encodes the peptide sequence at SEQ ID NO. 31645
ctccgccgcctcgcgcttcgccccccctcacttgcttccccacccggcggcgctccccgtcgcgaagagatggcggtgccgctgctgacgaagaagatcgtgaagaagcgggtcaagcagttcaagaggccccaccttgaccgctacaagtgcctcaagccaagctggcgcaggcccaagggtattgactcccgtgtcaggaggaagttcaagggatgcaccttgatgcctaacattgggtacggttctgacaagtcaaccaggcactaccttcccaacaagttcaagaagtttctggtgcacaatgtctctgagctggagttgctcatgatgcacaacaggacatactgtgcggagatcgcccacaacgtctcaacaaagaagcgcaaggatattgttgagcgtgctgctcagctcgacattgttgtcaccaacaagctcgccaggctccgcagccaggaggatgagtaggctgggttgctcgtcagcacaactgttgggtcttgtctttcttgtctgtaggaaaactactctgtttcgcgtcgtattgtattgctaccgaggataccttctatgcccgacctttttgcacactcgggcacgtcgagctcaaacgaaagacccccctgaccccct

SEQ ID NO: 31645 - protein, 133 aa, Panicum virgatum
  misc_feature: Ceres CLONE 1906672
  misc_feature (14)..(123): Pfam Name: Ribosomal_L32e Pfam Description: Ribosomal protein L32
MAVPLLTKKIVKKRVKQFKRPHLDRYKCLKPSWRRPKGIDSRVRRKFKGCTLMPNIGYGSDKSTRHYLPNKFKKFLVHNVSELELLMMHNRTYCAEIAHNVSTKKRKDIVERAAQLDIVVTNKLARLRSQEDE

SEQ ID NO: 31646 - DNA, 731 bp, Panicum virgatum
  misc_feature: Ceres CLONE 1906680
  misc_feature: Encodes the peptide sequence at SEQ ID NO. 31647
ttttcttcctctctttcatcgtctcgccgttccgtccctccaaaaccctagacgcgaccctcccccagcgccgctcgccgccgcccgcggccatggatctcctccgctcgcacctccacaaggtccgcatcccggagcccggcagccgcatccacaaggacgagtgctgcgtctccttcgactccccgaggtcggaggggggcctgtacgtggacatgagctcgttcctggggttcgggagggagcatgtggagtggaacttcgagaagaccggcaaccccgtgtacctccacattgtgcagcgccggaagccggagtcggacgaggcggatcgcccgctcaagaagcccaccctccttgcaataggcgtggaaggaggctttggtgatcaagaacctgaatatgatgatacttttgaaatcgtcattttacctgattttatctctcttccattcccctcagttgacttgccagagaaggttaggattgcagttgataaggttatccttgctgaaagtgctgacagaaaacaacaactagctgcttgggtcgctgaaaagaagaatattagtgcatatgctatggatctgcagcagctagaaaatggtgttattgtgcctcctactggatggaagtgcagcaaatgcgataaaactgagaacctctggttgaatttaactgatggtatgatcctttgcgggaggaagctttgggatggaagcggtgggaat

SEQ ID NO: 31647 - protein, 212 aa, Panicum virgatum
  misc_feature: Ceres CLONE 1906680
  misc_feature: SWISSPROT Homolog: EC 3.1.2.15 Ubiquitin thiolesterase
MDLLRSHLHKVRIPEPGSRIHKDECCVSFDSPRSEGGLYVDMSSFLGFGREHVEWNFEKTGNPVYLHIVQRRKPESDEADRPLKKPTLLAIGVEGGFGDQEPEYDDTFEIVILPDFISLPFPSVDLPEKVRIAVDKVILAESADRKQQLAAWVAEKKNISAYAMDLQQLENGVIVPPTGWKCSKCDKTENLWLNLTDGMILCGRKLWDGSGG

SEQ ID NO: 31648 - DNA, 634 bp, Panicum virgatum
  misc_feature: Ceres CLONE 1906724
  misc_feature: Encodes the peptide sequence at SEQ ID NO. 31649
atctatcccccccctcctcctcctcctcttcttgctagccgctgttcccgattgttgggcagattgaggaggagccagccgaattgttgggcagattgaggagccggcgagaaaggaagagatggaccagtacgagccggttcgggagatcggggctggccacttcggtgtggcgaagctgatgcggaacaaggagacgcgggagctggtggccatgaagttcatggagcgagggaacaggatcgacgagaatgttttccgcgagatcgtcaaccaccgttcccttcgccaccccaacatcatccgcttcaaggaggttgtgctgacgccgacccacctggcgatcgtcatggagtacgcggccggcggcgagctgttcgagcgcatctgcgaggccgggcgcttccacgaggacgaggcccgctacttcttccagcagctggtgtgcggggtgagctactgccacgccctgcagatctgccaccgcgacctcaagctggaaaacacgctgctggacggcagcccggcgccgcgcctcaagatctgcgacttcggctactccaagtcgtcggtgctgcactcgcgccccaagtcaacggtcggcacgccggcctacatcgcgccggaggtgctg

SEQ ID NO: 31649 - protein, 170 aa, Panicum virgatum
  misc_feature: Ceres CLONE 1906724
  misc_feature (4)..(170): Pfam Name: Pkinase Pfam Description: Protein kinase domain
  misc_feature: SWISSPROT Homolog: EC 2.7.11.1 Non-specific serine/threonine protein kinase
  misc_feature: Useful for biocontainment applications
  misc_feature: Useful for making plants with modulated biomass
  misc_feature: Useful for making plants with modulated time to senescence
  misc_feature: Useful for making plants with modulated water use efficiency
MDQYEPVREIGAGHFGVAKLMRNKETRELVAMKFMERGNRIDENVFREIVNHRSLRHPNIIRFKEVVLTPTHLAIVMEYAAGGELFERICEAGRFHEDEARYFFQQLVCGVSYCHALQICHRDLKLENTLLDGSPAPRLKICDFGYSKSSVLHSRPKSTVGTPAYIAPEV

SEQ ID NO: 31650 - DNA, 2779 bp, Panicum virgatum
  misc_feature: Ceres CLONE 1906734
  misc_feature: Encodes the peptide sequence at SEQ ID NO. 31651
gtaaccatccctcggaggagcgccaccgccgcgcagaccccacacaccaccggcttctcgctcctcgtcctctaatcctctcccggaaagccatcacactcctcctagctccttacttaaaccccggtttcgcttttgcgccagtgggcagagaaagtgcagtgcagccagcacgcacgtacgatcgaggctgctgcttgcatcgcatgcgatggcgcacgccgtgcacgaccgcctcccgtttctcgcctcgccgccggcgcccccgcctccagcgagggagaggggcaggaacccgtccctcgccgagatgctccgcctcgtcggcgccgccaccgtcgacccggtggctgccgcggacgacgacggagccgcgtccgtgttctcgcccccgctgccgctgcccgccacgctggcgggaggcggcggcggcggcgatggcgagtgcgcgcccatcgccatcgggcggagcgtccagttccgcctcgcgttcaccggcctgacctacagcgtccgcgccaagcagcagcgcggcgggcgcgccggcatgctgcccctgcagcgccgcgtcacagccgcggcgcccgacgcgcacgcgccgcgcatgagggcgctgctggacggcatctccggggaggcgagggagggcgagatcctggccgtcatgggcgccagcggctccggcaagtccacgctcatcgacgcgctcgccaaccgcatctcccgcgacgcgctcaagggcgccgtcacgctcaacggcgagcccctcacggggaacatcctcaagtccatctccgcctacgtcatgcaggacgacctgctgttccccatgctcaccgtcgccgagacgctctccttcgccgccgagttccgcctcccgcgggcgctgtcgccggccaagaagcgcgcgcgcgtgcaagcgctcatcgaccagctcgggctccgcgcggcggccaacaccatcatcggcgacgagggccaccgcggggtgtccgggggcgagcgccgcagggtctccatcggcaccgacatcatccacgacccgatcctcctcttcctcgacgagcccacgtcggggctcgactccacctcggcgttcatggtggtgaaggtgctgcgccgcatcgccgagagcggcagcattgtcatcacgtccatccaccagccgagccagcgcatcctcggcctcctcgaccgcctcatcctcctctccggcggccgcaccgtcttcagcgggacgccttccgccctcccgtcctacttcgccgagttcggcttcccggtccccgacgacgagaaccgcgccgagttcgcgctcgacctgatccgcgagttcgagtcgtcgccgacggggaccaagccgctcgtcgacttccaccgcgcgtggcagcgcatgcacgcgccgagccccggctcggcggcggacgccgatcatcagtcgctggtgcccacgacgatgtcgctcaaggaggccatcagcgcgagcatttcgcgtgggaagctggtgtcgggcgccgacgtggccggagaggcggcgtcgatgcacacgtacgcgaacccgttctgggtggagatgaaggtgctgacgaggcggtcggcgatcaacacgcggcgcatgccggagctgttcctgatccgtcttggcgccgtggtggtcaccggcgcgatcctggccacggtcttcttccggctggaccagtcccccaagggcgcgcaggaacggctgggcttcttcgccttcgccatgtccaccatgttctacacctgcgccgacgcgctgccggtgttcctccaggagcgctacgtcttcctccgggagacggcgtacggcgcgtaccggcgcgcctcctacgtgctctccaacgccatcgtctccttcccgccgctggtggtcctgtccctctccttcgccttcaccaccttcttcgccgtggggctcgccggcggcgtgcccgggttcgccttctacgcgctggccatcctggcgtccttctgggccgggagcgggttcgtgacgttcctctccggcgtgatcccgcacgtgatgatcgggtacaccgtggtggtggccatcctcgcctacttcctgctcttcagcggcttcttcatcaaccgcgaccggatcccgggctactggatctggttccactacctgtcgctggtcaagtaccccttcgagggggtgctgcagaacgagttcgggcgcggcggcgagtgcttcgtgcggggcgcgcagatcttcgacaactcgccgctggccgcgctgccggacgccgtcaaggcccgggtgctcgcgtccatcagctccgcgctcggggtggggatcggcgccgacacgtgcctcgtcactggccgcggcgtgctgcagcaggcggcggtgacgcagctcggcaagtgggagtgcctgctcatcacggtggcctgggggttcctcttccggatcttcttctacttcagcctcgtgctcggcagcaagaacaagcggaggtgatgccgtgatggtgatcgcgcccgccgccatggaaatatggaatcatcacgcgcgtacacgtatgtacatttcaaagcaatgcagtcaatcgtccaagctcgccatggaacacagcaagcaagcgcgcaaaagggaagtgaaggaagaagacgtagtcaaaatgtcaaataggtggtgattgttcatgattttttttcgccttcttctttctccagtgttttgtagctaaataagtggttttattacgggtatacacatgcttggacgatccactgtcttttcgttcag

SEQ ID NO: 31651 - protein, 759 aa, Panicum virgatum
  misc_feature: Ceres CLONE 1906734
  misc_feature (453)..(663): Pfam Name: ABC2_membrane Pfam Description: ABC-2 type transporter
  misc_feature (146)..(336): Pfam Name: ABC_tran Pfam Description: ABC transporter
  misc_feature: SWISSPROT Homolog: EC 3.6.3.30 Fe(3+)-transporting ATPase
MAHAVHDRLPFLASPPAPPPPARERGRNPSLAEMLRLVGAATVDPVAAADDDGAASVFSPPLPLPATLAGGGGGGDGECAPIAIGRSVQFRLAFTGLTYSVRAKQQRGGRAGMLPLQRRVTAAAPDAHAPRMRALLDGISGEAREGEILAVMGASGSGKSTLIDALANRISRDALKGAVTLNGEPLTGNILKSISAYVMQDDLLFPMLTVAETLSFAAEFRLPRALSPAKKRARVQALIDQLGLRAAANTIIGDEGHRGVSGGERRRVSIGTDIIHDPILLFLDEPTSGLDSTSAFMVVKVLRRIAESGSIVITSIHQPSQRILGLLDRLILLSGGRTVFSGTPSALPSYFAEFGFPVPDDENRAEFALDLIREFESSPTGTKPLVDFHRAWQRMHAPSPGSAADADHQSLVPTTMSLKEAISASISRGKLVSGADVAGEAASMHTYANPFWVEMKVLTRRSAINTRRMPELFLIRLGAVVVTGAILATVFFRLDQSPKGAQERLGFFAFAMSTMFYTCADALPVFLQERYVFLRETAYGAYRRASYVLSNAIVSFPPLVVLSLSFAFTTFFAVGLAGGVPGFAFYALAILASFWAGSGFVTFLSGVIPHVMIGYTVVVAILAYFLLFSGFFINRDRIPGYWIWFHYLSLVKYPFEGVLQNEFGRGGECFVRGAQIFDNSPLAALPDAVKARVLASISSALGVGIGADTCLVTGRGVLQQAAVTQLGKWECLLITVAWGFLFRIFFYFSLVLGSKNKRR

SEQ ID NO: 31652 - DNA, 687 bp, Panicum virgatum
  misc_feature: Ceres CLONE 1906740
  misc_feature: Encodes the peptide sequence at SEQ ID NO. 31653
agctgagctaagctgagcaagcagaacaagctcgctctggcgctctgctctagtattttacctaccaaacctcctcactccctccctcccttggtcactctcaattccgatccgtcgctccgcctcctgctgctgaccacccccggcccatcgaatcgctcaattccatccatggataatcaccggcggcagagcagcaccagcagcagcagcagcaccaccaccactaataataataagaagacggctgagctggaccctgtgctgcactcgatcgggttcgagatcgaggaggtgtcgccggcgcagctgacgggccgcctccccgtcacggccaggtgctgccagcccttcaaggtgctccacggcggcgtctccgccctcgtcgccgagggcctggccagcatgggcgcccacatggcctcgggctaccgccgcgtcgccggagtcagcctcagcatcaaccacttccgcagcgccgccgtgggggacgtcgtcctcgcccgcgccgccccgatccacgtcggccgctcaacccaggttaattattcctagctacctagccgtacttgtcatccgatccggagactgtttttttttgtttaattttgtggtgtacaataccaacgttagtgttgcttggatcaattcattgttgcacgtacgcacgcgtcccattaattaaat

SEQ ID NO: 31653 - protein, 127 aa, Panicum virgatum
  misc_feature: Ceres CLONE 1906740
  misc_feature (61)..(127): Pfam Name: 4HBT Pfam Description: Thioesterase superfamily
  misc_feature: Useful for making plants with modulated biomass
MDNHRRQSSTSSSSSTTTTNNNKKTAELDPVLHSIGFEIEEVSPAQLTGRLPVTARCCQPFKVLHGGVSALVAEGLASMGAHMASGYRRVAGVSLSINHFRSAAVGDVVLARAAPIHVGRSTQVNYS

SEQ ID NO: 31654 - DNA, 463 bp, Panicum virgatum
  misc_feature: Ceres CLONE 1906743
  misc_feature: Encodes the peptide sequence at SEQ ID NO. 31655
cgaggacccccccccccctctccaatccttcccccccatggcgtcccaggtagcccccgtcctccccggcatcccgcaggctccggaggaccccctcctgggggtgacggttgcgttccaccaggatccccgccccctgaaggtcaacctccgccgtcgcccctaccggacccaggaagggaagcccctcgtgctgaatgtggtccggtgcgccgagcagatgcttatcaatgacccctctcgttataaggagtacctaccaatcactggtttggctgaattcaataagctgagcgctaagcttatctttggtgctgacagccctgctattcaggagaatagggttgttacagtgcactgcctatcaggaactggttctttaagagtgggaggtgaatttcttgccaagcactaccatgagcgcactatttacatcccaacaccaacctggggaaaccacccc

SEQ ID NO: 31655 - protein, 141 aa, Panicum virgatum
  misc_feature: Ceres CLONE 1906743
  misc_feature: SWISSPROT Homolog: EC 2.6.1.1 Aspartate transaminase
MASQVAPVLPGIPQAPEDPLLGVTVAFHQDPRPLKVNLRRRPYRTQEGKPLVLNVVRCAEQMLINDPSRYKEYLPITGLAEFNKLSAKLIFGADSPAIQENRVVTVHCLSGTGSLRVGGEFLAKHYHERTIYIPTPTWGNH

SEQ ID NO: 31656 - DNA, 452 bp, Panicum virgatum
  misc_feature: Ceres CLONE 1906754
  misc_feature: Encodes the peptide sequence at SEQ ID NO. 31657
ttagttggcatacaagtgccaccgcaagacttcgatgaattcaagagttgtgctgacagtcttgggtacgagtacatgtcagagcacaacaatgagatataccggctgctgttgcgtgatccgaacatttaatgtcgttaggcacatgatgggtgaatggctattttcctttgcccccataaattgatgagactttgcaagcaagattcaactccaaggtagaaggcacaccttgctgcatctgtaggagtaaagccatcgccatacccatttatgtagtgctgatttggcttttgttaacttgttagattgtgtagtgtatctgctattgtgcatctgtaattcgtgctttgtggtctcaattattggtgcaagtcacctaaatttcgcaaataatgataataaatatgtaacccaaatatctgataataatgtattgagatccggactgc

SEQ ID NO: 31657 - protein, 43 aa, Panicum virgatum
  misc_feature: Ceres CLONE 1906754
  misc_feature: SWISSPROT Homolog: EC 4.3.1.19 Threonine ammonia-lyase
LVGIQVPPQDFDEFKSCADSLGYEYMSEHNNEIYRLLLRDPNI

SEQ ID NO: 31658 - DNA, 717 bp, Panicum virgatum
  misc_feature: Ceres CLONE 1906757
  misc_feature: Encodes the peptide sequence at SEQ ID NO. 31659
ctcgccacagcttcgtcaaagacacgcggaaaacaacaagactcggggggtaaagcgagggaggggaggcgacgcggacgaggcccgattccgatccccggtctcccgatccgcgcgttcggttcaagcagcaatggcatcatcttcggacccatgggtgaaagagtacaatgaagcatccaggcttgctgatgacatcagttccatgattgctgatagaggatctcttccgcaatcaggcccagaaattatgcggcatacttcagccatccggagaaaaataactattcttgggactagactggatagcttggagtcattgctggccagaattcctccaaagtcaatcactgacaaggagatgcataagcgccaagacatgctttccaatttgaagtctaaagcaaaacagatggcgacaagtttcaacatgtcaaactttgctaacagggaggatcttcttggacagagtaaaaaggcagatgatatgagcagagttgctggcttagacaaccaaggaattgttggccttcagagacaaattatgaaagagcaagatgagggccttgagaagctggaagagacagtgctgagcacaaagcatattgccttaacagtcaatgaagaacttaccctgcacacacgattgatagatgaccttgaagatcatgttgatgttacaaactcgcgtcttcagcgtgtgcaaaagagacttgc

SEQ ID NO: 31659 - protein, 194 aa, Panicum virgatum
  misc_feature: Ceres CLONE 1906757
  misc_feature (140)..(192): Pfam Name: SNARE Pfam Description: SNARE domain
MASSSDPWVKEYNEASRLADDISSMIADRGSLPQSGPEIMRHTSAIRRKITILGTRLDSLESLLARIPPKSITDKEMHKRQDMLSNLKSKAKQMATSFNMSNFANREDLLGQSKKADDMSRVAGLDNQGIVGLQRQIMKEQDEGLEKLEETVLSTKHIALTVNEELTLHTRLIDDLEDHVDVTNSRLQRVQKRL

SEQ ID NO: 31660 - DNA, 1408 bp, Panicum virgatum
  misc_feature: Ceres CLONE 1906778
  misc_feature: Encodes the peptide sequence at SEQ ID NO. 31661
aactcgcatctgctcgacaaaactgacaccgtggtccccaccccaccacactgccccgctcatccctcgttcgccccgccgccgccgacaaaaccccctcgacgaaccctcgccgcgctgggaatggcggactcgcccgcgcagttccggggccaggcgcgcctcccgcgcttcgccgccccgctccgctacgacctccgcctccgccccgacctcgccgcctgcaccttctccggcgccgcggccgtcgccgtcgcggtgtccgcacccacccgcttcctcgtcctcaacgccgccgagctcgacgtcgaccgcgcatccatccgattccaggacttggtgccgacagatgtgacgcagttcgaggaggatgagatcctggtcatcggattcgaccgggagctgaccatcggcgagggcgtgctcgccatggacttcactgggactctcaacgatcagatgaggggattctacaggagcaaatatgtgtgcaatggggagtcaaggaacatggcagttacacagtttgaagctgctgatgcgcggcggtgctttccatgttgggatgagcctgcatttaaggctaagttcaagctaacactggaagttccatctgacctgatcgcattgtccaacatgccagtggttaaggagacagtcagtggacctataaagactgtttattatgaggaatctccacttatgtcaacttatcttgtggctatagttgttggcttatttgattacatagagagctcaacatcagaggggaccaaagttcgcgtgtatactcaagttggcaagactaatcaaggaacgtttgccctagatgttggtgtgaagtcactggatctatataaagattattttgccactccttatccgctacctaagttggatatgattgctattccggattttgctgctggggccatggagaactatgggctagtcacctaccgtgaaacagctttgctgtatgatgagctacaatcatcagcatccaacaaacaacaggtagcaataactgttgcacatgagttggctcaccaatggttcggcaatcttgtgaccatggaatggtggactcacttgtggctaaatgagggttttgcttcctgggtaagctatttagcagtagattctttgtttcctgagtggaataactggacacaattccttgatgagacgacctctggccttagactggatgcacttgccgaatctcatcctatcgaggttgaaataaaccatgctagtgaaattgatgcaatttttgattccataagctatgacaagggagcttctgttattcgtatgctacagagttaccttggtgcagagcgttttcagaaagctttggcttcatatataaagaagtatgcctactcaaatgctaagactgaag

SEQ ID NO: 31661 - protein, 428 aa, Panicum virgatum
  misc_feature: Ceres CLONE 1906778
  misc_feature (14)..(393): Pfam Name: Peptidase_M1 Pfam Description: Peptidase family M1
  misc_feature: SWISSPROT Homolog: EC 3.4.11.7 Glutamyl aminopeptidase
MADSPAQFRGQARLPRFAAPLRYDLRLRPDLAACTFSGAAAVAVAVSAPTRFLVLNAAELDVDRASIRFQDLVPTDVTQFEEDEILVIGFDRELTIGEGVLAMDFTGTLNDQMRGFYRSKYVCNGESRNMAVTQFEAADARRCFPCWDEPAFKAKFKLTLEVPSDLIALSNMPVVKETVSGPIKTVYYEESPLMSTYLVAIVVGLFDYIESSTSEGTKVRVYTQVGKTNQGTFALDVGVKSLDLYKDYFATPYPLPKLDMIAIPDFAAGAMENYGLVTYRETALLYDELQSSASNKQQVAITVAHELAHQWFGNLVTMEWWTHLWLNEGFASWVSYLAVDSLFPEWNNWTQFLDETTSGLRLDALAESHPIEVEINHASEIDAIFDSISYDKGASVIRMLQSYLGAERFQKALASYIKKYAYSNAKTE

SEQ ID NO: 31662 - DNA, 613 bp, Panicum virgatum
  misc_feature: Ceres CLONE 1906778-R
tatgatgctctcctcaaaatctacagagaaacagctgaaccataggagaaatcacgtgtcttaggctccctgtcttcatcaccagataaggatattgttttggaggcattgaactttatgttactgatgaggtacggaatcaagattcatactatatccttggtggcattagcttagaaggacgtgatgttgcatggacctggctgaagacaaactgggatcatgtgttgaagacgtggaattcgagctcactcatatctgacttcatcaactccattgtttcaccgttcacatctgaagagaaagctgctgaggtgtccgagttctttgcctgccgcatgaagccgtcgttccagagagcgctgaagcagagcctcgagagggtgcggatcagcgcaaggtggatcgagagcatcaggagcgagcccagccttggtgaggcggtgcaggagctgctgcgcggcgcagcctagacatgcggctccaaacagctgttctttagtgtgatcacctcatctcatgtgagtccgcatgacggttctcttggaaatgttcttccgggcgtggctctgacagtgtatggtcggttgcttgtacatgatctgtgttgcgg

SEQ ID NO: 31663 - DNA, 716 bp, Panicum virgatum
  misc_feature: Ceres CLONE 1906782
  misc_feature: Encodes the peptide sequence at SEQ ID NO. 31664
agctaccagacacacccaccccgccatggccatccatctccgcgcccacgccttcgcggcgaacccgctgcgtggcgtctccgcctccaccaccgccgtctccccctccgcggccgccgaggccctgcgctccctcctcgagcccggctccgccgccgcggacgccgccaatccccacccgccgcacctctccaagatcctccctttccgccggggccgcccgctcgcgcgctccccggaccctcctgcctctgctccacccgcggcgccagcctggcgcctcgcgtggctcccgccctcccgcgtccccggggtcgccccggacgccttcgtcttcctgggtgcgcacgccgaggggggcggcaaggaggccgcggcgtactgggccgtcgatgtcagcgacggcgaggggccgagggtcgacggcggctcgggggacggggatgggtcggcgtttgtggacctgagaacgctcatggtggccacggactggagcgacaacgacgccatgggggacctcgccatcgccggacatgctcgagcactgctggagtggcacaataccgcaaaattttgtggagcttgtggagcgaaggctgttcctacagaagccggcaggcgtaagcagtgcagctatgagtcctgcaagaagaggatataccctcgagttgacccggttgtgatcatgctggtcatcgataaagaaaatgaccgtg

SEQ ID NO: 31664 - protein, 230 aa, Panicum virgatum
  misc_feature: Ceres CLONE 1906782
  misc_feature (55)..(177): Pfam Name: NUDIX-like Pfam Description: NADH pyrophosphatase-like rudimentary NUDIX domain
  misc_feature (179)..(212): Pfam Name: zf-NADH-PPase Pfam Description: NADH pyrophosphatase zinc ribbon domain
  misc_feature: SWISSPROT Homolog: EC 3.6.1.22 NAD(+) diphosphatase
MAIHLRAHAFAANPLRGVSASTTAVSPSAAAEALRSLLEPGSAAADAANPHPPHLSKILPFRRGRPLARSPDPPASAPPAAPAWRLAWLPPSRVPGVAPDAFVFLGAHAEGGGKEAAAYWAVDVSDGEGPRVDGGSGDGDGSAFVDLRTLMVATDWSDNDAMGDLAIAGHARALLEWHNTAKFCGACGAKAVPTEAGRRKQCSYESCKKRIYPRVDPVVIMLVIDKENDR

SEQ ID NO: 31665 - DNA, 698 bp, Panicum virgatum
  misc_feature: Ceres CLONE 1906788
  misc_feature: Encodes the peptide sequence at SEQ ID NO. 31666
acacagatcggtgcatcacactccaagtccaactagcatcagctccgtgcgtcttgcagcaccttgccagccatggccgccgcggctcccgtgtctgttcgccgcatcaagctgggctcccaggggctggaggtctcggcgcagggcctcggctgcatgagcatgtccgccttctacggcccgcccaagcccgaggccgacatgatcaagctcatccaccacgccgtcgccaccggagtcaccttgctcgacacctccgacgtctatggcccgcacacaaacgagatcctcctcggcaaggcgctgcagggcggggtgcgggagaaggtgcagctgggcaccaagttcggcgtcaacttcgccagcgccactgatgtcgacatccgcggggacccggcgtacgtgcgcgcggcgtgcgagggcagcctcaagcggctcggcgtagactgcatcgacctctactaccaacaccgcatcgacaagagggtgcccatcgaggtcacgatgggtgaactcaagaagctagttgaagaaggaaagataaagtacattggattatctgaaacttcggcatcgacgattagaagagctcatgcagtccatcctattactgcagttcaactggaatggtcattatggtgtagagacgtagaagaagatataattcccacttgcaggtacttttgtgagcccattat

SEQ ID NO: 31666 - protein, 208 aa, Panicum virgatum
  misc_feature: Ceres CLONE 1906788
  misc_feature (15)..(207): Pfam Name: Aldo_ket_red Pfam Description: Aldo/keto reductase family
  misc_feature: SWISSPROT Homolog: EC 1.1.1.65 Pyridoxine 4-dehydrogenase
MAAAAPVSVRRIKLGSQGLEVSAQGLGCMSMSAFYGPPKPEADMIKLIHHAVATGVTLLDTSDVYGPHTNEILLGKALQGGVREKVQLGTKFGVNFASATDVDIRGDPAYVRAACEGSLKRLGVDCIDLYYQHRIDKRVPIEVTMGELKKLVEEGKIKYIGLSETSASTIRRAHAVHPITAVQLEWSLWCRDVEEDIIPTCRYFCEPI

SEQ ID NO: 31667 - DNA, 1750 bp, Panicum virgatum
  misc_feature: Ceres CLONE 1906795
  misc_feature: Encodes the peptide sequence at SEQ ID NO. 31668
aacggcgcctgatgctcacgccatctccccctccatcctctcgctagagttacggcaaggcaaccgacgcggcggcgctccgcctccctcccgttccgcgcgccgccacccccccatggcgtcgctgctccgcctccaggccttcgctccagccctaaacgttccccgcaaccgttgcttcctctccccgctcggcctagcctccgcggccactgctccgctggctcgccgcctctccaccgccgcctccaccagctcgccggtgccgccatcctcggaaccgaatctggagtcaggtctgtatcttgtcgcaacgccaattgggaacctggaagatatcaccttgcgggcactgcgtgtccttaaatgtgctaatgtgatattatctgaagacacaaggcattctggaaagctgctccagcactataacatcaaaacacctcttcttagcttccataagttcaatgagcgtgagagagagcccagtatcttaaggaggcttcaggaaggtgaagcagttgcattgataagtgatgccggaactccaggcattagtgaccctggcatggaattggctagactatgcgcagctgagaaaatttctgtcgttcccattcctgggccttcggctgcaattgctgctctttctgcatcgggtttgccatctaatgaattcacatttgttgggtttttaccaaagcatgctcggtcaagaagagataggcttgagatatctgcccgtgaagctgctacacaaatattctatgttcctccccatggtattcatcaatttcttgttgatgctgcttcatcttttggcgattcaaggtcatgtgttattgcaagggagataacaaaattacatgaagagttctggcgtggaactctaggtgaagcaaatgaagcctttgcaactcgacagcctaagggagaaatcacagtgctcatagaggggcagttaatttcagttgatgaaactccatcagaggatttccttgagcatgaactaagagaattgatggcaaagggacataccctttcagcggcggtgaaattggtcactgaagctacatcagcaaagaagaaagatgtttatgctcttgcattgaggttgtttggaaaatgagtaaaatgcaacttttgatcgcatctgaatgaggtggacatcttccttctatcaaagccaaaggtggagtccatgtaactccatccttccagaagccatctttcatcctcaacgctgtaaaagagtgagagtgaccatgaactgtcagacaatgtgcaagtgcaaggaacgtacttagtctggcttgcatgtcatgtcttgtgcaaaccagccgcaggttcaccactgctggaacgccccaccaccactgttgtcaggcaacagaggccttgattcagttcgtcagtttcgtcagacaagtgaacaagtcgagctgcaaggtagtcagcgctattcaagacgtttcggcgacttcacccggatcgtttgatgctcatccgacggcttgaaggatgtaggaattagcagttcattctgtttaaactctgtttaattcagttaatctatgtttaagttaatgaccacgccacctgctatttaggttggtagggactctgtaatcagcaagcgggagtgaaccataagatattcgatagggcagaagtagctctaggcccccccatgaggatgttattttgtatttagccgatgactaacagcagcatgatatggtgagttatgggc

SEQ ID NO: 31668 - protein, 336 aa, Panicum virgatum
  misc_feature: Ceres CLONE 1906795
  misc_feature (61)..(262): Pfam Name: TP_methylase Pfam Description: Tetrapyrrole (Corrin/Porphyrin) Methylases
MASLLRLQAFAPALNVPRNRCFLSPLGLASAATAPLARRLSTAASTSSPVPPSSEPNLESGLYLVATPIGNLEDITLRALRVLKCANVILSEDTRHSGKLLQHYNIKTPLLSFHKFNEREREPSILRRLQEGEAVALISDAGTPGISDPGMELARLCAAEKISVVPIPGPSAAIAALSASGLPSNEFTFVGFLPKHARSRRDRLEISAREAATQIFYVPPHGIHQFLVDAASSFGDSRSCVIAREITKLHEEFWRGTLGEANEAFATRQPKGEITVLIEGQLISVDETPSEDFLEHELRELMAKGHTLSAAVKLVTEATSAKKKDVYALALRLFGK

SEQ ID NO: 31669 - DNA, 346 bp, Panicum virgatum
  misc_feature: Ceres CLONE 1906803
  misc_feature: Encodes the peptide sequence at SEQ ID NO. 31670
aagaggaggcgagcgaccggccgattcgagcagcagccagctagccatggcgacgcaggccgcgctgttcgctgggttctcgcagctcgccgcgcagccggcccgcgaccgcgccgggacgggggcgccggcgcgggttggcgtgacggcgatcgggggcgccagggcggggggcgtgaaggcgggggccgccgggcccgggtgggcggcggagccatgttgtgtgtggtgccgggcacaatatgattgatcctccccgggggcggctggcgcacccccaggccccacacgaggccggcccggacgaggccctgcaactggaggctgcgtgactgccgcaccgacg

SEQ ID NO: 31670 - protein, 67 aa, Panicum virgatum
  misc_feature: Ceres CLONE 1906803
  misc_feature: The sequence is a functional homolog of SEQ ID NO 4 in US patent 7038109
MATQAALFAGFSQLAAQPARDRAGTGAPARVGVTAIGGARAGGVKAGAAGPGWAAEPCCVWCRAQYD

SEQ ID NO: 31671 - DNA, 663 bp, Panicum virgatum
  misc_feature: Ceres CLONE 1906810
  misc_feature: Encodes the peptide sequence at SEQ ID NO. 31672
agctcagctcagaaccaccacacacgggagataactcaactcaactgggactttgggccatgctgccgaccttctcgccgacggcgagcgcctcggcgacgcctccgccgcggccgataccaggcagctacggcccgccggtgatcggcgcgctccgggaccgcctcgactacttctggttccagagccaggacgagttcttccgccgccgcgccgccgcgaaccggagcaccgtgttccgcaccaacatcccgcccacgttccccttcttcgtcggcatcgacccgcgcgtggtcgccgtcgtcgacgccgccgccttcaccgcgctcttcgacagcaccctcgtcgacaagcgcgacgtcctcatcggcccctacaaccccggcgccggcttcaccggcggcacccgcgtcggcgtctacctcgacaccgaggagcccgagcacgagcgcgtcaaggagttcgccatggccctgctccaccgcggcgcccaggcctggcccgccgagctccgcgccggcgtggacggcatgctcgacgccgtggaggccgacctcgccaaggccaccggcgacaagccctccgccagctacatcgtcccgctgcagcaatgcatcttccgcttcctgtgcaaggcgctcgtcggcgccgaccccgccgccg

SEQ ID NO: 31672 - protein, 201 aa, Panicum virgatum
  misc_feature: Ceres CLONE 1906810
  misc_feature: SWISSPROT Homolog: EC 4.2.1.92 Hydroperoxide dehydratase
MLPTFSPTASASATPPPRPIPGSYGPPVIGALRDRLDYFWFQSQDEFFRRRAAANRSTVFRTNIPPTFPFFVGIDPRVVAVVDAAAFTALFDSTLVDKRDVLIGPYNPGAGFTGGTRVGVYLDTEEPEHERVKEFAMALLHRGAQAWPAELRAGVDGMLDAVEADLAKATGDKPSASYIVPLQQCIFRFLCKALVGADPAA

SEQ ID NO: 31673 - DNA, 735 bp, Panicum virgatum
  misc_feature: Ceres CLONE 1906819
  misc_feature: Encodes the peptide sequence at SEQ ID NO. 31674
tgtacaccaattgcagcccatcaaatccccaaagcataccaccaaagaaatcagcatggcaatccggtcggcgtgcttgttgttactgctaaccgcctccatgttcttttccacactcccggccgccgacgccgacgatgaggcggcgctgctggccttcaaggcggcagcggttggcggcaatagcaacgcgctcgcttcctggaatgggagcaccgatggtggatactgcagctgggagggggtgaggtgccgcggcaggcaccgtcgagtggtggcgctgagcctgccatcctatgggctcactggcgtgctctcgcctgccgtcggaaacctgtcctccctgaggattcttaacttgacctacaacgaattcagcggtaacatccccgcgagcctcggtcgtcttggccacctccgcatcctcaacttgagccaaaatgccttctctggcccgctccccaccaacctgagctcatgcactagcttaatggtgatgcacctccgcttcaaccagctcagcgggagcgtgccttctgagttcggcgacaaactgatgagtcttaggattctcacccttaggaacaacagcctcaccggttccatcccagcatcgctgggcaacttatcttcattgggttatctggaactagcatttaaccagcttgagggcgctatcccgcacaacattggcattctcaagaatctcttgtttcttgggctcgactacaacac

SEQ ID NO: 31674 - protein, 226 aa, Panicum virgatum
  misc_feature: Ceres CLONE 1906819
  misc_feature (25)..(67): Pfam Name: LRRNT_2 Pfam Description: Leucine rich repeat N-terminal domain
  misc_feature: SWISSPROT Homolog: EC 2.7.11.1 Non-specific serine/threonine protein kinase
MAIRSACLLLLLTASMFFSTLPAADADDEAALLAFKAAAVGGNSNALASWNGSTDGGYCSWEGVRCRGRHRRVVALSLPSYGLTGVLSPAVGNLSSLRILNLTYNEFSGNIPASLGRLGHLRILNLSQNAFSGPLPTNLSSCTSLMVMHLRFNQLSGSVPSEFGDKLMSLRILTLRNNSLTGSIPASLGNLSSLGYLELAFNQLEGAIPHNIGILKNLLFLGLDYN

SEQ ID NO: 31675 - DNA, 651 bp, Panicum virgatum
  misc_feature: Ceres CLONE 1906822
  misc_feature: Encodes the peptide sequence at SEQ ID NO. 31676
ctctctctcctctcatccccagctcacccccgcgacgcggctgcgcaagtccaagcacagcgtgtggttcaactcccccgtcgacgtcgagggcctccggctgcacgactaccacgccatcatccgccgccccatggacctcggcaccgtcaagcggaacctcgccgccggccgctactacccctcgcacgaggccttcgccgccgacgtccgcctcaccttcaacaacgccgcgcgctacaacccgcccgaccaccacgtgcaccgctacgccggcagcctcctcgccacgttcgaggggctctacggggaggccgtcgcgtggttcgagcagcagcagcagcaaccggtctccgtgccggtgcagccggcgccccctcgggtgggggctggtgggaggaggcccaagcccaaggcgagggagctgaacaagagggacatggacgaggaggagaagcagaagctgagggtggagatcgagagcctgccggaggagaagatggtgaacgtgctgcagatcgtgcagaagaggaacagtgatccggcgctgacgggggaggtcgtggagctcgatttcgacgagctggatactgagaccctgtgggagctcgaccgattcgtggtcaattggaggaaggcgatgaagaagac

SEQ ID NO: 31676 - protein, 216 aa, Panicum virgatum
  misc_feature: Ceres CLONE 1906822
  misc_feature (2)..(93): Pfam Name: Bromodomain Pfam Description: Bromodomain
  misc_feature: SWISSPROT Homolog: EC 2.3.1.48 Histone acetyltransferase
SLSSHPQLTPATRLRKSKHSVWFNSPVDVEGLRLHDYHAIIRRPMDLGTVKRNLAAGRYYPSHEAFAADVRLTFNNAARYNPPDHHVHRYAGSLLATFEGLYGEAVAWFEQQQQQPVSVPVQPAPPRVGAGGRRPKPKARELNKRDMDEEEKQKLRVEIESLPEEKMVNVLQIVQKRNSDPALTGEVVELDFDELDTETLWELDRFVVNWRKAMKK

SEQ ID NO: 31677 - DNA, 1672 bp, Panicum virgatum
  misc_feature: Ceres CLONE 1906826
  misc_feature: Encodes the peptide sequence at SEQ ID NO. 31678
ctctcgctctctgctctctatctacttacccagcacatacacaatccaaccttcacagtccacacagccaatagatacagacagaaggatgaagctgagagcaaaaggcctcggcctcctgcttctccttgccttccttgctctttgctccaccattgatgtcagcgaggcaagaagaggcaagcattggaggcctaggagctcaccaggctcctcacagctgaagaaaggcgaaggaaagaagagtagctcccacaggcaacatggcaacaaccggccaagtccgaagcctccggtcagctcaacaccaagccctggtgctggcaaaggaaatcagaatccgtaccagccaagtccaactccggatgcccctgtcagcccaagtccaagccctgccaacagcagtaggcatccgagtcccaagcggccgactccaagctgtggaaagggtcatcaacagccattgcggccaccactgccaccacctgcctcacagggtgcagtcttcaacgtggttgattttggagccaagggtgatggagtaacagatgatactaaggcttttgaaggagcctgggctgctgcctgcaagcagggggcatctacagttctcgtaccaccagaactagagttccttgttgggccaatttcgttctctgggccttactgcaaaccaaacattgttttccagctggaaggaacaatcctagctccaaccagtgctaaagcctggggttctggcttgctccagtggcttgagttcaccaaactaaatggaatagtaattcaaggcagtggcatcataaatggcagagggcaacaatggtggacctactcagacccagaggatgaggatgatgatgacactgtaagaactagccaccaagtgcatgattgtcaataaattaatcgaatgaaaagttggttgtgtttgtttaccttggatactttcctgcagtacgatgtggagctcgatagaatgccacagattaaacctacagtaagaatatcaattatctttctggcattattatcacgtacagaaacaaagttatgataaatcagattttgtaacctgatgcaggcattgaggttttatggtagtttcaacatcttagtagctggcatcactattgtcaacagctcacagtgccatcttaagtttgacaactgtcaaggagtgatggtccacgatgtgactatatcctcccctgagaacagtctcaacactgacggaatacacctgcagaactccaaagatgtcagcattcatcatacaaacatggcttgcggtgacgattgtatctccatccagacaggatgcagcaacataaatatacacaacgtgaattgtggaccaggccatggaatcagcataggtggactgggacgggacaacacaaaagcatgtgtgtcaaatgttacagtaagagatgtcaacatgttcagaaccatgaatggtgtcaggatcaagacctggcagggtggtgtaggattggttcaagacataaggttctcaaatatacaagtctcagaagttcaaacacctattattatagatcagttttattgtgacaaaagcacttgcagaaatcaaacatcagcagtggcagtatcagggggtcagtatgagaacatcagaggaacatttacaatcaaacctgtccacttt

SEQ ID NO: 31678 - protein, 197 aa, Panicum virgatum
  misc_feature: Ceres CLONE 1906826
  misc_feature (1)..(197): Pfam Name: Glyco_hydro_28 Pfam Description: Glycosyl hydrolases family 28
  misc_feature: SWISSPROT Homolog: EC 3.2.1.15 Polygalacturonase
  misc_feature: Useful for making plants with altered carbohydrate content
  misc_feature: Useful for making plants with altered cell wall content and/or composition
MQALRFYGSFNILVAGITIVNSSQCHLKFDNCQGVMVHDVTISSPENSLNTDGIHLQNSKDVSIHHTNMACGDDCISIQTGCSNINIHNVNCGPGHGISIGGLGRDNTKACVSNVTVRDVNMFRTMNGVRIKTWQGGVGLVQDIRFSNIQVSEVQTPIIIDQFYCDKSTCRNQTSAVAVSGGQYENIRGTFTIKPVH

SEQ ID NO: 31679 - DNA, 440 bp, Panicum virgatum
  misc_feature: Ceres CLONE 1906826-R
  misc_feature: Encodes the peptide sequence at SEQ ID NO. 31680
gtccactttgcatgcagtgacagcttaccttgttcagggatctcccttaccggtgtgcaactcagaccagtgcaagtaccccactaccatctgaacaacccattctgctggcaggctttgggggaactctacaccccgactgtccctcccatagcttgcttgcagattggaaaacctgctgggaacaacttgcagacatataacgatatatgttgatacactataagtgcctcgtctgttgattggtgcttaccatgagtggtcgttgtgatacatccgacccctttgcaccattgcttggttatgtgcatatatacagttattttgatgccatttattagaacttttaacatacatataatcatttgaatggttatacagcaagagtatgtacttgagttttccaaatatgagtaaacatgatgaccaagattgtcttc

SEQ ID NO: 31680 - protein, 71 aa, Panicum virgatum
  misc_feature: Ceres CLONE 1906826-R
  misc_feature: Useful for making plants with altered carbohydrate content
  misc_feature: Useful for making plants with altered cell wall content and/or composition
VHFACSDSLPCSGISLTGVQLRPVQVPHYHLNNPFCWQALGELYTPTVPPIACLQIGKPAGNNLQTYNDIC

SEQ ID NO: 31681 - DNA, 718 bp, Panicum virgatum
  misc_feature: Ceres CLONE 1906843
  misc_feature: Encodes the peptide sequence at SEQ ID NO. 31682
aaaatccaatctcgcggcgggctgggccggtgatcgtgaatccggcttgcgttgggcggcgccatggcgagcaacagggcaggcggcgccggctacgactacgagagcggcagcgaccacgacggcgcgctgcagaagccgctgctgcccaacagcgggagctggtaccggatggggatggggtcgcgccagtccagcctcaacgccgggacctcctccatggccgtcctgcgcgagtcccacgtctccgccttgctctgcacgctcatcgtcgcgctcggccccatccagttcggcttcaccggtggctactcgtcaccgacgcaggacggcatcatccgggacctcaacctctcaatttccgagttctctgtgttcggatcgctgtccaatgtcggcgccatggtcggggccatcgccagcgggcagatggctgagtacgttggccgtaaagggtcattgatgattgcagcgattccgaacgtcattggttggcttgcaatctcctttgcaaaagactcttcgtttctgtatatgggacgcttgcttgaaggatttggtgttggtatcatttcctatgtggtaccagtatacatagcagagatatctcctcagaacatgagaggagctcttggctctgtgaaccagttgtctgtaacccttgacatcatgtttgtctatttgctcggcatgttggttccttggaggcttcttgcag

SEQ ID NO: 31682 - protein, 218 aa, Panicum virgatum
  misc_feature: Ceres CLONE 1906843
  misc_feature: Useful for biocontainment applications
MASNRAGGAGYDYESGSDHDGALQKPLLPNSGSWYRMGMGSRQSSLNAGTSSMAVLRESHVSALLCTLIVALGPIQFGFTGGYSSPTQDGIIRDLNLSISEFSVFGSLSNVGAMVGAIASGQMAEYVGRKGSLMIAAIPNVIGWLAISFAKDSSFLYMGRLLEGFGVGIISYVVPVYIAEISPQNMRGALGSVNQLSVTLDIMFVYLLGMLVPWRLLA

SEQ ID NO: 31683 - DNA, 702 bp, Panicum virgatum
  misc_feature: Ceres CLONE 1906850
  misc_feature: Encodes the peptide sequence at SEQ ID NO. 31684
atccagcccagcatacccacttcgcctctcgtcgtctgctcggccgatctcgcgcagcgccgccgccgccgccggatccctgaatctgaacccctgtcgtcttgcccagcctcgagcacgtcccccttccccctcctctaccctccctccgttcgattcgagcttgccgttagggttcttgaccccgctccaccttctcccatggcggatgaagccaaccgaacggcgttcatggagctgcaggcccggatgtttgataccaccggaaagatcaagcagttacaaacccaaatgcgttctaaagagggggaaaagaagcgtgcttacctcactctggaggaactccgccaattgccagaggacactaacacctacaagactgttggtaaggaagaatttttgagtagataatcttgtttcgcttctgaagccaagattacccattacataatttccttgtccatgaagtgtgttgaagaccaattgagttctctctaacatgctgccaatttttaatttttttttgaaaactctgccaattattattgtcgaatgatctacacagtgatcaggtgtcaatagtgagtattattatatatatagtcaatgaaagttgttgtcacctgtgactatcttcactctgaacctatctgggttatgttatttgtagctgataactatcttgaatgttgtgcttccatc

SEQ ID NO: 31684 - protein, 69 aa, Panicum virgatum
  misc_feature: Ceres CLONE 1906850
  misc_feature: Useful for making plants with altered terpenoid content
MADEANRTAFMELQARMFDTTGKIKQLQTQMRSKEGEKKRAYLTLEELRQLPEDTNTYKTVGKEEFLSR

SEQ ID NO: 31685 - DNA, 728 bp, Panicum virgatum
  misc_feature: Ceres CLONE 1906861
  misc_feature: Encodes the peptide sequence at SEQ ID NO. 31686
aaattaaaacgcggccatcccgccgccgtgcggctcggaaccctcgccgacgaggtcacccgggagtctccgccgccggcgagccccccgctgccgccaccgaaggcaaccaggccggcgaagcatagcttcatctcgctcccagtcaaggcagcccccggaaggcgcgcagactgtagtagataaaatgcagccatcccgccgccgtgcggctcggataattcgcccgacggcgacgaggttgccctggagtctccgccaccgccgaggcgccgaccccgagcccccgccgccgccgcccaagatcgtacccttggcaaccggatcatattctaaagcccaacctgcgcagatgctgtccaatagcagggattggtcggagctgcccgtggacgtcctcccgttggtttttgcaaaccttggtgcaatcgatatccttatgggctcaggcctcgtgtgccactcatggctcgaggcggccaagctgactgatctgtggcgatccgtggacatggccaaccacgaggcgctggaaaagatggatgacgatatcctgtgtgcaatggcgaaggtggccgtggaccgctccaagggccagctggaggtgttcttggggaagctttttgtcaatgatgagattcttaagtatataggggacaggtcagcatctctgaggagccttagcctcatatcatgccacgatatcaccaacaaaggattcactgact

SEQ ID NO: 31686 - protein, 125 aa, Panicum virgatum
  misc_feature: Ceres CLONE 1906861
  misc_feature (6)..(54): Pfam Name: F-box Pfam Description: F-box domain
MLSNSRDWSELPVDVLPLVFANLGAIDILMGSGLVCHSWLEAAKLTDLWRSVDMANHEALEKMDDDILCAMAKVAVDRSKGQLEVFLGKLFVNDEILKYIGDRSASLRSLSLISCHDITNKGFTD

SEQ ID NO: 31687 - DNA, 741 bp, Panicum virgatum
  misc_feature: Ceres CLONE 1906892
  misc_feature: Encodes the peptide sequence at SEQ ID NO. 31688
gtccatcggcttccttcctcccctgttctcctcgatccctcgccgccgctggtccggctccatccatcgtcccaaccgcttcgtctttctcgcgcagctgtcgcaggtccccctagcgcctagagtttgctgagtccgtcggcccaagataatggctggacaccgaaacagtcatggaaaacggcactctgattatgctgaaaatggaggtggtaagagaagaaatcctggtgatgattcctatgctcctggtcccgatgatactgtgtatcgctacctctgctcctctagaaaaattgggagtatcattggccgtggtggagagattgcaaagcagttgaggaccgagactcaagctaagattaggattgacgagagtgttcctgggtgtgaagagcgagttatcacaatatttagctcaagcagggaaactaatactattgatgatgctgaagataaggtttgctctgctcaggatgctctctttagagttcatgagaggcttgcttctgatgagggtcctgggaatgaagacagtgaagaagttgtacctcaagttactgttcgtttgcttgtgccatcagaccagattggatgcattattggaaaaggtgggcatatcatccaaggaatccgcagtgagactggtgcgcaaatacgtgtgcttagtaatgatcatatcccatcatgtgccattgatggtgatgaactcctccagatatcggggatgctgtagttgtc

SEQ ID NO: 31688 - protein, 194 aa, Panicum virgatum
  misc_feature: Ceres CLONE 1906892
  misc_feature (137)..(194): Pfam Name: KH_1 Pfam Description: KH domain
  misc_feature (39)..(104): Pfam Name: KH_1 Pfam Description: KH domain
MAGHRNSHGKRHSDYAENGGGKRRNPGDDSYAPGPDDTVYRYLCSSRKIGSIIGRGGEIAKQLRTETQAKIRIDESVPGCEERVITIFSSSRETNTIDDAEDKVCSAQDALFRVHERLASDEGPGNEDSEEVVPQVTVRLLVPSDQIGCIIGKGGHIIQGIRSETGAQIRVLSNDHIPSCAIDGDELLQISGML

SEQ ID NO: 31689 - DNA, 2151 bp, Panicum virgatum
  misc_feature: Ceres CLONE 1906912
  misc_feature: Encodes the peptide sequence at SEQ ID NO. 31690
gcaacattttttttcttcctcccttctctcttgcaatcgcaaaaacctcctcctctgcagtctgcagtccccgacatcttctccgatcgccccgtgccgccgccgcctcctcttcttcatactattgcccgccgcctccgccgcctcatcacccgccgtttacggcggtgcgggatggctctctccgccggcgatgtgccgaccatgtacgctgtcctcgtcaactcgctcagcgccgacgaggctgcgcgccgcccggcggaggcagctctcgcgcagtgcgagacccgcccgggtttctgctcctgcctcctggagatcatttcggcgaggggattggcttgtcgcgaggatgtgcgcctcctcgccacggtctattttaagaacagtatcatccgctactggcggcatcgccgcgattcctatggaattagcaatgaggagaaggaccaccttcggaaaaatcttctgctaaatattcgtgaggagaatagccagctagctgtactaatatccaagattgcgcgcttggattacccaaaagagtggtcagaccttctctctgtattggcacaacaactgcaatctgctgatgttcttgcttcgcatcgcgtgtttatggtcctctttcgaactttaaaggagctttcaactaaacggcttgccgtggatcaaaagaattatgcagagatcactggccacttgtttgagtacacctggaacctttggaagagcgatgtgcagactatattgcagaatctttctatgctcttgcagcgaaatgacatggattccattttggagcaatcaaacgaccttattttgatttgcgaccggtggttgctctgcttaaagatcattcgacaactaattttttcaggttatgctagtgactcaagaactgcactggaggtctggcaggtcagggaagtttgtccaacggttttgacagccattaaatcccttcttccatattacgactcctttaaagacaagcaaactaaactctgggactttgcaaaaagggcatgcattaaattgatgaaagtccttgttaccttacacggcagacatccatattcttttgttcaccaaactgtgcttccagctatagttgacttctgcttaaacatgattacaagtcctgaacaggctggcacatctttcgaggagtttcttatacaaagcatggttttggttaaatcagtattggagtgcaaagaatacagaccaagtcccacagggcgggtgacccatgaaaatgcacagcctttaagtctggagcaaagaaagaaaaactttgctgcagtggctagtgacatgctgaaggtcgttttgcctggtgatcgagtcatgttgctttgcaacattttagtaaggaaatacttcatttacacagcaaaagatttggaagaatggtcagagaatcctgagtcctttcaccatgagcagaatttggttcagtggactgagataaaacggccatgtgctgaagccctcttcattgttatcttcgagaagtatagagagctgctagctccagttgttgtttctgttcttcgcgaagctatggctgtttctccaccacaagaaactgatgttactgctggaatgcttttaaaggatgccgcatatacagctgctgggcatgtttattatgaactttcgaactacctcaattttaatgaatggttccatggatctctatctattgaagtttcaaatcatcaccccaacatgcgtatcattcgtagaaaaattgcattgctacttgggcaatggatttctgagatcaagggtgacactcggaaattggtctaccacgctttggttggattgctgcaggataatgacatagctgttaggctagcagcatgctcttctctgtgttatctattccaagaatctagtttttcggaactagatttgtttgaatgtcttcctacatgttggacaatgagtttcaagttgatagaagatgttcaagaatttgattcaaaggtgcaagtgttgaacttcatttcagttcttcttgaacatgctggagacaagattattccattcgcaagtcagttatcacaattttttcagatgatatgggatgaatctgcaggtgaaagtttgctacagattcaattgctaacggcactg

SEQ ID NO: 31690 - protein, 658 aa, Panicum virgatum
  misc_feature: Ceres CLONE 1906912
  misc_feature (29)..(104): Pfam Name: IBN_N Pfam Description: Importin-beta N-terminal domain
MALSAGDVPTMYAVLVNSLSADEAARRPAEAALAQCETRPGFCSCLLEIISARGLACREDVRLLATVYFKNSIIRYWRHRRDSYGISNEEKDHLRKNLLLNIREENSQLAVLISKIARLDYPKEWSDLLSVLAQQLQSADVLASHRVFMVLFRTLKELSTKRLAVDQKNYAEITGHLFEYTWNLWKSDVQTILQNLSMLLQRNDMDSILEQSNDLILICDRWLLCLKIIRQLIFSGYASDSRTALEVWQVREVCPTVLTAIKSLLPYYDSFKDKQTKLWDFAKRACIKLMKVLVTLHGRHPYSFVHQTVLPAIVDFCLNMITSPEQAGTSFEEFLIQSMVLVKSVLECKEYRPSPTGRVTHENAQPLSLEQRKKNFAAVASDMLKVVLPGDRVMLLCNILVRKYFIYTAKDLEEWSENPESFHHEQNLVQWTEIKRPCAEALFIVIFEKYRELLAPVVVSVLREAMAVSPPQETDVTAGMLLKDAAYTAAGHVYYELSNYLNFNEWFHGSLSIEVSNHHPNMRIIRRKIALLLGQWISEIKGDTRKLVYHALVGLLQDNDIAVRLAACSSLCYLFQESSFSELDLFECLPTCWTMSFKLIEDVQEFDSKVQVLNFISVLLEHAGDKIIPFASQLSQFFQMIWDESAGESLLQIQLLTA

SEQ ID NO: 31691 - DNA, 597 bp, Panicum virgatum
  misc_feature: Ceres CLONE 1906912-R
atactgcataagatgtgcatagctccttgattctttggtgttcttttcagtggactattctgaggaacatgcagtgcgttgtggggccaccatggtgtagagtgccaggccatagaatcacagtgctgccatttgatgcgccgcattttccagcctagcggtgatgtacccaactgttgaatgtgggatcttacagcagtgtagagtggcggagctagcgtgcgagcatgtagaggtgatatggggctgtttattcttttcagatatttttgcttatttgggtctgttgaggcgtgtcatatggtttgtggtgtggcataggaggattgggttgatttcgtcagtcctgaggatggcagagtttttagagctgcccattccaaaatgactgactggtggtccggggtttgattaatttttttcctcctccctagtaaaatcaaaagcattggcgtcattcatcatgctagtaaccctgtaactgtttgagaatgaagttgtcgtgtgggaggatagagtgtttactctagaatgcaattttgtttcttgagggttttttccctctccagtaacgcattcatgctcttgtattgtgcc

SEQ ID NO: 31692 - DNA, 338 bp, Panicum virgatum
  misc_feature: Ceres CLONE 1906922-R
  misc_feature: Encodes the peptide sequence at SEQ ID NO. 31693
ctgcccgtcccagttgccattggaggccctggtctgcaccctggagtgaaatttcggaatgacattcagacccctgggctcgccaacgttgctgccactgtgatgaacctccatggatttgaggcccctgctgactacgagccaaccctcattgaagttgctcacaactaaatactggccaaccttgatgtccaattttgttgctatagatttgagaatgcatcggttatggacatgtcatcatgcattcgtgccttggaatgtgcaattcacctgtcctacactacgcaaccaaaataatatcataatatgaggacacgatcccaaagttttaactc

SEQ ID NO: 31693 - protein, 56 aa, Panicum virgatum
  misc_feature: Ceres CLONE 1906922-R
  misc_feature: SWISSPROT Homolog: EC 5.4.2.1 Phosphoglycerate mutase
LPVPVAIGGPGLHPGVKFRNDIQTPGLANVAATVMNLHGFEAPADYEPTLIEVAHN

SEQ ID NO: 31694 - DNA, 657 bp, Panicum virgatum
  misc_feature: Ceres CLONE 1906922
gtcaccaccgtgaggtcgacctccctttcctccacacccaaatctcacctccatccagctcatagtcgctcgcgttgactcgcctggacctccaaccagtggctgcttggatcggctcagggacgccggcgggccgtgccggcgccgaatctcgcgcccatttcgcggtcctgttggttgccgccggagtggtttggatccgaggactggcctccagttctcggatctcctcccctcaatggcggcgctcgtggagcttttcctgggctccacgtcggcgacggtggactgggagacggaggcctacccgacctacggggacttcgccgtgctccccttgctcgtcgccttcttccccgccgtccggttcctgctcgaccgactcgtcttcgagatattagcacgaagacttatatttggaaagggatatgacaagcttgctgaaacagatgatagtagaaagaaaatcaataaatttaaggaatcagcgtggaagtttgtttattttctttctggagaggtgctttcgttatctgtaacatacgatgagccatggtttaagaacaccagatacttttgggtagggcctggtgatcagatctggcctgatcaaaagataaaactgaagctcaaagctgtctacatgtacgctgctgg

SEQ ID NO: 31695 - DNA, 666 bp, Panicum virgatum
  misc_feature: Ceres CLONE 1906938
  misc_feature: Encodes the peptide sequence at SEQ ID NO. 31696
atccgtcccctcccaaaaccctcgccgccatctcgcagtcgaaggcagcaggtgccgcagcgccgccgaaaccctcctcgccccgcgaccgggactagccagccacgcatggcggcgtcgctgctcctccgcgccgcgcggcggcgggagctcgcgtcccctctcggatctctgggcgccagcttacagtcgacatgtgctgccaatgtgtgctcaaaatggggtaattttgcaaggcctttcagtgcaaaagcagctggaaatgaggttattggaattgatctgggaacaactaactcatgtgttgctgttatggagggaaagaacccaaaagtcattgagaacgctgaaggtgcgcgaacaacaccatctgttgttgcttttactcagaaaggtgaaaggcttgttggaactccggccaagcgccaggcagtaaccaacccccagaatactttctttggaacaaagcggttgattgggcgccgctttgatgatccacagacacagaaagagatgaagatggtgccatacaaaattgtgaaggctccaaatggtgatgcttgggttgaaacaacagatggcaagcagtactcgccaagtcagatcggtgcatttgtgctgaccaagatgaaggagacagctgaatcttaccttggcaaatctgtc

SEQ ID NO: 31696 - protein, 185 aa, Panicum virgatum
  misc_feature: Ceres CLONE 1906938
  misc_feature: Useful for making plants with modulated heat sensitivity
MAASLLLRAARRRELASPLGSLGASLQSTCAANVCSKWGNFARPFSAKAAGNEVIGIDLGTTNSCVAVMEGKNPKVIENAEGARTTPSVVAFTQKGERLVGTPAKRQAVTNPQNTFFGTKRLIGRRFDDPQTQKEMKMVPYKIVKAPNGDAWVETTDGKQYSPSQIGAFVLTKMKETAESYLGKS

SEQ ID NO: 31697 - DNA, 449 bp, Panicum virgatum
  misc_feature: Ceres CLONE 1906943
  misc_feature: Encodes the peptide sequence at SEQ ID NO. 31698
agctagaggtcgtttcaggggaaaaggagaagagaagacaagatgcaggactgggcgccggtgttcatctcgctggtgctcttcatcctgctgtcgccgggcctgctgttccagatccccggcaagtgccgggtcatcgagttcggcaacttccacaccagcgcgctctccatcctcgtccactccatcctcttcttcgccctcatcgccatcttcctcatcgccatcggcgtgcacatgtacctcgggtcctagctagctggtagtagcttttgttagcctgatgcctacctcggtgtttgtcgatcagcttgcagctcgatcgtgttcttctctgctagtcgcccatctctaattaagagttctttctctatacacgtgttgaataacaatgtatgtatcatccatgttcatttctttcttcttctaataataataataacaaagtt

SEQ ID NO: 31698 - protein, 70 aa, Panicum virgatum
  misc_feature: Ceres CLONE 1906943
  misc_feature: Useful for making plants with altered cell wall content and/or composition
MQDWAPVFISLVLFILLSPGLLFQIPGKCRVIEFGNFHTSALSILVHSILFFALIAIFLIAIGVHMYLGS

SEQ ID NO: 31699 - DNA, 745 bp, Panicum virgatum
  misc_feature: Ceres CLONE 1906948
  misc_feature: Encodes the peptide sequence at SEQ ID NO. 31700
agaggaggaaaagccagggaaaaaaaaatatcacgctcctcttcctccgttcccctgctcgattccccgcgaggaattcgcccccaaatctatcgatctgctctacccagtccaccaatccgtggatcgatccgcgcgcgtgtccggtttgccccggggttccgatctggtcttcgcctcgtcaggggaggagccggaggaggagatgaacggcgccgggggcagccaccagcaacagcagcagaggctccggcagcagcagcagcagcaggcgctcctgatgcagcaggcactgcagcagcagcagcagcagtaccagtccggcgtcctcgcggcagcggcagcggccgccatgacccagatggaacctatttccaatggcaatcttccacctgggtttgatccttccacttgtcgcagtgtgtatgtggggaatgtgaacccaaacgtcaccgagagccttctgattgaagttttccagagtgctggccttgtggaaagatgcaagctcatcaggaaagagaagtcttcctttgggtttgtggattactatgatcgaagatctgctgctctagcaataatgacccttcatggccgtcacatatatggacaagcaatcaaggtgaactgggcatacgccagtacacagagggaggacacatctgggcatttccatatttttgtgggtgatttaagttctgaagtgaaatgatgcactctttatgcctgtttctcagcatatccc

SEQ ID NO: 31700 - protein, 168 aa, Panicum virgatum
  misc_feature: Ceres CLONE 1906948
  misc_feature (73)..(140): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with altered lignin content
MNGAGGSHQQQQQRLRQQQQQQALLMQQALQQQQQQYQSGVLAAAAAAAMTQMEPISNGNLPPGFDPSTCRSVYVGNVNPNVTESLLIEVFQSAGLVERCKLIRKEKSSFGFVDYYDRRSAALAIMTLHGRHIYGQAIKVNWAYASTQREDTSGHFHIFVGDLSSEVK

SEQ ID NO: 31701 - DNA, 1673 bp, Panicum virgatum
  misc_feature: Ceres CLONE 1906953
  misc_feature: Encodes the peptide sequence at SEQ ID NO. 31702
gtcagcactcggcattcatccacagaggaataaaaaggaggcagcgagagagcactagaggccaacagctcgagcttctccgcgaaccccacccctagcgccgccccttcccttccccgggcgccctccccggcatcctccccgctctccgatccaagatgtataagctggggagaggaaaccgcgacaaggtgcagcagttcatggccataaccggcgccagtgagaaggttgcccttcaggcactgaaagctagtgattggcacttggaaggagcttttgacttcttctatagccaacctcagatttctgctgtcaatactcggcatcttgaagacattttcaatagatacaaagaacctgatgctgatatgatcatggtggagggagtatctcagctttgcaatgatctgcaggtggagcctcaggatattgtcatggtatgtgcttagcttcttctgaactgacctgttatgtttttactaagtttgattgcgaattagtctgtggcagatatagtcatatgaactggtctactggagttggttttacttatgttggatacttggatgtagtgtttgctcacaaaaataagtttacaatgatatgcttattctatctgtgggaaccgtgtgatagcttggttggtagagctccagttgagaggctgcccatccaggttcaagcctgggtgctcgcaggtcatgtgaatacctatcaaatgggtttggtactcccctctcttaaggcagaagccaaggggacagttttctccctggtctagtcttttaatgcttattctttctatttaattcgacactgccacctttgatcattattgctcttagccatatagtcctgtgtggtgtgaacagcttgtcatatcatggcacatgaaagccgccacaatgtgtgaatttactcgccaggaattcattggtggactgcagtctattggggtagattcaatcgagaaatttcgtgcaaagttaccatcattacgagctgagctaaaagatgataataagttccgtgagatatacaacttcgcgttcacttgggcaagagaaaagggtcaaaagtctctctcactggagactgctattgggatgtgacagttgctatttgctgaaaggaactggcctcttctggatcattggtgccaatttttacaggtcaggcacaataaagccatatctagagacacctgggcgcagctgctggaatttgtaaagtcgattgatccacagctatccaactatgacgacgaaggtgcttggccctacctcatagatgaatttgtggaatacctgactgacaatgggttggttcagcgcacgaaatgaactgcaatggggaggattcgcccctcaccgaacaaacggttgggctgtacaaacacgattcatcttggtatatacggtgcccaggacccgatgttggcactcctgctcaatccactcgccaaactgttggcctatcattgcatgacagaatttgctgataaacgcggagaaaacgcaacctaagcctgggaagtggtggtcccgagcctgccatcgtgaactactccaaaatgcactggggagtttgggactctggttaacgtacgagttgtttcggatgtatcactgtcacttgctactatatttctattatccctcatcctgtcc

SEQ ID NO: 31702 - protein, 97 aa, Panicum virgatum
  misc_feature: Ceres CLONE 1906953
  misc_feature (7)..(44): Pfam Name: UBA Pfam Description: UBA/TS-N domain
  misc_feature: Useful for making plants with altered lignin content
MYKLGRGNRDKVQQFMAITGASEKVALQALKASDWHLEGAFDFFYSQPQISAVNTRHLEDIFNRYKEPDADMIMVEGVSQLCNDLQVEPQDIVMVCA

SEQ ID NO: 31703 - DNA, 2195 bp, Panicum virgatum
  misc_feature: Ceres CLONE 1906964
  misc_feature: Encodes the peptide sequence at SEQ ID NO. 31704
acccgcagcctcgccgccggccgccgctccgtgccctcctctcctcccccaggccccgccgccgacccgtgcttcgaagccgcgagtcgttgcggcggcgtgacctccgtccgtctctggccgaagcggatgcggtaattgcccttatcaagttcccggtagcctccttcgcggcaaatcacgcccccgacgaggccgaggtgggtgtggggggtcgcgatcccatcggacgcgccgtcgcggccagccgcctaggggacccgctcgctcggcccgcccccgccgcggtcggaggccagcgtcatcgtcttcggaggcaggcggggccgaaggagccgtcgctcggccgcggcacctccgccctaagctccaaaccctagaccagtgccgcgaccgctgcggaaagggctcgggccgtggacaattcggcgcgcgaggcgggcggcggcggcggcggccctcaagtctgcggttgtttggtgcttgtcttccttcctggactctgaatggagcaagggaagaaccaagctgctgataacttgcctgtctcatcatccgataataatgagtcggaagatttacctgtgaaggaaagatgttttgagcagagagaagctcttcctggggagcctcgctgtgttgtatgcggccgttatggggaatatatatgtgatcagactgatgatgacatctgcagtgtggaatgcaagacaattcttcttgctcggattgctgctaaaacaaagccagcagtacaagcagcaaagcgtgtgaatcttcctttgggcaatgagagcatctgtattaaggacactaattttccatctatacctaccttggctgacagccggatcactgcactgagaagtaagcttgacatttgtgtcaagggtgaggctgttcctgatccaatcatgtgtttctcttcctgtggtcttcctgagaagcttgtgcacaatcttgagactgcaggatattgtatgcctactccagtgcagatgcaagttatccctgcgtctatgagtaatagaagcttacttgtttctgctgatactggttcagggaaaactgcttcttttctgattcccataatttctcattgttcacaagtaagatcgcaacaatgcacaggcaagcgaggaccattggctatagttctttctccaactagagagctatgcacgcaggtggaagagcaagcaaaaatgcttggaaaaggtttgcctttcaaactgctctagttgttgggtggagatccattggctcagcaaatttacaggatcgaaaatggtattgagttaattgttggcacccctggtaggctaattgatcttctcatgaaacacgatgttgacctttccaatgtttctgtatttgttttggatgaagttgactgcctgctgcagaggggattccgggatcaggccatgcagatttttcagtctctttcaaacccccaggttatgatgtttacagcaacattagattcggaagtagagaagatgtccaactcactggctaagactattatacacatctcttgtgggaacccaagcagaccaaacaaatctgtgaaacaagtggtcatttgggtggagtctaagaagaagaagcaaaagatttttgagataatcaaaagcaagcagcactttaaacctcctgctgttgtgtttgtcagttccagagtcggtgctgatcttttgtctgaagcaattactgttgctactggattaaaggttgtttctatccatggtgagaaaatgatgagtgagagaagagagagtttgagaaggtttttgacaggagaagtatctatcgtagtttctactggggttctgggtcgtggaatggatctcctgaaagtgcgccaagtgatattgtttgacataccaaattccattgatgaatatattcaccaagttggaagggcatctcggatgggcgaggagggcatggctattgtgtttgtgaatgaggaggataggaggattttcaaagagcttgttccggttctgaagactgcaggagctccaataccccaggaacttgcaaattcaagatacatggctggtggttctcttggtagcgagaggaagagaaaattgatttcgagatctcgtccttgaccaagatgtataaaagagttgctcagtctttcttcaagccaaatatgatgctatttgcatgttctttgc

SEQ ID NO: 31704 - protein, 244 aa, Panicum virgatum
  misc_feature: Ceres CLONE 1906964
  misc_feature (40)..(69): Pfam Name: zf-HIT Pfam Description: HIT zinc finger
MEQGKNQAADNLPVSSSDNNESEDLPVKERCFEQREALPGEPRCVVCGRYGEYICDQTDDDICSVECKTILLARIAAKTKPAVQAAKRVNLPLGNESICIKDTNFPSIPTLADSRITALRSKLDICVKGEAVPDPIMCFSSCGLPEKLVHNLETAGYCMPTPVQMQVIPASMSNRSLLVSADTGSGKTASFLIPIISHCSQVRSQQCTGKRGPLAIVLSPTRELCTQVEEQAKMLGKGLPFKLL

SEQ ID NO: 31705 - DNA, 489 bp, Panicum virgatum
  misc_feature: Ceres CLONE 1906987
  misc_feature: Encodes the peptide sequence at SEQ ID NO. 31706
gtatcattatagacatcctcagcatccccatcccccagcccgggatccaccttggcaacgcctgctgggagctctattgcctcgagcacggcatcgagccctatggcaccatacccagagatacctcggttggcgtcgcacatgatgccttcaacaccttcttcaacgagaccgggtctggcaagcatgtgccgagggccatctttgtcgaccttgaccccactgtcatcgatgaggcgcccactggctcgtaccgcccgctctttcacccagagcagctaatctccgggaaggaggatgcggctaacaactttgcccgcggccactacactgttgggaaggagattgtcgatctgtgcctcgaccgactgccccagcaatcatacaattgcactgggctgtatggatttttggagttcaatgctgttggaggaggtactggctctggacttggttcactgctgttgcagctcctctcagatgattatg

SEQ ID NO: 31706 - protein, 162 aa, Panicum virgatum
  misc_feature: Ceres CLONE 1906987
  misc_feature (50)..(162): Pfam Name: Tubulin Pfam Description: Tubulin/FtsZ family, GTPase domain
  misc_feature: Useful for making plants with altered cell wall content and/or composition
IIIDILSIPIPQPGIHLGNACWELYCLEHGIEPYGTIPRDTSVGVAHDAFNTFFNETGSGKHVPRAIFVDLDPTVIDEAPTGSYRPLFHPEQLISGKEDAANNFARGHYTVGKEIVDLCLDRLPQQSYNCTGLYGFLEFNAVGGGTGSGLGSLLLQLLSDDY

SEQ ID NO: 31707 - DNA, 689 bp, Panicum virgatum
  misc_feature: Ceres CLONE 1906990
  misc_feature: Encodes the peptide sequence at SEQ ID NO. 31708
atcggatgggcgtctagaccgcggagggctccaccacactccttgcgtggcttccgtagtccgtaggcacacttcccttcaaagccactgcttcgtcttcctctacttaagcgcacgccccccgggccctgccctgtactcgcgtccgggaccgggagctcgcctcttcttcctgaggaggtgttggatggtggatgcatgggaagcctatgggtttcaaggaagtgtcatctgctacaatcttctgcctcttgcttctattctgcctgggctgcagatgcctggcatcagaactagtgacctcacaggcagcaactctcaatgttgacgcctcaccgcagtcagcccgaaagatccctgaaacactatttgggatatttttcgaggagatcaatcatgcaggagctggtggaatttgggcagagcttgttagtaacagaggtttcgaagctggaggcccacatactccctcaaatattgacccatggtccattattggagatgactcttctgtatttgtggcgactgatcgtacatcatgtttcagtcgaaacattgttgctctgaggatggaggtcctctgtgatgactgtcctactggtggtgttggtatttacaacccggggttctggggcatgaacatagaagatggaaaggcgtacaatcttgttatgtacgttaagtcacca

SEQ ID NO: 31708 - protein, 164 aa, Panicum virgatum
  misc_feature: Ceres CLONE 1906990
  misc_feature: SWISSPROT Homolog: EC 3.2.1.55 Alpha-N-arabinofuranosidase
  misc_feature: Useful for making plants with altered carbohydrate content
  misc_feature: Useful for making plants with altered cell wall content and/or composition
MHGKPMGFKEVSSATIFCLLLLFCLGCRCLASELVTSQAATLNVDASPQSARKIPETLFGIFFEEINHAGAGGIWAELVSNRGFEAGGPHTPSNIDPWSIIGDDSSVFVATDRTSCFSRNIVALRMEVLCDDCPTGGVGIYNPGFWGMNIEDGKAYNLVMYVKS

SEQ ID NO: 31709 - DNA, 799 bp, Panicum virgatum
  misc_feature: Ceres CLONE 1906990-R
  misc_feature: Encodes the peptide sequence at SEQ ID NO. 31710
gcaggtagaggaagtcttcttgcttcattggcggaagctgctttccttactggtctggagaagaacagtgacattgttcagatggcaagttatgctccactatttgtaaacgacaacgacagaacgtggaacccagatgccatcgtcttcaactcgtggcaacattatggaactcctagttactggatgcagacacttttccgtgagtccagcagtgctatggttcatccaattttagtcaattccagctactctggttcgctagcagcatctgcaattacttggcaggattcagagaacagcttcctaagagtaaaggttgttaattttggatcagatgccgttagccttacaatctccacaagtggacttcaggccagtgttaatgctctgggatcaaccaccactgttctcacatccgggaatgttatggatgaaaattctttcagtaacccaaacaaggttgtgccggtgaagagcgagctgagcaatgccgcagagcagatgcaggtcacgctggctccttactccttcagtgcgttcgatctcgcgctggctcagtccaagcttgttgcggagatgtgaagtggttggtatctcccatactaggctggtgacagatacacgaggaatacacaacaggtggtgcgatacacaaatagcagcaaccagggagttgctgctgttagcatcttgataaagctttgtatagtgtaacacgatgcagatatacagtactaaataaaaaaaatcacatcaggttggcttggtgttgactgttgactgatttgctttctcc

SEQ ID NO: 31710 - protein, 194 aa, Panicum virgatum
  misc_feature: Ceres CLONE 1906990-R
  misc_feature (1)..(177): Pfam Name: Alpha-L-AF_C Pfam Description: Alpha-L-arabinofuranosidase C-terminus
  misc_feature: SWISSPROT Homolog: EC 3.2.1.55 Alpha-N-arabinofuranosidase
  misc_feature: Useful for making plants with altered carbohydrate content
  misc_feature: Useful for making plants with altered cell wall content and/or composition
AGRGSLLASLAEAAFLTGLEKNSDIVQMASYAPLFVNDNDRTWNPDAIVFNSWQHYGTPSYWMQTLFRESSSAMVHPILVNSSYSGSLAASAITWQDSENSFLRVKVVNFGSDAVSLTISTSGLQASVNALGSTTTVLTSGNVMDENSFSNPNKVVPVKSELSNAAEQMQVTLAPYSFSAFDLALAQSKLVAEM

SEQ ID NO: 31711 - DNA, 1841 bp, Panicum virgatum
  misc_feature: Ceres CLONE 1907019
  misc_feature: Encodes the peptide sequence at SEQ ID NO. 31712
agaaagatgatctccatgacatgtgggcgcggagatgcagcacccacgtgtcagggtccaccgcgccgtccgccggagcaccgccgcgccggagctgtcctgcgcctccgtcccttcgctcacggagaagtcgcagctggccgcagcacggttctgtctcggcggccagcggggctgctacctggccagaagaggccgttgcttccccagatttttacaagttccgatcagaatattcgcgtcatggagaagccaccacctcgggaatatcgtgtcgccgcgatgaaggtggagctcgccgcgcgcacctcccagaccggcaagacggaggatactccgccaccgtccccggcagccgtagacgcaccatccgcggcggaggacgcgccgctcctcccagacgggggcgtgcggcgccggtcggggagcgggcggttcgcgcgcagcggctccttccgccgcgaggtcggccgcgccgccgctgagaccttcctcctcacgaggctcaccttgatcctgctccgctacctcgggataggctatagatggatccggcagtttctagccctctgctgttatactttcctgctgatgccaggttttattcaagttgtatattattatttcttctctaaccaagttcataggagtgttgtatatggagaccagccaagaaacagattggacttgtatatacccactagtacgacagggttaaaaccagttgtggcatttgtgactggtggagcatggatcatagggtacaaaggttggggggcccttttaggcagacgcttagcagaaaggggcatcatagttgcatgcattgattacagaaactttcctcaagggaccattgatgacatggtagaagatgcttctcaaggaatctcttttgtctgcaacaatatagcaagttatggaggtgatcctaacaggatttatcttgttggacaatcagctggtgcacatattgctgcatgtgccctcttaaaccaggccattagcgaatgcggtgaaagagattcttcgtcttggagtgtttctcaaataaaagcttactttggcatttctggcgggtacaatctccttaatttggttgatcatttccataggcgtggcctttaccgatccatctttctcagtattatggaaggtgaagagtcactccagaaattctctccacaagtgatgattaaggagtcatctgctagatctgcagtttctttgttgccccatattatccttttccacggaacaagtgactattcaataccatcagctgaaagccaagcattcgctgatgctttacaacagcatggtgcaaaagcagatctattcttgtatgaaggaaagacacatactgatttattcattcaggatcctcttcgtggtggtagagataaaatgctcgaagagatcgccagtgtgatacacagcgaagatccagatgtatctgccgaccacctcgtcgttcctgttgcacggcgtcttgtacctgaattcatgttgaagctcgctgggagagtaagccctttctgaagatggtggtggtttgcgattgcagcaagaaccagacataactgtaaagattattgtacattagggggaagcagcctggcgccaattgggtcctaagtaccatcccaactcccaagccctactcacgttgggaagctacagacctgctgtgatcaggacgtgtgtcaattgtttggtgctggtcgcgcatacggcatactaacgatatttcctgtgacatttgacattgttgtattgtatttgtaactctccatggcttattaagctcttgaagctgggcgtgcaaaatgttgtatgtc

SEQ ID NO: 31712 - protein, 432 aa, Panicum virgatum
  misc_feature: Ceres CLONE 1907019
  misc_feature (162)..(377): Pfam Name: Abhydrolase_3 Pfam Description: alpha/beta hydrolase fold
  misc_feature: SWISSPROT Homolog: EC 3.1.1.1 Carboxylesterase
MEKPPPREYRVAAMKVELAARTSQTGKTEDTPPPSPAAVDAPSAAEDAPLLPDGGVRRRSGSGRFARSGSFRREVGRAAAETFLLTRLTLILLRYLGIGYRWIRQFLALCCYTFLLMPGFIQVVYYYFFSNQVHRSVVYGDQPRNRLDLYIPTSTTGLKPVVAFVTGGAWIIGYKGWGALLGRRLAERGIIVACIDYRNFPQGTIDDMVEDASQGISFVCNNIASYGGDPNRIYLVGQSAGAHIAACALLNQAISECGERDSSSWSVSQIKAYFGISGGYNLLNLVDHFHRRGLYRSIFLSIMEGEESLQKFSPQVMIKESSARSAVSLLPHIILFHGTSDYSIPSAESQAFADALQQHGAKADLFLYEGKTHTDLFIQDPLRGGRDKMLEEIASVIHSEDPDVSADHLVVPVARRLVPEFMLKLAGRVSPF

SEQ ID NO: 31713 - DNA, 1903 bp, Panicum virgatum
  misc_feature: Ceres CLONE 1907022
  misc_feature: Encodes the peptide sequence at SEQ ID NO. 31714
ctggttctttctcgtctccttgcttggagttggagccaccaacctttcctcagcttggccatccagccagccagcttccctgtaaccctagctagccgcccgcccggctcgtaaaccctagcgaccagcaagggatgcagcccacgacgcgggaaatgcaggccatggccgccgccggccagatctccctcgacgacctccgcgcggccggcggcgtgcacgacgacttcctcgaccagatgctgggaggcctgcagccgtcggcctggccggaactggcatccgcggcgggagcgaaggcgccggagggcggagtggaggcgaaggggatgcaccaccagcagcagcaacagttcggtgggggcttgtacgacgagtccgcgctgctggcgtcgcggctccggcagcaccagatcagcggcggcggcgcggagtccgcggcggcggcgaagcagatggtgctgcagcagctggccgatctgaggcatggccaccacatgctgctccagggcatgggccgctcgacgggcggcggtggctgcggggacggcggcatgctcctcccgctctccctcggcagcggcggatcgggcggcgacgtgcaggcgctactcaaagccgccgccaattccgccggaggagaggccgccaccgtcttcggcggcgccttcgccggatcgctccagcagcagcagcagcaacatttccagccgcatccacagcagcaaacggcgccgctgccaggccagggcttcggtcgcggcggcggtgcgtccggtggcgcgtcacagcctcaggccggggcttcaggcgggaccgcggcggcggcgccgcccaggcagcgcgtgcgggcgcggcgcggccaggccaccgacccccacagcatcgcggagcggctccggagggagaggatcgcggagaggatgaaggccctgcaggagctggtgcccaacgccaacaagacggacaaggcgtcgatgctggacgagatcatcgactacgtcaagttcctgcagctccaagtcaaggtgctgagcatgagccggctaggtggcgccgctgccgtggcgccgctcgtggccgacatgtcctcggagggtcgaggcggcgcgccgccggccgcggcggggagcgacggactggcggcgacggagcagcaggtggccaagctcatggaggaggacatgggcaccgccatgcagtacctgcaggggaagggcctgtgcctcatgcccgtctcccttcgcctccgccatctcctccgcgacgtgccacatgcgcccgccggggctcggggtcgccgccgccgcgcaccacatggccgccatgcgcctgccgcccggcatgaacggcgccggcgccgacccggcggccgtgccggcctccccgagcatgtccgtgctcacggcgcagtcggccatggccaacggcgccggcggggccgacggcgagggctcccattcgcagcagcagcagcccaaggacgccgcgtccgtgtccaagccatgatcccggcctcgagaagacgacggtcgccgcttcactaacggcgaaaccctgacactcccgacctgacggcgtcggcctccagttacggacttccctgtccgcgggtctcgctcggcttggaccggactcctgggaaccgtgggctccctgacgggcccatctgcacccctacgggcccacgggctctcagcactgcacagccgcgcagcgcagcagccctcagagtcaccttttcatttttctttttctttcttctttttaatttcttcctagcttcaccattattttcttttctgtttaatattaatccctgttgctattgttgttctttccagtaaatattaattaattaatccagggctggttctcctgcagccggctttgtgccagcttc

SEQ ID NO: 31714 - protein, 460 aa, Panicum virgatum
  misc_feature: Ceres CLONE 1907022
  misc_feature (235)..(284): Pfam Name: HLH Pfam Description: Helix-loop-helix DNA-binding domain
  misc_feature: The sequence is a functional homolog of SEQ ID NO 1488 in the 11/479,226 US patent application
  misc_feature: The sequence is a functional homolog of SEQ ID NO 712 in the 10/412,699 US patent application
  misc_feature: The sequence is a functional homolog of SEQ ID NO 901 in the 11/479,226 US patent application
  misc_feature: The sequence is a functional homolog of SEQ ID NO 186 in the 10/714,887 US patent application
  misc_feature: The sequence is a functional homolog of SEQ ID NO 186 in the 11/435,388 US patent application
MAAAGQISLDDLRAAGGVHDDFLDQMLGGLQPSAWPELASAAGAKAPEGGVEAKGMHHQQQQQFGGGLYDESALLASRLRQHQISGGGAESAAAAKQMVLQQLADLRHGHHMLLQGMGRSTGGGGCGDGGMLLPLSLGSGGSGGDVQALLKAAANSAGGEAATVFGGAFAGSLQQQQQQHFQPHPQQQTAPLPGQGFGRGGGASGGASQPQAGASGGTAAAAPPRQRVRARRGQATDPHSIAERLRRERIAERMKALQELVPNANKTDKASMLDEIIDYVKFLQLQVKVLSMSRLGGAAAVAPLVADMSSEGRGGAPPAAAGSDGLAATEQQVAKLMEEDMGTAMQYLQGKGLCLMPVSLRLRHLLRDVPHAPAGARGRRRRAPHGRHAPAARHERRRRRPGGRAGLPEHVRAHGAVGHGQRRRRGRRRGLPFAAAAAQGRRVRVQAMIPASRRRRSPLH

SEQ ID NO: 31715 - DNA, 664 bp, Panicum virgatum
  misc_feature: Ceres CLONE 1907025
  misc_feature: Encodes the peptide sequence at SEQ ID NO. 31716
aacaatggatgaacagcgctgagggcctgtgctagctcagctgggcagctgcccaagtgctgaaggacccccggtcctacgaccaccggagctcggctagcattcactaactgctttcaattcctggataagccttcacatggattaccaagggaacaatctcagggatttccttcaactaaatggacaagtggtgcttcagagagtgaacaataactataatctgagatctttcacagaaaaggagatagaacacattaccaaaggatatagcactttgctgggcaaaggggccttcagtgaggtttacagaggagtattaggtgatcaacgtctggtggcagtaaagaaatacaaagatgggaccaggaaagaagacttggccaaagaggtgatagtgcactctcaaataaaccacaagaatgtggtaaggcttttgggttgctgcactgaggaaaatgctctagcaattgtcatggaacttatttgtaatggaaatcttggcgacctccttcatcgcagtactgctaatggccatgtttccttccctttgtacagacgtttgagcattgctattgagttagctgaagtgttatcgtacatgcattcaatgtatagtcctattcttcatggggacattaaacctgataatatactacttgat

SEQ ID NO: 31716 - protein, 174 aa, Panicum virgatum
  misc_feature: Ceres CLONE 1907025
  misc_feature (40)..(173): Pfam Name: Pkinase_Tyr Pfam Description: Protein tyrosine kinase
  misc_feature: SWISSPROT Homolog: EC 2.7.11.1 Non-specific serine/threonine protein kinase
MDYQGNNLRDFLQLNGQVVLQRVNNNYNLRSFTEKEIEHITKGYSTLLGKGAFSEVYRGVLGDQRLVAVKKYKDGTRKEDLAKEVIVHSQINHKNVVRLLGCCTEENALAIVMELICNGNLGDLLHRSTANGHVSFPLYRRLSIAIELAEVLSYMHSMYSPILHGDIKPDNILL

SEQ ID NO: 31717 - DNA, 1649 bp, Panicum virgatum
  misc_feature: Ceres CLONE 1907026
  misc_feature: Encodes the peptide sequence at SEQ ID NO. 31718
gtagcatttagctagcttgatcatcccctgggcaacagcatagcgtagtagagagaggagggagaaagcagcagctatggggtcaggaggaggcggcggcgaccggcaagcgcagccgctgctcggcaagctctcggagtcgtcgtccggcgagcacctggtcaagagaaccggcacggtatggacggcgatggcgcacatcatcacggcggtgatcggctccggcgtgctgtcgctggcgtggagcgtggcgcagctgggctgggtgggcgggccggcggccatggtgttcttcgccggcgtcaccgcggtgcagtcctccctgatcgccgactgctacatttcccacgacccggagcgcggcgtcgtcaggaaccgctcgtacgtcgacgccgtgcggctctacctaggtgagaagagccatttgttctgcggcttcttcctcaacttcagcctgtttggcaccggggtggtatacacgctcacctccgccaccagtatgagggcgatccagaggtccaactgctaccacagggatggccacgacgcgccgtgctccgtgggaggggacggctactacatgctcctcttcggcctcgcgcaggtggtcctgtcgcagatacccggcttccacgagatggcggggctctccttcttcgccgccgtcatgtccttcttctacgccttcgttggcgtcggcctcggcgccgccaaggtcatcgcgaacggggtgatcatgggcggcatcggaggcatccccatggtgtccacgccgcagaaggtgtggcgagtctcgcaggccctcggggacatcctgttcgcctaccccttctccctggtgctgctggagattgaggacacgctgaggtcgccgccgccggagaacgagacgatgaagacggcgacgagggcgagcatcgtgatcaccgccttcttctacctctgctgcgggtgcctcggctacgccgcgttcggcgacggcaccccgggcaacctcctcaccggcttcggcttctacgagccctactggctcatcgacctcgccaacctctgcatcgtcctccacctcctcggcggctaccaggtgtacacgcagccggtgttcggcttcgccgaccggcacttcggcggcgccgcggccgaggtgccggtgctgggcgcgcgccgcgtgaacgtgttccggctgtgcttccggacggcgtacgtggcggcgaccacggcgctggccgtgtggttcccctacttcaaccaggtcatcgggctgctcggcgccttcaccttctggccgctcgccatctactttcccgtggagatgtacctcgccaggaacaaggtgacgccgtggaccaagcagtggctcgccatccacggattcagctccgtctgcctgctcatcagcgcgttcgcctcggtcggatccgccgtgggggtatttgggtccgagaccagctaagcaactctgtcagcaatggcagctctagtgggcatagttttttttttcagatggggactagtgcagccacatgaatgtccacttgtataattatttgcagtcaggttaatttctagtatgtattaagaacttggtgtagatagataaggtaacttggtgtagatagataaggtgagttttaagagcatgcctttcg

SEQ ID NO: 31718 - protein, 458 aa, Panicum virgatum
  misc_feature: Ceres CLONE 1907026
  misc_feature (31)..(454): Pfam Name: Aa_trans Pfam Description: Transmembrane amino acid transporter protein
MGSGGGGGDRQAQPLLGKLSESSSGEHLVKRTGTVWTAMAHIITAVIGSGVLSLAWSVAQLGWVGGPAAMVFFAGVTAVQSSLIADCYISHDPERGVVRNRSYVDAVRLYLGEKSHLFCGFFLNFSLFGTGVVYTLTSATSMRAIQRSNCYHRDGHDAPCSVGGDGYYMLLFGLAQVVLSQIPGFHEMAGLSFFAAVMSFFYAFVGVGLGAAKVIANGVIMGGIGGIPMVSTPQKVWRVSQALGDILFAYPFSLVLLEIEDTLRSPPPENETMKTATRASIVITAFFYLCCGCLGYAAFGDGTPGNLLTGFGFYEPYWLIDLANLCIVLHLLGGYQVYTQPVFGFADRHFGGAAAEVPVLGARRVNVFRLCFRTAYVAATTALAVWFPYFNQVIGLLGAFTFWPLAIYFPVEMYLARNKVTPWTKQWLAIHGFSSVCLLISAFASVGSAVGVFGSETS

SEQ ID NO: 31719 - DNA, 488 bp, Panicum virgatum
  misc_feature: Ceres CLONE 1907028
  misc_feature: Encodes the peptide sequence at SEQ ID NO. 31720
caagccagcgggtgttccgagagcatagccagccagccacaatggcgggaaacctgctatctaactatgtccaggtctacgtcatgctcccgctggatgtcctcactgtcgacaacacgttcgagaaggccgacgagactagggtgccgctgcagaagctggtggaggccggcgctgacggggtcatgatcgacgtctggtggggcctggtggaagggaaggcgcccggggtctacgactggagcgcctacaaacacgtgttcaagctggcgcaggaggccgggctgaacccgccagccatcatgtcatgccacccatgcggcggcaatgtcggcgacatcctccacatcccgatcccgacgtgggtgcgggacgttggtgacgccaaccccgacatcttctacaccaaccggaggaagatgacgaacatcgagtacctcacgatcggagtggatgaccagcctctcttccaggggagaactgccatt

SEQ ID NO: 31720 - protein, 148 aa, Panicum virgatum
  misc_feature: Ceres CLONE 1907028
  misc_feature: SWISSPROT Homolog: EC 3.2.1.2 Beta-amylase
MAGNLLSNYVQVYVMLPLDVLTVDNTFEKADETRVPLQKLVEAGADGVMIDVWWGLVEGKAPGVYDWSAYKHVFKLAQEAGLNPPAIMSCHPCGGNVGDILHIPIPTWVRDVGDANPDIFYTNRRKMTNIEYLTIGVDDQPLFQGRTA

SEQ ID NO: 31721 - DNA, 1640 bp, Panicum virgatum
  misc_feature: Ceres CLONE 1907044
  misc_feature: Encodes the peptide sequence at SEQ ID NO. 31722
gtccacttccacctcctcctcatccccgtccttgcctgcgttttcgctgcggattggagcggcaagggctcacttctctccggctgcggcctgacgatgccggaggcaaatgcgggtgcgctggcgcaggcggagcagaggaagaaggtgggggagctcggttccagagtgaaaaatcacttcttttctctgccttcttggtgccatggatacgaagagtcccgtggggattaagggaggcaacggggcgtggtgccccgagcagcggtgctcgtgtgggatgactggataaggacgtggccctctgtcttctccggattttggcacggccggagctgctggatttggggggatttggatttcttgcggctctgatcctgactactagtttgcttcctgcgcgtgagaatatgcttcctgggataatgggatttaccacagtgatttcttgccttcttaggagatcccgtcttatccgaattattcgagctatagtattcctcagaatgctccttggtactgcacccgcaggaaatccgctctctcttcagttaaggtttccaatcccccaaaatctggctttttccgcgctatcgtaaagagggcgcggtaattcttgtttaccacgcaacacgggtggtcgaggagtcttggtaaacgcgggtattggattcggtgaccttgtacgtttatcctaatccgggtcggctattttctttccctttgtgggtcagagatggcttaggcaagcataaatattcctttgcccactggggaggcatatttaccgtctatatattttaagctcaatgccagttcagaggtgattattagccttgataagggtttgagagatcacgagttctttggccggtggcaaaggtcagtcttggctgggtcagagggggtagatactgcagagcttttgcgtttgagttgcttggattacttgccggcagtttttgcctttgcggtttgcaggtttggtgtgggtgagtacaaactaggctaagacttcactagtttactattccattggtttatttagtaaccagaaagcttctcttggtgcatatcaggagtagttgtctcttgctatctctggaagagtcggtttgtatgttcctcttggggatttcacctctgcttattttgctgtgctgattgtttggtttgctggttcagctgtttaatacataaaaaaaagtatgaatttcttcctaatttccaagtaatatgtcatcgcttaaattcttaatagttgactttgatatacttttcagagaaaagaacgtttactgtgtcctcaatgctaatgttttccactataaaacttccagaattcaccagagatggatttcttcagtgaatatggtgacgccaacagatacaaaattcaggaaataattggcaaaggaagctacggggttgtttgctcagctattgaccaacaaactggtgagaaggtagcaatcaagaaaatacagaatatctttgagcatctgtccgatgccgctaggatcctccgagagatcaagctcctccggcttctaaggcatcctgatattgttgagatcaaacatgtaatgttacctccatcaaggagggacttcagagatatttatgttgtttttgagctt

SEQ ID NO: 31722 - protein, 95 aa, Panicum virgatum
  misc_feature: Ceres CLONE 1907044
  misc_feature: SWISSPROT Homolog: EC 2.7.11.24 Mitogen-activated protein kinase
  misc_feature: Useful for making plants with altered cell wall content and/or composition
MDFFSEYGDANRYKIQEIIGKGSYGVVCSAIDQQTGEKVAIKKIQNIFEHLSDAARILREIKLLRLLRHPDIVEIKHVMLPPSRRDFRDIYVVFE

SEQ ID NO: 31723 - DNA, 323 bp, Panicum virgatum
  misc_feature: Ceres CLONE 1907083
  misc_feature: Encodes the peptide sequence at SEQ ID NO. 31724
gtaccaccttcatagtctcgatacacgcgcccccgtacacccctgtgttgatctcttcagtccgtggtgctctgcaccagcgctccggccatggctttcttccggggtcttctccgcggtctcgaggctgcaatcccgcgtgacccatcaggccagcgcgctgggtggtgtcagatggtcgcccttgcacagcgcttcccatctcgatctcatgtcccagttgcaggagctgattcctgaacagcgggatcggataaggaagcttaactcagaacacggagaggtccagcttgcaaacataactgtgggtatggttcttggtg

SEQ ID NO: 31724 - protein, 107 aa, Panicum virgatum
  misc_feature: Ceres CLONE 1907083
  misc_feature: SWISSPROT Homolog: EC 2.3.3.1 Citrate (Si)-synthase
YHLHSLDTRAPVHPCVDLFSPWCSAPALRPWLSSGVFSAVSRLQSRVTHQASALGGVRWSPLHSASHLDLMSQLQELIPEQRDRIRKLNSEHGEVQLANITVGMVLG

SEQ ID NO: 31725 - DNA, 522 bp, Panicum virgatum
  misc_feature: Ceres CLONE 1907094
  misc_feature: Encodes the peptide sequence at SEQ ID NO. 31726
cttcttcgtttcctatctgctatcccccttccccgatcttattgctacgaggcgctccgcgatccgacccttgcctacgctgacgactcccttcgccggcggcggtcctggcgtccggtgaccccttctcccccttccaggactccgagaacgagagctagtacggctatgtccgccaggactctggacctgtcgtcgtggctgatggactgggcggtgctgccatgtttgatcttgttcgtgtccgcccccatgccctcctctggcaaattatccgtcttgagggtgattcagctaccatccaagtttatgacgaaactgctggacttatggttaatgatcctgttttgagaacaccaaagcctctttctgttgacttgggacctgaatttctaggaatcatttttgatggtatcccgcgccctctaaagaccattgctattaaatccagacacgtgtacattcctcgcggtgttccagttcttgcccttgacaatgatacattgtggcattttcctccta

SEQ ID NO: 31726 - protein, 99 aa, Panicum virgatum
  misc_feature: Ceres CLONE 1907094
  misc_feature: SWISSPROT Homolog: EC 3.6.3.14 H(+)-transporting two-sector ATPase
MFDLVRVRPHALLWQIIRLEGDSATIQVYDETAGLMVNDPVLRTPKPLSVDLGPEFLGIIFDGIPRPLKTIAIKSRHVYIPRGVPVLALDNDTLWHFPP

SEQ ID NO: 31727 - DNA, 475 bp, Panicum virgatum
  misc_feature: Ceres CLONE 1907107
  misc_feature: Encodes the peptide sequence at SEQ ID NO. 31728
gtcttatcacctcgcggactcgactccctttccctccctcgcttccgccaccgtctcagtctctgggcctctcccccgctccggatggggttaaggcccccccccccctccccgccgagggaggatagcctagttcaccagctttcaagtcggtccggccggggcagccgaggatatcgccttcatatttggcgtggagtgttaccttcagctgaggtaggggacccgcgtggctgatctaatacccaaggatcaatggtgtcacaatctactctggtttaaagacatcatcatcgtctgttatctttggattgaactccacattcctggggaggaatgcactcccttcgggcatctgtcgctcaaaggattgtgccgaaagcggcttctgggtctcatatttctccccatgcatcttacaaaatgtccgtacttggtgctgctggaggaatcggacaacccctacgccttttga

SEQ ID NO: 31728 - protein, 46 aa, Panicum virgatum
  misc_feature: Ceres CLONE 1907107
  misc_feature: SWISSPROT Homolog: EC 1.1.1.37 Malate dehydrogenase
MHSLRASVAQRIVPKAASGSHISPHASYKMSVLGAAGGIGQPLRLL

SEQ ID NO: 31729 - DNA, 703 bp, Panicum virgatum
  misc_feature: Ceres CLONE 1907113
  misc_feature: Encodes the peptide sequence at SEQ ID NO. 31730
aggcggtcaggcaggccgcggggaccaacatcgagcagccgcagccgcagccgcgccaaacctccgcgagctcgctaatggcgctcgcactgtccacgctcccgctcgtgccctccaatccctctccatcctccggcgccacccctgccgccgccgcgttccctcctcgtcgggtccacctcgctgccgccggtaggagcggcgccggcgtcctcccgctcgcgtgtgccgcgccgcggcatcgcgggcgggttccgaggcggcgccgtggagggagcctggtggtctgggcgtcggcagactactacgcgacactgggcgtgccgcgctctgcgaccaacaaggacatcaaggccgcctaccggaagcttgcgcgccagtaccatcctgatgtgaataaggagcctggagcaactgaaaagtttaaagagataagtgcagcatacgaggtgttgtcagatgaaaagaagagggcattatatgaccaatatggtgaagctggggttaagagtgcggttggaggctcgggtggagcatacacaactaatccatttgatctgtttgagacattctttggagcaagcatgggtggcttttctggcatggaccagagcgcatttagaacacgcaggcgaggcactgctgttcagggtgaagacatcagatatgatgtgattctgggattcacagaagcaatattcgg

SEQ ID NO: 31730 - protein, 208 aa, Panicum virgatum
  misc_feature: Ceres CLONE 1907113
  misc_feature (75)..(136): Pfam Name: DnaJ Pfam Description: DnaJ domain
MALALSTLPLVPSNPSPSSGATPAAAAFPPRRVHLAAAGRSGAGVLPLACAAPRHRGRVPRRRRGGSLVVWASADYYATLGVPRSATNKDIKAAYRKLARQYHPDVNKEPGATEKFKEISAAYEVLSDEKKRALYDQYGEAGVKSAVGGSGGAYTTNPFDLFETFFGASMGGFSGMDQSAFRTRRRGTAVQGEDIRYDVILGFTEAIF

SEQ ID NO: 31731 - DNA, 1644 bp, Panicum virgatum
  misc_feature: Ceres CLONE 1907116
  misc_feature: Encodes the peptide sequence at SEQ ID NO. 31732
aagagttccatcaagaacacccatttgatctctctctctctctctctctctctctctctctctcgtccccaccatggattcatttgcatgggcggcggtctctcagaccccggggctagctgccgccggcgccgtctccgacgggcgaggcgggggcctctttcctccgatggccgggttccatctcccaccaccggccggtctcgggcacttctctctggactccggcctcgtcgagcgggaggggtgctcgccctgtttcggcgccgcaaatggaacagcaaccactgcaagcgcctcaaacatcaccttggagggggcgtcgggtcaccggagcaaggtcgccggcgggagcagcagtgtcagtggcgtccatgacgaggccggcaccggagactgctcctccggaggaccggagccggactccaagaacatgaagagatcaaacgaggacgttcttgggacggatcaagcgaaggcgtccaacgcgtccaccgattccgcaaacgggagctcgcgcagcaagggcgtcaaargcgaagagaatggcctggccgcacgacaggggtggccggcaagaggaaacggaatggatccaacgcgcctgacgaggaaggcgaagggtacatccatgtcagggcccggaaggggcaggcaaccaacaggcacagccttgcagagaggttgagaagggagaagatcagcgagaggatgaagcttctgcaagaccttgttcctggttgcagcaaagtgaccgggaaggcggtaatgctggatgagatcatcaactacgtccagtccctgcaaaggcaggtcgagttcctatccatgaagcttgcggcggtcaatccacagctaggcctcaacatagaagggatcctgtcaaaagatcttattcgcttccctggtgctcctccatctgctcccatcggattctcattgtcgcagtcaggcatggtccaggaaggcgttcatggattggccagttcgaatggattcagaacagtcatgcaggagcaattaaatgagagagactcgttcagagagcatgtttctcagtctctggagcagatgcctcgcgccatggatggatggttccacaatgcagggcaaccagcgtacagggcagtcatcaatccagaacatctaagcatcagccctgatcaggacgggtttcatctgtgatgttcagctccagctccatggatgctcgaagtttcttctcatcagcagacatgtagagagacaggcacgtaactagcatgtgcactggagtaactacattgtgcaggagcaggacaagcttgaatgctccaggaaagttcagacgttgcaaccattgctccagggttgtacatggggtgtcgtttgtgctcagagccaaaagttcagacatcaaaagtaggggggttatgtaggctgtagctatgaatttatgatgttggaaaccctgtctaggtggtcttttttttagtggagtcttgagtgaatatccctgaagattaaatacctacgaaaataggcagaattgctgcacagtgcattttttagttccacagtactgtttgtattattaacaacgtaagcttgcaaacagcaacagcaacatctattttcagattgaacactcgcttttactcgctc

SEQ ID NO: 31732 - protein, 157 aa, Panicum virgatum
  misc_feature: Ceres CLONE 1907116
  misc_feature: Useful for making plants with altered alkaloid content
  misc_feature: Useful for making plants with altered lignin content
  misc_feature: The sequence is a functional homolog of SEQ ID NO 864 in the 11/435,388 US patent application
  misc_feature: The sequence is a functional homolog of SEQ ID NO 104 in the 11/375,241 US patent application
  misc_feature: The sequence is a functional homolog of SEQ ID NO 188 in the 10/225,066 US patent application
  misc_feature: The sequence is a functional homolog of SEQ ID NO 416 in the 10/374,780 US patent application
  misc_feature: The sequence is a functional homolog of SEQ ID NO 554 in the 11/435,388 US patent application
MKLLQDLVPGCSKVTGKAVMLDEIINYVQSLQRQVEFLSMKLAAVNPQLGLNIEGILSKDLIRFPGAPPSAPIGFSLSQSGMVQEGVHGLASSNGFRTVMQEQLNERDSFREHVSQSLEQMPRAMDGWFHNAGQPAYRAVINPEHLSISPDQDGFHL

SEQ ID NO: 31733 - DNA, 1973 bp, Panicum virgatum
  misc_feature: Ceres CLONE 1907123
  misc_feature: Encodes the peptide sequence at SEQ ID NO. 31734
tatagtgtatcattatttttttcataaaaaaaacaattagctgttttactaatacatctacgctgctacatcatgttatctggctattgcattctttaaaagttctagatgctatcacaactgacagagtgaataagtacaaaagataaaaaaaatacagttactggtggagttgcttgccccttttgtttatttctacagaatatgggatatgggagttgcttgccccttgtgcttacttctacaaaatacgggatatgctgtttaagtatgttctcagtatatcaaatctgaactcttaatgtcatatatttctattattcaaataaataacttaggtataactgtataagtaaatttcaccggtagtccttaaacttgtcttgagttctcatcccggtcccagtactcttaaaatgcacatattagtccttaaacttgtcccatgctctcatcccggtccttaaacttatcctgagttctcatcccagtcccagtactcttaaaatgcacataataatccttaaacttgtcccacgctctcatcccagtccttaaacttgtccgtatgaaatttactccttaggtattatagctacttgaacaatattgtggccttttcttcttggtttgtgtacatatatttgcgagtcttatttccataccctgatttatcttgaatataagagtagatataaaactaagcttatggtttttgacagatttcccttgaaagctgttaaggtcatgcacacagttgccctgagaactgaagcaaccattactggtggggaaacacctgctgatcttggtcaggttttcaaggtctgacaccattctttctccgtcatgctgattagcaacttccattttctaacccacttcaatatgtagaatcacatgagtgaaatgttcgcataccatgcaacaatgatgtcaaatactcttggaacatcaatagtggttttcaccaggacaggatttatggctatcttgcttagtcactaccgtccctctggcactatttttgcctttacagatgagtaagttttctgttcttttgttcataaggatccagcctacaatacaaattgctgccgtcctaattttatatcccgtgatcatgactctgtcagtaaaatgtctccaagggcatgttttatctgattgtactgatgatggcctattgagaagattctgttaaatatttgagcataattaatattggtgattagctgtttaattcttttttcttgtaatatgttataataattgtggaactggaacatgaatcaattaggctgccttgtccgacccaataatttgttcataacctttgggacaacctttaaaattaaatgtgtgggcgtgtactagttagtgttgtttcagtgttgactgatgaaatcaagtacccatttgaaattatgtatgtgatttgtggttcacatgcaagatatgaattgtagaaaaccaaagtagtacacttacatttcaagactttacggactcttcgagcctatcaaaaaatgaacactagatattggcctttgtgattcattatcaagtgggcttggaagccaggatggctgaaacccatctgtgtgcagctcctctacaattggatgtatactaagtatgtagagtagacgcccaaaaagcttcatcgggccatgttatgctgatacatatttaggaaaggagacatttgatgttgcttgaagttgagcttcttatgaaattgctgtaagaaatctgtagtttaacggtaaactatccactgttagcattttgtaggaaaagagtgatatactgctgttgcacagagacaactgttcttaaacaggtcgcctgagattagtttgtttggtttatgttttcacctttagtcaatttttttcatttacaatccttgcatatctagcaaataattgttgctggtctatttatagggagagagtgagacaacgatt

SEQ ID NO: 31734 - protein, 48 aa, Panicum virgatum
  misc_feature: Ceres CLONE 1907123
  misc_feature: SWISSPROT Homolog: EC 2.7.1.40 Pyruvate kinase
MSEMFAYHATMMSNTLGTSIVVFTRTGFMAILLSHYRPSGTIFAFTDE

SEQ ID NO: 31735 - DNA, 377 bp, Panicum virgatum
  misc_feature: Ceres CLONE 1907123-R
gcagagatgcattgtggtattccaattgtcagggtaccaggtaagaaattgctattttctggcaaagtcgaaggcctggctataacaatgccacgcaggtcgtggtagttttccattaggttggttagcttgcgtccagggtatgttgcgagagctgcttctatgaatcttgattggttggtcgatttgttgtgtggttcccttccccagtttccgttccatgtaaaatggaggatggcccatctttgtgtgtagcagttatacatgtagcttggaacgcggtagggtcttgttgtgatggaatagttcccgttcatctaggagaagggtttcctggaggagatggccattcaacacgatgattatgaaagacggaa

SEQ ID NO: 31736 - DNA, 605 bp, Panicum virgatum
  misc_feature: Ceres CLONE 1907160
  misc_feature: Encodes the peptide sequence at SEQ ID NO. 31737
acctcctctcgcgagcctcacacatcccactccactcgcacccgagagaagaaagagaggggggaaaacgagtcccggcagcaaaaccctagcccgctccccgaccccccccccgtcgcaggcgggggcggggatgatgggggcgggggcgggaagcagctgccccagcagcagccgatggcggtgtccgccccagccccggcgcccgcggcgggggaggaagtgcggaaggtcaggaagccctacaccatccccaagtcacgggagagctggacggagccggagcacgacaagttcctcgaggccctgcagcttttcgatcgtgattggaaaaagattgaagcatatgttggctcaaagactgttatacagattaggagccatgcacagaagtacttcttgaaggttcagaagaatggtgcaggcgagcatctgcctccaccccggccaaaacgaaaggcagctcatccatatccacagaaggcatctaaaaatgtttctcaagctgttttgtctcaacaactccctcagagggagcaaggctcagtcatgtctatggatacatcttctgctgttagagatgcaaatgcaaattcagcaatgtc

SEQ ID NO: 31737 - protein, 201 aa, Panicum virgatum
  misc_feature: Ceres CLONE 1907160
  misc_feature (88)..(133): Pfam Name: Myb_DNA-binding Pfam Description: Myb-like DNA-binding domain
TSSREPHTSHSTRTREKKERGENESRQQNPSPLPDPPPVAGGGGDDGGGGGKQLPQQQPMAVSAPAPAPAAGEEVRKVRKPYTIPKSRESWTEPEHDKFLEALQLFDRDWKKIEAYVGSKTVIQIRSHAQKYFLKVQKNGAGEHLPPPRPKRKAAHPYPQKASKNVSQAVLSQQLPQREQGSVMSMDTSSAVRDANANSAM

SEQ ID NO: 31738 - DNA, 728 bp, Panicum virgatum
  misc_feature: Ceres CLONE 1907161
  misc_feature: Encodes the peptide sequence at SEQ ID NO. 31739
aaaaaagattggcataatcatcttatctttttcgtttttgttttttctcttcaacacctgctcaatcgcggcggcggcggaggcgtcgtccatctccatgaacacggtggcttctctgtctttgatgccgcacttgctcattaagccttccttcacgagcttctccagaaagggcgttggtcgctatggcggaatcaaggtgtatgcggtgctcagggaagatggagctgaattcgcaaggaacaacaacctggaggccctgttccatgtcgatgaccccgggccgagggtcccaatcaagaagggcaagttcttggatgtgaatgaggctctggaggtggtcagattcgacatccagtactgcgattggagggcgcggcaggatctcctcaccatcatggttctccacaacaaggtggtagaggttctcaatcctttagcaagagaattcaagtctattgaaaccttgaggaaagagcttgacgagttacaggaggaactagcaaaagctcacaatcaggttcatttatcagaagcgagagtatcatctgcgctcgacaagttagcacatatggagaccctggtaaatgacaggctattgccggatggagcctctagtacatccacagccgagtccacttcattagtttcaagtacatcatccaccacccatgtccgaactaagaaacagccgcgtaagactctgaacgtgtctggtccagtgaagc

SEQ ID NO: 31739 - protein, 210 aa, Panicum virgatum
  misc_feature: Ceres CLONE 1907161
  misc_feature: SWISSPROT Homolog: EC 1.13.12.14 Chlorophyllide-a oxygenase
MNTVASLSLMPHLLIKPSFTSFSRKGVGRYGGIKVYAVLREDGAEFARNNNLEALFHVDDPGPRVPIKKGKFLDVNEALEVVRFDIQYCDWRARQDLLTIMVLHNKVVEVLNPLAREFKSIETLRKELDELQEELAKAHNQVHLSEARVSSALDKLAHMETLVNDRLLPDGASSTSTAESTSLVSSTSSTTHVRTKKQPRKTLNVSGPVK

SEQ ID NO: 31740 - DNA, 1780 bp, Panicum virgatum
  misc_feature: Ceres CLONE 1907166
  misc_feature: Encodes the peptide sequence at SEQ ID NO. 31741
actgcccacttgtttgcaagcggtggtggacgacgctccgctcccaaccgagacgacgagccgcccaagacgacgagccatttactcccactcccaatcccatcacgccccgcattgtttcaaaattctcgattcggtccgtggtggcagccgcgcggccgccgccgagggggctctctgggtaagagggagagggcctcgccgtgctgcaaggtcgccggcggcggcggagggcgtcggaggagagggcggaagggaggaggagcagcggtggaggggtgaagaggcgccgcgcatgggcaccacgcgcggggtcgcgtgtctgctcgtggcggtgatctgcttgtcgtgtgctgccgccgccgccgccgcgaggtcgccggcggcgaggctgcaccgccacctcaagcggttcaacaagccggccgtgaagagcatcgagagcccagatggggacatcatagactgcgtgcacatctcccaccagccagcgtttgatcatccttacctcaagaaccacactgtccagatgagaccgaactatcaccccgaaggcctgtatgacgaatccaagaccaatgtggcctccaccagcagtggcgagaagcctaaggttcagctctggcatcagaatggcaggtgtccggaaggcaccgtccccatcaggagaacgaagaaggacgacctgctcagggcaagctcaatgcggaggtacggcaggaaacggcacaccaccgcgaacccaatgtcggtcaatcccaccatgctcaatgagggtggccatcagcatgccatagcgtacgttcaaggcgacaagtactacggcgccaaggtgaccatcaatgtctgggagcccaagatcgagcagcctaatgagttcagcttgtcccagctctggatcttaggggggtcatttggggaggatcttaacagcatcgaggctggatggcaggttagtccggacctgtatggggacaacaacacgaggctgttcacctactggaccagtgatgcataccaagcaacagggtgctacaacatgttgtgctccgggttcgttcagattaacagcgagattgccatgggtgccagcatcttcccaacctcaagctactctggctcccaatatgatatcagtatactgatctggaaggacccaaaggagggcaactggtggatgcagttcggcaaggactacgtgctgggctactggccgtcgttcctcttctcatacctggcggacagcgcgtcgatgatcgagtggggcggggaggtggtgaactcgcagcctgatggcgtgcacacgtcgacgcagatgggcagcgggcacttcccggaggaagggttcagcaaggcgagctacttcaagaacatccaggtggtggacagcaccaacaacctcaaggtccccaaggggctgggcaccttcaccgagcagtccaactgctacgacgtgcagaacggcaacaatggcgactggggcacctacttctactatggcggccctgggaggagctccaactgccagtaactccgaaatcgtaacaaccattggaatgtaatacaccgcctgcaagcctcagttttctccgtagtcctagatcaatagtgtgtcatgtgaatggggttgttttgtggtggtttgtagtagtttctctctgttgagtttcttctctcttttttcttttcttctattgttactgccaggaaggcttctgaagagaagcaatggcatgtggtggtgatgcgttgcccttatggtggcctacctccttttcct

SEQ ID NO: 31741 - protein, 411 aa, Panicum virgatum
  misc_feature: Ceres CLONE 1907166
  misc_feature: Useful for biocontainment applications
MGTTRGVACLLVAVICLSCAAAAAAARSPAARLHRHLKRFNKPAVKSIESPDGDIIDCVHISHQPAFDHPYLKNHTVQMRPNYHPEGLYDESKTNVASTSSGEKPKVQLWHQNGRCPEGTVPIRRTKKDDLLRASSMRRYGRKRHTTANPMSVNPTMLNEGGHQHAIAYVQGDKYYGAKVTINVWEPKIEQPNEFSLSQLWILGGSFGEDLNSIEAGWQVSPDLYGDNNTRLFTYWTSDAYQATGCYNMLCSGFVQINSEIAMGASIFPTSSYSGSQYDISILIWKDPKEGNWWMQFGKDYVLGYWPSFLFSYLADSASMIEWGGEVVNSQPDGVHTSTQMGSGHFPEEGFSKASYFKNIQVVDSTNNLKVPKGLGTFTEQSNCYDVQNGNNGDWGTYFYYGGPGRSSNCQ

SEQ ID NO: 31742 - DNA, 687 bp, Panicum virgatum
  misc_feature: Ceres CLONE 1907167
  misc_feature: Encodes the peptide sequence at SEQ ID NO. 31743
ataaagagaaaggactttgcgattgtcgcttctttcctctccaaatcagagcctgccctcttacctatcccagcggaacggaaggatgtcgtcgccggcgaccagcgcgagcgcggacgaccacaagccgctggtgctcctggcgcagccactgttcccgaacttagccgcggtgctggagggccggtaccgcttggccctggccgcggacgccgacgaggccacggcgggcgaggccagggtgctgctcgtgccggggctcaaggaggtgaccgccgagctcatcggcaggctcccggcgctggagctcgtggtggccacctccgtcgggctggaccacgtcgacctggacgcctgccgccgcagcgggctcgccgtcaccaacgccggggacgccttctccgcggactcggccgactacgccgtgggcctcctcatcgccgtgctgcgcaggatcgccgccgccgaggcgtacctccgccgcggcaggtgggccacggacggcgagtacccgctcgccaccaaggttagtagtttgacctgtcaaaccacgccacctcctgcttgttgaccgagtcagacgcagtctggaccattcagattcagtgcgatgagagaaattcaggatagggcacaagatgtagtactatgacatagaaattcgtatttaggaccataagaatttct

SEQ ID NO: 31743 - protein, 161 aa, Panicum virgatum
  misc_feature: Ceres CLONE 1907167
  misc_feature (17)..(149): Pfam Name: 2-Hacid_dh Pfam Description: D-isomer specific 2-hydroxyacid dehydrogenase, catalytic domain
  misc_feature: SWISSPROT Homolog: EC 1.1.1.95 Phosphoglycerate dehydrogenase
MSSPATSASADDHKPLVLLAQPLFPNLAAVLEGRYRLALAADADEATAGEARVLLVPGLKEVTAELIGRLPALELVVATSVGLDHVDLDACRRSGLAVTNAGDAFSADSADYAVGLLIAVLRRIAAAEAYLRRGRWATDGEYPLATKVSSLTCQTTPPPAC

SEQ ID NO: 31744 - DNA, 912 bp, Panicum virgatum
  misc_feature: Ceres CLONE 1907169
  misc_feature: Encodes the peptide sequence at SEQ ID NO. 31745
gatctctcccatcgagagcggcggctcggctcccccggcccgcacccctcgccggcgccgctgcctcccgcccgagtctcccccagtcctccggatcggctcgctcctcgcctacctctcccaaatcaatctcgtcagcggcaggccagcatggggagctcgaccctcaccgatatgacgctcctgcccggcgtcgagacgatcgtggcggggctggccgccggctcctcctccccgggtccggatggcaaggtcaagaagaagcccatgaagtccctctacctcaagttcttcgacacggcgcccgacggcaagtcccgcatctgcaggctctgcaggaagagctactgcatgaccactgccacggggaatttgggaaagcatcttaataaccgccaccctggttatcaccaacttcctgaaggccccagcttcactgctcagagtaccgtacagactaccatggttactagaagcaagaaacctcatgttccggtgcgagctcgggcccaagcacagcctcaagttcaaagtcaatctcaaattcaagatcaacctcaagctcaagttcattctcaacctaagatgaaaccagctgttgatattgaccatgtcaactggttacttcttaggtggcttattggctcctcccttccaccttccaccctcgaagataatatgcttattgacagttgcaagtacctgagctcgtctgtcaggctttggccaaaagaaaaggttcaagaaattaccctagaggtgttcagaagtatgaaggaggatgtcaaggcatctctgcaacgtatcagttcccggctctctgttactctggacttttggacttcgtatgagaatatcgtatacatgtccgtcaagtgccattggattgatgaaaactgggtcttgcagaaa

SEQ ID NO: 31745 - protein, 253 aa, Panicum virgatum
  misc_feature: Ceres CLONE 1907169
  misc_feature (42)..(84): Pfam Name: zf-BED Pfam Description: BED zinc finger
MGSSTLTDMTLLPGVETIVAGLAAGSSSPGPDGKVKKKPMKSLYLKFFDTAPDGKSRICRLCRKSYCMTTATGNLGKHLNNRHPGYHQLPEGPSFTAQSTVQTTMVTRSKKPHVPVRARAQAQPQVQSQSQIQDQPQAQVHSQPKMKPAVDIDHVNWLLLRWLIGSSLPPSTLEDNMLIDSCKYLSSSVRLWPKEKVQEITLEVFRSMKEDVKASLQRISSRLSVTLDFWTSYENIVYMSVKCHWIDENWVLQ

SEQ ID NO: 31746 - DNA, 155 bp, Panicum virgatum
  misc_feature: Ceres CLONE 1907169-R
aatgtcgtcttatatggtgggcctcttgcaaaatcccagagttagaacctagaaccttgtgagcagcttgtgcttgcataattatgaaaaattagaatatttgtatttgttgcaattacggaaagccctgtacctccataatggtgtttgtttcc

SEQ ID NO: 31747 - DNA, 535 bp, Panicum virgatum
  misc_feature: Ceres CLONE 1907178
  misc_feature: Encodes the peptide sequence at SEQ ID NO. 31748
attgcattctcctctcctctcttctcatgctgcactcccactaaccatgaatccaaccccattccaggccgtcgagcatacacaatcgcggcgtgaggaccaggagagccggctggccgatgtggaaccacaaccaggacgtgacgggggccccacgcggcccgatcctgctgcaagactaccacctgatggagaaggtgatcaccttcgcccgcgagcgcttcccgcagcgcgtggtcaacacacccgcctcctcctccaatggcttcttctagtgcgcccccgacgtgaccgaccccaccttctcctacttcctcggcgcccccggcgcccccacgccggtgatcgtccgcttctccgctgtgatccatgagtgtggctcctgccacactattcatgacccggactgtttcgccttaaacttctacacccggtagggcaactgggacctgctgggcactaacttcctcttcttcttcatacccgactgcctcgacttccccaactttatccactccttctagtcctacctgcg

SEQ ID NO: 31748 - protein, 51 aa, Panicum virgatum
  misc_feature: Ceres CLONE 1907178
  misc_feature: SWISSPROT Homolog: EC 1.11.1.6 Catalase
MWNHNQDVTGAPRGPILLQDYHLMEKVITFARERFPQRVVNTPASSSNGFF

SEQ ID NO: 31749 - DNA, 724 bp, Panicum virgatum
  misc_feature: Ceres CLONE 1907182
  misc_feature: Encodes the peptide sequence at SEQ ID NO. 31750
accacccagcccacacgcacagggggccgcggggacccgcgaattcggcacgcaccacagccatggacgcgccccagctcctcctcgacgcgctcctctttctcctccccgccgcgctcctcctcctcaccctcctccaccgctcgcggggcaagcgcccgcgcctcccgccgggcccgccgtccctgccgctcctcggcagcgtggtgtggctcaccaactcgcccaccgagatcgagcccctgctgcggcgcctcttcgagcggcacggccccgtcgtggcgctccgcgtcggggcgcgcctctccgtcttcatcgccgaccgccgcctcgcgcacgcggcgctcgtcgagcgcggcgccgcgctggcggaccgcccggcgctcgtgtcggccaggctcctcggcgagaacgacaacaccatcacccgcgccagctacgggcccgtgtggcgcctcctccgccgcaacctcgtcgccgagacgctccacccgtctcgggtgaggctcttcgcgccggcccgcgcctgggtgcgccgcgtgctcgtcgacaagctcggggaggccgggcccgggcccggcgcgccgccgccccgggtcgtggagacgttccagtacgccatgttctgcctcctcgtgctcatgtgcttcggcgagcgcctcgacgagcccgcggtgcgcgcgatcgccgccgcgcagcgggagacgctcatctacatctccag

SEQ ID NO: 31750 - protein, 220 aa, Panicum virgatum
  misc_feature: Ceres CLONE 1907182
  misc_feature: SWISSPROT Homolog: EC 1.14.99.9 Steroid 17-alpha-monooxygenase
MDAPQLLLDALLFLLPAALLLLTLLHRSRGKRPRLPPGPPSLPLLGSVVWLTNSPTEIEPLLRRLFERHGPVVALRVGARLSVFIADRRLAHAALVERGAALADRPALVSARLLGENDNTITRASYGPVWRLLRRNLVAETLHPSRVRLFAPARAWVRRVLVDKLGEAGPGPGAPPPRVVETFQYAMFCLLVLMCFGERLDEPAVRAIAAAQRETLIYIS

SEQ ID NO: 31751 - DNA, 731 bp, Panicum virgatum
  misc_feature: Ceres CLONE 1907210
  misc_feature: Encodes the peptide sequence at SEQ ID NO. 31752
aaaccctagccgcatccacgcccccgcctccgcatccagatcggccgcgcccatggcgctcaagcagaagggcaccgacgctgccgccgccgaccccaagaagcgccgccgcgtcggcttctctggcatcgatgctggagtcgaggcaaatgagtgtatgaaagtgtttctggcaaggaatcctgacgaggcgggctctgaggactgcacttctattcaaccatttgacctaaaccatttttttggtgaagatggaaagatatatggttacaaaaatcttaagataaatgtgtggataagtgcaatatcattccatggatacgctgatatttcatttgaggaaacatctgatggagggaaaggaataacagatctaaaacctgttcttcagagcatttttggagaaaacttggtagaaaaagaggaatttctgcaaaccttttcaaaggaatgcgaatatatcagagacgtggtgacaaatggtaatgcaataaagcatgaaggcaccaatgaatcagatccagcagttgagattgttcgagttgaactccacggtgctgctgctttcctttattctcgtctggtgccgcttgttctgcttctggttgaaggttccacacctatagatattggagaacatggatgggaaatgcttctggtagtaaagaaacaacacaagagtctgtttcaaatttcaactgctaggttttgcagctgtccataatttttat

SEQ ID NO: 31752 - protein, 223 aa, Panicum virgatum
  misc_feature: Ceres CLONE 1907210
  misc_feature: SWISSPROT Homolog: EC 2.3.1.48 Histone acetyltransferase
MALKQKGTDAAAADPKKRRRVGFSGIDAGVEANECMKVFLARNPDEAGSEDCTSIQPFDLNHFFGEDGKIYGYKNLKINVWISAISFHGYADISFEETSDGGKGITDLKPVLQSIFGENLVEKEEFLQTFSKECEYIRDVVTNGNAIKHEGTNESDPAVEIVRVELHGAAAFLYSRLVPLVLLLVEGSTPIDIGEHGWEMLLVVKKQHKSLFQISTARFCSCP

SEQ ID NO: 31753 - DNA, 1874 bp, Panicum virgatum
  misc_feature: Ceres CLONE 1907211
  misc_feature: Encodes the peptide sequence at SEQ ID NO. 31754
acaaaagaattcgataaccatggcgtcctagaggagtcaaaccagtaagccaagaatcgtggcgccgtaagaggagaagggccaagaaatggcgagaaccgtggccggcgatgggatgcggcgggggcttagaggcggctggcggcggcgctgaccgcatggaggaggaggcgggggcaccatcatcatcctcgtcgtcgccgccgcccatcgcgcagctgggctacgaccagctgctgtccgtcctccgcctgctcccgcccgaggccgtgctctccttcgccgccacctgccgcgcgttccgggcgtgggcctcctccgacgcactctgggaggcgctgtgccgccgcgactggggcgcccgcaccgccgccgcgctagccgagcgccggcgcgagcgtggcggcggcggggtgccggcgccgtggaggagggtccacgccgaggtcgccaggctaggcgccctgtccgcgcgccgcgtccccgtgaggggcgcctcgccgcgaccccgcgcgtcgcactcgctcaacctagtcgctggatggcttgtgctcttcggcggcggctgcgagggaggtcaccaccttgatgatacttgggtggcttatactggaactggagctggaaatagactgcctactgtacttagctggcagcaattagcctctggcattccaagtgggcgtttcagtcattcatgcactctagtcagggacacattagtcttatttggtggaatcactgaccggggccagcgtttaaatgacacatggataggtcaagttatttctgaagaacctcgaaggatgcgaatttcatggagactgctggaggtaggtccacttgcaccacctccacgtggagcccatgcagcctgctgcgttgatgataagttcattgtgattcatggagggatagggctctatggcagccggcttggtgatacatggcttcttgatctctcaaatggcctccgatccggcagttggcatcaaatagggaacacatggcctttgcctccacctcgttctggccactctttaacttggattggtgggacacgcatggtgctgtttggtggtagaggatcagaatttgaggttcttaatgatgtctggttgtttgatattagtgatcattgcccaaaatggaaggagctaaagtatgacttgtctagtgctcttggtgaaatgccttttccacgggttgggcattcagcaatacttgccttgggaggcaaggtccttgtgtatggcggagaggactcacaaaggcgacggaaggatgacttttggatcttggatacaccagctctacttcaatacgagtcaggttccaagaaaatgattaaaaggatgtggaaaaagctaagaattgatggtcagtgcccaaattaccgatccttccatggggcgtatgtagatacttctggttgttgtgtgtatatttttggtggcatggttgatggccttgttcaccctgcagaagccttgggtctgcgatttgatgggcagctgtatcaagtggagcttgtgctgcatctttagaatgtgtatgttgttcccttgtaaatctgagaaatttcctaggtttgatctttagcatcttgtgtagtttgtaaaaacttcatcttaaatcttgaggtctcccagcaaatattgaaatgaccagtaccactaccatgtcacccagcttttcaacaatgtaaggatgctccaaatggtgtcggcctgtcaattgcttatgggcgcacgcccatacctgtcactgatctgtaaaaggaacagtgatcctttgtatttttttccattaaggaccgatctgtctgtatatgtggtttgaatctttattcctttatcatattcatacgttcc

SEQ ID NO: 31754 - protein, 478 aa, Panicum virgatum
  misc_feature: Ceres CLONE 1907211
  misc_feature (32)..(79): Pfam Name: F-box Pfam Description: F-box domain
  misc_feature: SWISSPROT Homolog: EC 3.1.3.16 Phosphoprotein phosphatase
MGCGGGLEAAGGGADRMEEEAGAPSSSSSSPPPIAQLGYDQLLSVLRLLPPEAVLSFAATCRAFRAWASSDALWEALCRRDWGARTAAALAERRRERGGGGVPAPWRRVHAEVARLGALSARRVPVRGASPRPRASHSLNLVAGWLVLFGGGCEGGHHLDDTWVAYTGTGAGNRLPTVLSWQQLASGIPSGRFSHSCTLVRDTLVLFGGITDRGQRLNDTWIGQVISEEPRRMRISWRLLEVGPLAPPPRGAHAACCVDDKFIVIHGGIGLYGSRLGDTWLLDLSNGLRSGSWHQIGNTWPLPPPRSGHSLTWIGGTRMVLFGGRGSEFEVLNDVWLFDISDHCPKWKELKYDLSSALGEMPFPRVGHSAILALGGKVLVYGGEDSQRRRKDDFWILDTPALLQYESGSKKMIKRMWKKLRIDGQCPNYRSFHGAYVDTSGCCVYIFGGMVDGLVHPAEALGLRFDGQLYQVELVLHL

SEQ ID NO: 31755 - DNA, 2748 bp, Panicum virgatum
  misc_feature: Ceres CLONE 1907216
  misc_feature: Encodes the peptide sequence at SEQ ID NO. 31756
gataaaccccagagtcggccgcgcagcctcctcttccgtccgcctctcctcgccgatagagagaggcagaggtagggcacccagctcaccaggagcttcgattccatccgctctcgtgcgcggattcgcaccccgggctcggctgtcgattttcaaccggagcagcggcgcaaccatgacgacggaccagccggtgatcagcctgcgcccgggcggcggcggcatcggcctgcgcgccccccgcctcttcccaaccgcgttcgccgccgccgccgccaccggagctggagacttcctccgtccgcacggcgggtcctcgaccggctttgccgccaagcttggagattcacgttttgagcctcttgagcgggttcgctacacaagagatcaactccttgaaatgcgtgagattgttgatatagctaaggaaatcttgaaactacagcaagatattagtgtagtaatccttgatgaggaacacgaggatcaaagttggcttcacaatgactcaaatgtacaaactcagtcaaataaccgctataccgagactgacagtcgcgactggcgttcacgttctcaaacttccccggttgctagtgaagagaagtcttgggataaaatccgtgaagctaaagaatctcgtgtttcaagtggaaagcaagagcaattaagctcccagtttgctgctaaagctcagactggtcccacccctactcttgtcaaggccgaagtcccatggtcagtccggagaggaaatctctctgagaaagagaaagttctgaaagccgtgaaaggaatactgaacaaattaactccagagaagtttgaccttctgaagggccaattgatagaagcaggaattactacagctgatattttgaaggatgttattactctcatatttgagaaggctgtatttgagcccacattctgtcagatgtatgctcagctgtgctttgaactcaatgaaagcctcccatcattccctcctgaagagcctggtgatagagagattacattcaaacgtgtactgttgaacaattgtcaagaagcatttgaaggtgctggcaacctacgggccgaggtggagaaattgactggtccagaccaggaggcggagagacgtgataaagaaaggcttgtgaagcttcgaacactgggaaacattcgccttattggtgagctgctgaagcaaaaaatggtgacagagaagatagtacatcacattgttcaggagttgctgggttctgatagcaactcatgccctgctgaggaaaatgttgaggccatctgccagttcttcaacacaattggtaaacagttggatgagaacccaaagtctcgtcgatttaatgatgtctacttcaaccgcatgaaggagcttacagctaatactcagttggcaccacgtttgaggttcatggcacgtgatatccttgatctctgttcaaacaactgggtgcctcgacgtgaggagataaaagccaagaaaatcagtgaaattcatacagaggcagaaatgaaacttggattgcgacctgggtccacggcaaacataaggaatggacggaccggtactggagggccactctcacctggagcttttccattgaatggacctggaactggtggcatgatgcctggcatgcctggagcgagaaagatgcctggaatgcctgggttagatagtgataattgggaagttccacgttctaaatccagagctgatccactccgcagccacacccagctggtgaataagccaccgtctgtcaattctagactgcttcctcaaggcagtggagcactaactagtggcaggacaagtgcgcttttgggcagtgggggtccaatatctcgtccttcaagttattctcctggactcgatgttgcaccagctccatctgcagctcctgtagctgagaagccagctgctgctcccaagccaaactctgctagtcttcaaaagaagactgtctctcttcttgaggagtatttccacgtttgtatattagatgaagcacaacagtgcattgaggagctcaaaagtcctgattactacccagaagtcgttaaagaagccatcaatcttgcccttgacaaaggtaccaattccatcgatcctcttgtgaggctactggaacacctccacagcaagaatattatcaagacagtagacttggaaactggattcttgctttatggttctcttctggatgatcttgctattgaccttccgaaagctccagcacattttggtgaagttattgggcggctgatcttgtcacactgtctggacattcgagttgttgaggataccctgaagaaaatggaggatacctccttccgctcagcggttttcaaagctgcaacgaatgccatagaagcatatgcgtcggggcaggctatcttgagctcgcatgtttctgaaattgatgcttgcaacaatcttttatcctccaaataaatagcttagaagtgtctccagttttgccctcgacttgagaaattataaagctgcagtagtgagaaacaaccatttgctagctgtatattttctttttgagaagccatatgagtgcttattgtttggacagtgacgaaatgaaaggatgaaagccacaaattttgctcttgtaacgttaggttaattttctgtacttctagcctgagatgaacaaggcaagcccttaacgtgaccctatttgtcgtatctaatgtaacttctactgtgttttggcacgtatt

SEQ ID NO: 31756 - protein, 763 aa, Panicum virgatum
  misc_feature: Ceres CLONE 1907216
  misc_feature (202)..(427): Pfam Name: MIF4G Pfam Description: MIF4G domain
  misc_feature (596)..(708): Pfam Name: MA3 Pfam Description: MA3 domain
MTTDQPVISLRPGGGGIGLRAPRLFPTAFAAAAATGAGDFLRPHGGSSTGFAAKLGDSRFEPLERVRYTRDQLLEMREIVDIAKEILKLQQDISVVILDEEHEDQSWLHNDSNVQTQSNNRYTETDSRDWRSRSQTSPVASEEKSWDKIREAKESRVSSGKQEQLSSQFAAKAQTGPTPTLVKAEVPWSVRRGNLSEKEKVLKAVKGILNKLTPEKFDLLKGQLIEAGITTADILKDVITLIFEKAVFEPTFCQMYAQLCFELNESLPSFPPEEPGDREITFKRVLLNNCQEAFEGAGNLRAEVEKLTGPDQEAERRDKERLVKLRTLGNIRLIGELLKQKMVTEKIVHHIVQELLGSDSNSCPAEENVEAICQFFNTIGKQLDENPKSRRFNDVYFNRMKELTANTQLAPRLRFMARDILDLCSNNWVPRREEIKAKKISEIHTEAEMKLGLRPGSTANIRNGRTGTGGPLSPGAFPLNGPGTGGMMPGMPGARKMPGMPGLDSDNWEVPRSKSRADPLRSHTQLVNKPPSVNSRLLPQGSGALTSGRTSALLGSGGPISRPSSYSPGLDVAPAPSAAPVAEKPAAAPKPNSASLQKKTVSLLEEYFHVCILDEAQQCIEELKSPDYYPEVVKEAINLALDKGTNSIDPLVRLLEHLHSKNIIKTVDLETGFLLYGSLLDDLAIDLPKAPAHFGEVIGRLILSHCLDIRVVEDTLKKMEDTSFRSAVFKAATNAIEAYASGQAILSSHVSEIDACNNLLSSK

SEQ ID NO: 31757 - DNA, 544 bp, Panicum virgatum
  misc_feature: Ceres CLONE 1907224
  misc_feature: Encodes the peptide sequence at SEQ ID NO. 31758
cacaaggattgtgttgataaatggctcaagataaatgcactttgccctttgtgcaaatctgagatagcgagctcatccaacacttctgatacacgtcaatcggaccagaatgctattccggtgcaggagattgaaatgcattaggttggtctgctctccctccttattacacaagaataccgctgtttggggttccctggcttgatgtataaagctggagattgatgtatggattgtagtgactcctagggttcgttttatcattgttatcttggagatgttacagctcttctcgctgtcacccaacaatgccaagccaatactacccaggtttccatcagcgtggattgtgccttgtgttctgttttggatgacactggatggctatttcgtagcccaaaagaggcgggccaggtccaggtacatagatgatccgttaacagcgtgatcctagtcaactttgcagtattttcattctgtgaaactgaagtttacgatattcagttgatgactataaaaatctggtaaacatgttccacttgtt

SEQ ID NO: 31758 - protein, 47 aa, Panicum virgatum
  misc_feature: Ceres CLONE 1907224
  misc_feature: The sequence is a functional homolog of SEQ ID NO 2 in US patent 7053203
  misc_feature: The sequence is a functional homolog of SEQ ID NO 404 in the 10/666,642 US patent application
  misc_feature: The sequence is a functional homolog of SEQ ID NO 178 in the 10/666,642 US patent application
  misc_feature: Useful for making plants with altered terpenoid content
  misc_feature: Useful for making plants with altered alkaloid content
HKDCVDKWLKINALCPLCKSEIASSSNTSDTRQSDQNAIPVQEIEMH

SEQ ID NO: 31759 - DNA, 695 bp, Panicum virgatum
  misc_feature: Ceres CLONE 1907231
  misc_feature: Encodes the peptide sequence at SEQ ID NO. 31760
ccggccaccgcatcgcgagtcgcgactcgtacccaccccaacttctgctccccgcccccctcgccgcggcgatggcgtccgggaacagcggcaagcagaggagcgaggaggaatggcgcgccatcctctcccccgagcagttccgcatcctccgcctcaagggcaccgagttacccggcacaggagagtacaacaaatttaaagctgacggggtttataactgtgttggctgcggaacccccctgtacaagtcggacaccaaattcgagtcaggttgcggctggccagcgttctttgaggggcttccaggagccataaaccgaacaccggatcctgatggtcggagggtagagatcacgtgcgcagcgtgcggcgggcatctgggccatgtgttcaagggagaaggcttcaagacgcccacggatgagcgccactgcgtgaacagtatctcaatcaagttcactcctgcctcctaaatcatcgtctctagattagcactcgcatgtctggaactggaagcactacagaacgttgaataagatctgtatccagcacatatgtgtgtgcgtgtcacctgttactttggctgtgagctgaaaaaaaactcccaccacagtccgcagcagcagctagcgaccggtctcagcaaccctccttcggctcacgcaatggccgcctccaccatggcgatctcc

SEQ ID NO: 31760 - protein, 134 aa, Panicum virgatum
  misc_feature: Ceres CLONE 1907231
  misc_feature (12)..(133): Pfam Name: SelR Pfam Description: SelR domain
  misc_feature: SWISSPROT Homolog: EC 1.8.4.12 Peptide-methionine (R)-S-oxide reductase
  misc_feature: Useful for making plants with modulated heat sensitivity
MASGNSGKQRSEEEWRAILSPEQFRILRLKGTELPGTGEYNKFKADGVYNCVGCGTPLYKSDTKFESGCGWPAFFEGLPGAINRTPDPDGRRVEITCAACGGHLGHVFKGEGFKTPTDERHCVNSISIKFTPAS

SEQ ID NO: 31761 - DNA, 1640 bp, Panicum virgatum
  misc_feature: Ceres CLONE 1907259
  misc_feature: Encodes the peptide sequence at SEQ ID NO. 31762
attttctttaacagtcccactccccaaccgggctctactcaacctccgcgccttcttgatccccgcccgcccaccaagcacaccgatccatctaatcctggtcgccgctgctgccggattcgcccgctaaccaacccgcgcaagctccgccccctgccgcgccgccatgctggcctcggcgagggggttctgggcgcggcaccgccggaagatcctcgtctcgctgggcgtcgcgggggcgggctacgccgcctaccgcctctacgacgcgcaccgcgcccagctcctgcgggtggagcagctgcgcgccagggaggagaaggccgccgacgacctcgtcaagaaccagctacagcaacactttgagaaggtgcagagcatttgtgacactaccacattgcctttggccatgcatcagctctgtgaaaacataacgagtcagttggatatttcaaaattgactgccaagttacggcaagggaaggcagaatcaagagcaatgacaccaaaagaaaaatatgatacttgggaggagattaaaattaagagtttcacaaagacagtttcttcaatttgggcaatgacgttgctcagcttgtacactagagttcaggtcaccatattaggcaggcatctctacttagattttgcccgaggtacacatggtgcacagttacaggaagaatctgatacctttagtgaaaatggacacaagagcttccttacaacggctgattatcttcccactggcaaaatcaatgcatacataatgcatatgcaacatgctgcaacaggagtcctaaaagagaagcaactgaaagaccttatgagcacggacgaagtattgcaaacaatgttacaaatattggactttttcatgaatctgtgtgaagataactcatggataaaataccttgtacctgacgatgccagtgttcaagcacagttgatggctgtgtccactagtggctttgatgattcatcactcctaaatgatttcagaaaactcgaacaactaatggccgagacacgagtagtactggcaagtgatgatttcagaaatatcatggagaggtcattgaggaagatagctgacatggtgatagaggacctgactgcgcaggctggaattccaagtcctccatcaggattgcccttagcgacgctcttgcccagagttgctcatttgagctcgctattgcttgaggagccaaacaagaacaaatacattcagatgatccgaagtatgcctgaagtggaactcttctacacattcctctatgcaaacatgccaccagaaacatgatctgtacattgatatgaaacgatcacttccttctgaactgtggctccaatggtctggcggtatgtggatgccgaacattctgcaaatctgggaaccaagagctcatttctgcgctgtatatgctgagatattccgcttttactaacatgaagtaactaagtgaagttccttccatctggattctttctttcttcaaagtctgggttgtgagtgtctatttaggatccccaccctttgtttctgctattttgctatatttttggaagcttacacgacgataattggtgcgtatgttttactggtcaaatggttaatgtatacatttctacttagt

SEQ ID NO: 31762 - protein, 379 aa, Panicum virgatum
  misc_feature: Ceres CLONE 1907259
  misc_feature (2)..(375): Pfam Name: Peroxin-3 Pfam Description: Peroxin-3
MLASARGFWARHRRKILVSLGVAGAGYAAYRLYDAHRAQLLRVEQLRAREEKAADDLVKNQLQQHFEKVQSICDTTTLPLAMHQLCENITSQLDISKLTAKLRQGKAESRAMTPKEKYDTWEEIKIKSFTKTVSSIWAMTLLSLYTRVQVTILGRHLYLDFARGTHGAQLQEESDTFSENGHKSFLTTADYLPTGKINAYIMHMQHAATGVLKEKQLKDLMSTDEVLQTMLQILDFFMNLCEDNSWIKYLVPDDASVQAQLMAVSTSGFDDSSLLNDFRKLEQLMAETRVVLASDDFRNIMERSLRKIADMVIEDLTAQAGIPSPPSGLPLATLLPRVAHLSSLLLEEPNKNKYIQMIRSMPEVELFYTFLYANMPPET

SEQ ID NO: 31763 - DNA, 1720 bp, Panicum virgatum
  misc_feature: Ceres CLONE 1907277
  misc_feature: Encodes the peptide sequence at SEQ ID NO. 31764
gcgatatccacttgcccagttcccctctctctcgcaccctcgcacaccatggcggcactctgctccgcctccccggccatctccacggcggcatctctcggacttcccgcgcgccgggtcgcctccctcctccgcctgcgcctgcgcgccgccgcgcgctcctactccgcagcagcagaaccgcgggcggcggcggcggcggcggcgtggcgagcgcggcggagattcgcggcgtcggcggcttccacgacagaggagtcttctggagtagatatgatgatcccacccgacaatcgcatcccagccaccatcatcaccggcttcctcggttccggcaagacaactttactgaatcacatcttgactgctcaccatggaaagcgaattgctgttatagaaaatgagtttggagaagtagacatcgatggctcactagttgctgcacaaactgctggagctgaggacataatgatgctaaataatggctgcctttgctgcactgtgcgtggtgatttagtccgtatgattggtgaattggtcaacaagaagaaggcgaagtttgatcatattgttattgaaacgacaggtttggctaatccagcgccaattatacagacgttctatgcagaggatgtagtttttaatgatgtcaagctggatggtgtggtaactttagttgatgcaaagcatgctagattgcatttggatgaagtaaagcccatgggtatagtcaatgaagcagttcagcaaattgcctatgctgacaggattatagttaacaagattgatcttgtaaatgaacctgaagtttcttccttggttgagcgtattaggggtattaatcgcatggctaatttgaaacgagctgagtatggcaaagttgatttagattatgttcttggaattggagtatttgatctggagaggattgagagtgctgtctctgaaaaatcacacgaagacctcgcggaacatgaccatcatcatgagcatgagcatgaccacgaccatcatcatgaccatgaccatgaccatcatcaccatcatgaccacgaccacggacacgaccatcatgcacatgatcacacccatgatcccggtgtttcttctgtgagcattgtttgtgaaggggagatggatcttgaaaaggctgacatgtggttggggaatctactgctggaacacagtgaagatatatataggatgaaaggactgcttgctgtcagtggaatgcctcaacgattcgtgtttcagggagtgcacgacattttccagggatctcctgagaggatgtgggagccaaatgagccacgcatcaacaagattgtcttcatcggcaggaacctcaacaaagaagagctggagaagggcttcaaggattgcctgctgaagaaatagaccgagtctagcttctatgattttccaacatattggatggatctccagcttcatgattttgagctttgcggctgcagaacttatccttgagaaaccaaagtatcgaactgacgtgatgtgtgagattgtatagaatggatagctttattgcaaccttgcatccttctcacaacaacagcagtgcagtagccatttatatcacaatatcgttgcacggagttgaactgtaacctctagatctagagatagagtaaaactttcagtgtggtccgtggaaatcacataagcacatttgcaatacttcatggaatattactactgt

SEQ ID NO: 31764 - protein, 449 aa, Panicum virgatum
  misc_feature: Ceres CLONE 1907277
  misc_feature (85)..(272): Pfam Name: cobW Pfam Description: CobW/HypB/UreG, nucleotide-binding domain
  misc_feature (352)..(446): Pfam Name: CobW_C Pfam Description: Cobalamin synthesis protein cobW C-terminal domain
MAALCSASPAISTAASLGLPARRVASLLRLRLRAAARSYSAAAEPRAAAAAAAWRARRRFAASAASTTEESSGVDMMIPPDNRIPATIITGFLGSGKTTLLNHILTAHHGKRIAVIENEFGEVDIDGSLVAAQTAGAEDIMMLNNGCLCCTVRGDLVRMIGELVNKKKAKFDHIVIETTGLANPAPIIQTFYAEDVVFNDVKLDGVVTLVDAKHARLHLDEVKPMGIVNEAVQQIAYADRIIVNKIDLVNEPEVSSLVERIRGINRMANLKRAEYGKVDLDYVLGIGVFDLERIESAVSEKSHEDLAEHDHHHEHEHDHDHHHDHDHDHHHHHDHDHGHDHHAHDHTHDPGVSSVSIVCEGEMDLEKADMWLGNLLLEHSEDIYRMKGLLAVSGMPQRFVFQGVHDIFQGSPERMWEPNEPRINKIVFIGRNLNKEELEKGFKDCLLKK

SEQ ID NO: 31765 - DNA, 1856 bp, Panicum virgatum
  misc_feature: Ceres CLONE 1907296
  misc_feature: Encodes the peptide sequence at SEQ ID NO. 31766
acccatggcggcccacgacgcccccgccaccgcagcagcgggcgacggggcgcgccgcccgccgccgcggcccacgctctccctgcccccgcgctccgccgtcgagtccctcttcgccggctcctcctcggccggcgccggcgccggcgccaccgagaccagccccggcccgctcaccctcgccgccgcgttcttccccgacgcgccctccccggccttccacggctccttcacgcagctcctcgtcggcgccataggctcgcccgccgcctccgccgccgcgccggccgtccccgcgccgccgtccccgttctccgtgccgccggacctcagccccaccgcgctcctcggctcgcccggcctcttctccccaacggggagctttgagatgtcccatcaacaagccttagcacaagtaacagcacaagcagtccactcacagtttaatatgatcaatcactcagatttctcgatccctttttcgtcgacagcaagaccagcttcgacatcacagcatcagcatgccaaccctgccaatgtgacatcaacgcaggagatatcaactctgccatcacatacagctaaaaagagcattgaatctaatgaggtttcacaaggactccaaagttctgcaccctcttttgataaacctgctgacgatggatacaactggcggaagtatggccagaaggcagttaagggtggcgagtatccaaggagttactacaaatgtacccatgcaagttgtccagttaagaaaaaagtggagcgctcaggagaaggacacatcactcaaataatttatagaggtcagcacaaccaccagcgtccaccgaaaaggaggtccaaagatggtggtggtctcctaattgaagcggatgatttccatgagaatgaagatgcttcaacaagatcagaaccaggctctcaagaccactctgggaaacatgggggttccaatgatggcatagcagggcctcgtgtgtcaaggaagagagaaggagatgagcaattgtcgggttctagtgatagtgaggaggaggaagatgctgaacaaagggttggcaatggagatgctggtcgggcaaatgcaaacagaagacatgtgccaactccagctcaaaggataattgtgcaaacaactagtcaggttgatcttcttgatgatggttaccgatggcgcaagtatggtcagaaagtggtaaaagggaatccacacccaaggagttactacaaatgcacgtatcaagggtgtgatgtgaagaagcatatcgaaaggtcatcacaagacccaaaggccgtcataacgacatacgaagggaagcacagccacgatgtgcctgcagccaggaacagtagccatgctgctgctgctaacaccaacgcgtcatcctccaccagcttaccacacaggggacagaattcagcatccagtagtggcagaggagcagatgtgtcgtcggcttcttctatgctactaaaagaggaaaatgaaataacataatgttttggagtgtctagctgcctgaattattctgttctctcggtccatttcccgggtgtgttgcctcgccctatggtggtctgctggagcaaattggtattgtaaatcctgcttggtttcagcgaagagcgagatccttttgttcgcacacttccgacagctttgcactaactgtttttgcagcattttgttgttgccccgttggttgtaaatgccattagtcttacccatggagaactatatagtagatgacagctttcatcagccaattgtatatgctcgatttggaacgtttaactgagatgatttgtagatacacggctgacaggatatataaatttatagttgctgg

SEQ ID NO: 31766 - protein, 499 aa, Panicum virgatum
  misc_feature: Ceres CLONE 1907296
  misc_feature (386)..(445): Pfam Name: WRKY Pfam Description: WRKY DNA -binding domain
  misc_feature (217)..(275): Pfam Name: WRKY Pfam Description: WRKY DNA -binding domain
  misc_feature: The sequence is a functional homolog of SEQ ID NO 140 in the 10/225,068 US patent application
  misc_feature: The sequence is a functional homolog of SEQ ID NO 2444 in the 10/374,780 US patent application
  misc_feature: The sequence is a functional homolog of SEQ ID NO 592 in the 10/412,699 US patent application
  misc_feature: The sequence is a functional homolog of SEQ ID NO 734 in the 10/225,066 US patent application
  misc_feature: The sequence is a functional homolog of SEQ ID NO 86 in the 10/412,699 US patent application
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
MAAHDAPATAAAGDGARRPPPRPTLSLPPRSAVESLFAGSSSAGAGAGATETSPGPLTLAAAFFPDAPSPAFHGSFTQLLVGAIGSPAASAAAPAVPAPPSPFSVPPDLSPTALLGSPGLFSPTGSFEMSHQQALAQVTAQAVHSQFNMINHSDFSIPFSSTARPASTSQHQHANPANVTSTQEISTLPSHTAKKSIESNEVSQGLQSSAPSFDKPADDGYNWRKYGQKAVKGGEYPRSYYKCTHASCPVKKKVERSGEGHITQIIYRGQHNHQRPPKRRSKDGGGLLIEADDFHENEDASTRSEPGSQDHSGKHGGSNDGIAGPRVSRKREGDEQLSGSSDSEEEEDAEQRVGNGDAGRANANRRHVPTPAQRIIVQTTSQVDLLDDGYRWRKYGQKVVKGNPHPRSYYKCTYQGCDVKKHIERSSQDPKAVITTYEGKHSHDVPAARNSSHAAAANTNASSSTSLPHRGQNSASSSGRGADVSSASSMLLKEENEIT

SEQ ID NO: 31767 - DNA, 1968 bp, Panicum virgatum
  misc_feature: Ceres CLONE 1907302
  misc_feature: Encodes the peptide sequence at SEQ ID NO. 31768
gttcatctccgagctccaacgccgccgcgcccggaggccggagctgggatctctgggaggtgtggggacggggggtctagccgccggaagtaggtagggcggtctccgtacctagccctattgttgggtccgcttcttcgccgccaagttcttggtacgcggccctaccctcacttctcccagattcatgaagatccctcccttcaggccgtcgtattgctgacttgccgtcacacagtccacgactagcgtttctaatggaggaagaacacatagatgcaccgtcgtatatccacattgagagcaacgatttctcctacagaaagcacaagaggcagaaagaggaggacatagttgtgtgcgagtgccagtatgatatcttggatccggagagtccatgtggagatcggtgcttgaatttcttgactaacacagagtgcacgcctggctactgccgctgtggtgtgtactgcaaaaaccagcggttccaaaaatgtcaatatgctaggacaaggctggtaaagactgaagggcgtggatggggtcttgtggcagatgagaatattatggctggtcaatttgttattgaatattgtggcgaagtaatatcatggaaggaagccaaacggagatctcaagcttatgaaacccaaggtttaaaggacgcctatatcatttacctcaatgctgatgaatctattgacgcaacaagaaaagggagtcttgccagatttatcaatcattcatgccaaccgaattgtgagacaaggaaatggaacgtccttggggaagtaagagttggaatatttgcaaagcaagacattccttatggaacagaattatcctatgactacaactttgagtggtttggtgatgtgatggtacggtgcctttgtggagctgccaactgttctgggtttctagaggctaagtcacgtggtttccaggaggccacgtacctctgggaagatgatgatgacaggttttctgttgagaatgtccctctttatgattctgctgatgatgaacctacaagcatcaataaggagatcctcctaggaaatggtgggtcgatcgctcaatatggcaacagtgatacagtgcagaacactgagaaccctgggattgcaaacacaaatgaatttgcaccaatgattgttgaacaatttactgcaagctcaaatgaattagcaacaatgactgtcgagcccttggctgcaagttcaaatgaattcacaccaatgactgttgaaccattgaatgctattccaatgggagcccgttttgctgagaatgggttgactgaacataatgcacaagattctcatgtcgctcctcaaaattcagtgccagaagctgcaaatcacgagaaccaaactgaatcacaaaacaaagcattggtccctgtaaagcccatacccaagcgacgtggtaggaaacctaaacgtgttgtgcgcaaactggatattccagatatttgcgaccggttagtatcatctgtggcgtgtgaagaaatattgtactgtgaggaagtgaagaatcaggctgcttctcaaatagatgccctgtatgacgagataaggccagcgattgaagagcatgagagagatagccaagacagcgtctccacaagccttgcggagaagtggatcgaggccagctgctgcaagtacaaagctgatttcgatctgtatgctgcaatcatcaagaaccttgcctccgcgccgctaagatctaaggatgatgtggccccgagagaacagaatggattgaaatacttgraaaatggctcgtgatttagttagaaatgtgcattctttactattgcaccctgatgttgttgaggttttaggtttttctttcttcttcaattgatcttaattaccttatcaacaaaatgaccttaattaggtagagaaacttcgtgtgatcacaaattaacaatgttgaattatacatcttcagtcc

SEQ ID NO: 31768 - protein, 512 aa, Panicum virgatum
  misc_feature: Ceres CLONE 1907302
  misc_feature (77)..(206): Pfam Name: SET Pfam Description: SET domain
  misc_feature: SWISSPROT Homolog: EC 2.1.1.43 Histone-lysine N-methyltransferase
  misc_feature (509)..(509): Xaa is any aa, unknown, or other
MEEEHIDAPSYIHIESNDFSYRKHKRQKEEDIVVCECQYDILDPESPCGDRCLNFLTNTECTPGYCRCGVYCKNQRFQKCQYARTRLVKTEGRGWGLVADENIMAGQFVIEYCGEVISWKEAKRRSQAYETQGLKDAYIIYLNADESIDATRKGSLARFINHSCQPNCETRKWNVLGEVRVGIFAKQDIPYGTELSYDYNFEWFGDVMVRCLCGAANCSGFLEAKSRGFQEATYLWEDDDDRFSVENVPLYDSADDEPTSINKEILLGNGGSIAQYGNSDTVQNTENPGIANTNEFAPMIVEQFTASSNELATMTVEPLAASSNEFTPMTVEPLNAIPMGARFAENGLTEHNAQDSHVAPQNSVPEAANHENQTESQNKALVPVKPIPKRRGRKPKRVVRKLDIPDICDRLVSSVACEEILYCEEVKNQAASQIDALYDEIRPAIEEHERDSQDSVSTSLAEKWIEASCCKYKADFDLYAAIIKNLASAPLRSKDDVAPREQNGLKYLXNGS

SEQ ID NO: 31769 - DNA, 1655 bp, Panicum virgatum
  misc_feature: Ceres CLONE 1907304
  misc_feature: Encodes the peptide sequence at SEQ ID NO. 31770
aaccggggaagcggagtaagccctgcgcgattctcttcttgagacggaagcaaaactagagagagagaccgatactgcgggaggacgagatggccgacggggaggacaccgccgccgcgcgccgccggtccgccatcaccgactaccggaagaagctgctcaactgcagggagctcgagtcgcgcgtcggcaccgtgagagaaagcctaaaaaatgcgaagaaggactttgccaagactgaagacgacttgaaatcgctgcaaagcgtgggtcaaataattggagaggtcctccggcctcttgataatgaacgtttcattgtgaaggccagcagtggtccccgatatgtggttggttgccgaagtaaagtggacaaggagaagctgacttctggaactcgtgttgtacttgacatgacgaccttgacaataatgcgtactctaccacgggaggttgatcccgtggtatacaacatgcttcatgaagacccaggaaatgtcagttactctgctgtaggtggtttgtctgatcagattagagaactcaaggagtccattgagttaccgcttatgaaccctgaactctttcttcgggtggggattaagcctcctaagggtgttctactctacggtcctccagggaccgggaagacactattggcgagggctatcgccagtaacatcgatgccaactttttgaagatcgtttcaagtgctattattgacaagtacattggagaaagtgctcgtttgattagagaaatgtttggctatgcacgagatcaccaaccatgcatcatcttcatggatgaaattgatgccattggtgggcgaagatttagtgagggaactagtgctgatcgtgagatccagcggacgttgatggagctccttaaccagctagacggatttgatgagcttgggaaggttaagatgatcatggctacgaaccgacctgatgttctggacccggcactcctgcgtcctggacgtttagacagaaagattgagattccactacccaacgagcaggcaagaatggaagttcttaaaattcatgctgctggtattgccaaacatggggaaattgattatgaagctgtcgtgaaacttgcagaaggtttcaatggggctgatcttcggaatgtctgcacggaagctggtatggctgcaattcgggcagaaagggactatgtggtccatgaagacttcataaaggctgtgcgcaagctaaatgatgcaaagaagctggaatcgagtgcgcactacagcgcagactttgggaaggagtagtaacgcccgattttgctactaaggcgtatgctgtgtatcactggggagctcagccatcaccatgcgaaagcaagaaagaaattggctatctatgttcagtctcctggacattcctctttttctgatattcgcaatcttattgaggaggattgtcaagctgaccactgggagaaaccattcgagaatttactaattttgaaccagttgctgtttgcttcagtgatcatcatacgttatcagcttccctgtgtattagtctggtaactcttgttcgggctgtttcatttccatcattccatgtacttggacagtgtgcgtgcctgctcggtaacaaagtaagaaaaaagaggctagtttgtgttc

SEQ ID NO: 31770 - protein, 400 aa, Panicum virgatum
  misc_feature: Ceres CLONE 1907304
  misc_feature (176)..(363): Pfam Name: AAA Pfam Description: ATPase family associated with various cellular activities (AAA)
  misc_feature: SWISSPROT Homolog: EC 3.6.4.3 Microtubule-severing ATPase
MADGEDTAAARRRSAITDYRKKLLNCRELESRVGTVRESLKNAKKDFAKTEDDLKSLQSVGQIIGEVLRPLDNERFIVKASSGPRYVVGCRSKVDKEKLTSGTRVVLDMTTLTIMRTLPREVDPVVYNMLHEDPGNVSYSAVGGLSDQIRELKESIELPLMNPELFLRVGIKPPKGVLLYGPPGTGKTLLARAIASNIDANFLKIVSSAIIDKYIGESARLIREMFGYARDHQPCIIFMDEIDAIGGRRFSEGTSADREIQRTLMELLNQLDGFDELGKVKMIMATNRPDVLDPALLRPGRLDRKIEIPLPNEQARMEVLKIHAAGIAKHGEIDYEAVVKLAEGFNGADLRNVCTEAGMAAIRAERDYVVHEDFIKAVRKLNDAKKLESSAHYSADFGKE

SEQ ID NO: 31771 - DNA, 634 bp, Panicum virgatum
  misc_feature: Ceres CLONE 1907315
  misc_feature: Encodes the peptide sequence at SEQ ID NO. 31772
gagccacgatccaccaccacacactctccagcacccggcggagcaagcggccagcgagagatccagaggcagcagcaatggccaccgtcagcgccgccgcggcgaccaccgtcgttgcccgcgccgccctagggctgccgcagctgagggcgaggagcgagagggtgcggtgcggctactcgagggacgccaggagcgcggcggccgccgtgagcgcgaggggcgccggcgcgtcgctgctggccgcggcgggcgcggtgaccgcgtcggcggggccggcgctggcgctcgtggacgagaggatgtcgacggagggcaccgggctgagcctggggctcagcaacaacctgctggggtggatcctcctgggggtcttcggcctcatctggtcgctctacaccgtctacacctccgacctcgacgaggacgaggagtccggcggcctctcgctctagataatatcatgtccgtcctctgctcctgttactaccgatccggatgtaaacatggcggtggtcatcggtgtaatgtcagacttggctatttaagtctagactctataggagacagtcgcaggaggccaggagaagcagccggcgagcagcaagccgtggcgtccaccacctgcttcctc

SEQ ID NO: 31772 - protein, 125 aa, Panicum virgatum
  misc_feature: Ceres CLONE 1907315
  misc_feature (1)..(125): Pfam Name: PsbW Pfam Description: Photosystem II reaction centre W protein, PsbW
MATVSAAAATTVVARAALGLPQLRARSERVRCGYSRDARSAAAAVSARGAGASLLAAAGAVTASAGPALALVDERMSTEGTGLSLGLSNNLLGWILLGVFGLIWSLYTVYTSDLDEDEESGGLSL

SEQ ID NO: 31773 - DNA, 712 bp, Panicum virgatum
  misc_feature: Ceres CLONE 1907319
  misc_feature: Encodes the peptide sequence at SEQ ID NO. 31774
aaaaatcattccccactcgcatctcgcctgatctggaccatggaggaggaggaggaggaggaggagggatctaagaaggacaactctctggtgtcggaagcagaggcggaggcggcggcggcggcggcggcggccagcctcctcacggacgacctcatcatggagatcctgtcacggctccccgtcaggtcagtccaccgcttcaagtgcgtctgcaagcgctggcgcgacctcatcgcctgcccggcccaccgcgaaaagctgccccaaacccttgccggcttcctctacaccacctaccccggcggctaccgccaccacctggccgccgtctcggcagccacggtcatcgattccgtcgacgcttccctcgctttcctgcggcctatgaattacaccaagatccgcctggtggacacctgcaacggcctcctcctctgctcctgctacaacaacaacaacgaggaacgtctggtcgtctgcaatcccgccacccagaggtggaccgagctgcccccacctccgcagccgcagccaaccacagattactgtgcccaacacctggctttcgatccggcagttagcccatcccatttctgcgtcctcgatttcgaggccactgtcaaggaatggcatctcacaggagtgagcatctactcatccagaaccagagcctggactcatagggatatttggcttggttgacaaaatt

SEQ ID NO: 31774 - protein, 221 aa, Panicum virgatum
  misc_feature: Ceres CLONE 1907319
  misc_feature (30)..(77): Pfam Name: F-box Pfam Description: F-box domain
MEEEEEEEEGSKKDNSLVSEAEAEAAAAAAAASLLTDDLIMEILSRLPVRSVHRFKCVCKRWRDLIACPAHREKLPQTLAGFLYTTYPGGYRHHLAAVSAATVIDSVDASLAFLRPMNYTKIRLVDTCNGLLLCSCYNNNNEERLVVCNPATQRWTELPPPPQPQPTTDYCAQHLAFDPAVSPSHFCVLDFEATVKEWHLTGVSIYSSRTRAWTHRDIWLG

SEQ ID NO: 31775 - DNA, 570 bp, Panicum virgatum
  misc_feature: Ceres CLONE 1907321
  misc_feature: Encodes the peptide sequence at SEQ ID NO. 31776
acatccccaatcgcacgacgaggcccttgcattgcctcttgaatgttagttttgtacaacccaagatcgatcgaagccatggccaagcctcacatcctcatggagccgctgccggaccaaggccacgtcacccccatgatggagctcgcccacagtttggtcaaacacggcttcgatgtcaccttcctcaacacccaagaccctcacccgcaggtcgtcggcgcgctgcaggcggagggcggcacggccggcgctggccggcatccacctggacgccatcccggacaggctggagcaagaggaacgcttggacgtcgtcaagagtcatcgagtactaccaccggcacattccggggcacctgcagcggctcatcgccgaaatggaggcatccaggaagcccaaagtgaactggatcggctgcaaagtgtacatgtagacgtgctacctcatcgccaaaaagtaccgcatccgcctggccgcactctggcaggcggcggaggcgtgcttagcctttaatatcaagatccccatgttattaaaggatgggctactcaactacaagggtttgc

SEQ ID NO: 31776 - protein, 109 aa, Panicum virgatum
  misc_feature: Ceres CLONE 1907321
  misc_feature: SWISSPROT Homolog: EC 2.4.1.218 Hydroquinone glucosyltransferase
  misc_feature: Useful for making plants with altered carbohydrate content
MAKPHILMEPLPDQGHVTPMMELAHSLVKHGFDVTFLNTQDPHPQVVGALQAEGGTAGAGRHPPGRHPGQAGARGTLGRRQESSSTTTGTFRGTCSGSSPKWRHPGSPK

SEQ ID NO: 31777 - DNA, 689 bp, Panicum virgatum
  misc_feature: Ceres CLONE 1907333
  misc_feature: Encodes the peptide sequence at SEQ ID NO. 31778
acctgctgccaatcaaccaagaagcacgcgcggtcacaccaagtcagggagaaggccatggccggcgtgaactcaaccagcgtcgtcgggctcaagcccgccgcggcggtgccgcaggccgccacctcctcgccggcggcgaagcgggtccaggtcgcgcccaaggaccgggcggccgagagccggcgcgcggcgctcctcggcctggcggccgtcttcgccgtcacggccaccaccgggtcggccaaggccgggatcatcgacgagtacctcgagaagagcaaggccaacaaggagctgaacgacaagaagaggctggctaccagcggcgccaacttctcccgcgcctacaccgtcgagttcggcagctgccagttcccctacaacttcaccggctgccaggacctcgccaagcagaagaaagttcccttcatcactgacgacctcgagatcgagtgcgaggggaaggagaagtacaagtgcggctccaacgtcttctggaagtggtgaagcgcacgcttgattggcttggaactggagggggcgctggcggtgtaacgtgtgtacctagatgcccaaactgcaggaaaaatttggatgtgtaatttaccgtcactgtatctgtgccatctcatcatcgtctgaacatgaacctcttgtattgaggagtgtgaaaaaatctcatccgg

SEQ ID NO: 31778 - protein, 150 aa, Panicum virgatum
  misc_feature: Ceres CLONE 1907333
  misc_feature (9)..(150): Pfam Name: PsaN Pfam Description: Photosystem I reaction centre subunit N (PSAN or PSI-N)
MAGVNSTSVVGLKPAAAVPQAATSSPAAKRVQVAPKDRAAESRRAALLGLAAVFAVTATTGSAKAGIIDEYLEKSKANKELNDKKRLATSGANFSRAYTVEFGSCQFPYNFTGCQDLAKQKKVPFITDDLEIECEGKEKYKCGSNVFWKW

SEQ ID NO: 31779 - DNA, 1392 bp, Panicum virgatum
  misc_feature: Ceres CLONE 1907373
  misc_feature: Encodes the peptide sequence at SEQ ID NO. 31780
gttgctttgccgtctgccggccggcgagtcgacagggaaaatctccgaggggaggagaccgcgagatgtccttcttcttccgcatggcgtcgcggctgcggccgtcgacgccggaggaggtcgtccgctccatcaaggactccttcctcgcgctcaacaccaggacccacaccaaggctctggaagaggttgagaaaaacattgcatccttgagattgttgatctctggtgatggagaggtggaaccaaatcaagagcaggtcctgcaaataactattgagatttgcaaggaggacatcatttccctcttcgtccagaatctaccttccttgggttggacagtaagaaaagatctggttcactgctggtgcattttgctgaggcagaaaaatgatgaaagttattgctgtgtgcagtatattgaaaatcatttggagcttttggatttccttgttggttgctacaagaacttggatattgcattgaactgtgggaatatgttaagagaatgcataaagtacccaactctagcaaaatatatattggaatctggtaactttgaactgttctttgaatatgttgagctgccaaactttgatattgcttctgacgctctgaacaccttcaaggatctgcttaccaagcatgaaactgtagttgcagagttcttgggttcccactacgaccagttctttgaactctactcaaggctcttgttgtcgactaattatttaacaagaaggcaggcaatgaagttcctatcagaatttttactggaggctcctaactctcaaataatgaagcgatacattgtggaagttcgttttttgaacattatgatcaatctactaaaggtattgtctatattattttaaatcttcttttggaaattacctgagaatatttttcatataaccattgcactattctgtcgcttcctacttttatatttataactttactgtcttgttttattcttgtggatgctttacaaattgaacaattaaaatactcatttgattatactgaccagattttacactatgaatttggaaggtaaaaggcactattgcaatttgcattaaatacaacattttgctgaaatttcaaatgccaaggtcatcacgcatcaatacaggttcgaatttttgggttataggatctgtttgttgaaccctacttgtatcagttggctatgatagttgcttgccaactaaaactttttccagcataaaaaaaactaaatttttttccaacctatgtatgtcttcagaacttttaattaatgggtgcttgcctaatttaggtagctcttgtggtagttctgtttcttgacaagatgggtgacacaagttacaggcttgctgaaaaaaagtaaaaggttcaacaatt

SEQ ID NO: 31780 - protein, 269 aa, Panicum virgatum
  misc_feature: Ceres CLONE 1907373
  misc_feature (1)..(269): Pfam Name: Mo25 Pfam Description: Mo25-like
MSFFFRMASRLRPSTPEEVVRSIKDSFLALNTRTHTKALEEVEKNIASLRLLISGDGEVEPNQEQVLQITIEICKEDIISLFVQNLPSLGWTVRKDLVHCWCILLRQKNDESYCCVQYIENHLELLDFLVGCYKNLDIALNCGNMLRECIKYPTLAKYILESGNFELFFEYVELPNFDIASDALNTFKDLLTKHETVVAEFLGSHYDQFFELYSRLLLSTNYLTRRQAMKFLSEFLLEAPNSQIMKRYIVEVRFLNIMINLLKVLSILF

SEQ ID NO: 31781 - DNA, 649 bp, Panicum virgatum
  misc_feature: Ceres CLONE 1907373-R
tttgcaggattcgagtaaaaatatcagaatatgtgccttccacgtttttaaggtatttgttgccaatccaaacaagcctcgctgtataattgaagctttactacagaatcgtcgtgaactgttgaagctacttcacaatcttcctaccagtaaaggtgatgatgaacttgatgaggagaaagatctgataattcagcaaatccagaagctggcatgatcatcagcgcggaaccttacagttatcggagcaatggtaccatgtccttttggagggcttcagcacccgtcaaccataccactagaaggcccaaaatcatgtatatagcactgcatgcatatagcctccaagggctgttgaatttttggagggttttgctgttggtctcaggagaccgtggcagacgattgtcctttttgaaagattttacagttggttttggggggaccagagtaattggatatatacagggaaaagatagctgcagagatgaatgaacgagagagcaggttttctttgagaaaaaaagagacgaggtgtaaccaatgtaaatttgtaatgtggtgtgtgctgtcagcagattcagagtatgtgtaattgatggtactatttggaaaagaaatatctagtactcttgtgcttccagaactt

SEQ ID NO: 31782 - DNA, 668 bp, Panicum virgatum
  misc_feature: Ceres CLONE 1907383
  misc_feature: Encodes the peptide sequence at SEQ ID NO. 31783
aaccacgtctctcatcctccttccgccgccgccattctcatctcccccgcactgtcgtggaacgggatccatctggactcgaaatttcctctctctcgctggcttctaatcagttggacctattctgaatcatggcggagcacttggcttcgatatttggtacagagaaagacagagtcaattgcccattttacttcaagattggggcttgccgtcatggtgatcgttgctcccgtctccataacaggccaaccatatcaccgactcttgtgctggttaacatgtatcaacgccctgacatgatcacccctggggttgatgctcaaggccagccaattgatcctcgcaagatgcaggagcattttgaagatttttatgaggatatctttgaagaactgagcaaatttggtgagattgagaacctcaatgtatgcgacaaccttgctgatcacatgataggcaatgtctatgtccaattcagggaggaagatcaggcagctgcagctcatacagcccttcaaggccgcttttactctggtcgcccaattgttgttgacttctccccggttactgactttcgtgaagcaacctgcagacagtatgaggagaacagctgcaatcgtggcggatattgcaattttatgcatgtgaagaagattggtagggat

SEQ ID NO: 31783 - protein, 178 aa, Panicum virgatum
  misc_feature: Ceres CLONE 1907383
  misc_feature (13)..(39): Pfam Name: zf-CCCH Pfam Description: Zinc finger C-x8-C-x5-C-x3-H type (and similar)
  misc_feature (149)..(174): Pfam Name: zf-CCCH Pfam Description: Zinc finger C-x8-C-x5-C-x3-H type (and similar)
  misc_feature: SWISSPROT Homolog: EC 2.7.11.1 Non-specific serine/threonine protein kinase
MAEHLASIFGTEKDRVNCPFYFKIGACRHGDRCSRLHNRPTISPTLVLVNMYQRPDMITPGVDAQGQPIDPRKMQEHFEDFYEDIFEELSKFGEIENLNVCDNLADHMIGNVYVQFREEDQAAAAHTALQGRFYSGRPIVVDFSPVTDFREATCRQYEENSCNRGGYCNFMHVKKIGR

SEQ ID NO: 31784 - DNA, 473 bp, Panicum virgatum
  misc_feature: Ceres CLONE 1907392
  misc_feature: Encodes the peptide sequence at SEQ ID NO. 31785
taggcggcgggtggttgccgggccgaaccgaccacaccaaaaagaaaagcgcgatgaggcggacggcgtcgatgctgttcagcggccacgccggcgccggccgccggggcatcccgcaggctctcgccgacgtgctggtctgccccctctccaagaagcctctcaggtactacgaggccagcgggtccctggtcagcgacgccgtcggcgtgtccttcccgatagaagatgggattccttgccttgttccgaaagatgggatgttgcttgaggacaactccgagaaatcagaacaagagcccagcccagcaatctaatcattctttaccaagaagacatcgttggttgtaatacctgagatatcgctcatttccaattagtgttcgttgtaatggttggcgttttttgccttgctcagtgtaatgaagtggatacatgattgttgttgttcacatgaaaaggctatattcttt

SEQ ID NO: 31785 - protein, 87 aa, Panicum virgatum
  misc_feature: Ceres CLONE 1907392
  misc_feature (21)..(60): Pfam Name: Trm112p Pfam Description: Trm112p-like protein
  misc_feature: SWISSPROT Homolog: EC 2.7.1.130 Tetraacyldisaccharide 4'-kinase
MRRTASMLFSGHAGAGRRGIPQALADVLVCPLSKKPLRYYEASGSLVSDAVGVSFPIEDGIPCLVPKDGMLLEDNSEKSEQEPSPAI

SEQ ID NO: 31786 - DNA, 1756 bp, Panicum virgatum
  misc_feature: Ceres CLONE 1907415
  misc_feature: Encodes the peptide sequence at SEQ ID NO. 31787
accactagtccactgctccatccggccaccaccgagctccgagcgaagtatccctgccaagtgccgctgccccccccccccccccgcgccacctccgcgcccgagggcatgtccgtcgcctcctcccaccacctacgcccggcgccggccggcgcggcgcggcgccctggctgcacggccgccgtggctctccggccgccgtggcccccgtcacgcggccgctgcgccgtcgcggcggcgggcgctgggggcgaggcggcttcagcccccgccgccgccgcggtgtcggcggccgccgccagggacagggtgcggcgccacacgatttccgtgttcgtcggggacgagagcggcatgatcaaccggatcgccggggtgttcgccaggagagggtacaacatcgagtcgctcgccgtggggctcaacaaggacaaggcgcttttcaccatcgtcgtctcggggaccgacagggtgctaaaccaagtcatcgagcagctcaacatgcttgtcaacgtcctcagtgtcgaacatctatctaaagaacctcaggttgaaagagagctgatgcttataaaactaaatgttaaacctgatcagcgccctgaggtcatggttttagttgatattttcagagcaaaagttgttgatatatctgatagcacacttaccatggaggtaactggagatcctggaaaaattgctgcagtggagaggaaccttaggaaatttggaatcaaagaaatttgccgaacgggaaaaattgctttgagacgtgagaagattggcgcgactgcccgtttctggcgattttctgctgcttcttacccagaccttatagaggcattgccaaaaaatccaattacatctgtaaataagacagttaatggcagttttgttcaaccatccagtgctgggggtgatgtttatcctgtggaaccttatgagagctcatcgatgaaccaagtacttgatgcccattggggtgttcttgatgatgattcaactggacttcgctcacatacgctctccatccttgtgaatgattgtcctggtgtcctcaacatagtaacaggggtatttgctcgcaggggctacaatatacagagccttgctgttggcccagctgagaaggaaggcatttcacgtattacaacagttgtccctggtactgatgaatccattgagaagttagttcagcagctttacaagcttattgatgtgcatgaggttcatgacattactcactcaccttttgctgaaagggagctgatgcttattaaggtttctgtaaacaccgctgctcggagggagatcctagatattgctgaaatcttccgagcaaaacctgtcgatgtttctgaccacacagttacactgcagctcactggggatcttgacaagatggttgcattgcaaaggttattagagccttatggcatctgtgaggtcgccagaacaggccgtgtggcgctggtccgcgaatccagagtggactccaagtacctccgtggctactctcttccgttgtagcctctggcgtttgtgatgatggcccaggaaatcgcatacctggttgctagagcagaatgtgtaggactcctttgttaggttgtgtgtatctgcaagagttgtttcctccatctcgtcgactccttgactggcttgcttaattaataatatgctccttggtggatgtaagctgaagttgcatatgtatcccgttgacagtcataataagatacatgtgcatcctctt

SEQ ID NO: 31787 - protein, 473 aa, Panicum virgatum
  misc_feature: Ceres CLONE 1907415
  misc_feature (304)..(370): Pfam Name: ACT Pfam Description: ACT domain
  misc_feature (71)..(135): Pfam Name: ACT Pfam Description: ACT domain
  misc_feature: SWISSPROT Homolog: EC 2.2.1.6 Acetolactate synthase
MSVASSHHLRPAPAGAARRPGCTAAVALRPPWPPSRGRCAVAAAGAGGEAASAPAAAAVSAAAARDRVRRHTISVFVGDESGMINRIAGVFARRGYNIESLAVGLNKDKALFTIVVSGTDRVLNQVIEQLNMLVNVLSVEHLSKEPQVERELMLIKLNVKPDQRPEVMVLVDIFRAKVVDISDSTLTMEVTGDPGKIAAVERNLRKFGIKEICRTGKIALRREKIGATARFWRFSAASYPDLIEALPKNPITSVNKTVNGSFVQPSSAGGDVYPVEPYESSSMNQVLDAHWGVLDDDSTGLRSHTLSILVNDCPGVLNIVTGVFARRGYNIQSLAVGPAEKEGISRITTVVPGTDESIEKLVQQLYKLIDVHEVHDITHSPFAERELMLIKVSVNTAARREILDIAEIFRAKPVDVSDHTVTLQLTGDLDKMVALQRLLEPYGICEVARTGRVALVRESRVDSKYLRGYSLPL

SEQ ID NO: 31788 - DNA, 739 bp, Panicum virgatum
  misc_feature: Ceres CLONE 1907424
  misc_feature: Encodes the peptide sequence at SEQ ID NO. 31789
aatcggctaagtaccccttcgcctgttctgcctccttctgattctgcccattcctttccatcctcatgtctcctctgctatgggcttctttacactcggctacatgctcggctcgaatcgagatgctcttgttcctctcccatgggtcaccatatgatttgttcttcctcccacccccaaactccccctgcttttttcgcagttcttcgtctatcctcttcacggtctgttgaattaggtgaagctctcgcatttttcaacgatttctcaccgatggggtgcttcgccttcaggagcggcaagggcaggtccaagagccagccggccgccggcgccaagacggcgccagccaagtcgcccccggcgtccgactcctccggtggcggcaggcagaggagcaaggcctcgtccgcatcggcgtccacgcccaccaggagcatccaggagctgtccgaggagcggggcgcgcagcggctgcgggtgttcgacctcgacgagctccagagcgccaccaacggcttcagccgcgcgctcaaggtcggcgaggggggcttcggctccgtctaccgcgccttcttccgctccgccggcggcggccgcgtcgtcctcgccgtcaagcgcctcaaccatcgcagccttcagggtcacaagcagtggctggctgaagtccaattcctgggtgttcttgagcacccgaatctcataaagctgatcggctactgtgcagtggattcagaag

SEQ ID NO: 31789 - protein, 155 aa, Panicum virgatum
  misc_feature: Ceres CLONE 1907424
  misc_feature: SWISSPROT Homolog: EC 2.7.11.1 Non-specific serine/threonine protein kinase
MGCFAFRSGKGRSKSQPAAGAKTAPAKSPPASDSSGGGRQRSKASSASASTPTRSIQELSEERGAQRLRVFDLDELQSATNGFSRALKVGEGGFGSVYRAFFRSAGGGRVVLAVKRLNHRSLQGHKQWLAEVQFLGVLEHPNLIKLIGYCAVDSE

SEQ ID NO: 31790 - DNA, 2245 bp, Panicum virgatum
  misc_feature: Ceres CLONE 1907425
  misc_feature: Encodes the peptide sequence at SEQ ID NO. 31791
gttcctccactcccagcctcttcttccctccagaggtgatggccaaatgctactccgatttgcccccgatcccgcctctgcgtccgtcgcgaagaacgccgccgcaatcccacgcctccctgtgcgcgatcaggcggcagctcgcgtccttcgtgctccactgctccaggtcctgcgcttcccctctcctcgagcccaagaacctgcccgatgagttccccgccgtgccgccggcgccggcgccggcgctgctgccggacgccgccccgaagctcggcatctccaacaagttcatccggggcctctgcagcgacccgcagaccgagcagctcgccttcgagtgctaccggagggcgctgctgcagccggggttcctgccggagaagaagacggccaacgcgctgaccgtgcagctgctcagggccaagcagtggggctcgctggagctgctggtccaggacatgggcgcccacggcgtgctcccggagaagcggacgtgcgcgcggctcgtcgcctgctgcatcagggcggggcggttcggcctcgccgacgcggtgctcgccgtcctcgaggccaggaagggggcgcccgccgtgatggccttcggcgcggccatgcaggcgtacaacaagctgcacatgtaccggagcacggtgctgctgtacgggcaggccagggtggctcgcctgccgctgggcgccgccgcctaccgcgccgctatggcggcgtgcggcgcgctgggcgagccggacatggtggcgtcgctgttcaagctctacaggtcgcagaaatggtacccctccgatggctgcgcggaggcgtacgccgtcgtctgcgacgcgctggcgaaggcgggccgacccctggacgcgctgcggagcctgcgggagatggaggccgacaggctctcgccaagcgccgccacctactcctccgtcatcggcgccctggcagatgcccgggagaaggcggcggcggaggacctgtaccaccaagcctgggacagcaagatgctgagggatcccgacatgttcctgaagctgaccgtcatgcacgtcgaggctggtgtggtggaggagacgatcgaggtcgccaagggcatgaggcagatcggcctgagggtcacggactgcatcctctccacaatcatcaacggcttcgtcaagaggagaggcctgaaaccagccatcagagcgtacgacaagctggtgttcatcgggtgcgagcccgggcaagtcacctacgcctccgtcatcaacgtgtactgccggctcggccggagcgacagggcggaggccgtcttctcggagatgatcggccggggcttcgacaagtgcgtggtcgcctacggcaacatgatctccatgtacggcaagatcaggagagcatccgaggccatgaagctgctggccatgatgaagcacaaggggtgcgaacccaacgccctggtgtacaactccctgctcgacatgaacggccggctcgggaactcgaagcaggccgagaagatgtggaaggagatggtgcggcgcaaggtccggcctgaccggatcagctacacggccatcatcctggcgaacaaccgggcaggggagctggaccggtgcatggagctgtaccaggagttcagggagaccggagggaaggtggacaaggccatggcagggctcatggtgggggtgttctccaagtgcagccggttcaacgagctcatcgagctgctcaaggacatgaatggcaccaagctcaagctggaccggaggctgtacatgaccgtcctgcgaagcctcagggatgcggggcttgaggtccatgtgaagtggctccaaagtaacttcacgttcatggaagagaaaacctgatatgatatcaggtgccacgggttcttcttgctgtgaatattcagcaccggagtataccgggcgtccaagaaaggcattgctctgtaaatggaaactgaaaaaaaaaaggtaaatatttgcttgcctcaatgctctcttttgaagctttgtatgatattgttgatcaatttcgaccttcattggctcaactgctcaagtggatataacaatgtaattgtattttaagggatgccaactttgtaccggtaatgatctgattcgaaaattcttgaacagattgccaagttcagtaactctgcatatgccagatttattgaaattactgtaccatagccactttggacaaatgtaactttgtatctataatgaaaatttcatattat

SEQ ID NO: 31791 - protein, 607 aa, Panicum virgatum
  misc_feature: Ceres CLONE 1907425
  misc_feature (435)..(469): Pfam Name: PPR Pfam Description: PPR repeat
  misc_feature (400)..(434): Pfam Name: PPR Pfam Description: PPR repeat
  misc_feature (470)..(504): Pfam Name: PPR Pfam Description: PPR repeat
MAKCYSDLPPIPPLRPSRRTPPQSHASLCAIRRQLASFVLHCSRSCASPLLEPKNLPDEFPAVPPAPAPALLPDAAPKLGISNKFIRGLCSDPQTEQLAFECYRRALLQPGFLPEKKTANALTVQLLRAKQWGSLELLVQDMGAHGVLPEKRTCARLVACCIRAGRFGLADAVLAVLEARKGAPAVMAFGAAMQAYNKLHMYRSTVLLYGQARVARLPLGAAAYRAAMAACGALGEPDMVASLFKLYRSQKWYPSDGCAEAYAVVCDALAKAGRPLDALRSLREMEADRLSPSAATYSSVIGALADAREKAAAEDLYHQAWDSKMLRDPDMFLKLTVMHVEAGVVEETIEVAKGMRQIGLRVTDCILSTIINGFVKRRGLKPAIRAYDKLVFIGCEPGQVTYASVINVYCRLGRSDRAEAVFSEMIGRGFDKCVVAYGNMISMYGKIRRASEAMKLLAMMKHKGCEPNALVYNSLLDMNGRLGNSKQAEKMWKEMVRRKVRPDRISYTAIILANNRAGELDRCMELYQEFRETGGKVDKAMAGLMVGVFSKCSRFNELIELLKDMNGTKLKLDRRLYMTVLRSLRDAGLEVHVKWLQSNFTFMEEKT

SEQ ID NO: 31792 - DNA, 631 bp, Panicum virgatum
  misc_feature: Ceres CLONE 1907435
  misc_feature: Encodes the peptide sequence at SEQ ID NO. 31793
agaaagtatccgttcccctcttctcccattgtgtcgtctgcgcgccagcgccggcgccgccgccatgccttcacactcccgagcggtcaggggcccgacgctgctcccggtctcgctggacgatttcttcatagatggcgactagattgacttctgagaaaaggaccccgatgaggaccccgatggcgacggacgatcgtcggacgagggacaggaccactgatgatcggatgacgaacgacaggacaagagtgaatgatccagcgacgacgaacacgatgatgatgaggaagaggaggaggaacaggagagggaagagtttgctggtggagattgcgggccatccgcccaagctagggtttccatggagacggatgccggtggctcttccgaaagggccaacatgcccacctgccccgtatgtatggagccatggacttcccaaggcccgcatcgcatcacctgcatcccgtgtgggcatgtctactgcagatcttgcttagagaggtggttaacccagcgtgggaataccagtgccacgtgccctcaatgtggccaaaagcttaaaaataaggacatcatcaatctctatgcaccagaggttgccattctaaacatgaacaagaaaacg

SEQ ID NO: 31793 - protein, 88 aa, Panicum virgatum
  misc_feature: Ceres CLONE 1907435
  misc_feature (17)..(63): Pfam Name: zf-C3HC4 Pfam Description: Zinc finger, C3HC4 type (RING finger)
  misc_feature: SWISSPROT Homolog: EC 6.3.2.19 Ubiquitin--protein ligase
METDAGGSSERANMPTCPVCMEPWTSQGPHRITCIPCGHVYCRSCLERWLTQRGNTSATCPQCGQKLKNKDIINLYAPEVAILNMNKK

SEQ ID NO: 31794 - DNA, 731 bp, Panicum virgatum
  misc_feature: Ceres CLONE 1907438
  misc_feature: Encodes the peptide sequence at SEQ ID NO. 31795
agctatctatcgtcccatctctcgggcctccttccactcatcagtacaccgccatggccgccgtgaccgccgcggccgtctctctgtcgtccttccctgctgctgccaaggcggccgcctcgacgtcgtccccgtcgtcatgcagcatcacgtacccgcggcgcagcgccgcccgggcggtgcgcgtgcaggtgtcgacgacggagaccgctgaggccggggcggcgccggtgaagacggagaagatctccaagaagcaggacgagggtgtggtgaccaacaagtacaggcccaaggagccctacgtggggaggtgcctgctcaacaccaggatcaccggcgacaaggcgccgggggagacgtggcacatggtcttcagcacagaaggcgagatcccttacagagaagggcagtccattggcgtcatcgccgacggcgtcgacaagaacggcaagccgcacaagctcaggctctactccatcgccagcagcgccctcggggatttcggcgactccaagaccgtgtcgctgtgcgtgaagaggctcgtgtacaccaacgatcaaggagagatcgtcaaaggagtctgctccaactacctatgtcagtagagtactagtgttcattttctccaattcatcacatgctgctatatatagcttcgatcttctcttaatcaggcatgcatgctgttgttgttctattccattttctgtcagatcgttgttcagcat

SEQ ID NO: 31795 - protein, 184 aa, Panicum virgatum
  misc_feature: Ceres CLONE 1907438
  misc_feature: SWISSPROT Homolog: EC 1.18.1.2 Ferredoxin--NADP(+) reductase
MAAVTAAAVSLSSFPAAAKAAASTSSPSSCSITYPRRSAARAVRVQVSTTETAEAGAAPVKTEKISKKQDEGVVTNKYRPKEPYVGRCLLNTRITGDKAPGETWHMVFSTEGEIPYREGQSIGVIADGVDKNGKPHKLRLYSIASSALGDFGDSKTVSLCVKRLVYTNDQGEIVKGVCSNYLCQ

SEQ ID NO: 31796 - DNA, 1401 bp, Panicum virgatum
  misc_feature: Ceres CLONE 1907440
  misc_feature: Encodes the peptide sequence at SEQ ID NO. 31797
acgttatcgcctcacgtcacctgcacttcggcaagttaagcgcaatccaaggttgcgtaaccttcatttgtgctgtatttgcactcttgtaaagtactccacaatgaacgcttctctgggaagccgctctaccgcccgcggtgctgcagtcaatggcaaggctggaaaccggaaggctacagtttcccggtctgctggcctgaacatccgctgtgaaaaggtcgtaggcattgatcttggtaccaccaactccgcggtggctgccatggagggcggcaagccaaccatcatcactaacgctgagggcggtcgcactaccccatcagtggttgctttcaccaagactggtgacaggcttgtgggccagattgccaagcgccaggctgtcgtcaacgctgagaacaccttcttctctgtcaagcgcttcattggcaggaaggtcaacgaggtcaaggaggagtcaaagcagatcccataccaggtcgtcgaggaaaactccaacgtcaagatcaggtcctccaatgccggcaaggacttctcccccgaggagatctcagcccaggttctgaggaagctggctgatgatgctgccaagttcctgaacgataaggttgccaaggctgtggtcactgtgcctgcatacttcaacgactcccagcgccaggccaccaaggatgccggccgcattgctggtctggaggtgctgcgcatcatcaacgagcccaccgccgcctcactggcgtacggctttgacaggaaggccaacgagaccatcctggtgttcgacctgggtggcggcaccttcgatgtctccattctggaggtcggcgacggcgtctttgaggtgctctccaccagtggcgacacccacttaggtggtgatgactttgacaagcgcatcgttgacttcctggctgctgacttccagaggtccgagggcatcgacctgaagaaggacaggcaggcgctgcagaggctgactgaggctgccgagaaggccaaggttgagctgtctggcgtgccctccacctccatcaacctgcccttcatcactgccactgctgagggccccaagcacattgacaccagcctcaccagggccaagtttgaggagatgtgctcagacctgctggaccgctgcaaggtgccagtggagaacgcactgagggacgccaagctcaacctcagccagattgacgaggtcatcatggtcggtggatccacccgtatccccgctgtgtacgagattgtcaagaagatgactggcaaggagcccaacgtgactgtgaaccccgatgaggtcgtcgccttgggagctgcagtgcaggctggtgtgctggctggcgaggtctccgacattgtgctgctggacgtgactcctctgtccctgggtctggagac

SEQ ID NO: 31797 - protein, 432 aa, Panicum virgatum
  misc_feature: Ceres CLONE 1907440
  misc_feature (40)..(432): Pfam Name: HSP70 Pfam Description: Hsp70 protein
  misc_feature: Useful for making plants with modulated heat sensitivity
  misc_feature: Useful for making plants with modulated drought sensitivity
MNASLGSRSTARGAAVNGKAGNRKATVSRSAGLNIRCEKVVGIDLGTTNSAVAAMEGGKPTIITNAEGGRTTPSVVAFTKTGDRLVGQIAKRQAVVNAENTFFSVKRFIGRKVNEVKEESKQIPYQVVEENSNVKIRSSNAGKDFSPEEISAQVLRKLADDAAKFLNDKVAKAVVTVPAYFNDSQRQATKDAGRIAGLEVLRIINEPTAASLAYGFDRKANETILVFDLGGGTFDVSILEVGDGVFEVLSTSGDTHLGGDDFDKRIVDFLAADFQRSEGIDLKKDRQALQRLTEAAEKAKVELSGVPSTSINLPFITATAEGPKHIDTSLTRAKFEEMCSDLLDRCKVPVENALRDAKLNLSQIDEVIMVGGSTRIPAVYEIVKKMTGKEPNVTVNPDEVVALGAAVQAGVLAGEVSDIVLLDVTPLSLGLE

SEQ ID NO: 31798 - DNA, 694 bp, Panicum virgatum
  misc_feature: Ceres CLONE 1907440-R
agtttgacgagaagctgcctgctgacgtcaagaccaaggtctcagccaagattgaggagctcaggacctctgtgaacgctgacgatgttgagggtatgaagaagggcatggaggcgctgcagcaggaggccatgcagatgggccaggccatgtatgcacaaggaggtgctgaggcaggtgcaccaggtgccgagggtgcggccccaggaggcggtgctgacaagccctcagatgacagcgtcattgatgccgagttcactgacaagaagtgaagacactcacagctgtttcatgttgatatagcagtgagctatgtgtgtggctccgcttttttggttgttgtgtgacttgacttgtctgtttggtatggcctggctcctcggttgctggctggttacttatgactctccttggtggcgatcaaatgtgcgactgcatgttggtgactaggggcattgtgccgtataggtccaagcttttgaagccaacatggtgaccaatttgggacaagtgggtggttccattattcaaattggatgcagcatttgatctacttatattccttcttgatgcagcttgtgctcaagctcgcagctaacctgacgtgtccctgtgaattttgtttgactggacttggggttagcatgtagcttggctctgcctgccctgtgatttgtaagaataatgcccggtg

SEQ ID NO: 31799 - DNA, 736 bp, Panicum virgatum
  misc_feature: Ceres CLONE 1907445
  misc_feature: Encodes the peptide sequence at SEQ ID NO. 31800
ttataatgttccgaaaatgtttatgccatatgtcccagtacttgatgctacataaggttttcaaacattcatggaataacattcagcgtcgcagttgtcaaattctttactggccaattgtcctcctagatacctccctaagctccactgtgaacatggagtatgcacacaaagctgcaattcggaagcatgctttgtggtcaagtatcgccgtggatctcctgatgggttttgtccttggagcagtatttttattaaatacggagacaatttgtatttggactatagctctcgtccaccacatgacagacgcaatcttacgatctggctgtgtgtggctgatgggtgttccggctggctttaagctgaatacagagttagcagagcttttaggcatgatttcactgaatgcagttcaaatttactctaccctttggttctttgtgggagcctacctgaggcatataattcaaggaattgcattttctggaattattttgggcctgacagctccagtttcattctttattgatattatccagcttgctacattgcatgttactatgcttcactggttaatatcatcgatctattcaagacagattcagacagttgcatccttgtggcgtcttttcagggggcgcaaatggaatcctcttaggcagagattagatagctatgactacacagttgaacagcatgtggttggttccttgctgtttacaccagtcctact

SEQ ID NO: 31800 - protein, 244 aa, Panicum virgatum
  misc_feature: Ceres CLONE 1907445
  misc_feature (61)..(244): Pfam Name: Gpi1 Pfam Description: N-acetylglucosaminyl transferase component (Gpi1)
  misc_feature: SWISSPROT Homolog: EC 2.4.1.198 Phosphatidylinositol N-acetylglucosaminyltransferase
IMFRKCLCHMSQYLMLHKVFKHSWNNIQRRSCQILYWPIVLLDTSLSSTVNMEYAHKAAIRKHALWSSIAVDLLMGFVLGAVFLLNTETICIWTIALVHHMTDAILRSGCVWLMGVPAGFKLNTELAELLGMISLNAVQIYSTLWFFVGAYLRHIIQGIAFSGIILGLTAPVSFFIDIIQLATLHVTMLHWLISSIYSRQIQTVASLWRLFRGRKWNPLRQRLDSYDYTVEQHVVGSLLFTPVL

SEQ ID NO: 31801 - DNA, 1679 bp, Panicum virgatum
  misc_feature: Ceres CLONE 1907446
  misc_feature: Encodes the peptide sequence at SEQ ID NO. 31802
ctgttcctccgtccagcctccctcccggcaggccgtgttgcccttcccgtcggcggcgctaccatacatggccaccttatcggccgtctccgccattgccggcggcttcggtgcggcgacggcgaccaccctgagctggaaggtaaagcgccgggagtgtggattcggacggctctgtctgtgctcggtagcatgcatttatttatttcttcgcccaattgttttttccagtttgtgcttagtaattactagcacaccacaattcagtaatttcagcccaagtgaaatactatagtagcttgtcttagctgtttctttctttctcctcgtcctcgatggttcgtggcttgcctgctttttcaattgttttttctcaatcgttttttcccaaagtagagtacttgttgcctcaagcaaattcagagtaatggcgagtgtgtttagagttttttttcctaataatgaaggaaaaaagaaataaacaccagcggctaatccggcccaggtgccggccgctcaacaggatgtgatacaaacttttttccccctctcatttgggggtgtaccagctagaccataacggagtttcctgatttggaattttggataattgggttgaacatggtttttgatagggaacaaaattgtaaaatcctcctacagtaagttactctgcctgcttcaagatctcacctcccaaggcattttgttgcagagagagccaactatgctccatacatgtttttttaggagtgtaaagaggtgatccttagatgcacctccaacacaaaattttgaattaaagagggttggaggtgcacctaaaagatatcactttgcacccctatgtttttttatctgtcaaaacaaacaaaaactaccctacgttttcacctctcctctgaataatctgactgtgccactgaaactttcagggaagcagggtttcaggccggagcctcatctccatgggggcgacgagaagccgcctcgtctccctacgaacacctcgcttccgcgtctacgcggtaacgtccagcggcggtgcttgcaaattttaaattttcccccccaacagtttcgatctatctgaactgggaagcgacacctgctgctgcaggccaaggcggagacggtgagcaaggtgatggacatcgtgaagcagcggctggcgctgggcgcggacgcggcggcggcgctgacgcccgagtccaagttcacggacctcggcgccgactcgctcgacaccgtggagatcgtcatggcgctcgaggaggagttcaagatcaccgtcgaggaggacaacgcccagaacatcaccaccatccaggacgccgccgaactcatcgacaagctcgtcggatgattccatcattttattttattttattttatttttgttggaagaatgatgaacgttgttggttggccaggatcgattttcttcttcttcctcttagctcctttccagcctagcgtacgtctttactttatttgtttgggctccgatccccagctcttgttcccgccaatttttagctgtacgtgacgtggctgcgtctttttgaaagattcttcatgttaggattcatcaccatgttcctgcaccgacgcacttgtgaattgtcagtacaatcattgacgaggcattggaatatcattttcacaagatttgttag

SEQ ID NO: 31802 - protein, 72 aa, Panicum virgatum
  misc_feature: Ceres CLONE 1907446
  misc_feature (2)..(67): Pfam Name: PP-binding Pfam Description: Phosphopantetheine attachment site
MDIVKQRLALGADAAAALTPESKFTDLGADSLDTVEIVMALEEEFKITVEEDNAQNITTIQDAAELIDKLVG

SEQ ID NO: 31803 - DNA, 729 bp, Panicum virgatum
  misc_feature: Ceres CLONE 1907449
  misc_feature: Encodes the peptide sequence at SEQ ID NO. 31804
gtaccagcacagcaaaagcactaagccatctgatctcgcaaacacagcttcaaacacttccagattccctccagttcctcccaaggtttcgcgccacttgccggctctgaagcagcagccatgagctcccgaatggccggagccgcgctcctgcgccacctggccccccgcctcttcgccgcggagccggtgcccgggctcgccggaagagggctcgtgcccgcggccgccagggttctctccgcgcggatgtccagcaccgctgcggaggccgccgccaaagaagctgccgcctcagagcaggagcggcagcagcacggtggcagcgccgaaaagccgacggcggcagatgggcaggagaagaagggcaccgtcagctactggggcatccagccgccgaagctcgtcaaggaggacggcacggagtggaggtggttctgcttcaggccatgggacacgtacagggcggacacgtcgatcgacatgaagaagcaccacgagccgagggcgccgccggacaagctggcctactggctggtcaagtcgctggtcgtgcccaagcagctcttcttccagcgtcggcacgccagccacgcgctgctgctggagacggtggccgccgtgccgggcatggtgggcggcatgctgctccacctgcggtcgctgcgccgcttcgagcacagcggcgggtggatccgggcgctgctggaggaggctgagaacgagcgg

SEQ ID NO: 31804 - protein, 202 aa, Panicum virgatum
  misc_feature: Ceres CLONE 1907449
  misc_feature (50)..(202): Pfam Name: AOX Pfam Description: Alternative oxidase
MSSRMAGAALLRHLAPRLFAAEPVPGLAGRGLVPAAARVLSARMSSTAAEAAAKEAAASEQERQQHGGSAEKPTAADGQEKKGTVSYWGIQPPKLVKEDGTEWRWFCFRPWDTYRADTSIDMKKHHEPRAPPDKLAYWLVKSLVVPKQLFFQRRHASHALLLETVAAVPGMVGGMLLHLRSLRRFEHSGGWIRALLEEAENE

SEQ ID NO: 31805 - DNA, 462 bp, Panicum virgatum
  misc_feature: Ceres CLONE 1907468
  misc_feature: Encodes the peptide sequence at SEQ ID NO. 31806
cgcttattcttccctaccttcctcccggtggagggggtctggctcctacccccccctgccagctagcgtatccccagatatgatcccggcgacctgcctctccttctcagtgcctccatcatgctgcgccggccggcgacgcgtggcggcaggagacaccggcgtcggtgtccgccacggacccgccgcccgaggtggtctaggcgacggggcggatgccgctgccgacggtgtccgggaactacaggtcgccggtggtggacgacctcccggagcagcacgagttcttctgcaggcacgacggctccgacttcttcttgaggggccccgtccacttcccccgctacctcctgctgcggctcttcatgccgacggcttccttcgtggcgcgcgacccgtgcgtggcggcgcttctcgaaacatcctccttcacggagctcatctccaccacgatcgtttacg

SEQ ID NO: 31806 - protein, 82 aa, Panicum virgatum
  misc_feature: Ceres CLONE 1907468
  misc_feature: SWISSPROT Homolog: EC 4.2.1.92 Hydroperoxide dehydratase
MPLPTVSGNYRSPVVDDLPEQHEFFCRHDGSDFFLRGPVHFPRYLLLRLFMPTASFVARDPCVAALLETSSFTELISTTIVY

SEQ ID NO: 31807 - DNA, 1649 bp, Panicum virgatum
  misc_feature: Ceres CLONE 1907480
  misc_feature: Encodes the peptide sequence at SEQ ID NO. 31808
gcgcggcaccacagtgcaagtgtgcagctcactcacctgtggccatggcgccctatcctttccagcacaagccactccatctcccgcacagcaccaagccagcaactccaattcacgaccgtcttgggcatggagatccgagggccgacgctgtgtcggcgtcgctccggcaaggcgccccgaccgacgcccgcggcctccgggtgttcatcaaggcagtctccgcgtcctcctcctccgcctccgcggcggcggtgcacgcccacgccgccaagctggggctggaacgcgagcgcaccgtccgcaacagcctcatcgcgctctacctcgcgcgcggcgaccgcgccgccgcgggggccctgttccacgggttcccggacggccgggacgtggtttcctggacggccatggtgaccggccacgcgcggctggggttccccgacgaggccgttgcgctgttcctcgagatggcggacggcggctgcggcgtggccgtggacgcggtggcggccgccgcggggttcgcggcctgcgccgaggtgagggacctcgcgctcgccagggaggcgcaccggcgcgtcgcggccgcggaggtcgccctcgacgtcgtcgcgtggaacgcgctggtggacatgtacgccaagtgcggcgacgtggcggcggcgcaccggtggttcagggctatgccggcgagcaagaccgtcgtgtcatggaacacgatgatctcggcgttcgcccgcaccggcgagcacggcgaggcgctggccctgttccgggagatgcagcgcgcgggggtgcgcccggacgacgcgacgctcgtcgccgtcctcggcgcgtgcgcccagctcggcgcgctcgacaccgggcggtgggtgcacgcctacatgcgccggcagctggggcgccgcgaggccgacggcgtcgtcggcaacgctctgcttgacatgtacgccaagtgcggtgcggtcgaccaagccgtcgcggtgttcgacggcatggcgcggcgcgacgtgtacacgtacgcgtccatgatcctggggctcgcgacgcacggccgcgccgaggacgccctggctctgttcgcggccatgcggcgagccggcgtgcgcccgaacgcggtggcgctcctcggcgtgctctccgcgtgctgccacgccggccgcgtcgaggaggggctccggcacctgagggacatggcgcggtgccacggcgtgacgccgggcatcgagcactacggctgcgccgtcgacatgctcggccgcgcggggaggctggacgaggcggaggcgctcgtggcggcgatgcccgcgacgcccgacgcgctcgtccggggctccctcctcgcggcctgccgggcgcgcggcgacgtcgagcgagccgagcggctgatgcgtagcatgaacgacgacgacggcgactccggggactacgtgctcatgtcgaacatgtacgcctccaggggacggcacggccgagcggtgcgggtgaggaagaagatgaggaggagcaagctgaccaaggaaccagggtgcagcgccatcgagatcgacggcgtcgtgcacgagttccatgcggttccggccaactccgtcacgtgatgcatttcttttctatctatatattaaaaagcacgctttcagctttctccc

SEQ ID NO: 31808 - protein, 517 aa, Panicum virgatum
  misc_feature: Ceres CLONE 1907480
  misc_feature (117)..(151): Pfam Name: PPR Pfam Description: PPR repeat
  misc_feature (221)..(255): Pfam Name: PPR Pfam Description: PPR repeat
  misc_feature (324)..(358): Pfam Name: PPR Pfam Description: PPR repeat
MAPYPFQHKPLHLPHSTKPATPIHDRLGHGDPRADAVSASLRQGAPTDARGLRVFIKAVSASSSSASAAAVHAHAAKLGLERERTVRNSLIALYLARGDRAAAGALFHGFPDGRDVVSWTAMVTGHARLGFPDEAVALFLEMADGGCGVAVDAVAAAAGFAACAEVRDLALAREAHRRVAAAEVALDVVAWNALVDMYAKCGDVAAAHRWFRAMPASKTVVSWNTMISAFARTGEHGEALALFREMQRAGVRPDDATLVAVLGACAQLGALDTGRWVHAYMRRQLGRREADGVVGNALLDMYAKCGAVDQAVAVFDGMARRDVYTYASMILGLATHGRAEDALALFAAMRRAGVRPNAVALLGVLSACCHAGRVEEGLRHLRDMARCHGVTPGIEHYGCAVDMLGRAGRLDEAEALVAAMPATPDALVRGSLLAACRARGDVERAERLMRSMNDDDGDSGDYVLMSNMYASRGRHGRAVRVRKKMRRSKLTKEPGCSAIEIDGVVHEFHAVPANSVT

SEQ ID NO: 31809 - DNA, 569 bp, Panicum virgatum
  misc_feature: Ceres CLONE 1907501
  misc_feature: Encodes the peptide sequence at SEQ ID NO. 31810
tctctcgggcctccttccattcatcggtacaccgccatggccgccgtgaccgccgcggccgtctctttgtcgtccttcccggctgctgccaaggcggccgcctcgacttcgtccgcgttgtcatgctcaatcacatacccgcggtgcaccgccgcccgggcggtgcgcgtgcaggtgtcaacgacagacaccgctgacgcaggagcgacaacggtgaatacggacaacatctccaacaatcaggaagagggtgaggagaacaacaagtacaggcccaagaagacctacagggggaggcgcctgctcaacaccaagatcaccggcgaccaggcggcgggggagacatggtacatggtcttcccaacataaggccacatccctaacaaaaaacggcactccattgccgtcatcaccaacagggacgacaagaacggctagacgaacaagctcaagctctactccatcgacagcaacgaccacaaggattaccgggactaccagatcgaggcgctgtgcttgaagaggctcgtgtagaccaactatcaagaatagatcggctgcggagtctg

SEQ ID NO: 31810 - protein, 110 aa, Panicum virgatum
  misc_feature: Ceres CLONE 1907501
  misc_feature: SWISSPROT Homolog: EC 1.18.1.2 Ferredoxin--NADP(+) reductase
MAAVTAAAVSLSSFPAAAKAAASTSSALSCSITYPRCTAARAVRVQVSTTDTADAGATTVNTDNISNNQEEGEENNKYRPKKTYRGRRLLNTKITGDQAAGETWYMVFPT

SEQ ID NO: 31811 - DNA, 678 bp, Panicum virgatum
  misc_feature: Ceres CLONE 1907518
  misc_feature: Encodes the peptide sequence at SEQ ID NO. 31812
gccacggtacccgtttctctcacacctcgcgcagcatcggagcactagagaggaatccagcccagcagcccaagcaatggagtgcgtcctgggcgtggtcggccgcgacttcgcggtggtggcggcggacacctccgccgtgcagagcatcctcgtccacaagacggacgaggacaaggtgatggtcctcgactcgcacaagctgatgggcgcctcgggggagcccggcgaccgggtgcaattcacggagtacatacagaagaacctccacctgtaccagttccgcaacaccaccccgctctccaccgccgccaccgccaacttcacccgcggtgagctcgccacagccctccgaaaggtacggacccgaattaatcctattcctctgtctgtgctactgtgtttgcctgcaatcgaatttttagagcgcagaagggtcaatccgggttggattagggttaggtatagtctcttgtatggccgatttggatgtcccatagttcgattggatggagattactgcttgctggtgattacggatcaaatttgactgggtgaaacggagatgatttaagccagtggcataggtgttttgattgatgaattatggcgaactgaaacaggggttacatcgctagcgaaagagatatatgcctgcaggatttctcatgttaagtt

SEQ ID NO: 31812 - protein, 157 aa, Panicum virgatum
  misc_feature: Ceres CLONE 1907518
  misc_feature (1)..(154): Pfam Name: Proteasome Pfam Description: Proteasome A-type and B-type
  misc_feature: SWISSPROT Homolog: EC 3.4.25.1 Proteasome endopeptidase complex
MECVLGVVGRDFAVVAADTSAVQSILVHKTDEDKVMVLDSHKLMGASGEPGDRVQFTEYIQKNLHLYQFRNTTPLSTAATANFTRGELATALRKVRTRINPIPLSVLLCLPAIEFLERRRVNPGWIRVRYSLLYGRFGCPIVRLDGDYCLLVITDQI

SEQ ID NO: 31813 - DNA, 1549 bp, Panicum virgatum
  misc_feature: Ceres CLONE 1907525
  misc_feature: Encodes the peptide sequence at SEQ ID NO. 31814
agactagggcatccaaccccgagccatccctcccccgcacacgagcccaatccccccgcgcatccaaacccaaaccctcctctccgcgaggccatggccgccgcgacggagaagacggcggaggacatccgccgcgagctccaggagctccagcgccagcaccgcgagatcaccgagcgacttcgcgatccccgcggccttcgccgcggcgccgccggccctggccctggacctggacccggggtgccccgcccgctccgcggcttcgtgagacctgcacccggtgcggaatcgggggaccagcctgcgcagaagcggcggctgctatctgccgtggttaaggttgatggtgctgaaactaacgaggaaggtgaaaaggctgccgaggcagagggacgcgaggagggttcaggtgctgctgaaggcagtgacaggagggctgttagcaatggtggcttcaggagggatgggagcctgcggatgctaaggagagtggactataattcccttccagagccagctccaagggagcttcccaagaatgaggacccaaatatggtgagaaggaataagaggatgttgggccagcttcttgtcggtacattagagaaatttcagcaagaggacaagaaattatccaactctgaggcttatctgcgcagatcagagacgcagcgaaaggctgagcaaaaggttcgtgaggaaagtgaaaggttgcgacagcaggagcgagagcaaattgcagagaagcgtaagcgtgacatgatgctttgcgctcgtgtagctgctaaggcagaagaaaagaggttggagctgttgtacattcagtggactgagcatcataaaaagctgtccaatttcttaaggacaaaagctgaaccacctatttactacatgccagctaaaccgatcattgatgatcctactgttattgagcagaataaggaaaaggtatttgaagaatggaaatctgtgcgcagagccgagctgactcagtttcaaaagcaagttgaggagcaatatctctccaatgttgagaggcagttggaaagaatccagaatgcccggaatgctaggagagcaaacgggcttgctaacatgcaagaaatggacaaggagctggacacacacagagcggagcatggtcctaagactcggcgagttcccgaggagggtggcaatgatgaggatgaggatgcggaggatatggcagcggaagacgagctgatggaagaagttctgggcatcaacgatgggattaatgaggatctgtccaagccttccgatgaagctgtcactgatggtggtgaacctgcacctgaggaggcacagtaggcatgcttgttacaagctaagcacttaggcggtctgcattttgatctcattagttgacgtcttgtttggactgcatgtacgtgggctgtattgctgtattgctgtcagttttgcttctgtccccttggtcatgtgatactgttgtttgccctatttgacatttgttccatacacttgagtactcctgggaatggaatggactaaatccaaatct

SEQ ID NO: 31814 - protein, 413 aa, Panicum virgatum
  misc_feature: Ceres CLONE 1907525
  misc_feature (151)..(288): Pfam Name: Pinin_SDK_memA Pfam Description: pinin/SDK/memA/ protein conserved region
MAAATEKTAEDIRRELQELQRQHREITERLRDPRGLRRGAAGPGPGPGPGVPRPLRGFVRPAPGAESGDQPAQKRRLLSAVVKVDGAETNEEGEKAAEAEGREEGSGAAEGSDRRAVSNGGFRRDGSLRMLRRVDYNSLPEPAPRELPKNEDPNMVRRNKRMLGQLLVGTLEKFQQEDKKLSNSEAYLRRSETQRKAEQKVREESERLRQQEREQIAEKRKRDMMLCARVAAKAEEKRLELLYIQWTEHHKKLSNFLRTKAEPPIYYMPAKPIIDDPTVIEQNKEKVFEEWKSVRRAELTQFQKQVEEQYLSNVERQLERIQNARNARRANGLANMQEMDKELDTHRAEHGPKTRRVPEEGGNDEDEDAEDMAAEDELMEEVLGINDGINEDLSKPSDEAVTDGGEPAPEEAQ

SEQ ID NO: 31815 - DNA, 1326 bp, Panicum virgatum
  misc_feature: Ceres CLONE 1907527
  misc_feature: Encodes the peptide sequence at SEQ ID NO. 31816
aaaaatccccgaagcaacccacccacccccgtcgcctccgtccacccctccccggctgctcctcctccacaccgcgcgcggcggtgttgacccaccccacccgtccctctccccaccaccatcagcgctggaggcggcggtggccaagtcccctggacccttcggcggcggcggcggcggcgtgcggttatgccgagaggctcccaggtttcatcaccgtgctctgctggaattatagcattttcggcaaggacatggagtacaccccttacacagcaagttcctctgtatccctcatctcgctgctcgaggaagttcttggctggaggttttgtctttacggagacttccttgtcatctcttttgtcaactgcacctgaggaccaaactgctcttagcgactgctgtgcctggtcccatgctgtcagacattagagttgcctagtgattacagtgcggctgtagcaaacttatttgagcatggtggatctgtttctctggcaacaatttggtaatctttgtcttggcattggtcagccagcaaaagttaccgtcaagacatctttggacacttggatctaactcttagagctttctcctctcatataagctctasgttccggttttctttgttgctgctagctttgttctaccctgtcactgtaagttttcagttggatcagtccaaagtttggtgtgtattggtcagcgtgtcatcaagcttcacttgccaacgcataaccttagaggagaggtgttcaagattttgtcgtcacaaagcctgggtattgcttacagagctttgacaagagtctccaacgactttggtgttcaaacgtccaaagacactgctgtcatacatatatgagtcttgcttgtgactatacaactgtcctaaaataagggcagttttgtgcaccaccagctcaataaaatggagaggtatacggttatcaaggaagttggtgatggaacattcgggagtgtctggcgtgctatccataacgaaagtggtgaagtggttgcgatcaacaaaatgaagaaaaaatattattcttgcgaagagtgcatacacctccgtgaagtgaaatccctgcaaaggataaaccatccaaacatcgtgaagctcaaggaagtcatacgagagaatgacatgttgttctttgtttctgaatacatgtaatgcaatctctatcagctgatgaacaccacaggagaacccttctctgagactgaagtccgaaattggtgctttcaaatatctcaagctctgaatcacatgcaccaacgtggatattttcaccgcgaccttaaccctcaaaattt

SEQ ID NO: 31816 - protein, 82 aa, Panicum virgatum
  misc_feature: Ceres CLONE 1907527
  misc_feature: SWISSPROT Homolog: EC 2.7.11.22 Cyclin-dependent kinase
MERYTVIKEVGDGTFGSVWRAIHNESGEVVAINKMKKKYYSCEECIHLREVKSLQRINHPNIVKLKEVIRENDMLFFVSEYM

SEQ ID NO: 31817 - DNA, 689 bp, Panicum virgatum
  misc_feature: Ceres CLONE 1907551
  misc_feature: Encodes the peptide sequence at SEQ ID NO. 31818
gtccccaaccagctcgcccccagtctggcagtctcctcctccacctcgccctacccacgccgatccccaatcgcccatggatcccaagcccgacgccaacgcgccggcggcctcggagccggcggagcacgcggcgtacccgcgcctgtccccggaggagatggcgccgccgccgccgcccgtcgtgccgccggccggcgccaacccctacgtgctctccgccccgtcgcccaacccccccgccaagagcgctacggacaatctgaaggagatgttcggcatggtggggaagaagttcaacgaggccgcgcgcaagaccgagggcatcgtcggcgacgtctggcagcacctcaaaactggatctagcatgacggatactgcaatggggaggattgctcagatatcaaaggtaatatctgagggtggttacgacaagatatttcggcagacttttgagtgcttgcctgatgagaagctcaagaaggtgtatgtgtgctacctatcgacatctcatggcccgatcatgggcgtcctgtatctctcgactgtcaagattgcatttggtagtgacagccttgtgaaatatgtaaccgaggacaacaaaaccgagtcatccttttacaaggttgttttacccattccccacttgagatcagttaaccccacggcaagtcaacaaaaccctgcag

SEQ ID NO: 31818 - protein, 204 aa, Panicum virgatum
  misc_feature: Ceres CLONE 1907551
  misc_feature (120)..(198): Pfam Name: GRAM Pfam Description: GRAM domain
MDPKPDANAPAASEPAEHAAYPRLSPEEMAPPPPPVVPPAGANPYVLSAPSPNPPAKSATDNLKEMFGMVGKKFNEAARKTEGIVGDVWQHLKTGSSMTDTAMGRIAQISKVISEGGYDKIFRQTFECLPDEKLKKVYVCYLSTSHGPIMGVLYLSTVKIAFGSDSLVKYVTEDNKTESSFYKVVLPIPHLRSVNPTASQQNPA

SEQ ID NO: 31819 - DNA, 1018 bp, Panicum virgatum
  misc_feature: Ceres CLONE 1907553
  misc_feature: Encodes the peptide sequence at SEQ ID NO. 31820
agggtttataccgttcccctctcggccccctgccttccgaatcgccggcgtctccgcaggctcgccgcgcccaaaggggacaagaggggttttgggcggacggcaggagtgtcaaggaggtcaggtgcggttgcgagaggaggggacacgatgaggccggtcttctgcggcaacttcgattacgacacgcgccagtacgacctggagggtctcttctccaagtacggccccatccgccgcatcaacatgaagtcaggttatgctttcatttactttgaagatgagcgcgatgcagaggatgctataaggcgtctcgacaatgtttcttttggttataacaggcgcaggctctctgtagaatggtcgaggcaagttgaaccagtgtcaaggagccgtgataggcctgctggggatgtaaagccaactagaactctctttgttatcaattttgaccccatacgcactaaaattcgtgatattgagaggcattttgaaccatatggcaagattacaaacattcgtgttagaaggaactttgcgtttgtacagtacgagacacaagaggaagctagtgctgctgtcaagaacactgataagagcacaatattggacagggtggtgacagttgaatacgccttccgtgatgatgacaatgaaagagatgacagatacagcagccccaagcgaggtggtcatgacaggcgtcgtgctagcccctacatgcgctcacctagcccaagttggtttatcctgaagaatccagattcggtaaggaagttgtgccatggaggaagtggcaggcaacatgattttcttgtgccatgtatacttggagctgccttggtgtcccaaaatagcgcaacaatataacgtgattctgtagtctctgttgttgataggaacaaatatcatatgttacatggattgcttgccgtttgccaccttgcctatttcaagtacaatttttggcgctgatattggaaagaaatgtaatgtctcctgaccagcttcgacactg

SEQ ID NO: 31820 - protein, 239 aa, Panicum virgatum
  misc_feature: Ceres CLONE 1907553
  misc_feature (4)..(69): Pfam Name: RRM_1 Pfam Description: RNA recognition motif. (a.k.a. RRM, RBD, or RNP domain)
  misc_feature (95)..(159): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with modulated biomass
MRPVFCGNFDYDTRQYDLEGLFSKYGPIRRINMKSGYAFIYFEDERDAEDAIRRLDNVSFGYNRRRLSVEWSRQVEPVSRSRDRPAGDVKPTRTLFVINFDPIRTKIRDIERHFEPYGKITNIRVRRNFAFVQYETQEEASAAVKNTDKSTILDRVVTVEYAFRDDDNERDDRYSSPKRGGHDRRRASPYMRSPSPSWFILKNPDSVRKLCHGGSGRQHDFLVPCILGAALVSQNSATI

SEQ ID NO: 31821 - DNA, 566 bp, Panicum virgatum
  misc_feature: Ceres CLONE 1907560
  misc_feature: Encodes the peptide sequence at SEQ ID NO. 31822
atttccctcccttcctcctactctgcatccctttctttcctgttttcgctgcctcctccctcgccgccgtctgtgatctccgtctcctctggccaccaaccatgtcttgctcccccatctcccccggctggtcatccttggcgctcatcagggacatctcgtccatccggcggcgctcctccgccccgcgcttcggcggcagcgtcttggaggtgatgtgctccctccgcgacctccactcccctatccactccttccgctcctcccagaagatcatcgagggcatgaacctggaggacgccgacgacgggcggggcgcgtacgaggccctcgtctcgttcctgcccttctcggacgggctggtggaggtgctctacgacatgaacttcgacatcctcatcgacgacatcgacttgctcttcagccactcccgccccgggaacaacggcgctctggtggtcttcaccgacgagcgcgacctctgcgacaccttcctcaacatcgtgctcaagaaggccgacacctgcatgtgccacctcaggttcctggtgatccactacatgggc

SEQ ID NO: 31822 - protein, 154 aa, Panicum virgatum
  misc_feature: Ceres CLONE 1907560
  misc_feature: SWISSPROT Homolog: EC 3.6.3.14 H(+)-transporting two-sector ATPase
MSCSPISPGWSSLALIRDISSIRRRSSAPRFGGSVLEVMCSLRDLHSPIHSFRSSQKIIEGMNLEDADDGRGAYEALVSFLPFSDGLVEVLYDMNFDILIDDIDLLFSHSRPGNNGALVVFTDERDLCDTFLNIVLKKADTCMCHLRFLVIHYM

SEQ ID NO: 31823 - DNA, 1603 bp, Panicum virgatum
  misc_feature: Ceres CLONE 1907570
  misc_feature: Encodes the peptide sequence at SEQ ID NO. 31824
ctgcctcacaaacaactccaccctgtcatttagccctgttctagtaccagctgagtcttctctcctgctctgccgtttcaactagggcaagttctgttcttgcattcgtccattgtctgttctgcttcaaccatgttttgaaggatcaattcaacatctatctctctttgtttctatatatgctatggcttagtgaatcttttaagtggccttagtttccttgggctggctacaaatatttttttttggaaatttccttatctattcatctctagttttatgaatcatttgaattctcttgtttttgcaacaagatttgggttcctgaaaacgaaaatactgcctaatggagatgggaccattaagtgctaaattgcacacatcactttgtgctgagcactgtcagaaccagaatacaacatcaacgagcatgtattatacggtgccagaagtgatcgactgaagctatgggaaacttatgctgctgtgttcaagttgatcagtcgactgtggccatcagggagcagtttgacaagtttgacagcgtgcttgagccaggatgccactgcatgccttggttcatcggcaagcgtgtagctggtcatcttacactcaggctgcagcaactggacgtgcgctgtgagaccaagactaaggacaatgtctttgtgaacgtcgtggcatctattcagtaccgtgctctggctggcaaagcaagcgatgcgttctacaaactgagcaacacaaggtcccagatccaagcatacgtctttgatgttatccgagcaagcgttcccaagctcattttagatgacgcttttgagcagaaagatgagatcgcaaaggctgtggaggaggagctcgagaaggccatgtcagcttacggttttgagatcgtgcagactctgattgtggacattgagccagatgagcacgtgaagcgctcaatgaatgagatcaacgcagcggcgaggctgagggttgctgcgaacgagaagggtgaggcggagaagatcgtacagatcaagcgtgcggagggtgaggcggaggccaagttcctgtctgggctgggcattgcccggcagcggcaggcgatcgtggatgggctgagggacagcgtgctgggcttctccgtgaacgtgccgggcaccaccgccaaggacgtgatggacatggtgctcatcacccagtacttcgacaccatgaaggagatcggcgcgtcgtccaaggcctcgtcggtgttcatcccgcatggccccggcgcggtgcgcgacatcgccactcagatccgcgaaggcctcctgcagggctcttccgtctcccaccactagtctgctggttctggagcagcgtggatgcggattcattcagtcacagggaaggagattgcttagctatatatgcttgccactgtcggtcagaccagtatgatgcctgtctatattgctcgtgtgtttctgcggagtatggagtgatctcagtgtggaaccataaattataacgctctacctgctactcctaggatgcttggggatcggagaaccttatctaaccttttagagaaggggtaatatgaacataatgcagcatgagtttgcagtat

SEQ ID NO: 31824 - protein, 287 aa, Panicum virgatum
  misc_feature: Ceres CLONE 1907570
  misc_feature (8)..(182): Pfam Name: Band_7 Pfam Description: SPFH domain / Band 7 family
MGNLCCCVQVDQSTVAIREQFDKFDSVLEPGCHCMPWFIGKRVAGHLTLRLQQLDVRCETKTKDNVFVNVVASIQYRALAGKASDAFYKLSNTRSQIQAYVFDVIRASVPKLILDDAFEQKDEIAKAVEEELEKAMSAYGFEIVQTLIVDIEPDEHVKRSMNEINAAARLRVAANEKGEAEKIVQIKRAEGEAEAKFLSGLGIARQRQAIVDGLRDSVLGFSVNVPGTTAKDVMDMVLITQYFDTMKEIGASSKASSVFIPHGPGAVRDIATQIREGLLQGSSVSHH

SEQ ID NO: 31825 - DNA, 1288 bp, Panicum virgatum
  misc_feature: Ceres CLONE 1907577
  misc_feature: Encodes the peptide sequence at SEQ ID NO. 31826
gctaactcccctgctccacaagaccactcggatcccaatcagccgagccgagccctgctcgtcttcggcgtcggcgtcggcgtcggcggcgacggtcccgcgaccgagagcccccgcgggcgagccagccacgcagcggcgtggacttggggggaagacggtagcggggagccggaggaatggaccccgagaagcgcggctacaggctccaggagtttgtggcgcacgatgccgacgtgaggtccctggccatcggcaagaagtctagccgtgtcttcatcaccggtggcaatgatcgcaaggtcaacttgtgggccattggcaagcaaactccgcttctgagcttatcaggccacacaagtgcggtggaggttgtgcagtttgattcagcagagatgcttgtgcttgctggctcatcaaatggttccatcaagctctgggacttagaggaagctaaagttgtgcgatctcttaccgggcatagatcgagttgcacttctgttgaattccatccatttggcgagttttttgcatctggttcatcagatacagacctgaagatatgggatataaagaaaaagggatgcattcacacatataagggtcacagaggagcaattaaaagaatcaggtttacccctgacgggcgatgggttgtcaccggaggggaagataacattgtgaaggtgtgggatctgacggctggaaagcttttacatgatttcaagttccacagcggacaaattaattgcattgattttcatcctcaagaatttttgcttgcaacaggctcagctgatcggacagtgaaattttgggacctggaaacttttgaattgataggttctgctggacccgagggttctggagtacattctatggtctttcatccagatggtaaaacccttttctgtggattagaccagagcttgaaggtattctcttgggaaccagtaagatgccatgacgttgttgacatggggtggagtaatttggccgaccttagtatttatgaagggaaactattgggatgctcctaccatgaacggcgtgttggtctatgggctgctgatatatcactcattgaaccctatgctcttggtgtgttgcccaaagcaaatttttttgctgagcttgtgcaatctttggatgataatcctgtgaagccaagtgatagcactgcaaattctagtcctgctttagcaatgatgcaaccgaaaaattcatacaaagtcaaggagcctgggactgctgaatgctgggttcgtggctcacatttgaatccagc

SEQ ID NO: 31826 - protein, 369 aa, Panicum virgatum
  misc_feature: Ceres CLONE 1907577
  misc_feature (176)..(214): Pfam Name: WD40 Pfam Description: WD domain, G-beta repeat
  misc_feature (92)..(130): Pfam Name: WD40 Pfam Description: WD domain, G-beta repeat
  misc_feature (134)..(172): Pfam Name: WD40 Pfam Description: WD domain, G-beta repeat
  misc_feature (50)..(88): Pfam Name: WD40 Pfam Description: WD domain, G-beta repeat
  misc_feature (7)..(46): Pfam Name: WD40 Pfam Description: WD domain, G-beta repeat
  misc_feature: SWISSPROT Homolog: EC 2.7.11.7 [Myosin heavy-chain] kinase
MDPEKRGYRLQEFVAHDADVRSLAIGKKSSRVFITGGNDRKVNLWAIGKQTPLLSLSGHTSAVEVVQFDSAEMLVLAGSSNGSIKLWDLEEAKVVRSLTGHRSSCTSVEFHPFGEFFASGSSDTDLKIWDIKKKGCIHTYKGHRGAIKRIRFTPDGRWVVTGGEDNIVKVWDLTAGKLLHDFKFHSGQINCIDFHPQEFLLATGSADRTVKFWDLETFELIGSAGPEGSGVHSMVFHPDGKTLFCGLDQSLKVFSWEPVRCHDVVDMGWSNLADLSIYEGKLLGCSYHERRVGLWAADISLIEPYALGVLPKANFFAELVQSLDDNPVKPSDSTANSSPALAMMQPKNSYKVKEPGTAECWVRGSHLNP

SEQ ID NO: 31827 - DNA, 784 bp, Panicum virgatum
  misc_feature: Ceres CLONE 1907577-R
tcaaaggagcaattgctgcagtggcaaagctgcctgacaatgctgttcaagctgatgttgttagtgctctcaaagggaagcttgatcttttcaacctggagattttctcaagctttctgcctgttcttgctgggttgctgagtagcaggactgaaaggcatgctgcagtttctttggaaatgttgttggatcttataaagattttcggaccagttatacattcaacattatcagcaaatctaggtgtaggagttaacattcaggcggagcagaggttgcaacgttgcgcacgctgctttaaccatttgcaaaagattcaacaagttctgcatccattgattatgcggggcggtgaatcagcacaactcgctcaagaactaagtctttcgttgcaagacttggtggtgatctaaaacaactcgggtgaatctcatccgtacggcagagtagatacgattctttttggcgaaaagtgcccacagttgtgtagcttgtaattttgtcatagctttgcaagtgggtcttgcaattgtgttttgacttaggctggcattcggcctttgtatatgtagcctggctgtgcatcagtttgtaattagccacatttgctgtgtgggcagccttgaacaaagattagcggaaacaggaaagtaaacaattagaaaaggacaatttagtttcttgcgcgactgacacccccagttggcagcccttgtatcatgtgattattgttcattgcttggatcaggatgaacgtatggtcaatgcttactttgacctaatc

SEQ ID NO: 31828 - DNA, 530 bp, Panicum virgatum
  misc_feature: Ceres CLONE 1907584
  misc_feature: Encodes the peptide sequence at SEQ ID NO. 31829
acgagcgccagccagtcaccacctacccgaagccgccgcgatcgatcgagccgagcgccccgcccccacgccgccaccgaaaccctagctcctcctcctcctcagccatggccaccgtctcgctcacgccgcaggtggtcttctccaccgagtcgggcggcgccctctcctccgccacaatcctccgtttcccgccaaacttcgtgcgccagctcagcaccaaggcccgccgcaactgcagcaacatcggcgtcgcgcagatcgtcgccgcggcgtggtcggactgccccgccggccgcccccactccggcggcggtggctgccgcggcctctgtttcgtccacaactgcgttcatgactcagcaggtacacttgtgcccattagaaaagcagaaaacattgaaggtgattgcatgtgttagttctcaagtaatcaaatgctcatattacttgctttacctttcatagtttgattggcttttatgttccgtgctcgtcacgaatgcataccttgtgagctattgtaattc

SEQ ID NO: 31829 - protein, 104 aa, Panicum virgatum
  misc_feature: Ceres CLONE 1907584
  misc_feature: SWISSPROT Homolog: EC 2.5.1.48 Cystathionine gamma-synthase
MATVSLTPQVVFSTESGGALSSATILRFPPNFVRQLSTKARRNCSNIGVAQIVAAAWSDCPAGRPHSGGGGCRGLCFVHNCVHDSAGTLVPIRKAENIEGDCMC

SEQ ID NO: 31830 - DNA, 1774 bp, Panicum virgatum
  misc_feature: Ceres CLONE 1907586
  misc_feature: Encodes the peptide sequence at SEQ ID NO. 31831
aagacgaacacaccgaggcaagtcagcgtctcagcgatgaatcccttcgcgaagaagccagcgccgcgagaggtgatgcggagcagcaagcgagacctgacgaatgctacgcgaggtaatgggcccgtctctagctgcgcgcttataccagataatgagaattgttctttttcacgctatatggttgtgtgcttacctagagcatccggagctacatgtaatgacttcactttgcatcttagtgcaattatgcgagatgcgccgaaacgcttgttcattgtcaacagtaattgctgctttgaaactttctgcgcccttattttgagcactttggtaacgctacatgtgtacctaaaatgccagcgccttttttttcgtgagtttatttgtttgaaaaaaataatttcgaggacttgagagtaagaaacatgaagaagatgataccctgtatcagtatgtggtttcctgtacccttaagggctatgcaggctgtatggttatttaatgcctgaggtgccctgtctgcagggattgagaggtatgtcgcatcattacaacaagaggtatgataattcaatcacaacactggtctgattaataaaaaatatccttttatattttgttgatttgtgaatttccttatatgttcatacttcatgttcaactgatggcttcttaagctgaaatatatgcttaggaagctctgtatgttccgctttagattatttctgcatcatattggatctagaaatatatcatactcattttaacatccattgcctttccattacatgttcccactattcgattttgttgatgcagttgaattaaattaacaatagcagatttacagactttttttttaaataacaggagaagaagctagttgctgaaattaaaaggacagcaaaaactggcaatgaggcagcaacaaaaattctagcccgtcagctgatcaggttaaggcagcagatttctaatttgcaaggtagccgagctcagattcgggggattgcaacacatactcaggcaatgcatgccaacacttcagtgactactggtttacaaagtgcgagcaaagcaatgggagctcttaataagcaaatggcacctaaaaagcagatgaaaataatgaaagaattccaaaagcagtcagcacaaatggatatgacaaatgagatgatgtctgattcaattgatgatgtcttggacgatgatcaggctgaggaagagactgaagaacttgctaatcaggttctggatgagattggtgtggacattgcctcacagttgtcctcggctcctaaaggaaaaattgccggaaagaaggttcaggttgatgaaagttcaaagctggaggaactagagaaaaggctggctgctttaaaaaatccgtaggatggtacctgttcgcatccttctctctacgcagagtccatatcctcgttagacattcaaaaaacatcgtgattttgtaaatattggatgaaagatgatcccagccccaagtttctcgacgaatcgatgagcacctatacagccatacatgctatcttgcagaagatggggctgtggtgcgttaacagtgacatattacttgattcagagcaacttatgtaatcgtgtaaaggaaattcgaatattttacagcttggccttttgtttctgatcattcaacatgataacattttgtttttgttcgtgtaaagaagttagaacctcacagcaacaatgattgctcgaatttttttaagcatcaaattactttgcgatt

SEQ ID NO: 31831 - protein, 121 aa, Panicum virgatum
  misc_feature: Ceres CLONE 1907586
  misc_feature (1)..(95): Pfam Name: Snf7 Pfam Description: Snf7
MHANTSVTTGLQSASKAMGALNKQMAPKKQMKIMKEFQKQSAQMDMTNEMMSDSIDDVLDDDQAEEETEELANQVLDEIGVDIASQLSSAPKGKIAGKKVQVDESSKLEELEKRLAALKNP

SEQ ID NO: 31832 - DNA, 707 bp, Panicum virgatum
  misc_feature: Ceres CLONE 1907598
  misc_feature: Encodes the peptide sequence at SEQ ID NO. 31833
atatcacactgattgctgaagatgagttcctccacgtccagcgctctcgtgctagcagcagcagtgctcctagcagcactgaccgtagcacagcatggctccctcgccgcagccgccggccccagggtcatcatcgtcggcgccggcatgtccgggatctcggctgctaaaacgctgtcggaggccgggataaccgacctgctgattctggaagcaacggaccgcatcggcggccggatgcacaagaagaacttctccggcatcaacgtcgagatcggcgccaactgggtggagggcgtcaacggcggcaagatgaaccccatctggcccatcgtcaacgaaacgctcaagctccgcaacttcctcaccgactttagtgtcgccacaaacatctacaaggaggagtatatacctactccgttccgttcgaactatacttcactttgattttatttgttgtaaatcaacaattttaactccaacctaataagtaagtcacaaaaaaacatcaactaatcagttagttcttacgaaaaaaaacatccactgattcggcagttcgcaacacatagctcgagagaccgcctcgcgtcgcctcctgtgaggcggctcgggggtcggggcgacgcactccgccgtcgaggcggcccgtctgctccttggccgccgccgctgctctccggcgagcggtggcgctcaaaaaggct

SEQ ID NO: 31833 - protein, 99 aa, Panicum virgatum; identical to SEQ ID NO: 25797
  misc_feature: Ceres CLONE 1907598
  misc_feature: SWISSPROT Homolog: EC 1.5.3.11 Polyamine oxidase

SEQ ID NO: 31834 - DNA, 705 bp, Panicum virgatum
  misc_feature: Ceres CLONE 1907599
  misc_feature: Encodes the peptide sequence at SEQ ID NO. 31835
acatcccgcggccgcctccctcatatcctccgtcctcgctcggtcaagtgccgccgctaccccccccccccccccccctccgtcactcttctcccgtggccaccacccaccgcatccgccgctccccgcccctctccaccggccggtttggtttgtctctgaaaggcggcggcggcggcagcggaaatgtccaaaaagaagcgcggcggcggcggcacccgcaaggacgaggtggtgacccgcgagtacaccattaacctccacaagcgcctccacggatgcaccttcaaaaaaaaagcaccaaatgccatcaaggagatcaggaagtttgcacagaaggctatgggaaccactgatgtccgaattgatgtgaagctcaacaagcacatctggagcagtggtatccggagcgttccaaggcgagttcgcgtcaggatcgcccggaaaaggaatgatgaggaagatgccaaggaggagctctactctctggtcacagttgctgagatccctgcagagggtctcaaaggtttgggtactaaggttgttgaggatgaggattaagcccacccatggattgaatctgctagcacttagtgcatatcatgagagcaagtttgagaatgttaccttagcttattgttatctaccgttgatgacttatgtaatagaagattcaagactttgctcatttctttcaagtgcttg

SEQ ID NO: 31835 - protein, 124 aa, Panicum virgatum
  misc_feature: Ceres CLONE 1907599
  misc_feature (12)..(106): Pfam Name: Ribosomal_L31e Pfam Description: Ribosomal protein L31e
MSKKKRGGGGTRKDEVVTREYTINLHKRLHGCTFKKKAPNAIKEIRKFAQKAMGTTDVRIDVKLNKHIWSSGIRSVPRRVRVRIARKRNDEEDAKEELYSLVTVAEIPAEGLKGLGTKVVEDED

SEQ ID NO: 31836 - DNA, 744 bp, Panicum virgatum
  misc_feature: Ceres CLONE 1907612
  misc_feature: Encodes the peptide sequence at SEQ ID NO. 31837
aaatcaaagcctcttcattccccaagtaaaaacaggcagcgacagccagcaccccgcccaaccaagcaccaccatgtcaggcggtggaaatggcagcgccgccgttcccactcacatcgtgatgttcccctggctcgccttcggccacatcagcccgttcgcccagctgacgcgcaggctcatcgtcggatccggcgacggcgtcttccgcgtaacgttcctgacggccgccgggaacgtaacccgcgtcgaggcgatgctggcggaggccgccgggacggtgaaggtcgcgccgctggacctgccaagcgtgccgggcctgccagcgggcgccgcaagcaccacagagctctccgccgatggcgctgagcttctaaaggtcgcgctcgacggcacccggccgcaggtcgccgcgctcctggcggagctccgcccggacgccgtgatcttcgacttcgccgtgccgtgggtctacgacgtcgcggcgccgctcggcatcaagccgctctacttcaacgtttactccgccgcgaccctcgcgttgctctccgtccccgctcggtgccccggcgggcggtgcccgtccgcgcacgacctcatggcggcccccgccggctttccctcggactcgccgctcgtcacgctgccggcgtaccaagccgcagacttgacgtacgcgtatgagagcttctacagcttgccgagcgtgtatcaccgcttcattccctgcttcgagggctgcgc

SEQ ID NO: 31837 - protein, 223 aa, Panicum virgatum
  misc_feature: Ceres CLONE 1907612
  misc_feature: SWISSPROT Homolog: EC 2.4.1.115 Anthocyanidin 3-O-glucosyltransferase
MSGGGNGSAAVPTHIVMFPWLAFGHISPFAQLTRRLIVGSGDGVFRVTFLTAAGNVTRVEAMLAEAAGTVKVAPLDLPSVPGLPAGAASTTELSADGAELLKVALDGTRPQVAALLAELRPDAVIFDFAVPWVYDVAAPLGIKPLYFNVYSAATLALLSVPARCPGGRCPSAHDLMAAPAGFPSDSPLVTLPAYQAADLTYAYESFYSLPSVYHRFIPCFEGC

SEQ ID NO: 31838 - DNA, 642 bp, Panicum virgatum
  misc_feature: Ceres CLONE 1907615
  misc_feature: Encodes the peptide sequence at SEQ ID NO. 31839
gcctcatggccagcgcgggactccaccactcccccccatcttcctcgccctcccgaatcttccaccgatcccacgagaggccggcgtccaggtcctctcccccgcggttcagatccccggatcgagccggcgcctcgtgaaaatccgcagcggcgacgaggtggaaagtttttttttttgttggggttgcttggggctgtggatctgctgaggtggcgacatgagcctggatttgggagctgttctcaaacccggcactttcggggtctcggaccacgacgcgatcgtttcgatcaacatcttcattgcgctgctctgcagctgcattgtaatcgggcacctgctcgaagggaaccgatgggtgaatgagtccatcactgcgcttgttatgggtctgatcaccggaggtgtgattctgctcgctactaatgggacaaattcacgcatcctcgtgtttagcgaggacctgtttttcatctatttgcttccgccaataatcttcaatgctgggtttcaagtaaagaaaaagcaattcttccgcaactttatgacaattattttgttcggagctgttgggactctgatttcctttgtaataatcactcttggtgccatgggattgttcaagaaacttgatgttgg

SEQ ID NO: 31839 - protein, 140 aa, Panicum virgatum
  misc_feature: Ceres CLONE 1907615
  misc_feature: The sequence is a functional homolog of SEQ ID NO 4 in US patent 7250560
  misc_feature: The sequence is a functional homolog of SEQ ID NO 2 in US patent 7250560
  misc_feature: Useful for making plants with modulated water use efficiency
  misc_feature: The sequence is a functional homolog of SEQ ID NO 2 in US patent 7041875
  misc_feature: Useful for making plants with modulated drought sensitivity
  misc_feature: The sequence is a functional homolog of SEQ ID NO 4 in US patent 7256326
MSLDLGAVLKPGTFGVSDHDAIVSINIFIALLCSCIVIGHLLEGNRWVNESITALVMGLITGGVILLATNGTNSRILVFSEDLFFIYLLPPIIFNAGFQVKKKQFFRNFMTIILFGAVGTLISFVIITLGAMGLFKKLDV

SEQ ID NO: 31840 - DNA, 1814 bp, Panicum virgatum
  misc_feature: Ceres CLONE 1907616
  misc_feature: Encodes the peptide sequence at SEQ ID NO. 31841
acccaacagcgaacacttccccacgaaatcctgcaacagccggtacctctgttcacccccgtcaatctccggcgaagttggagatctttaagctaaaattccttccaatctgaatccaaatacattccaccggaacggaatatccaggaccaagggttcttttaagcttttatctgcttcagttctttagaaaaatctagaagtatactaaccacacctgcaatggcgggttaccaaactagccttgtggctgagccacagttgctgaacaacgagatcatcactcagaaggccactaataaatttgtttcttacaccgccacaaaagacaaatccattggctacttggatgtgtttgtacatcaggcacgcgatatccacaatgtttgtatctaccacaagcaggatgtgtatgcaaagctgtgccttacaagcaacccagatgtttcatgctcaaccaaggtaattaacagtgctgggtgcaacccagtattcgaagaaagcctacggcttgacgtgcagactgtggacgcttcactcaaatgtgagatatggatgttaagcagagtgaggaactaccttgaggaccagctccttggctttgcccttgttcctctggcagacatcgtaatgggtaatgggaagctggtccaggagttctccctgacatccactgagctgttccacacacctgctggttttgtgcagctgtccttgtcatatgctggttgttccccagatgtcatcctcatctcatcacccgataaatcagtgtcaagagtggccgattctggaaatgattgtgcagttccttctcagcttgaaaagatcgagttcccagacctaaatgttgtgaaggaggatgaggttatggtctccaagtatctcgagatggggtctttggattctgagaaccctataaaaactgagaatggcaagttgctgctttctggaaatgataacgatattccttctgaatttgggaaggtcgacttaccagactccgagaaccctgtaaaagccgagaatggcaagttactgcagttcggtgcagctgtgcctggtactgcaatgtgtggagataagctggaggaacatcaggatgaaagccctctaagttgtgtctcaaccacaggttcctccactgccctttctgcaacacgacaatcagtttctgagccaagttctgaaccttcagagaccactgttgaggcatctccaagacaaagacagaaggagaaaagccaagatgttactgatggtgaggctgattcttctgaagcaccacccagggatgaagttgtcaagcctatgatcagcattaatcttcagccagagcagtcagttgtccaacaggacatagttgacatgtacatgaagagcatgcaacagttcacagaatctcttgcaaaaatgaagcttccgttggatgttgagaatagtagtctctcaaatgatgtctctgactccagtacaattgagaagccacccccatccccatcatcatccgtgtcaaagggttctagggtcttttatggaagcagggccttcttctaagtttcttatgcgaagtagcgctagctcatctcctatatatatggttcaggtttgttaggtattggctagcatgtattgacatacttttctgtcgccacaatatactgctaggactcactcttggtattgttcatagtgttgtgctttgttaaaaaagaacaataatttcagaataatgtcctctcagagttgtagattgatcctatgtactaatatgtgtcgatgaatatagtaatgataatgaaatcagttctgcc

SEQ ID NO: 31841 - protein, 444 aa, Panicum virgatum
  misc_feature: Ceres CLONE 1907616
  misc_feature (42)..(129): Pfam Name: C2 Pfam Description: C2 domain
  misc_feature: Useful for making plants with modulated biomass
MAGYQTSLVAEPQLLNNEIITQKATNKFVSYTATKDKSIGYLDVFVHQARDIHNVCIYHKQDVYAKLCLTSNPDVSCSTKVINSAGCNPVFEESLRLDVQTVDASLKCEIWMLSRVRNYLEDQLLGFALVPLADIVMGNGKLVQEFSLTSTELFHTPAGFVQLSLSYAGCSPDVILISSPDKSVSRVADSGNDCAVPSQLEKIEFPDLNVVKEDEVMVSKYLEMGSLDSENPIKTENGKLLLSGNDNDIPSEFGKVDLPDSENPVKAENGKLLQFGAAVPGTAMCGDKLEEHQDESPLSCVSTTGSSTALSATRQSVSEPSSEPSETTVEASPRQRQKEKSQDVTDGEADSSEAPPRDEVVKPMISINLQPEQSVVQQDIVDMYMKSMQQFTESLAKMKLPLDVENSSLSNDVSDSSTIEKPPPSPSSSVSKGSRVFYGSRAFF

SEQ ID NO: 31842 - DNA, 729 bp, Panicum virgatum
  misc_feature: Ceres CLONE 1907617
  misc_feature: Encodes the peptide sequence at SEQ ID NO. 31843
aggggacagaccagctagtgcgccagcacagtctagcctgctgctgctggccactgctactgtgctactagctgacgccgggccggtgggggtgtgagcgggctgcggcgagctgccactgcggcggtcggctggcggcggccgcgcgagcggagtggagcgagatgaacgctcggtgggcggtgcttctcgcgctgctggtggcgagcgccggcgccggcggcgcgcgcgccgcggggttcggcgggctgagccgcgcgtcgttccccaaggggttcgtgttcgggacggcgacggcggcgtaccaggtcgagggcgcggcgtccaccaacggccgggggccctccatctgggacgcattcgcgcacaccccaggaaatgttgtgggaaatcaaaatggagatgtcgcggtggatcaataccatcgctacaaggaagatgttgatctcatgaaaagtttgaattttgatgcctaccgattttcaatctcatggtccaggatcttcccagatggagagggaagagtcaatccagaaggtgtagcatattacaacaatttgataaactacctgctccagaaaggcatgactccttacgtcaacatttaccactacgatcttcctcttgcactcgagaagaaatacggagggtggttaagctcagagatggcagacctgtttacagagtatgctgacttctgttttaagacctatggcgatcgtgtaaagc

SEQ ID NO: 31843 - protein, 188 aa, Panicum virgatum
  misc_feature: Ceres CLONE 1907617
  misc_feature (30)..(188): Pfam Name: Glyco_hydro_1 Pfam Description: Glycosyl hydrolase family 1
  misc_feature: SWISSPROT Homolog: EC 3.2.1.21 Beta-glucosidase
  misc_feature: Useful for making plants with altered cell wall content and/or composition
  misc_feature: Useful for making plants with altered carbohydrate content
  misc_feature: Useful for making plants with modulated biomass
MNARWAVLLALLVASAGAGGARAAGFGGLSRASFPKGFVFGTATAAYQVEGAASTNGRGPSIWDAFAHTPGNVVGNQNGDVAVDQYHRYKEDVDLMKSLNFDAYRFSISWSRIFPDGEGRVNPEGVAYYNNLINYLLQKGMTPYVNIYHYDLPLALEKKYGGWLSSEMADLFTEYADFCFKTYGDRVK

SEQ ID NO: 31844 - DNA, 1874 bp, Panicum virgatum
  misc_feature: Ceres CLONE 1907618
  misc_feature: Encodes the peptide sequence at SEQ ID NO. 31845
atctaccgtttcgtccacccccagcgccgcccgcagatgccgcccaaggtggtgaccatcgccgcgggcgaggtccacacgctcgccctcacgggtgatggggaggtgtactcgtggggcaggggcccgttcggccgcctcgggaccggccgcgaggacgacgagctcgtccccaccgccgtggcgcccgcggtcggcgcctgcggtgggaggccgaggcccaggttcgtggccgtcgccgccggggcctaccacagccttgcgctggacgatgaaggttcactctggtcatggggctacaatctctatggccagcttggctacggggatcagaatgccctttttccttgtttggttgatcaatttcaggatctagattctcctgaaacactagatgatgaagcccagagcacaggtgatcgaacttctttgaagctgtcttctgtcaaagctggtggcatgatgtcttttgccatagacagtttgggggccctgtggatgtggggaaattgccctcagcagacggatgctggagaattttgtattgcaagtagttctgttccactacctgtgtgggatttccatggacacactgttgttaaggttgcctgtggtaatgagcatgtagtagctgcagttagtgctggggagacttatactggaggtgaccttgtttgctatgcttggggaaacaacaaccatggtcagttgggtctaggtgacaaggaaagtagatctcgtcctgtgcttatctcagcatttagtgaagaatcttcttgggaggtgtatgaaattgcatgcggagcttctcacactgccgtcctcaccaataagaagtcttttgaccagatagaatctcggtgctggacgtttggccttggtgacaaggggcagcttggccacggaaccacagccaccatttgctcaccacaacctgttgatggcttaccaaccggatccttccttatttctcttgattgtggattgtttcacacaactgtagtctcctctgatggagaggtgtggtgttggggaatggagagaggtcttgggctgtgcccagatgctagcttttcaggggttgatgcaggggatgctctatgtccgataagagttcagtcacctgaaacaaatgggttcaaatttcttggtccagtgcagatcgcctgtggagctgcccacactgttctcgttgctggtgatgggtataggatgtgggcatggggcagaggccgcagtggtgtgcttgggagaggccagactgctgacagctacataccatgcgttgtgatgtggcctcctcttggtgagaacttccaggagattcatgaggaccaagcagaggcatcaacatcaagagtgaatgatcgcactagaactgagttggagcagaagctatctgctgcctcggatgaattacagttcctaaggtcaaaactgacactcatggagagatatgccaacatactccacatatcaatctttcgtaagccacttgatgaacggacactgccacgttcactccaggaatctccagtctttgatattagaaaggaatttgagaacatattggatgcagcagacactgatgaactcaatcgtttggagatcttctaccgcagcatgctttccggtgtgaaggacaagcttctgaagcgaagagtccaagagatggttcaacaatgcattatttcactctcagcagggaggcaaacccctcgagatcagtgaattgattgtatacttaccaaatagaaagtcagtacaggatcaccagatttgatgtcataaaaaatgcagtaagccctgtttatgctaacctaccgttgcatctgtttcttaatatatatatatatatatatatatggcgaggc

SEQ ID NO: 31845 - protein, 564 aa, Panicum virgatum
  misc_feature: Ceres CLONE 1907618
  misc_feature (21)..(77): Pfam Name: RCC1 Pfam Description: Regulator of chromosome condensation (RCC1)
  misc_feature (211)..(263): Pfam Name: RCC1 Pfam Description: Regulator of chromosome condensation (RCC1)
  misc_feature: SWISSPROT Homolog: EC 2.7.11.1 Non-specific serine/threonine protein kinase
MPPKVVTIAAGEVHTLALTGDGEVYSWGRGPFGRLGTGREDDELVPTAVAPAVGACGGRPRPRFVAVAAGAYHSLALDDEGSLWSWGYNLYGQLGYGDQNALFPCLVDQFQDLDSPETLDDEAQSTGDRTSLKLSSVKAGGMMSFAIDSLGALWMWGNCPQQTDAGEFCIASSSVPLPVWDFHGHTVVKVACGNEHVVAAVSAGETYTGGDLVCYAWGNNNHGQLGLGDKESRSRPVLISAFSEESSWEVYEIACGASHTAVLTNKKSFDQIESRCWTFGLGDKGQLGHGTTATICSPQPVDGLPTGSFLISLDCGLFHTTVVSSDGEVWCWGMERGLGLCPDASFSGVDAGDALCPIRVQSPETNGFKFLGPVQIACGAAHTVLVAGDGYRMWAWGRGRSGVLGRGQTADSYIPCVVMWPPLGENFQEIHEDQAEASTSRVNDRTRTELEQKLSAASDELQFLRSKLTLMERYANILHISIFRKPLDERTLPRSLQESPVFDIRKEFENILDAADTDELNRLEIFYRSMLSGVKDKLLKRRVQEMVQQCIISLSAGRQTPRDQ

SEQ ID NO: 31846 - DNA, 613 bp, Panicum virgatum
  misc_feature: Ceres CLONE 1907627
  misc_feature: Encodes the peptide sequence at SEQ ID NO. 31847
acgtgcacccgcggcgggacacgactcccttggctcaccatgtcttcttccccctcctcggcgcactggctgagccacgccgggagcatctggctgaagaccatcaacgggcccaacgccgacttccccgtctactcgtctcaactcaaggacctgaagcacatctcgcaggtgcagctcaacttcctggccttcccctccgacgcccgcaagttcttcggctgggtctccggggtggccgcgctctacctgccgctctggctcgtcgccttcgacggcgccgccttcggcctcgacggctacggcgtccaatacctcttcctcgacagcgccggcctccgctactggcacctcttcctgctcacctccctcgccgggaatggcatctgctggatcaacaccggctgctacctcctttgcatccgcaacttcggcaccagcaaccgcgtagcggtgatcctcgccaccagctacctcggcctcagcgccaaggtctacaccagcctggccgactccatacccggcctggccagctccaaggtcaaggcctacctcctcctcgatgccgtcgtgcccatgctcgtcaccgtcgtggtggcgccggcgctccggg

SEQ ID NO: 31847 - protein, 191 aa, Panicum virgatum
  misc_feature: Ceres CLONE 1907627
  misc_feature (9)..(191): Pfam Name: Nodulin-like Pfam Description: Nodulin-like
MSSSPSSAHWLSHAGSIWLKTINGPNADFPVYSSQLKDLKHISQVQLNFLAFPSDARKFFGWVSGVAALYLPLWLVAFDGAAFGLDGYGVQYLFLDSAGLRYWHLFLLTSLAGNGICWINTGCYLLCIRNFGTSNRVAVILATSYLGLSAKVYTSLADSIPGLASSKVKAYLLLDAVVPMLVTVVVAPALR

SEQ ID NO: 31848 - DNA, 1996 bp, Panicum virgatum
  misc_feature: Ceres CLONE 1907642
  misc_feature: Encodes the peptide sequence at SEQ ID NO. 31849
cgcacgcttatgatgattgcaatcttgatcgcagctctgctcgtgctctccgtctccgttgtcaccgtcggcgagaggcggaggagacggcggcgaggcggcggcgacggcgcgtccgacggattaggccaagatcacggccgctggtgctgcataggcgccggtgtcaaagaaatgagcttgcggggcgacccggcggcggccggggacgagacggcggaggagctgctggagcgtgtccgggggatggtgccaccggcgctggcggcggcgggggcggcggccgggttcccgggccggtggaaggcgatcgccgccaagctggaggcgctcccggcgtgcctgtccgacctgtccagccacccttgcttcgccaagaacgcgctgtgccgcgagctgctgcagtcggtcgccgccacgctcgccgaggcggccgacctcgcggggcggtgccggggcccgccgccggacgggaagctgcggacgcagagcgccatcgacgcgctctccgggaagctggacctcaacatccgggactgcgcgctgctcgtcaggaccggcgtgctgtccgacgcctccggcccgtcgccgccggcgcacgcggacgtccgggagctgctcgcgaggctgcagatcgggcacaccgaggccaagaaccgggccgtggacgggctcctcgaggcgctgcgcagcgacgagaagagcgtgctctccgtgctcggccgcgccaacgtcgccgcgatggtgcagctgctcacggcgccggctcccgtggtccgggagaaggccgccacggtgatatgccaggtcgcggagtcgggcgcctgcgacgggctgctcgtgtcggagggcgtcctgccgccgctcatcaggctggccgagtccggcagcctcgtcggccgcgagaaggccgcgatcacgctgcagcgcctgtccgccgtgtcccctgacgctgcgcgcgcgatcgtcggccacggcggcgccggcccgctcatcgagatctgccagacgggggactccatctcgcagcccgccgcggccggcgcgctcaggaacctctcggcggtggcggaggtgcgggaggccttggctgaccagggaatcgtccgcatcatggtgaacctgctggactgcggcaccgtggccggctccaaggagcacgccgccgagtgcctgcagaacctgacgtcgggcggcgacagcttgcggcgcgccgtggtgtccgagggcgggctgcgcagcctgctgctctacctggatggcccgctgccgccggagcccgcggcgggcgcgctccggaacctcgtgggcgccgtgtcgcccgacagcctggtgtcgctgggcgtgctgccccggctggcccacgtgctgagggtcgggtcgatcggcgcgcagcaggcggcggcggcggcgatctgccggatgtcgagctccgcggagatgaagcgcgcggtcggcgagcacgggtgcgtgccgctgctggtgcggctgctggaggccaagtcgaaggcggcgcgggaggtggcggcgcaggcgctggcgagcctggtgagctggccacccaacgcccgggaggtgaggagggacgacaagggcgtgccgagcctggtgcagctgctggacccgagcccggcgaacacggccaacaagtacgccatcgcgtgcctgctgacgctggcggcggccaagcggtgcaggaagctgatgatctcacacggcgccatcgggtacctcaagaagctctccgacatggacgtcgccggcgccaggaagctgctcgagaggctggagcgcggcagcctgcgcagcctcttcagtaggaactagcgtatagcggctgtaaaaactaacaaagctgccttcactcgctgcttatacattggcatttttttttcttttttgctgtataacatgtataaaaatcaagtccagtttgacacacacacactctgttaactgtcgatgaaatggtgatgtgcaggtgttcgtgttaacc

SEQ ID NO: 31849 - protein, 550 aa, Panicum virgatum
  misc_feature: Ceres CLONE 1907642
  misc_feature (257)..(297): Pfam Name: Arm Pfam Description: Armadillo/beta-catenin-like repeat
  misc_feature (420)..(460): Pfam Name: Arm Pfam Description: Armadillo/beta-catenin-like repeat
MSLRGDPAAAGDETAEELLERVRGMVPPALAAAGAAAGFPGRWKAIAAKLEALPACLSDLSSHPCFAKNALCRELLQSVAATLAEAADLAGRCRGPPPDGKLRTQSAIDALSGKLDLNIRDCALLVRTGVLSDASGPSPPAHADVRELLARLQIGHTEAKNRAVDGLLEALRSDEKSVLSVLGRANVAAMVQLLTAPAPVVREKAATVICQVAESGACDGLLVSEGVLPPLIRLAESGSLVGREKAAITLQRLSAVSPDAARAIVGHGGAGPLIEICQTGDSISQPAAAGALRNLSAVAEVREALADQGIVRIMVNLLDCGTVAGSKEHAAECLQNLTSGGDSLRRAVVSEGGLRSLLLYLDGPLPPEPAAGALRNLVGAVSPDSLVSLGVLPRLAHVLRVGSIGAQQAAAAAICRMSSSAEMKRAVGEHGCVPLLVRLLEAKSKAAREVAAQALASLVSWPPNAREVRRDDKGVPSLVQLLDPSPANTANKYAIACLLTLAAAKRCRKLMISHGAIGYLKKLSDMDVAGARKLLERLERGSLRSLFSRN

SEQ ID NO: 31850 - DNA, 1339 bp, Panicum virgatum
  misc_feature: Ceres CLONE 1907650
  misc_feature: Encodes the peptide sequence at SEQ ID NO. 31851
gagcaagcaagcttaaatcccagcaccacgacggggccgaccgctacggtctcctcccccgctcccccgcttccagaagcttcggcgctccgccatgcgtcccgccttcctcgcggcgctcctcctcgtcgccgcggccgcctccccggccgccgcgctctactcggcgggctccccagtcctccagctcgaccccaacaacttcaaatcaaaggtgctgaactcgaacagggtggtgctggttgagttcttcgcgccctggtgcgggcactgcaagcagctggctcccgcctgggagaaggccgccggcgtgctcaagggcgttgcaacggtcgccgccctcgacgccgacgcgcacaaggatctcgcgcaggaatatggaatcaggggatttccaactataaaggtgtttgtccctggtaaacctccagttgattatcaaggagcaagagatgtaaagccaattgtagaatttgctctgtctcaggtcaaggcccttcttagagatagattgaatggcaaggcatcagcagggtcaagtggcaaggcatctggaggttcaagtgagaaaagtgaaccaagtgcatcagttgaactaaattcacataattttgatgaacttgtcgtcaaaagcaaggacctttggattgtggaattctttgcaccatggtgtgggcactgcaagaaattggcacctgaatggaaaaaggctgcaaagaagttgaagggccaagtgaagctagggcatgttgattgtgatgctgaaaagtccttgatgagcaagtacaaggttgaaggcttcccgactattttggtatttggtgttgataaggagagcccattcccgtaccagggggctagagttgcatctgccattgagtcctttgcattggagcagttggaagccaactctggtccagctgaagtttctgagttgactggccccgatgtcatggaggagaagtgcacttctgctgccatttgctttgtatcattcctcccggacatccttgattcaaaggcagaaggaagaaacaagtaccttgagctccttctttctgttgctgagaagttcaaaaagagtccatacagttttgtctggacagctgctaccaagcaacctgatctcgagaaccaggttggagttggtggctatggctatcccgccatggttgctctcaatgtgaagaaaagcgcatacgctccacttcgtagtgctttccagcgtgatgaaatcatcgagtttgtgaaggaagcagggcgcggtggaaagggaaatcttcctcttagtggtgtcccgacggtagtaccatccgagccatgggacggcaaggatgga

SEQ ID NO: 31851 - protein, 414 aa, Panicum virgatum
  misc_feature: Ceres CLONE 1907650
  misc_feature (28)..(131): Pfam Name: Thioredoxin Pfam Description: Thioredoxin
  misc_feature (164)..(268): Pfam Name: Thioredoxin Pfam Description: Thioredoxin
  misc_feature: SWISSPROT Homolog: EC 5.3.4.1 Protein disulfide-isomerase
MRPAFLAALLLVAAAASPAAALYSAGSPVLQLDPNNFKSKVLNSNRVVLVEFFAPWCGHCKQLAPAWEKAAGVLKGVATVAALDADAHKDLAQEYGIRGFPTIKVFVPGKPPVDYQGARDVKPIVEFALSQVKALLRDRLNGKASAGSSGKASGGSSEKSEPSASVELNSHNFDELVVKSKDLWIVEFFAPWCGHCKKLAPEWKKAAKKLKGQVKLGHVDCDAEKSLMSKYKVEGFPTILVFGVDKESPFPYQGARVASAIESFALEQLEANSGPAEVSELTGPDVMEEKCTSAAICFVSFLPDILDSKAEGRNKYLELLLSVAEKFKKSPYSFVWTAATKQPDLENQVGVGGYGYPAMVALNVKKSAYAPLRSAFQRDEIIEFVKEAGRGGKGNLPLSGVPTVVPSEPWDGKD

SEQ ID NO: 31852 - DNA, 649 bp, Panicum virgatum
  misc_feature: Ceres CLONE 1907650-R
acttctggccatgtcctgagctcagaatggttgttctggatggttatgacttcagttgtcttgggtggcgtgatgaccatcctgtgactgcagcagcaaagaagttccgggatgaaacgaacccaaacaatgacaagaacagccctgctggtttggttggcgtcgccaggcggtttgtgaagttcaatggcgcagttggcaaggagcagctgtcctggctcaatgatgtcctccaggacgcatcggcactccatcaaaatgtcattatatgcagccatctcccaatggatcccggmgcatcttccccagcagctctcatgtggaaytacgakgaggtgatggatattgttcgccggwacagctgtgtcaaggcytgcttkggggggcatgaccacaagggtggccactcggtggactcgcmcggtgtgcatcaccgcactctcgaggckgcattggagtgtcctccaggcaccagcgcattsgggcakgttgaagtctatcctgacaggctgctgcttgttggttttgacagaatggcggatactgaaatccctttttgagccattagagtgatctgtctagcacaataaaattcttgtgacttcattgtttgacgaaataatgtcattgaaattaaattatcttcaat

SEQ ID NO: 31853 - DNA, 1403 bp, Panicum virgatum
  misc_feature: Ceres CLONE 1907672
  misc_feature: Encodes the peptide sequence at SEQ ID NO. 31854
ctgcttgccccttcctctctcctggcgccaccttcacagcaccaaccccccttcatccctccctcccagcgccacctgcagcacccctgcaccggccccttcctcctcacgcgccgcctgcaccaacccaaacgccggctgcaggcgccgccgagcctccctccgcgccgggccgttcctccctcacccaatcatgcacgggctgcgtgggcatggcaccctgcggccgcggcggagcggacaacttggggaattatggaatgatgatggtgctgtttgagacgccttctggctttgcaattctaactattgatggggtgtgcctgtaccttccagatgccatggagaatatctgggcaaacttcacagttggttatagagcacgagatgttgtttggctcaaggaatttaaaacttttaaggacaagtccagcgccattaggcttgatactggtgttgacagcaagctgtctaagatgatcatgaagtggcgccgtcgtgggcagacgttggttgttgggaaacctgaatataaaacaatcatagaaatgaacatgggtatacgctgcctgtgtgatgaaagtgtgatgaaggtgatgtggggcctcaagaatatcatgcctactttagtacctgaagaaaaatcacggctgactagggaggaccgccttcccatgagtcaaggactaataaagttcctgaatcgttatggcttttatatcgaaccagagatggttaatgagcagattattctggcagcctgtaccttgcttgattgtgaacttattgagcagaaacattgtgcagccttgaaaaaggctggtgagcaaattaaggatgtgtctggcatcaacacaaatggttggagcttactgaaacttgcaacagcactgatgattatattgtatcctgaagaaaatatcatagcaggaaaccctaaaatgatgtttacagatgctgagcgattgaagttgcaggaagatgtacaggattacaatggcaaattctttaagtgggcatgccagaggatttacaaagaaactagattgcccataaagctagatcgccgacttttgcattattgacctccttggttaaggaggctaaagaagcatatgaagctgaaggaagtgcccaagaggctaaagaagcatataaatctgaaggaagtgcccaaaaagcgactagctgaaactgttgcatctggggattgtaagcatgtaggtgttgacacttcgatgttattattaaacatctagttctgccatcttgctatgtcagttggccggcatatagaactttaagcatgtactattctagctattttctggttttgactttgttatctggaagtgcaaactcagtttgactcttcaacttgagttaaatttacaaacttggcc

SEQ ID NO: 31854 - protein, 290 aa, Panicum virgatum
  misc_feature: Ceres CLONE 1907672
  misc_feature (18)..(85): Pfam Name: NOP5NT Pfam Description: NOP5NT (NUC127) domain
MAPCGRGGADNLGNYGMMMVLFETPSGFAILTIDGVCLYLPDAMENIWANFTVGYRARDVVWLKEFKTFKDKSSAIRLDTGVDSKLSKMIMKWRRRGQTLVVGKPEYKTIIEMNMGIRCLCDESVMKVMWGLKNIMPTLVPEEKSRLTREDRLPMSQGLIKFLNRYGFYIEPEMVNEQIILAACTLLDCELIEQKHCAALKKAGEQIKDVSGINTNGWSLLKLATALMIILYPEENIIAGNPKMMFTDAERLKLQEDVQDYNGKFFKWACQRIYKETRLPIKLDRRLLHY

SEQ ID NO: 31855 - DNA, 359 bp, Panicum virgatum
  misc_feature: Ceres CLONE 1907674
  misc_feature: Encodes the peptide sequence at SEQ ID NO. 31856
atcaagcagctcggagaaggccgacgcccgacgacggcgagccagaagaggccgccgatccgaccctgagagctcgcgcgcacagtacgcggccatggttgaggaagcggcggccgtgccccccgccgtggcggcatcggcggccgcgagcgccccgccgcacctgctgctgatctgcttcccggggcagggccacgtgaaccccatgctccgcctggccaagcgcgtcgcggcccacggcctcctcgtgaccttctcctcgctggccagcgttggcccgaaggtggtggccgccgcgggggcgtcggccggcggcgacgggctgcccgccggccggcgcctctgtccagttccagttc

SEQ ID NO: 31856 - protein, 88 aa, Panicum virgatum
  misc_feature: Ceres CLONE 1907674
  misc_feature (23)..(53): SWISSPROT Homolog: EC 2.4.1.121 Indole-3-acetate beta-glucosyltransferase
  misc_feature (23)..(56): SWISSPROT Homolog: EC 2.4.1.210 Limonoid glucosyltransferase
  misc_feature: Useful for making plants with altered carbohydrate content
MVEEAAAVPPAVAASAAASAPPHLLLICFPGQGHVNPMLRLAKRVAAHGLLVTFSSLASVGPKVVAAAGASAGGDGLPAGRRLCPVPV

SEQ ID NO: 31857 - DNA, 700 bp, Panicum virgatum
  misc_feature: Ceres CLONE 1907686
  misc_feature: Encodes the peptide sequence at SEQ ID NO. 31858
gaaatcgaagcagcagcagcaatggcggcatccatgatcacgtcgtcagctctggtggcgccggccagggcccagggcctgccgtcccacggccgccgcgcctcctccttcgccgtcgtctgcggcaccggcaagaagatcaagaccgacaagcccttcgggattggaggtggcctcaccgtcgaccacgatgcctccgggaggaaggtcaagggcaagggcgtgtaccagttcgtcgacaagtacggcgccaacgtcgacggatacagcccaatctacaaagaggaggactggtctcccaccggtgacgtctacgtcggtggtaagtagatatatagtaatttcacaaattcactatatatgattatgcggtcactaagctagtacagatctggcttgttgttcccgttcccaaccccttttagtccgggttccgggactacaaatctcggactagagacctggattatttagtcctagtagaactaatacctttggcctcgtccataacttgttaaccaccccacctacacagtatatatgattttgaatggaatgcgctcctttaaaactaatccgtgaagaatcctttagttttggttgacaccaccaaccgggactaaagatccttttagtccgagttggagcaccaaccaggactaaagggtcatccttcagtccgaactcccgggttggcgtg

SEQ ID NO: 31858 - protein, 102 aa, Panicum virgatum
  misc_feature: Ceres CLONE 1907686
  misc_feature (35)..(102): Pfam Name: PsbR Pfam Description: Photosystem II 10 kDa polypeptide PsbR
MAASMITSSALVAPARAQGLPSHGRRASSFAVVCGTGKKIKTDKPFGIGGGLTVDHDASGRKVKGKGVYQFVDKYGANVDGYSPIYKEEDWSPTGDVYVGGK

SEQ ID NO: 31859 - DNA, 1641 bp, Panicum virgatum
  misc_feature: Ceres CLONE 1907745
  misc_feature: Encodes the peptide sequence at SEQ ID NO. 31860
aaggcgccagcaggggacctcgacgacggcgagcaaggattcccatggatgcacgacgacctgttccaccaccacctctggaccagcgccgccgtctccatgcacaccaagcaaggatggaagggtgccaaccaggacgccatgaccgtctcccaggactttgctggccacaaaggccacatcttctgcggggtatttgatgggcatggccctcttggccgagaagtcgctcgccatgtccgcgacacccttcccttgaaactatcctctgctttgaagctgaaaactcaagaagaagatccttcaaaccatacttccaagctcacaactgaagaagaccactcaagcaatacagatttggattcctgtgacaagtcagactccacctcgtttagtgatgatacaagcgatgagaagctcctgttgtccacttggaagaacatatttgtgaaggcatttgatcgggtggatgaggagctcaggcaacattcaggaattgactgcatttgcagtggcaccacagcagtcactgttgttaggcagggtgatcacttgatgattgccaatttgggtgactcgcgtgctgttctttgtacccgggacagcaaggaccgtctgatcccagtccaactcaccactgactttaagccagatcttccaagtgaacttgcaaggattctgaattgcaagggacgagttttcgcgatggatgacgaaccagacgtgcccagaatgtggttgccggaccaggatgcaccaggccttgccatggcaagggcctttggggacttctgcctgaagaaccatggccttatctgtacacctgaagtctactacaggaagttatctgaaaaggacgagttcttggtgcttgcaactgatgggatttgggacgtgctgtcgaacaaggaggtgatgaagattgtgtcttcaggcagcgacccatccaaggcggcgaggcaggtgatcgaccgtgcggtccgagcatggcggcgcaagtacccgacgtccatggtggacgactgcgcggtggtgtgcctgttcttgaaccggcgggcggcctctcatggtgatgatgaggaggaggaggcggtgtcgtcgttccgcaagcaggttgtgggcggcgttgatggttgggaggaagggacgacgacggtgtggagagccctggagggggtggcgcgggccaactcggtgatgaggctgccgcggatggggcgcgtgctcagctggcggaggcggtcgtcgacttcgctcatggccatgggtgaagaccaagaccattgatgatatgatttttctttctttcatggtagcatgcaatgcaatggccgcgagcttttaactggcagaaatgattttaggattggattgacatgatgccgcgtcgcattaattcaaagttgctgagatgaactggagcaggactgctgctgagacgacgatccaggttcgagcacagcatggatcagaaccgtcctgcccattcctttagagccggcggtttgtttgttgtcatgtgccatcagccacgacggccatcgcacgctcctagcttttaactggcagaaatgattttaggattggattgattttaggatggttgccgcgtcgcatgaattaattcaagttgttgagacg

SEQ ID NO: 31860 - protein, 428 aa, Panicum virgatum
  misc_feature: Ceres CLONE 1907745
  misc_feature (30)..(335): Pfam Name: PP2C Pfam Description: Protein phosphatase 2C
  misc_feature: SWISSPROT Homolog: EC 3.1.3.16 Phosphoprotein phosphatase
KAPAGDLDDGEQGFPWMHDDLFHHHLWTSAAVSMHTKQGWKGANQDAMTVSQDFAGHKGHIFCGVFDGHGPLGREVARHVRDTLPLKLSSALKLKTQEEDPSNHTSKLTTEEDHSSNTDLDSCDKSDSTSFSDDTSDEKLLLSTWKNIFVKAFDRVDEELRQHSGIDCICSGTTAVTVVRQGDHLMIANLGDSRAVLCTRDSKDRLIPVQLTTDFKPDLPSELARILNCKGRVFAMDDEPDVPRMWLPDQDAPGLAMARAFGDFCLKNHGLICTPEVYYRKLSEKDEFLVLATDGIWDVLSNKEVMKIVSSGSDPSKAARQVIDRAVRAWRRKYPTSMVDDCAVVCLFLNRRAASHGDDEEEEAVSSFRKQVVGGVDGWEEGTTTVWRALEGVARANSVMRLPRMGRVLSWRRRSSTSLMAMGEDQDH

SEQ ID NO: 31861 - DNA, 610 bp, Panicum virgatum
  misc_feature: Ceres CLONE 1907766
  misc_feature: Encodes the peptide sequence at SEQ ID NO. 31862
gcattcctcagctctgctctgctctctctctctctctctctctctctctctctccgcggcgctggccgctgctcgatcccaccgtgctccgggtgaaggttctggaagctctcgggagatgaggaggggtggacgaggaggaggaggagggacgccgcgcgcatggtgtgggacgagtcgaagcgcctgtggggcatcggcctccccatcgccgtgggcacgctcagcgcgtacgccctcagctccgtcacccagatgttcgccggccacctcggcaacctccccctcgccgccgcctccatcggcctctccgtcttcgccaccttcgcgctcggcttcctcctcggcatgggcagcgcgctcgagacgctctgcggccaggccttcggcgccggccaagtcgccatgctcggcgtctacctccagcgctcctggatcatcctcctcgccgccgcgctgctcatgtcgccgctcttcgtcttcgccgagccgctgctcctgctcatcggccaggacccggacgtcgcgcgcgaggccgccaggttcgtgctctacatcctccccgccgtcttcgccatggccatctacttcgccgccggcaagttcctcc

SEQ ID NO: 31862 - protein, 149 aa, Panicum virgatum
  misc_feature: Ceres CLONE 1907766
  misc_feature (15)..(149): Pfam Name: MatE Pfam Description: MatE
MVWDESKRLWGIGLPIAVGTLSAYALSSVTQMFAGHLGNLPLAAASIGLSVFATFALGFLLGMGSALETLCGQAFGAGQVAMLGVYLQRSWIILLAAALLMSPLFVFAEPLLLLIGQDPDVAREAARFVLYILPAVFAMAIYFAAGKFL

SEQ ID NO: 31863 - DNA, 487 bp, Panicum virgatum
  misc_feature: Ceres CLONE 1907775
  misc_feature: Encodes the peptide sequence at SEQ ID NO. 31864
cagctctgtacaccacaggccacggacactagtgatcgatgcgcccttgtcccacctatagcttcctcgatcactccggccacgccgaggaccaggagcttgaggattgaggcggtgcctgcgcgagcgtctcgcaccaccaggatgcttcttggaggaacgatgggccagggcccggcaccgtgctgcgccaaggagggcctcccctcgggctcctggacgccggaggaggacatgcgactcttctcctacattcataactacagccacaccaactggcgcgccctgcccaggctaacttgtctgctgcgatgcgggaacatctgccggctcctgaggatcaactacctccggcacgacctcacgcgcgttaatcttcacagccgatgaggaggaggcaatcatcaccctccacggtatgctcggcaacgactgtcccctgatcgcggcgtgcgtgccaggccggacacacaacgagatcacgaag

SEQ ID NO: 31864 - protein, 75 aa, Panicum virgatum
  misc_feature: Ceres CLONE 1907775
  misc_feature: The sequence is a functional homolog of SEQ ID NO 822 in the 10/412,699 US patent application
  misc_feature: The sequence is a functional homolog of SEQ ID NO 1680 in the 11/479,226 US patent application
  misc_feature: The sequence is a functional homolog of SEQ ID NO 202 in the 10/666,642 US patent application
  misc_feature: The sequence is a functional homolog of SEQ ID NO 852 in the 10/412,699 US patent application
  misc_feature: The sequence is a functional homolog of SEQ ID NO 156 in the 10/412,699 US patent application
  misc_feature: The sequence is a functional homolog of SEQ ID NO 164 in the 10/412,699 US patent application
  misc_feature: The sequence is a functional homolog of SEQ ID NO 1754 in the 10/412,699 US patent application
  misc_feature: The sequence is a functional homolog of SEQ ID NO 1978 in the 10/374,780 US patent application
  misc_feature: The sequence is a functional homolog of SEQ ID NO 353 in the 11/479,226 US patent application
  misc_feature: The sequence is a functional homolog of SEQ ID NO 369 in the 11/479,226 US patent application
  misc_feature: The sequence is a functional homolog of SEQ ID NO 40 in the 10/374,780 US patent application
  misc_feature: The sequence is a functional homolog of SEQ ID NO 776 in the 10/225,066 US patent application
  misc_feature: Useful for making plants with altered alkaloid content
  misc_feature: Useful for making plants with altered lignin content
  misc_feature: Useful for making plants with modulated nitrogen use efficiency
  misc_feature: The sequence is a functional homolog of SEQ ID NO 569 in the 10/374,780 US patent application
  misc_feature: The sequence is a functional homolog of SEQ ID NO 1052 in the 11/479,226 US patent application
  misc_feature: The sequence is a functional homolog of SEQ ID NO 456 in the 10/412,699 US patent application
  misc_feature: The sequence is a functional homolog of SEQ ID NO 116 in the 10/412,699 US patent application
  misc_feature: The sequence is a functional homolog of SEQ ID NO 280 in the 11/479,226 US patent application
  misc_feature: Useful for making plants with altered cell wall content and/or composition
  misc_feature: The sequence is a functional homolog of SEQ ID NO 1040 in the 10/225,066 US patent application
  misc_feature: The sequence is a functional homolog of SEQ ID NO 2864 in the 10/374,780 US patent application
  misc_feature: The sequence is a functional homolog of SEQ ID NO 296 in the 11/479,226 US patent application
  misc_feature: The sequence is a functional homolog of SEQ ID NO 442 in the 10/412,699 US patent application
  misc_feature: The sequence is a functional homolog of SEQ ID NO 1065 in the 10/374,780 US patent application
  misc_feature: The sequence is a functional homolog of SEQ ID NO 1307 in the 10/412,699 US patent application
  misc_feature: The sequence is a functional homolog of SEQ ID NO 986 in the 11/435,388 US patent application
  misc_feature: The sequence is a functional homolog of SEQ ID NO 1071 in the 10/412,699 US patent application
  misc_feature: The sequence is a functional homolog of SEQ ID NO 587 in the 10/374,780 US patent application
  misc_feature: The sequence is a functional homolog of SEQ ID NO 728 in the 11/435,388 US patent application
  misc_feature: The sequence is a functional homolog of SEQ ID NO 1901 in the 11/479,226 US patent application
  misc_feature: The sequence is a functional homolog of SEQ ID NO 310 in the 10/374,780 US patent application
  misc_feature: The sequence is a functional homolog of SEQ ID NO 842 in the 10/225,066 US patent application
  misc_feature: The sequence is a functional homolog of SEQ ID NO 824 in the 10/412,699 US patent application
  misc_feature: The sequence is a functional homolog of SEQ ID NO 430 in the 10/412,699 US patent application
  misc_feature: The sequence is a functional homolog of SEQ ID NO 995 in the 11/479,226 US patent application
  misc_feature: The sequence is a functional homolog of SEQ ID NO 1002 in the 11/435,388 US patent application
  misc_feature: The sequence is a functional homolog of SEQ ID NO 1072 in the 10/374,780 US patent application
  misc_feature: The sequence is a functional homolog of SEQ ID NO 996 in the 11/435,388 US patent application
  misc_feature: Useful for making plants with altered carbohydrate content
  misc_feature: The sequence is a functional homolog of SEQ ID NO 2221 in the 10/666,642 US patent application
  misc_feature: The sequence is a functional homolog of SEQ ID NO 998 in the 11/435,388 US patent application
  misc_feature: The sequence is a functional homolog of SEQ ID NO 1000 in the 11/435,388 US patent application
  misc_feature: The sequence is a functional homolog of SEQ ID NO 2223 in the 10/666,642 US patent application
  misc_feature: The sequence is a functional homolog of SEQ ID NO 110 in the 10/412,699 US patent application
  misc_feature: The sequence is a functional homolog of SEQ ID NO 259 in the 11/479,226 US patent application
  misc_feature: The sequence is a functional homolog of SEQ ID NO 1684 in the 11/479,226 US patent application
  misc_feature: The sequence is a functional homolog of SEQ ID NO 2582 in the 10/374,780 US patent application
  misc_feature: The sequence is a functional homolog of SEQ ID NO 30 in the 11/375,241 US patent application
  misc_feature: The sequence is a functional homolog of SEQ ID NO 854 in the 10/412,699 US patent application
  misc_feature: The sequence is a functional homolog of SEQ ID NO 1070 in the 10/374,780 US patent application
  misc_feature: The sequence is a functional homolog of SEQ ID NO 992 in the 11/435,388 US patent application
  misc_feature: The sequence is a functional homolog of SEQ ID NO 1010 in the 11/435,388 US patent application
  misc_feature: The sequence is a functional homolog of SEQ ID NO 1069 in the 10/374,780 US patent application
  misc_feature: The sequence is a functional homolog of SEQ ID NO 988 in the 11/435,388 US patent application
  misc_feature: The sequence is a functional homolog of SEQ ID NO 1068 in the 10/374,780 US patent application
  misc_feature: The sequence is a functional homolog of SEQ ID NO 984 in the 11/435,388 US patent application
  misc_feature: The sequence is a functional homolog of SEQ ID NO 1863 in the 10/374,780 US patent application
  misc_feature: The sequence is a functional homolog of SEQ ID NO 743 in the 10/666,642 US patent application
  misc_feature: The sequence is a functional homolog of SEQ ID NO 1064 in the 10/374,780 US patent application
  misc_feature: The sequence is a functional homolog of SEQ ID NO 1306 in the 10/412,699 US patent application
  misc_feature: The sequence is a functional homolog of SEQ ID NO 990 in the 11/435,388 US patent application
  misc_feature: The sequence is a functional homolog of SEQ ID NO 792 in the 11/435,388 US patent application
  misc_feature: The sequence is a functional homolog of SEQ ID NO 788 in the 11/435,388 US patent application
  misc_feature: The sequence is a functional homolog of SEQ ID NO 794 in the 11/435,388 US patent application
  misc_feature: The sequence is a functional homolog of SEQ ID NO 1074 in the 10/412,699 US patent application
  misc_feature: The sequence is a functional homolog of SEQ ID NO 590 in the 10/374,780 US patent application
  misc_feature: The sequence is a functional homolog of SEQ ID NO 726 in the 11/435,388 US patent application
  misc_feature: The sequence is a functional homolog of SEQ ID NO 108 in the 10/412,699 US patent application
  misc_feature: The sequence is a functional homolog of SEQ ID NO 1740 in the 10/412,699 US patent application
  misc_feature: The sequence is a functional homolog of SEQ ID NO 1964 in the 10/374,780 US patent application
  misc_feature: The sequence is a functional homolog of SEQ ID NO 255 in the 11/479,226 US patent application
  misc_feature: The sequence is a functional homolog of SEQ ID NO 908 in the 11/435,388 US patent application
  misc_feature: The sequence is a functional homolog of SEQ ID NO 1067 in the 10/374,780 US patent application
  misc_feature: The sequence is a functional homolog of SEQ ID NO 1309 in the 10/412,699 US patent application
  misc_feature: The sequence is a functional homolog of SEQ ID NO 2564 in the 10/374,780 US patent application
  misc_feature: The sequence is a functional homolog of SEQ ID NO 276 in the 10/225,066 US patent application
  misc_feature: The sequence is a functional homolog of SEQ ID NO 818 in the 10/412,699 US patent application
  misc_feature: The sequence is a functional homolog of SEQ ID NO 836 in the 10/412,699 US patent application
  misc_feature: The sequence is a functional homolog of SEQ ID NO 1073 in the 10/374,780 US patent application
  misc_feature: The sequence is a functional homolog of SEQ ID NO 263 in the 11/479,226 US patent application
  misc_feature: The sequence is a functional homolog of SEQ ID NO 478 in the 11/435,388 US patent application
  misc_feature: The sequence is a functional homolog of SEQ ID NO 54 in the 10/666,642 US patent application
  misc_feature: The sequence is a functional homolog of SEQ ID NO 148 in the 10/412,699 US patent application
  misc_feature: The sequence is a functional homolog of SEQ ID NO 2266 in the 10/374,780 US patent application
  misc_feature: The sequence is a functional homolog of SEQ ID NO 341 in the 11/479,226 US patent application
  misc_feature: The sequence is a functional homolog of SEQ ID NO 58 in the 11/375,241 US patent application
  misc_feature: The sequence is a functional homolog of SEQ ID NO 1071 in the 10/374,780 US patent application
  misc_feature: The sequence is a functional homolog of SEQ ID NO 994 in the 11/435,388 US patent application
  misc_feature: The sequence is a functional homolog of SEQ ID NO 796 in the 11/435,388 US patent application
  misc_feature: The sequence is a functional homolog of SEQ ID NO 1072 in the 10/412,699 US patent application
  misc_feature: The sequence is a functional homolog of SEQ ID NO 1073 in the 10/412,699 US patent application
  misc_feature: The sequence is a functional homolog of SEQ ID NO 588 in the 10/374,780 US patent application
  misc_feature: The sequence is a functional homolog of SEQ ID NO 589 in the 10/374,780 US patent application
  misc_feature: The sequence is a functional homolog of SEQ ID NO 730 in the 11/435,388 US patent application
  misc_feature: The sequence is a functional homolog of SEQ ID NO 593 in the 10/374,780 US patent application
  misc_feature: The sequence is a functional homolog of SEQ ID NO 782 in the 11/435,388 US patent application
  misc_feature: The sequence is a functional homolog of SEQ ID NO 1004 in the 11/435,388 US patent application
  misc_feature: The sequence is a functional homolog of SEQ ID NO 1006 in the 11/435,388 US patent application
  misc_feature: The sequence is a functional homolog of SEQ ID NO 1008 in the 11/435,388 US patent application
  misc_feature: The sequence is a functional homolog of SEQ ID NO 58 in the 10/666,642 US patent application
  misc_feature: The sequence is a functional homolog of SEQ ID NO 2572 in the 10/374,780 US patent application
  misc_feature: The sequence is a functional homolog of SEQ ID NO 636 in the 10/225,066 US patent application
  misc_feature: The sequence is a functional homolog of SEQ ID NO 838 in the 10/412,699 US patent application
  misc_feature: The sequence is a functional homolog of SEQ ID NO 594 in the 10/374,780 US patent application
  misc_feature: The sequence is a functional homolog of SEQ ID NO 784 in the 11/435,388 US patent application
  misc_feature: The sequence is a functional homolog of SEQ ID NO 112 in the 10/412,699 US patent application
  misc_feature: The sequence is a functional homolog of SEQ ID NO 267 in the 11/479,226 US patent application
  misc_feature: The sequence is a functional homolog of SEQ ID NO 1041 in the 11/479,226 US patent application
  misc_feature: The sequence is a functional homolog of SEQ ID NO 112 in the 10/225,066 US patent application
  misc_feature: The sequence is a functional homolog of SEQ ID NO 20 in the 11/375,241 US patent application
  misc_feature: The sequence is a functional homolog of SEQ ID NO 2052 in the 10/374,780 US patent application
  misc_feature: The sequence is a functional homolog of SEQ ID NO 450 in the 10/412,699 US patent application
  misc_feature: The sequence is a functional homolog of SEQ ID NO 1094 in the 10/225,066 US patent application
  misc_feature: The sequence is a functional homolog of SEQ ID NO 386 in the 10/374,780 US patent application
  misc_feature: The sequence is a functional homolog of SEQ ID NO 188 in the 10/412,699 US patent application
  misc_feature: The sequence is a functional homolog of SEQ ID NO 2274 in the 10/374,780 US patent application
  misc_feature: The sequence is a functional homolog of SEQ ID NO 704 in the 10/225,066 US patent application
  misc_feature: Useful for making plants with modulated low light sensitivity
  misc_feature: The sequence is a functional homolog of SEQ ID NO 136 in the 10/412,699 US patent application
  misc_feature: The sequence is a functional homolog of SEQ ID NO 325 in the 11/479,226 US patent application
  misc_feature: The sequence is a functional homolog of SEQ ID NO 184 in the 10/412,699 US patent application
  misc_feature: The sequence is a functional homolog of SEQ ID NO 397 in the 11/479,226 US patent application
  misc_feature: The sequence is a functional homolog of SEQ ID NO 46 in the 10/374,780 US patent application
  misc_feature: The sequence is a functional homolog of SEQ ID NO 590 in the 11/435,388 US patent application
  misc_feature: The sequence is a functional homolog of SEQ ID NO 6 in the 10/225,068 US patent application
  misc_feature: The sequence is a functional homolog of SEQ ID NO 1660 in the 11/479,226 US patent application
  misc_feature: The sequence is a functional homolog of SEQ ID NO 840 in the 10/412,699 US patent application
  misc_feature: Useful for biocontainment applications
  misc_feature: The sequence is a functional homolog of SEQ ID NO 1066 in the 10/374,780 US patent application
  misc_feature: The sequence is a functional homolog of SEQ ID NO 1308 in the 10/412,699 US patent application
  misc_feature: The sequence is a functional homolog of SEQ ID NO 790 in the 11/435,388 US patent application
  misc_feature: The sequence is a functional homolog of SEQ ID NO 1031 in the 11/479,226 US patent application
  misc_feature: The sequence is a functional homolog of SEQ ID NO 1804 in the 10/412,699 US patent application
  misc_feature: The sequence is a functional homolog of SEQ ID NO 2050 in the 10/374,780 US patent application
  misc_feature: The sequence is a functional homolog of SEQ ID NO 444 in the 10/412,699 US patent application
  misc_feature: The sequence is a functional homolog of SEQ ID NO 598 in the 10/225,066 US patent application
  misc_feature: The sequence is a functional homolog of SEQ ID NO 620 in the 11/435,388 US patent application
  misc_feature: The sequence is a functional homolog of SEQ ID NO 1100 in the 10/225,066 US patent application
  misc_feature: The sequence is a functional homolog of SEQ ID NO 158 in the 10/412,699 US patent application
  misc_feature: The sequence is a functional homolog of SEQ ID NO 2268 in the 10/374,780 US patent application
  misc_feature: The sequence is a functional homolog of SEQ ID NO 357 in the 11/479,226 US patent application
  misc_feature: The sequence is a functional homolog of SEQ ID NO 480 in the 11/435,388 US patent application
  misc_feature: Useful for making plants with altered terpenoid content
  misc_feature: Useful for making plants with modulated biomass
  misc_feature: The sequence is a functional homolog of SEQ ID NO 2394 in the 10/374,780 US patent application
  misc_feature: The sequence is a functional homolog of SEQ ID NO 544 in the 10/225,066 US patent application
  misc_feature: The sequence is a functional homolog of SEQ ID NO 999 in the 11/479,226 US patent application
MGQGPAPCCAKEGLPSGSWTPEEDMRLFSYIHNYSHTNWRALPRLTCLLRCGNICRLLRINYLRHDLTRVNLHSR

SEQ ID NO: 31865 - DNA, 1213 bp, Panicum virgatum
  misc_feature: Ceres CLONE 1907777
  misc_feature: Encodes the peptide sequence at SEQ ID NO. 31866
aaggcgcctctcgttccctcctccacctcctcctcacccacctcatcgccttcctccaccgtgccggccagcccggacgtacacgacgcgacacctccgcacgcacgaccggtcgtcgcagcgccgcgccgcgggtttgatcgatcgcgagctgtgaccttcgttttcggtcttccccgatgaccacctcgtcgtccgggagcatcgaggcgccggcgaactcgaggcccggatcgttctcgttcgcgagcacgagcttcacggacatgctggggggctccgcggccgcggccggcggggcgtcgaggtacaaggcgatgaccccgccgtccctgccgctgtcgccgccgccggtgtcgccctcgtccttcttcaacatccccggcggcctgaaccccgccgacttcctcgactcgccggccctcctcacctccagtttcttcccgtcgccgacgacgaacgcattcgcctcgcagcagttcagctggctggcgccgcagggcgcggagcaaggcggcggcaaggacgagcagaggcagtcgtacccggacttctcgttccagacggcgccgacgaccgaagaggccgtgcggacgacgacgaccttccagcagccaccggttccaccggccccactgggtgaagaggcatacagaagtcagcagcagcagcagcaaccctggagctaccagcagcagcaaccaggcatggacgcgggctccagccaggcggcctacggcgggccgttccaggcagcaggctcgtcggacgccgccgcgatggcgccagcgagctgcgggtacaaccaggcgcagtcgcagaggcggtcgtcggacgacgggtacaactggcgcaagtacgggcagaagcaggtgaaggggagcgagaacccgcgcagctactacaagtgcaccttccagggctgccccaccaagaagaaggtggagcggtcgctggacggccagatcaccgagatcgtgtacaagggcacgcacaaccacgccaagccgcagaacacgcgcaggaactccagcgcggcggcggcgcagctgctgcagggtgccggcgaggcggcgtcggagcactcgttcggcggcacgcctgtcgcgacgcccgagaactcctcggcgtccttcggggacgacgaggccggcggcgcgggctcgccgcgggccgggatcgccggcggcgacgagttcgacgaggacgagtc

SEQ ID NO: 31866 - protein, 344 aa, Panicum virgatum
  misc_feature: Ceres CLONE 1907777
  misc_feature (218)..(276): Pfam Name: WRKY Pfam Description: WRKY DNA -binding domain
MTTSSSGSIEAPANSRPGSFSFASTSFTDMLGGSAAAAGGASRYKAMTPPSLPLSPPPVSPSSFFNIPGGLNPADFLDSPALLTSSFFPSPTTNAFASQQFSWLAPQGAEQGGGKDEQRQSYPDFSFQTAPTTEEAVRTTTTFQQPPVPPAPLGEEAYRSQQQQQQPWSYQQQQPGMDAGSSQAAYGGPFQAAGSSDAAAMAPASCGYNQAQSQRRSSDDGYNWRKYGQKQVKGSENPRSYYKCTFQGCPTKKKVERSLDGQITEIVYKGTHNHAKPQNTRRNSSAAAAQLLQGAGEAASEHSFGGTPVATPENSSASFGDDEAGGAGSPRAGIAGGDEFDEDE

SEQ ID NO: 31867 - DNA, 804 bp, Panicum virgatum
  misc_feature: Ceres CLONE 1907777-R
  misc_feature: Encodes the peptide sequence at SEQ ID NO. 31868
agaccatgagcgacatcgacatcctcgatgacggctaccgctggaggaagtacgggcagaaggtggtgaagggaaaccccaacccaaggagctactacaagtgcacgacggccgggtgcccggtgcggaagcacgtggagcgcgcgtcgcacgacctgcgcgccgtgatcaccacgtacgagggcaagcacaaccacgacgtgcccgccgcacggggcagcgccgcgctgtaccggcccgcgccgccgccggcggacacctacctcgccgcggcccccggcgtgaggccgccggcgcccatggcggcctaccagacggggcagcagtacgggttcggcgggccgagctcgttcggcggcgcggcggcgcagcagagcggcggcggcggcggctttgggttcccctccggcttcgacaacccgatggggtcgtacatgagccagcacgagcagcagcagcggcagaacgacgcgatgcacgcgtcgagggccaaggaggagcccagggaggacatggcgttcttcccgcagtcgatgatgtacaactgacgacaggaggagctgaggacacgacacgacgtcgcgggaaatggcaagacatgacgcgatgtccgtaatatggttgctgtatctaggctaggatagatagggtttgaacagatttatttctttatttgtttggaggcctccatgtcgcttgccgaaaatggggtcctcccttaacacgtggagggggggtgactactaggatcataggactcaggacaagctagaaaaagggtatcaacagttttgttcttcgatt

SEQ ID NO: 31868 - protein, 181 aa, Panicum virgatum
  misc_feature: Ceres CLONE 1907777-R
  misc_feature (8)..(67): Pfam Name: WRKY Pfam Description: WRKY DNA -binding domain
  misc_feature: The sequence is a functional homolog of SEQ ID NO 1326 in the 11/479,226 US patent application
  misc_feature: The sequence is a functional homolog of SEQ ID NO 618 in the 10/412,699 US patent application
  misc_feature: The sequence is a functional homolog of SEQ ID NO 1389 in the 10/412,699 US patent application
  misc_feature: The sequence is a functional homolog of SEQ ID NO 513 in the 10/374,780 US patent application
  misc_feature: The sequence is a functional homolog of SEQ ID NO 1390 in the 10/412,699 US patent application
  misc_feature: The sequence is a functional homolog of SEQ ID NO 514 in the 10/374,780 US patent application
TMSDIDILDDGYRWRKYGQKVVKGNPNPRSYYKCTTAGCPVRKHVERASHDLRAVITTYEGKHNHDVPAARGSAALYRPAPPPADTYLAAAPGVRPPAPMAAYQTGQQYGFGGPSSFGGAAAQQSGGGGGFGFPSGFDNPMGSYMSQHEQQQRQNDAMHASRAKEEPREDMAFFPQSMMYN

SEQ ID NO: 31869 - DNA, 1596 bp, Panicum virgatum
  misc_feature: Ceres CLONE 1907782
  misc_feature: Encodes the peptide sequence at SEQ ID NO. 31870
atacggcctctccagaacaacttgtgcatgcttctgcagatctcatcagtcctagcttcattcaccatcttccagccatggtctctgccggccaagcactcaccgataaccaggaagcctcagaaaggaagcacttcgtgctggttccactgatggcacagggccacactatccccatgactgacatggcacgcctgctagctgagcatggtgcccaggttagcttcatcaccacaccggtgaacgccaccaggatggcagggttcatcaaccacgcacaggcaacgggcctcacaatccagttcgtcaaactcaacttccccgcagttgagtttggcctgcctaacggttgcgagaatgccgacatgatccagtcaagagatctgtacaagaatttcatggaggcctgcgcagcacttcgggagccacttacagcatacctccgtcagcaacacccatctccaagctgcatcatatccgatatgtcacactggtggactgctgacattgcaagggagtttggtatcccaaggctcacgtttaatggcttctgcaccttcgcgtcccttgtcaggtacatcattgcccgcgacaacttattggaacacgttgaagatgagaacgagctcattaacttcccaggattccctacgccacttcagttgacaaaggaaaaatgccctggaagcctatctgtttatggtcttgagcaaatccgtaaaaatatttatgaggaggagatgagatccagtggtgttgtcataaacagcttccaagagctggagactttgtacatcgagtcctttgagcacattacagggaagaaggtctggacggtggggccaatgtgtttgtgcaaccaggacataaatgcaatggctgcaaggggtaacaaggcctcaatggatgaggcacagtgcttgcgatggcttgattcgatgaagccaggttcagtgacctttgttagcttcggcagccttgcctgtaccgcaccccggcagcttgtttagctaggactaggactggaagcttccaagaagccatttgtctgggtgattaaagcaggagataagtttccacaagttgaggaatggcttgcagagggtttcgaagaacgagtgaaggacagaggcttgatcataaggggctgggcgccacaggtattgatcctgtggcacaaggccatcggaggtttcatgacacactgtgggtggaactcaacaatagagggcatctgcgcaggcatacccatgatcacatggccacactttgcagaacagtttgtgaatgagaggttggtggtggatgtgctgaaaactggggtggagattggagtgaaagcagtgacacaatgggggcaagaacaaacggaggttacagtgacaagggatgctgtggagaaagcagtttccaagttgatggatggtggggaggctgcagaggagatgaggacgagagcgaaggaatttggtgttaaagcaaggaaggctttggaagagggtggatcttcgtataacaatataaatatattgattcaagaaatgggaaaccaggcaaatgcatctggctgatatagaaaggataaagtatttttcc

SEQ ID NO: 31870 - protein, 310 aa, Panicum virgatum
  misc_feature: Ceres CLONE 1907782
  misc_feature: SWISSPROT Homolog: EC 2.4.1.238 Anthocyanin 3'-O-beta-glucosyltransferase
MVSAGQALTDNQEASERKHFVLVPLMAQGHTIPMTDMARLLAEHGAQVSFITTPVNATRMAGFINHAQATGLTIQFVKLNFPAVEFGLPNGCENADMIQSRDLYKNFMEACAALREPLTAYLRQQHPSPSCIISDMSHWWTADIAREFGIPRLTFNGFCTFASLVRYIIARDNLLEHVEDENELINFPGFPTPLQLTKEKCPGSLSVYGLEQIRKNIYEEEMRSSGVVINSFQELETLYIESFEHITGKKVWTVGPMCLCNQDINAMAARGNKASMDEAQCLRWLDSMKPGSVTFVSFGSLACTAPRQLV

SEQ ID NO: 31871 - DNA, 692 bp, Panicum virgatum
  misc_feature: Ceres CLONE 1907818
  misc_feature: Encodes the peptide sequence at SEQ ID NO. 31872
gagtcgcggggaaggaggagcagcaagcaagcaacaagggagagtcggtcaactcaagaggatggtcaagagcaagaagatgggaaacacacagcagcagctgttcgtactcttcgtagtcttcctcctatctccggtcgccccgcaggaacttatgggcgtgcaggtagtcagagcagtgaaaccaatcccaaattccattctcggggttgaggagggagacaattccagaggaatcatccagaaggacatcatagagacggtcaacaaccatcccaatgctgggtggacggctgcacacaatccttactttgcaaactatactattgcacaatttaaacgtatccttggagtgaagcctacaccacagaatgtgctgactgatgttcctaccaaaacttattcaagatcactgaaacttccaaaggagttcgatgccagatctaagtggtctcattgcagcacaattgggaacatacttgatcaaggtcattgtggctcctgttgggcttttggtgccgtggagtgcctccaggatcgtttttgcattcatatgaacatgaacatttcactatcagtcaatgacctactggcatgctgtggttttatgtgcggtgatggttgtgatggaggctatcctatcatggcatggcgctactttgttcaaaatggtgttgtcacagaggagtgcc

SEQ ID NO: 31872 - protein, 210 aa, Panicum virgatum
  misc_feature: Ceres CLONE 1907818
  misc_feature (60)..(103): Pfam Name: Propeptide_C1 Pfam Description: Peptidase family C1 propeptide
  misc_feature (120)..(210): Pfam Name: Peptidase_C1 Pfam Description: Papain family cysteine protease
  misc_feature: SWISSPROT Homolog: EC 3.4.22.1 Cathepsin B
MVKSKKMGNTQQQLFVLFVVFLLSPVAPQELMGVQVVRAVKPIPNSILGVEEGDNSRGIIQKDIIETVNNHPNAGWTAAHNPYFANYTIAQFKRILGVKPTPQNVLTDVPTKTYSRSLKLPKEFDARSKWSHCSTIGNILDQGHCGSCWAFGAVECLQDRFCIHMNMNISLSVNDLLACCGFMCGDGCDGGYPIMAWRYFVQNGVVTEEC

SEQ ID NO: 31873 - DNA, 728 bp, Panicum virgatum
  misc_feature: Ceres CLONE 1907835
  misc_feature: Encodes the peptide sequence at SEQ ID NO. 31874
  misc_feature (648)..(648): n is a, c, t, g, unknown, or other
agccattcccctcctctcccgcgccgccgccgccgccgtttttgccctcctcgcggtcccgccgtccgtcgaggtaaggtcagcatggtgagggtcagtgtgctcaacgatgcactgaagtccatgtacaatgctgagaagagggggaaaagacaggtcatgatcaggccgtcatccaaggttatcatcaagttcttgttggtcatgcagcgtcatggctacattggtgagttcgaatatgtggatgaccatcgtgctggaaagattgtggtggaactgaatggaagactaaacaaatgtggtgtgatcagccctcgctttgatgttggtgtaaaggagattgaaggttggactgccaggctgctcccatctcgtcagtttggctacatagtgttgacaacttctgctggcattatggaccatgaggaggcccggcggaagaatgttggtggcaaggtgctaggtttcttctactgaagcgagtacgatgaaagtattaggatattcccaagaactcatctgagcttgtgttttttggtctgaatagagtgccttgttaagattctggaatgtgttatgtacttcagaaattgggaaccttgttatgagctgtgcctgtcgttaattatcacgacatatttgcctaanaaaaaaaaaagccatctgcaagtcaagtctcactagtcactcctaatcctaaccacaagacaccttgggtgttagaagtg

SEQ ID NO: 31874 - protein, 130 aa, Panicum virgatum
  misc_feature: Ceres CLONE 1907835
  misc_feature (5)..(130): Pfam Name: Ribosomal_S8 Pfam Description: Ribosomal protein S8
MVRVSVLNDALKSMYNAEKRGKRQVMIRPSSKVIIKFLLVMQRHGYIGEFEYVDDHRAGKIVVELNGRLNKCGVISPRFDVGVKEIEGWTARLLPSRQFGYIVLTTSAGIMDHEEARRKNVGGKVLGFFY

SEQ ID NO: 31875 - DNA, 706 bp, Panicum virgatum
  misc_feature: Ceres CLONE 1907844
  misc_feature: Encodes the peptide sequence at SEQ ID NO. 31876
aactactgccccccaaatagtctcactttccatgcttaattctgctgtcccccagttgagccaccttgcaatttaccggaagaacccctcttcaactaaccagttctccagtggattagcgtttactaaccagcaaaaggagttgacctcacaatctgctgtttggtctcgaccctctgcggcctgtccagcatgcacccaggaggaggtgaacaaggttatggaggcggccaaggtcgcgcagaaggcgtgggcccggacgccgctatggaagcgtgccgagctcctccacaaggccgccgcgatcctgaaggagcacaaggcgccgatcgccgagtgccttgtcaaggagatcgccaagccggccaaggatgctatttctgaggttgtgcggtctggggatttggtgtcgtacacagctgaggagggtgttcgcatactgggggagggcaagctgctggtttctgatagcttccccggtaatgagcggaacaagtactgtctgagctccaagataccccttggagtagttttggcaatcccgccatttaactatcctgtcaacctagcagtttctaagattggcccagcactaatagctggcaattctcttgtgctcaagcctccaactcagggtgcagtggctgcgcttcatatggtacactgcttccacctggctggtttcccgaaaggcttgattagttgt

SEQ ID NO: 31876 - protein, 224 aa, Panicum virgatum
  misc_feature: Ceres CLONE 1907844
  misc_feature (31)..(224): Pfam Name: Aldedh Pfam Description: Aldehyde dehydrogenase family
  misc_feature: SWISSPROT Homolog: EC 1.2.1.9 Glyceraldehyde-3-phosphate dehydrogenase (NADP(+))
MLNSAVPQLSHLAIYRKNPSSTNQFSSGLAFTNQQKELTSQSAVWSRPSAACPACTQEEVNKVMEAAKVAQKAWARTPLWKRAELLHKAAAILKEHKAPIAECLVKEIAKPAKDAISEVVRSGDLVSYTAEEGVRILGEGKLLVSDSFPGNERNKYCLSSKIPLGVVLAIPPFNYPVNLAVSKIGPALIAGNSLVLKPPTQGAVAALHMVHCFHLAGFPKGLIS

SEQ ID NO: 31877 - DNA, 1223 bp, Panicum virgatum
  misc_feature: Ceres CLONE 1907855
  misc_feature: Encodes the peptide sequence at SEQ ID NO. 31878
acggtggttcgcttcggtctccagagatttcgcttggagaagaaacccaagaggaatccgcagatgaagatcattcctgtaccttgtctggaggacaactatgcctacctaatcgtggacgagagcaccaagaaggcggcggccgttgacccggtggagccggagaaggttctcaaggcggccagcgaggtcggcgcctacgtcgactgcgtcctcaccacccaccaccactgggatcatgctggtggcaatgagaagatgaggctgcaggtgccagggataaaggtctttggtggatccctggacaatgtgaaaggctgcactgatcaggtggagaatggaacaaagttgtcacttggaaagggcattgagatactatgcctacacaccccttggtatgctattaactatgatgttctcttgtcttgtaagtttcacttccctgtttatgatataacagaaacagtcgcctcctgagtaaggccgatttatttacaaaaaagttataactgccaaataagagccttgtgaaattgtgaatttagtataacattcagtgccaggtccactttaagaaaaatgatgcctttctattttggaggctcttttatatctaaagaacctgcatgcagctgagtggcacaaacatgtcatgcatgttacttaaaagacttagttgagctcattgataaatcctcacttgaattatctgtaaacgttttatctgtgtttgcttagtagaagcttgttgacaatttgattttctgttccctgtcattttctttcttctacagtcacacaaaaggtcatattagctactttgttactagtaaagagggggaagatccagcggtcttcactggagacactttggttagtatattcatctggcttacgctgatggctcctttcatctttgtatcctgaccttcttgttataaatcttgttataaaaacatacagttcattgctggttgtggaaggttttttgagggtactgcagagcaaatgtaccagtcccttattgttacactgggctcgctgccaaagtcaactcaagtttactgtgggcatgaggtatgatctcttgttttcagttcggagtcttccagtcatcccataatgctaggcttccattctggaggaacctgaatgtcattgaatctgtatcgtatataaataaccatgttcagtattttgttatcggtgcttaaagggcatgt

SEQ ID NO: 31878 - protein, 137 aa, Panicum virgatum
  misc_feature: Ceres CLONE 1907855
  misc_feature (11)..(137): Pfam Name: Lactamase_B Pfam Description: Metallo-beta-lactamase superfamily
  misc_feature: SWISSPROT Homolog: EC 3.1.2.6 Hydroxyacylglutathione hydrolase
  misc_feature: Useful for making plants with modulated biomass
MKIIPVPCLEDNYAYLIVDESTKKAAAVDPVEPEKVLKAASEVGAYVDCVLTTHHHWDHAGGNEKMRLQVPGIKVFGGSLDNVKGCTDQVENGTKLSLGKGIEILCLHTPWYAINYDVLLSCKFHFPVYDITETVAS

SEQ ID NO: 31879 - DNA, 397 bp, Panicum virgatum
  misc_feature: Ceres CLONE 1907855-R
  misc_feature: Encodes the peptide sequence at SEQ ID NO. 31880
aaagcagcgtgaagcgaatcagcctacagttccctcaactataggagatgagtttgagatcaataccttcatgcgcgttgatcttccagaaatacaggcaaagttcagtgccaagtctccagttgaagcgctgagagaggtcaggaagatcaaagataactggaaaggttgatacccatgtcggctgtcactctgttggacggccagcaactcaaagtgagctaattcagaaaccttgcctgtaggtgggaatgaggtttactgccgcgcaatgctttgataggtatggcgtcgggaaggagaagactcttataataagcaccgtgttgataaaaacaataatcatgtaacttctgaactgtttgtttgcgaacagtaatgcatgaactattttatg

SEQ ID NO: 31880 - protein, 56 aa, Panicum virgatum
  misc_feature: Ceres CLONE 1907855-R
  misc_feature: SWISSPROT Homolog: EC 3.1.2.6 Hydroxyacylglutathione hydrolase
  misc_feature: Useful for making plants with modulated biomass
KQREANQPTVPSTIGDEFEINTFMRVDLPEIQAKFSAKSPVEALREVRKIKDNWKG

SEQ ID NO: 31881 - DNA, 686 bp, Panicum virgatum
  misc_feature: Ceres CLONE 1907866
  misc_feature: Encodes the peptide sequence at SEQ ID NO. 31882
ctactagtatcagagagagaagagagaagagagagatctttttctattagagagagaggcattgccgtgacccctctttcgccggcgaccgatgggctcggaggcggagatcacgggcccgctcctcgcggccggcggcggcggcggcggcgcggaggcggaggcggtgccgccgtggcgggagcaggtaacggtgcgggggctggcggtcagcgcggtcctgggggtgctcttctgcctcatcacgcacaagctcaacctcaccgtcgggatcatcccctcgctcaacgtcgccgcggggctgctcggctacttcctcgtccgcacgtggacggcggcgctcgagaggctcggcgtcgtctccaagcccttcaccaagcaggagaacaccgtcatccagacgtgcgtcgtcgcctgctacgggctcgccttcagcggggggtttggaagttatatacttgcgatggatcagaaaacctacgagcttatcgggacagattatcctggtaacagggctgtggatgtcaagaatccttcacttggttggatgattgggtttatgttcgtcgttagcttcctcggcctatttagtcttgttgcgctacgcaaggtcatggtaatcgattacaagctgacctaccctagcgggacagccacggccatgttgataaatagcttccacacgc

SEQ ID NO: 31882 - protein, 198 aa, Panicum virgatum
  misc_feature: Ceres CLONE 1907866
  misc_feature: The sequence is a functional homolog of SEQ ID NO 214 in the 10/412,699 US patent application
MGSEAEITGPLLAAGGGGGGAEAEAVPPWREQVTVRGLAVSAVLGVLFCLITHKLNLTVGIIPSLNVAAGLLGYFLVRTWTAALERLGVVSKPFTKQENTVIQTCVVACYGLAFSGGFGSYILAMDQKTYELIGTDYPGNRAVDVKNPSLGWMIGFMFVVSFLGLFSLVALRKVMVIDYKLTYPSGTATAMLINSFHT

SEQ ID NO: 31883 - DNA, 1977 bp, Panicum virgatum
  misc_feature: Ceres CLONE 1907873
  misc_feature: Encodes the peptide sequence at SEQ ID NO. 31884
atcaaaccaacagcgccatggccgcctcgagctttggtgcccgtcttgtcgccctcttcttgttcagcgcctgctgccaacaccatggcctcctcgcccccagcacacctgcgccctccgacgccactctcggccggccactccctgcatctcatgtccatcacgacggcgttgtcaatgtcaactcaacgtccactaccgcaaaagaagacgccgccccatccgtgagcttcttcgaccgatcaccgcccccgtcatggagcaaggccaagttcagttggccggacactggaagcagcttcagtccgagcaagcttcctaagaacaaaagcggcggcgtcagcgacctctttgtcatggacctttccagcaacaatcccacaagccacgcggacagacagggcagagcttccgtggattctaacgggaacgccacggagccgacgcgtcagcgccagcaggagccacctctcgctcctagaaggaacagcaagagcggcagcgcctcgcctaaagcaaggaaaccactgtgtttttaccgtcggaaggcgagtttgctgcatgatcggattgagtgtagtggtgcagtaatcgtcgtggtcgccggcgccgcgctgctcgtcttgctctgctccgtcgcagttgccggactgctcgtgcggtgcgtgcacaggaagcgacgaggggagagtgagatctccggcgcagctgcggatccagaggatgacgacgacagggatctggacaggccagcagcccgacgacctggcttactccggccaccagctgggcctcgacggtacagctacggcacgctcgccgcggcgacgagcaatttcgcggagcgtaagaggatcgggcgaggcgggttcggttcggtgtaccgcgggcacctcggcgaccaggaccgccatgtcgcggtcaagacgttctcagcggccggatcgccggagcaagggaggagggagttcgaggccgaggtcctggtcatgagccagctccaccatcgcaacgtagtccagctcgttggctggtccgatggccacaaagggctcttgcttgtctacgagctcgtgccaggtggcaaccttcataagcagcttcatgatcctgacaggcttctaacatggcccgagaggtacaagatcgcgcttgacctgggcgccgccgtactctacctccacacggggtccgaccagtgcgtggtgcacggtgacatcaagccgagcaacgtgctgctcgactcgtccggctacgccaagctcggcgacttcggcctagcgaggctcgtcgatcacggagccgagccgcgcacaacacaggtcgtcgcggggaccttgggatatatagacccagagttcatcggcgaccagaggcgcggcgccgagtcggacgtctacagcttcggcgtcgtgctccttgagatcgccagcggccgccagccgacctcttcaggggcagggcagccaaggaaagaactgctgaaccaagtccgccgcatgtatgacggcaacgctatcgtcgacgcggcggacggaaggctgggtggcgcgttcgtcgagcggcagatggagcgggtgctcgtcactggcctctggtgcgcggaccgtgaccggagccagcggccgtccatttcggaagccatggacgttttgcggggcgcgaaatcggagctgccggtcctaccagcggttggtccgcactgtggatgtggggagatctgtgtcctggaggaacatgcccacggcgacttgtcgacggaggacggggacgatgggtcgacgatttcatctgcttccaccacatacctttctctttctcttgatcgaggactcgaaatatctacacgcacatgaatgttttggttaactaagtagacaagaaacatgtatatgtatgtctctcttgcatgccttttattaggtaaaaccgttcacaatgaaaatcatggaaaaaggatgaaaacactactccctc

SEQ ID NO: 31884 - protein, 499 aa, Panicum virgatum
  misc_feature: Ceres CLONE 1907873
  misc_feature (161)..(433): Pfam Name: Pkinase Pfam Description: Protein kinase domain
  misc_feature: SWISSPROT Homolog: EC 2.7.11.1 Non-specific serine/threonine protein kinase
MDLSSNNPTSHADRQGRASVDSNGNATEPTRQRQQEPPLAPRRNSKSGSASPKARKPLCFYRRKASLLHDRIECSGAVIVVVAGAALLVLLCSVAVAGLLVRCVHRKRRGESEISGAAADPEDDDDRDLDRPAARRPGLLRPPAGPRRYSYGTLAAATSNFAERKRIGRGGFGSVYRGHLGDQDRHVAVKTFSAAGSPEQGRREFEAEVLVMSQLHHRNVVQLVGWSDGHKGLLLVYELVPGGNLHKQLHDPDRLLTWPERYKIALDLGAAVLYLHTGSDQCVVHGDIKPSNVLLDSSGYAKLGDFGLARLVDHGAEPRTTQVVAGTLGYIDPEFIGDQRRGAESDVYSFGVVLLEIASGRQPTSSGAGQPRKELLNQVRRMYDGNAIVDAADGRLGGAFVERQMERVLVTGLWCADRDRSQRPSISEAMDVLRGAKSELPVLPAVGPHCGCGEICVLEEHAHGDLSTEDGDDGSTISSASTTYLSLSLDRGLEISTRT

SEQ ID NO: 31885 - DNA, 1315 bp, Panicum virgatum
  misc_feature: Ceres CLONE 1907877
  misc_feature: Encodes the peptide sequence at SEQ ID NO. 31886
cgtcctctgctctcttgagcagtggctcgcctcccgctgctatccatccatccacccgttccattccattccctccctctcccgctccgccccctcttcgtcctctcgctgcggccggcctcgttcccccgagggttggcgcggagcggagagccgcccgggcgccgagttctactctggcatctacatttttgaactgaaagagaggattatgaaaatggcacatttggtcactcactgtagtttcagtgcatctcctgctgttaagacgttctccagatctcctggttattgctgcaatgttggccaattacagaactcgaaatcttcaaatctgtccctcaaatcttctctcaagagacaaaagaagtcatatgttacttgtgctagtgctgctgtacaaggacagacacaaacacctctaactggtagtcaggaagcttctgggcattcatcctccaagcctaaaaaagtaatggttattggtggagatggatactgtgggtgggcgacagctcttcatctctccaacaaaggttatgaggttgctatagttgataaccttgttcgacgtctttttgatcaccagcttggtcttgagtcccttacccccataacttccatccaaaatcgtgtccgtagatggaagtctctcactggcaagacaatccagctctttattggtgacatatgtgattttgacttcctctcagaagccttcaagtcttttgagccagatgttgctgtccactttggtgagcaaagatctgcaccatactctatgattgatcgttcaagggcagtctacacgcagcataacaatgttattggaacacttaatgtcttatttgccattaaggagtacagtgaagagtgccatctggttaagctcggaactatgggtgagtatggaacaccaaacattgacattgaagaggggtttatcagtataactcacaatggaagaactgacaccttgccttacccgaagcaagcaagttccttctaccatctaagcaaagtgcatgactcccacaacatagcatttacttgcaaggcttggggtataagggccacagatcttaaccaaggtgtagtctatggagtcagaacagatgaaactgcattgcatgaagagctatccaacaggtttgactatgatggtgtctttgggacagcactaaataggttctgtgtccaggctgctgtagggcatccacttacagtttacggaaaaggtggtcagacccgtggatatctggacatcagggacactgtacagtgcgttgagctagcaatagccaacccagccaaa

SEQ ID NO: 31886 - protein, 367 aa, Panicum virgatum
  misc_feature: Ceres CLONE 1907877
  misc_feature (88)..(367): Pfam Name: Epimerase Pfam Description: NAD dependent epimerase/dehydratase family
  misc_feature: SWISSPROT Homolog: EC 3.13.1.1 UDP-sulfoquinovose synthase
MKMAHLVTHCSFSASPAVKTFSRSPGYCCNVGQLQNSKSSNLSLKSSLKRQKKSYVTCASAAVQGQTQTPLTGSQEASGHSSSKPKKVMVIGGDGYCGWATALHLSNKGYEVAIVDNLVRRLFDHQLGLESLTPITSIQNRVRRWKSLTGKTIQLFIGDICDFDFLSEAFKSFEPDVAVHFGEQRSAPYSMIDRSRAVYTQHNNVIGTLNVLFAIKEYSEECHLVKLGTMGEYGTPNIDIEEGFISITHNGRTDTLPYPKQASSFYHLSKVHDSHNIAFTCKAWGIRATDLNQGVVYGVRTDETALHEELSNRFDYDGVFGTALNRFCVQAAVGHPLTVYGKGGQTRGYLDIRDTVQCVELAIANPA

SEQ ID NO: 31887 - DNA, 464 bp, Panicum virgatum
  misc_feature: Ceres CLONE 1907877-R
  misc_feature: Encodes the peptide sequence at SEQ ID NO. 31888
ttcagtttactgagcagttctccgtcaacgatctggccaagctcgtgactgccgcgggagccaagctcggtctggacgtgcagaccaagtcagtccctaacccccgggtcgaggccgaggagcactactacaatgccaagcacacgaagctgattgagctcggtctggtgccccacctgctctcggactccctgctcgactcactgctcaacttcgctgtccagtacaaggacagggtcgacacggcccagatcatgcctagcgtgtcgtggaagaagatgggcgccaagccaaggacagtctctgtttagagcagagggaacgttcccctggcgtataatgtcaaccatgacattgacattattgacatacgtaatgtaataattacgcacattagtgtgatgtgctagttagtgaggtgttttatttacgatattagatttaatttttgctgccccacgact

SEQ ID NO: 31888 - protein, 102 aa, Panicum virgatum
  misc_feature: Ceres CLONE 1907877-R
  misc_feature: SWISSPROT Homolog: EC 3.13.1.1 UDP-sulfoquinovose synthase
QFTEQFSVNDLAKLVTAAGAKLGLDVQTKSVPNPRVEAEEHYYNAKHTKLIELGLVPHLLSDSLLDSLLNFAVQYKDRVDTAQIMPSVSWKKMGAKPRTVSV

SEQ ID NO: 31889 - DNA, 1688 bp, Panicum virgatum
  misc_feature: Ceres CLONE 1907903
  misc_feature: Encodes the peptide sequence at SEQ ID NO. 31890
agcaatctacgctccggctcctttcgtttccaccccgttcctctgcgcccccttcggcttctccaggactcgtgctcgcccccaccgcaccccgtcaccatgcgccgcccgtggaggcacccggcgccggcggcagccgccggcgcgcggcgccacggcgcggcggatctctgcttccgcgaggtcggggacctcctcccccgccatttcacccgccgcgcggccggctccgaggaccttgtgatgcggttccagattcaccggaagcttgataggcacacgggctgcgtcaacacagtgggcttcaatgaggtcggtgacaccctcatatcagggtccgacgaccagatggtgatgctgtgggactgggacactggcgccgtcaaattggagttccattcaggccatggtggcaacgtgttccaggcacgcttcatgccctgcacaaatgatcggaccattgtcacttgtgctgccgatggcgaggtgagactcgccaaggtacaggatggtggagatgtgtccactacattgcttggtgaacatgggggaagggctcataatttggctgtagagcctggtagcccttatatcttttacagctgtggcgaggatggccttgttcaacattttgatctcagaacaaacacagccacaaaactattcctctgcagaagttctttaaggaaatcaggattctcctcctgtgttcaccttaatgcgattgcaatagatccgaggaacccaaatctttttgccgttggagggagcaatgcatatgctcgtgtgtatgacatccgcaagcacaagtgggatgggtcatctgattttggtcacccatctgactgctattgtccaccacatcttgttgacgataaacgtgttggggtaacagggttagcattctctcacttgagtgagttgcttgtatcttataatgaagagaatatttacctatttcccaaaaatggaggactgggatctgacccaatcccatctatcaagattggagcaaatgaaggttacaaatcaacaatgactgcatctggacaagatattgctcaacctgcacctcaggtatatgttggtcatcgcaatcgtgaaactgtgaagcgtgtgactttcattgggccaaatgatgaatacgttgctagtgggtcagactgtggtcggatatttatttggagaaagggagatggtaggtttttacgagccatggagggtgatgagtgcatagtgaattgcattgagccacatcctcatgatatgacaattgcaagcagtggaattgataatgatgtaaaaatgtggactccctctgccatcgagcgagcacctgtggtaaatattgaggagttgagacctcgcaagagaagagccaagctttggaactttgacttaccagagctgtttatccggcacttactggcatcagagcgtaggcaacaatcaactgaagaagattcatcggaggaccttgaggacagcacaggattacttaggctagtactatgtgctgctgatggaagtgtgtcatcgactgatgatgaagacatctctgatggctctgaagagtttacagtcaactgatctgttgtccaactttcagggccatttcaaaattgtacatatacattaataagttatcacactcttatgaatgatatagcagcaaagtgtggtttagc

SEQ ID NO: 31890 - protein, 496 aa, Panicum virgatum
  misc_feature: Ceres CLONE 1907903
  misc_feature (51)..(89): Pfam Name: WD40 Pfam Description: WD domain, G-beta repeat
  misc_feature (367)..(405): Pfam Name: WD40 Pfam Description: WD domain, G-beta repeat
MRRPWRHPAPAAAAGARRHGAADLCFREVGDLLPRHFTRRAAGSEDLVMRFQIHRKLDRHTGCVNTVGFNEVGDTLISGSDDQMVMLWDWDTGAVKLEFHSGHGGNVFQARFMPCTNDRTIVTCAADGEVRLAKVQDGGDVSTTLLGEHGGRAHNLAVEPGSPYIFYSCGEDGLVQHFDLRTNTATKLFLCRSSLRKSGFSSCVHLNAIAIDPRNPNLFAVGGSNAYARVYDIRKHKWDGSSDFGHPSDCYCPPHLVDDKRVGVTGLAFSHLSELLVSYNEENIYLFPKNGGLGSDPIPSIKIGANEGYKSTMTASGQDIAQPAPQVYVGHRNRETVKRVTFIGPNDEYVASGSDCGRIFIWRKGDGRFLRAMEGDECIVNCIEPHPHDMTIASSGIDNDVKMWTPSAIERAPVVNIEELRPRKRRAKLWNFDLPELFIRHLLASERRQQSTEEDSSEDLEDSTGLLRLVLCAADGSVSSTDDEDISDGSEEFTVN

SEQ ID NO: 31891 - DNA, 873 bp, Panicum virgatum
  misc_feature: Ceres CLONE 1907909-R
  misc_feature: Encodes the peptide sequence at SEQ ID NO. 31892
gactgcaccgtcgaggacgtgcgcaaggcctaccgcaagctctcgctcaaggtgcaccctgacaagaacaaggcccctggcgcagaggatgccttcaaggccgtttccaaagctttccagtgccttagcgatgccgagagtcgtaagcgctatgaccttgttggctcggatgagccagtaacacaccacaggaggacctccactgcccgtgcgtacaatggtttctatgaggacgactttgacccagatgagatattcagaaacttctttggtggtatggcacctgccaccaccaggcagtttggacagtttgggacgttccatttcagaactggtggaatgcatgctcatgggcagcaaaactctggtggctcaactgtcaggatgcttattcagcttttgccagttctactgctgctgttgctcaacttcctgccatcctctgagcctgtttactccctctcccgctcctatccatatgagcacaagttccaaacaccacgtggagttgcgtactatgtcaagatgcctaattttgaggagcagtatccacaccaaagcactgagcggtcaacactggagcggcatgttgagagggattattattcaataatcacgcagaattgcagggttgaactgcagcgccgccaatgggggttagcataccagacaccacactgtgatatgcttaaaaaatttgaggcggcagctcagtaattcattcaatggtccaaggtgcggttcaactttctctgcacacaaattgcaataataatatatttacgccgtgatgaagatttatgtggtgtgctacaaccttatctgctttgtaccataaattactttgcttttgtaatgcaaccatatgtgatt

SEQ ID NO: 31892 - protein, 238 aa, Panicum virgatum
  misc_feature: Ceres CLONE 1907909-R
  misc_feature (1)..(52): Pfam Name: DnaJ Pfam Description: DnaJ domain
DCTVEDVRKAYRKLSLKVHPDKNKAPGAEDAFKAVSKAFQCLSDAESRKRYDLVGSDEPVTHHRRTSTARAYNGFYEDDFDPDEIFRNFFGGMAPATTRQFGQFGTFHFRTGGMHAHGQQNSGGSTVRMLIQLLPVLLLLLLNFLPSSEPVYSLSRSYPYEHKFQTPRGVAYYVKMPNFEEQYPHQSTERSTLERHVERDYYSIITQNCRVELQRRQWGLAYQTPHCDMLKKFEAAAQ

SEQ ID NO: 31893 - DNA, 710 bp, Panicum virgatum
  misc_feature: Ceres CLONE 1907909
aaaaaaaaagtcagttttgggggtcgtcgccgcgtcggtgtcgctcgccatatcccctttcctccccctcccacctccctctccgagcccgactccggcgatccgccccgcctgaaccctactccaagtcgcctcgccggttgggttgggggccgagtcgagccgatccgatcggatcggggcgggttcctgcgccgccgctgcgtgacctcctcccggtcgctcgcctgctcggctcgatcggccggtgaccgcggcggccagatctgcgatggagggcaacaaggacgacgcggccaagtgcctgcgcatcggcaggggcgcgctcgaagccggcgaccgcgcgcgcgccgtcaagttcctctccaaggccaagcgcctcgacccgtccctccccatcgacgacctcctcgctccgctcctcaacccccaggacgactcccccgcttcctcgtcgtcgccgccgccgccgccgccgccgccgccgccgccgccgccgccgccacaaccttcagcagctgggccagccggagcagctgaggctgacgggctgagagagaggaagcagaagggcaagaagagggaggaggaggaagaggttactggcgctgcgagggagtacacggcggagcagctcgaggttgtgcgccaggtcaagaagcactccagggactactaccagatcctcggcctcgagaaggactgcaccg

SEQ ID NO: 31894 - DNA, 1613 bp, Panicum virgatum
  misc_feature: Ceres CLONE 1907924
  misc_feature: Encodes the peptide sequence at SEQ ID NO. 31895
atcctgctcactcccctggcggcggccgccgccgcgggggccacgccggcgactgcgaggaagaccctcttcaccgccaccgccaccctcttttcgtcctcactcacaagcggcagccgcggccgcggccgccccgcgcctcgctccgcagccgccggacctggtccggtgggtgcagcgcgagggcgggttcgtccaccctgccctccgcgtcacggaccacccggaacacggacttggggtctctgccgccgctgccgacggcgacatcccccctggggacgtccttatcacgctcccgggccgcctcccactacgactccgccgccccaccggcgctgcggacgacctgctcgtgcagcttgctcaacaagtaccggatgaactttgggctatgaagctgggcttgaggttgcttcaagaaagggccaaacctgattcattttggtggccatatattgccaatttgccagagacatttactgttccaatcttctttcctggggatgacattaaaaacttgcagtatgcccctctcctccaccaggaaaagatgccgttttcttcttgaattcgagaaagaggtgcgacagaagcttgatactgtgcccttgggtgatcatcctttttatggacaagatgtaaattcatcttcccttggatgggctatgtcggctgtgtcttctcgtgcatttcgtttgcatggggaaatcccaatgctgttgcgtctgattgatatgtgcaaccatagtttcaacccaaatgctaggattgtccaggaaggaagtgtaaacagctcagacatgtcagttaaggttgttgctgagactaagattgagcaaaatgcagcaataacactgaattatggttgccaccccaatgatttctttcttcttgattatggatttgtgataacaccaaacccgtatgatcaagtggaactgagctatgatggaacacttcttgatgctgctagcatggcagcagggatctcttctcccaccttttcagcaccagccaagtggcaagaagatatcttgtcacagctaaacctgcttggagagggcgccattttgaaggtaagcttaggaggcccagacatagttgatggacgcttgttagctgctctacgggtgcttcttgcagctgatccagaggctgtgcacaagcatgacctgaaaactttgatgtcccttaacgcacaagctcctttaggcccaacagttgaagcctcagcacttcgaacagttcttgcactctgtgcgattgctctccaacacttccacacaaagataatggaagacaaagccattctaaaaggggaactgcctcttaccactgaactggccgtccagtttagattgcagaagaagtttatgattgttgacgtgatgcaaaatatctcccggagaatcaagatgttgtcgccacagaaatccaccacgtagttctttgctttcttcttcagacaatcaaataccgttctgaactggttactgcagataatagaagccccaatttcaattctgcaccatatctgcattgaaaagttcgtcgagcttacgtttatgtactgattgttgtggataatgatgaatccccaattttgactc

SEQ ID NO: 31895 - protein, 313 aa, Panicum virgatum
  misc_feature: Ceres CLONE 1907924
  misc_feature (167)..(292): Pfam Name: Rubis-subs-bind Pfam Description: Rubisco LSMT substrate-binding
  misc_feature (2)..(127): Pfam Name: SET Pfam Description: SET domain
MTLKTCSMPLSSTRKRCRFLLEFEKEVRQKLDTVPLGDHPFYGQDVNSSSLGWAMSAVSSRAFRLHGEIPMLLRLIDMCNHSFNPNARIVQEGSVNSSDMSVKVVAETKIEQNAAITLNYGCHPNDFFLLDYGFVITPNPYDQVELSYDGTLLDAASMAAGISSPTFSAPAKWQEDILSQLNLLGEGAILKVSLGGPDIVDGRLLAALRVLLAADPEAVHKHDLKTLMSLNAQAPLGPTVEASALRTVLALCAIALQHFHTKIMEDKAILKGELPLTTELAVQFRLQKKFMIVDVMQNISRRIKMLSPQKSTT

SEQ ID NO: 31896 - DNA, 1602 bp, Panicum virgatum
  misc_feature: Ceres CLONE 1907932
  misc_feature: Encodes the peptide sequence at SEQ ID NO. 31897
gtcctccgttgctcttcctttcccggcggcgccgactgggggagcggcggcgccatttgtcacgtcttcgcccagcccttagccggcgacgagcgtcctccagagcatgatcctgcggtgagcgcagatagctcgtgcaagctgctggtttgggagttctcttggtaatctgctccagagaaatcctgaggcaatagagtgaaatggatgcgagcccggatgttgctgatgctattggtgcaaagagcattgacaatggggcgatggggaagttgccgcctggtgatgttatagaggggcatggagaagaacacgatgtgctggctgatggagctcattcgggtgagagtgaggttatcaacccatctgaagaggtggaaggggaagccacctcaccatcgcaggacgtgaagcctcgtgttcctgcggacagtcaaagccattcgccaaaggttgttagatctcagcgacagagccctcgtggcggagataagagtcaagctaggaaaagctctcctagtccttatcccaaggcacccatcgcacgagtttctgatccggatcttgttgatagctcttcaagcaatggtgatgctagtgtcagtaaaaaaaaggctgaaaagagcagttttcgcccagttgccaaggagagctcatcacttgaggactctaaagagaagaagaaaactcagaagccatcaaaccaacgttctgttaaaaaggatattgaagaagaatcaaatgaaagtataaaacctcaaagggttggcagcactccttcttatggctttagttttaagtgtgatgagagagctgaaaaaagaagagagttctactcgaagcttgaggagaagattcatgcacaggaactagagaaaagcaacttgcaggcaaaatcaaaggaagctgaagaagctgaactcaaaatgcttagaaaaagtttaaatttcaaggcagcacccatgcctagcttttacaaggaaccacctcctcccaaggttgagttaaagaagatccctacaacaagacctagatcaccaaagcttgggcgctccaagaacacaacctccacaggcacagaaggaaagacaaatcctccagtccgttcagctcgtctgagcctcgataaaagggcatccttaaatggtgtcaagcaagcacccactgcaaatgcagtgaagaagccccaacgcaaatctttccctaaattgccatcggagcaaacggctaaagttcatgtcgcagcacctctttcatccggagaagagctagaaaacaagtcatcgacagatcttgttcgagagccaatccgtgctcaagttactcctgatgaacctggactccctggctaaatgaaacctatcaagtccgactccaatgaaatgggagggctgtgccccagcttcctttatcacattttgctatttctgcagtacactgctggctggtattatgtgctaaaattagtctcatccccaggagtttgtagaatggcaagtgaccccctgtattgtttgtcttagtttccgttcacatacgaggcatttgtagttggcaataatttcatatgattgtcctatttccagggctagctcttgctct

SEQ ID NO: 31897 - protein, 382 aa, Panicum virgatum
  misc_feature: Ceres CLONE 1907932
  misc_feature (198)..(254): Pfam Name: TPX2 Pfam Description: Targeting protein for Xklp2 (TPX2)
MDASPDVADAIGAKSIDNGAMGKLPPGDVIEGHGEEHDVLADGAHSGESEVINPSEEVEGEATSPSQDVKPRVPADSQSHSPKVVRSQRQSPRGGDKSQARKSSPSPYPKAPIARVSDPDLVDSSSSNGDASVSKKKAEKSSFRPVAKESSSLEDSKEKKKTQKPSNQRSVKKDIEEESNESIKPQRVGSTPSYGFSFKCDERAEKRREFYSKLEEKIHAQELEKSNLQAKSKEAEEAELKMLRKSLNFKAAPMPSFYKEPPPPKVELKKIPTTRPRSPKLGRSKNTTSTGTEGKTNPPVRSARLSLDKRASLNGVKQAPTANAVKKPQRKSFPKLPSEQTAKVHVAAPLSSGEELENKSSTDLVREPIRAQVTPDEPGLPG

SEQ ID NO: 31898 - DNA, 726 bp, Panicum virgatum
  misc_feature: Ceres CLONE 1907973
  misc_feature: Encodes the peptide sequence at SEQ ID NO. 31899
ctctcccattcccctttcgccgaatccacgcgaccgcgcgagcgcatagagcaccgccaccgccgaggggatcggaccagacgagcaaaccctccgagtctcggcggcaatggcgctctccgacctgtcccgcgagtcgctcctcccgagcttcctctacgcccctgcggcggcgaggtccttcgccggcgcctcccgcctccccgcctcgcccgccgcggcaccggggggtgcgggcgcgccgtccttcccgatccaggcgcccaaggagaagatcgagatgtactcgccggcgttctacgccgcctgcacagccggaggcatcgccagctgccggctcacccacatggccgtcacgccgctcgacctcgtcaagtgcaacatgcagatcgatccagcgaaatacaacagcatcacatccaggtttggaattctggccaaggagcaaggagtgaggggcttcttcaggggatgggtgcccaccctgcttggttaccgtgctcacggagcttgcaagtttggattctatgagttcttcaagaagtactactcagatattgcacgggctgagtatgctcagaagtacaagaccttgatataccttgctgggtcggcttctgctgaggtgattgctgatgtggctctctgcccctttgaagctgtgaacgtccgtgtgcacacacagcctgcttctgctcgtggactcactgatgggctccctaagtt

SEQ ID NO: 31899 - protein, 205 aa, Panicum virgatum
  misc_feature: Ceres CLONE 1907973
  misc_feature (62)..(151): Pfam Name: Mito_carr Pfam Description: Mitochondrial carrier protein
MALSDLSRESLLPSFLYAPAAARSFAGASRLPASPAAAPGGAGAPSFPIQAPKEKIEMYSPAFYAACTAGGIASCRLTHMAVTPLDLVKCNMQIDPAKYNSITSRFGILAKEQGVRGFFRGWVPTLLGYRAHGACKFGFYEFFKKYYSDIARAEYAQKYKTLIYLAGSASAEVIADVALCPFEAVNVRVHTQPASARGLTDGLPK

SEQ ID NO: 31900 - DNA, 635 bp, Panicum virgatum
  misc_feature: Ceres CLONE 1907983
  misc_feature: Encodes the peptide sequence at SEQ ID NO. 31901
atccactgcaaggccgggcgatctctggatactcgcagcggctgcagaggccggccggcgtcgaagaagatggctaagcggggcgttgctcccgtgctcgcagccgcattggtcgttgcggcattcgccgccaccgctacaagtatatatccgtccatcttcttcttgagctccggcgaaccatgcatctggctatagcgtagagaggaaactaaactaagagattatattcatcaagctagcggcggcccttgcttttatttgctgcgtgcaggtgtgcgagccatcggcgtgtgctacggcgtgatcggcagcggcctccggtcgtcgtccaagagcgacgtcgtgcagctctacaagtccaacggcatcgccaacatgcgcttctacttcgccgaccaggacgtcctcaacgccctgcgcagatcgggcatcggcctcgccctcgacgtcggcaacgagaacctccgcgacctcgccgccaaccccgcctccgcggagtcctgggtcaaggacaacgtgcaggcctactatccggacgtcaacatcaggtacatcgtcgtcgggaacgaggtcgacggcgcagcctcggtcctccaggccatgcagaacgtccacgacgccctcgcgtcggc

SEQ ID NO: 31901 - protein, 85 aa, Panicum virgatum
  misc_feature: Ceres CLONE 1907983
  misc_feature: SWISSPROT Homolog: EC 3.2.1.39 Glucan endo-1,3-beta-D-glucosidase
  misc_feature: Useful for making plants with altered carbohydrate content
  misc_feature: Useful for making plants with altered cell wall content and/or composition
MRFYFADQDVLNALRRSGIGLALDVGNENLRDLAANPASAESWVKDNVQAYYPDVNIRYIVVGNEVDGAASVLQAMQNVHDALAS

SEQ ID NO: 31902 - DNA, 1760 bp, Panicum virgatum
  misc_feature: Ceres CLONE 1907996
  misc_feature: Encodes the peptide sequence at SEQ ID NO. 31903
atcctagatcaaatactttgttcttttttctttttggtttcatctcgacgccagtggattttagagtttggatggaatttatctgcgaggctgattccaacccaaacaccaacgtggcccgccttgctccgatccaacccgtctatttatacggccgcctggtctcagctcggctcccaacgagagcgaagcgagctgttagctgcacgagcgcacaccagcggcagccagacgcgagcagagcaatggcgggggcggagcagcagctgcggtcgttcgtggaggtgccggcgggctcgcacttccccatccagaacctgcccttcggggtcgtccgccggcgggggtcgcgggcgccgccgcgccccgcggtggcaatcggggacctggcgctcgacctcgccgccgtcgccgacgccgggctcttcgacgggcccgcgctcgccggctccccgtgcttccaccaggagacgctcaacatgttcttggagatgggccggccggcgtggaaggaggcgcgcgccacgctccagaaaatcctatcagctgatgagccagtcttgcgtgacaatgaggccctcaggagcaagtgtcttgttccaatgagtgatattgagatggttctgccaatcactgtcggaggctacacagacttcttttgttccgtgcaccatgccaggaattgcgggtttatcttccgtgggccgcagactccagtcaatccaaattggtttcatcttcccataggttacaacggaagggcatcatctgtagttgtgtctggaacagatgtcattcgacccagaggacaaggacatccaacaggaaactccagtccttattttggtccatctcagaagcttgattttgaacttgagatggctgccattgttggcccagggaatgaattgggaaaacctatcgatattaataatgctgaagaccatatttttggcctagctttgatgaatgattggagtgccagagatatccaggcttgggagactatacctcttggaccattccttggaaaaagcttcagtaccacaatatcgccatggattgtcactctggatgctttaaagcctttcacctgtgaggcacctaagcaggaacctgagcctttgccttacttggctgaaaagaatcacgtgaactacgatattcctcttgaagtttggattaagcccaaagatcaaagtgacgcctcaatcgtcgcaaagactaatttcaaacatttgtattggacggtgacgcagcagctagcacaccacactatcaatggatgcaacatgagaccaggggatatatttgcaactggcacactcagtggacctgaacccgagtctctggggtgtcttctggagctaacatggaacgggcagaaggagataccagttggaaattcgacccgcaagtttctagaagatggggatgaagtcatcttgaccggctgttgcaagggtgaaggctacaacattggatttggaacctgcacagggaaggttctgcctgcgcttccttgagccaacatatcttcacttcaattcatggagtctcgatgatcccaaaggagttcatgcgctgaaatctaccaagctccgatccttagtctgtttaaagcctactagttatggtaactggatattaggtattgtttttcttgaatgcggaaaaggaaactggtccctctctctagtgcaataaaactgatgctaagtcatctttttatacaattttttccctctgggagttgtttt

SEQ ID NO: 31903 - protein, 426 aa, Panicum virgatum
  misc_feature: Ceres CLONE 1907996
  misc_feature (158)..(369): Pfam Name: FAA_hydrolase Pfam Description: Fumarylacetoacetate (FAA) hydrolase family
  misc_feature: SWISSPROT Homolog: EC 3.7.1.2 Fumarylacetoacetase
MAGAEQQLRSFVEVPAGSHFPIQNLPFGVVRRRGSRAPPRPAVAIGDLALDLAAVADAGLFDGPALAGSPCFHQETLNMFLEMGRPAWKEARATLQKILSADEPVLRDNEALRSKCLVPMSDIEMVLPITVGGYTDFFCSVHHARNCGFIFRGPQTPVNPNWFHLPIGYNGRASSVVVSGTDVIRPRGQGHPTGNSSPYFGPSQKLDFELEMAAIVGPGNELGKPIDINNAEDHIFGLALMNDWSARDIQAWETIPLGPFLGKSFSTTISPWIVTLDALKPFTCEAPKQEPEPLPYLAEKNHVNYDIPLEVWIKPKDQSDASIVAKTNFKHLYWTVTQQLAHHTINGCNMRPGDIFATGTLSGPEPESLGCLLELTWNGQKEIPVGNSTRKFLEDGDEVILTGCCKGEGYNIGFGTCTGKVLPALP

SEQ ID NO: 31904 - DNA, 1308 bp, Panicum virgatum
  misc_feature: Ceres CLONE 1908005
  misc_feature: Encodes the peptide sequence at SEQ ID NO. 31905
tctctccctcctctgagctgccgcaagccgcaaaaggggaggaggcccacccccacccccacgacaccacccccgctcccactccacactgtcaagagggaagggggagggcgaagcgcctccgcgcccatcccgatccgcccgcccacctaacgccggtcgccgatcggcggccgccgcgatggggttcgacgggctggtggtggtgtccgacccctacctgcagcgccgcttcacgcaggccgacctccgcgcgctccaggcccagtatgcggcgctacgggacgcgtcacccagcgggaggttgcggatgcgggacctccccgccgccatctccagcctccgcggcgccaccgtctcggccaaggccgacgccgagaaggagaacagcgcgccagaaccaggccccggcccgggcctcaccgatgaggaatgggcctccgtgctcaaagccgtcgcgcgcgccgacgagaggccgcaccaggacgccagcttcgagctcttcctccgcgtctacgccgagatgcagcttcgcctaaaatcggccggcgccggcgccggcgggaagaaggcggccggcggcatcgcccgctcctcgtcctcctccgccgttgccttcctcacggcggccaccaccacgctgctgcacaccatcagcgagtccgagaaggcgtcctacgtcggccacatcaacgcatacctcgctgaggatccgttccttaagagcgcgctccccatagatccggcaaccgatcacatcttccacgtcaccaaggacggcgtcctcctatgcaagcttattaacttggccgtaccgggcaccattgacgagagggccatcaacaccaagagggtgctcaatctatgggagaagaacgagaatcatacactttgcctgaactccgccaaggccatcggctgcactgtcgtcaacatcggcacacaggacctcgcggaagggaggcctcatcttgtcctgggcttaatttctcaaataatcaagatacaactgttggcagatgttaacctgaaaagtacgcctcagttggttgaattagttgaggacagcaaggagatggaggagcttatgagtttgtctcctgaaaagattctattaaggtggatgaactttcaactgaagaagggaggcttccagagaacagtatcaaacttttcatcggatataaaagacagtgaagcgtatgcatgtctattgaatgtcctggcacctgagtgcagtgcaaaactatccgcaatgtcagtaaaagatctgcttcatagagcaagattagtccttgagcatgcaga

SEQ ID NO: 31905 - protein, 375 aa, Panicum virgatum
  misc_feature: Ceres CLONE 1908005
  misc_feature (161)..(277): Pfam Name: CH Pfam Description: Calponin homology (CH) domain
MGFDGLVVVSDPYLQRRFTQADLRALQAQYAALRDASPSGRLRMRDLPAAISSLRGATVSAKADAEKENSAPEPGPGPGLTDEEWASVLKAVARADERPHQDASFELFLRVYAEMQLRLKSAGAGAGGKKAAGGIARSSSSSAVAFLTAATTTLLHTISESEKASYVGHINAYLAEDPFLKSALPIDPATDHIFHVTKDGVLLCKLINLAVPGTIDERAINTKRVLNLWEKNENHTLCLNSAKAIGCTVVNIGTQDLAEGRPHLVLGLISQIIKIQLLADVNLKSTPQLVELVEDSKEMEELMSLSPEKILLRWMNFQLKKGGFQRTVSNFSSDIKDSEAYACLLNVLAPECSAKLSAMSVKDLLHRARLVLEHA

SEQ ID NO: 31906 - DNA, 659 bp, Panicum virgatum
  misc_feature: Ceres CLONE 1908005-R
caagtggcacctttttccttgacttactaagtgctgtggagcctcgagttgtgaattggagccttgtgacgaaaggagaaaaagatgaagagaagcaaatgaatgcttcatacatcatttctgtggctaggaagcttggttgctccattttcttgttgccagaagatatattggaggtgaaccagaaaatgatgctaactctgacagcaagcatcatgtactggtatttgaaaaggccaacatcacattcattagactctgaaaatgggagttcatgtgagacaagctccaccacaacttcagacgattctgcatctgaatcatcattcgatgacaacgcagctagatagaagtgcaaggatcatgaagcgaaatgatccaacttgtctttttgaaaacttgaatactcctcgtcccagcggcggtgttgactgtgttcttgattcgttgctgtaattttaagagcaaatgcattcaagacagagagaagggaagcgacaaaaagcttaagggtgtttatttgtgagttttgtagtgtgaaaatttgattgggtgagagattgtgtaacatcctgtaaatattggcacaggtagcctacatttgtaaaatcatagtgacagtggattgctagaaatccagagtttggttttcttgggcg

SEQ ID NO: 31907 - DNA, 601 bp, Panicum virgatum
  misc_feature: Ceres CLONE 1908015
  misc_feature: Encodes the peptide sequence at SEQ ID NO. 31908
atcccattccccttccttccagaggagagagagagagagaagaaaagataagctcaggctcagctcgcaagcaagtggagatgcggagcccacgaggagcagcagcagccgggcgctgcggcgcccaggagcacgtcgacctgatcccgggcatccccgacgacgtcgccgtcgactgcctggcgcgcgttccccacgcgtcccaccgcgcgctccgccgcgtctgccgcggctggcgcagcgccgccgccaagccggccttcgcctcggcgcgcgccgccgcgggcgccaccgaggacctcgtctacctcctgcagttcggcgacccctccgccgccgacgacgacggggcgcctaaggacggcgccgacgcgccgccgcccagcgcgccggcctacggcgtcgccgtctacaacgtgaccacgggcgagtggcgccgggagcgcggcgcgccgcccgtgctccccgtctgctcgcagtgcgccgcggtgggcacctgcgtggccgtgctccgcggctgggacccgcgcaccttcgagcgagtagccgacgtgcacgtccgcgacgccgcatgaggtgcgtggcgacgagccgagccgat

SEQ ID NO: 31908 - protein, 164 aa, Panicum virgatum
  misc_feature: Ceres CLONE 1908015
  misc_feature (20)..(67): Pfam Name: F-box Pfam Description: F-box domain
MRSPRGAAAAGRCGAQEHVDLIPGIPDDVAVDCLARVPHASHRALRRVCRGWRSAAAKPAFASARAAAGATEDLVYLLQFGDPSAADDDGAPKDGADAPPPSAPAYGVAVYNVTTGEWRRERGAPPVLPVCSQCAAVGTCVAVLRGWDPRTFERVADVHVRDAA

SEQ ID NO: 31909 - DNA, 661 bp, Panicum virgatum
  misc_feature: Ceres CLONE 1908026
  misc_feature: Encodes the peptide sequence at SEQ ID NO. 31910
cttaacacttagctgggtagcgtaattatatacttgtgaccgactggccaatataatcgattgaagaatttcgatacgcatcacatttacatatatgcacttgcgtatcgacgaggcagctgagctagagctagagctagagctagagctagagccagagccagagcttgagcttgagatggagaacggcgacgtgaagcctgctcgcagctcggtggcggcgagcgccatggcggcctcgtacaacgaccagattcggccgctgctggacgccgttgaccggctgcggcagctgaacgtgagccaggagggcatccagctcccgaccatcgtcgtggtgggcgaccagtccagcggcaagtcgagcgtgctggagtcgctggccggcatcagcctcccgcgcgggctgggcatctgcacccgcgtgccgctcgtcatgcggctgcaggacggcgacgacccccggctgcaggtgaagtacggcaacggcaccgtggtgcccgtcgcctccgaggcggaggtcgccgacgcaatcgaagccgccacggccgagatcgccggctccgggaaggggatctccgacgcgcccatcaccctcctggtgcggaagaagggcgtgccggacctcaccctggtggacctgccgggcatcacccgcgtg

SEQ ID NO: 31910 - protein, 188 aa, Panicum virgatum
  misc_feature: Ceres CLONE 1908026
  misc_feature (79)..(188): Pfam Name: Dynamin_N Pfam Description: Dynamin family
  misc_feature: SWISSPROT Homolog: EC 3.6.5.5 Dynamin GTPase
MHLRIDEAAELELELELELEPEPELELEMENGDVKPARSSVAASAMAASYNDQIRPLLDAVDRLRQLNVSQEGIQLPTIVVVGDQSSGKSSVLESLAGISLPRGLGICTRVPLVMRLQDGDDPRLQVKYGNGTVVPVASEAEVADAIEAATAEIAGSGKGISDAPITLLVRKKGVPDLTLVDLPGITR

SEQ ID NO: 31911 - DNA, 382 bp, Panicum virgatum
  misc_feature: Ceres CLONE 1908028
  misc_feature: Encodes the peptide sequence at SEQ ID NO. 31912
actagaccagttcctctgttcctgcacgagctcaatcaagctcgaggccaatggagaccccagctcgtcctcctccgcagcagatgcacttcctgttcgtgaccagcccgctgcagggccacatcaacccggtgcgccgcctggccgcccgagtgatggcggccaatccggacgcgctcgtcaccttctccaccgccgtctccgggcactgccgcatgttcccctccctggcgcgccccgacgacgaggccgtggacgccgcgggcgtgctgcacgtccccttctccgacgggttcgacgacgggttcaactccccggcgcacggtgcgggcaccctactgggcccgcgccagctcggccgggcgcgcgaatgggtgggggg

SEQ ID NO: 31912 - protein, 110 aa, Panicum virgatum
  misc_feature: Ceres CLONE 1908028
  misc_feature: Useful for making plants with altered carbohydrate content
METPARPPPQQMHFLFVTSPLQGHINPVRRLAARVMAANPDALVTFSTAVSGHCRMFPSLARPDDEAVDAAGVLHVPFSDGFDDGFNSPAHGAGTLLGPRQLGRAREWVG

SEQ ID NO: 31913 - DNA, 1834 bp, Panicum virgatum
  misc_feature: Ceres CLONE 1908062
  misc_feature: Encodes the peptide sequence at SEQ ID NO. 31914
tctgaggctgttcgccatgagcttggcttatccgctgctgttccgcctcccggcgggccgctgctccctcgcggcggcggcactcgcgtcatcgtctccgcttcccgtgtcagtgaccttatcggcttcggcttccgcggatgggggtgggggcgagctgacggcgcgggagaggcggctacagaagagggagcggcgggagctgcgggcgacggactggaaggaggaggtgcaggaacggctcatccacgagccggcgcgccggcggaagaagccgccaaagaggtcgtggcgggaggagctcaacctcgacctcctcgccgagctggggccgcagtggtggctcgtgcgcgtctccatggcgcccggcaccgactacgtcgacctcctcaccaaggccatctcacgacgcttccccgaagttcccttcaagatttataatccatccatccaagtcaagaggagattgaagagtggcacaatcagtgtcaaatcgaagcctttgcatcctgggttggtctttttgcattgcaccttaaacaaggagctacatgacttcatcagggacaccgaaggttgttatggctttattggggctacagttggttcaatcaaaaggcagattaaaaagccaaaaccaattccaattgaagaagttgaatcaattatcagagaagaaaaggaggaacaagagaaagttgatagagaatttgaaggaatggagaacatggcaaatgttgagtcattcagtaaacctgttgaaaaatctgaacttatgttaatgaataagatcaagaagcagtttaagaagtcaccctcaaaaggtggcaccagccagcgagctttttcagctggtgctactgtccatgttctctctggaccttttgaggacttcattggttcaatcctggaagtgaatctcaaaaacaggaaggccactgtccagttgacacttttcgggaaagagagcttcgtggatctagattttgatcaaattgagttggttgaaacggacaacaatgacagtaaattatgaggtctgaaaactcctctaaatcctcatttctgactttgataaacatttatgcctgtagaagtgatcagaaggggacatctagctgttgaagttacataaataggatagcagaagaaatggtagatatggagcatgttttctcacctgtgggcaaagattgtactccctccgtttcaaattgtaggttgttttggcaaatctagatatataatttttgtcatgcatatagacatagtatttatctagatgcatagcaaaaattatgcatctagatttgtcaaaacgatctacaatttggaacggagggagtactatgatagaacctgcattcattgttattgcactgctctgatttgtgctccgccatttaagtgaacgtccatttaacaccatacaagtctttttttttctgcaagttcgtataagtaataaaacttcaggattccatcatatatcaattttcttctcattatgataatattttagctccttcatactttagctgcaggagagcagtttctcactttttgtttaatgtccgagcaggcatcttgtgtttgtggatcacaatatcgatagcttttaacaacactcaaggtctccagctggagattggggtgaatgaagcagggacttcagtgggtggacagtggactgttgaagagcgagttatcagggaaagagttagcacatgagctgtcgtcaaaatttgaccagtaacttctgagtctggtagcatgcgttctcttccactgatttttttgaacgaacgggcaccagaacgtccctatttcattg

SEQ ID NO: 31914 - protein, 339 aa, Panicum virgatum
  misc_feature: Ceres CLONE 1908062
  misc_feature (106)..(214): Pfam Name: NusG Pfam Description: Transcription termination factor nusG
  misc_feature (279)..(314): Pfam Name: KOW Pfam Description: KOW motif
MSLAYPLLFRLPAGRCSLAAAALASSSPLPVSVTLSASASADGGGGELTARERRLQKRERRELRATDWKEEVQERLIHEPARRRKKPPKRSWREELNLDLLAELGPQWWLVRVSMAPGTDYVDLLTKAISRRFPEVPFKIYNPSIQVKRRLKSGTISVKSKPLHPGLVFLHCTLNKELHDFIRDTEGCYGFIGATVGSIKRQIKKPKPIPIEEVESIIREEKEEQEKVDREFEGMENMANVESFSKPVEKSELMLMNKIKKQFKKSPSKGGTSQRAFSAGATVHVLSGPFEDFIGSILEVNLKNRKATVQLTLFGKESFVDLDFDQIELVETDNNDSKL

SEQ ID NO: 31915 - DNA, 564 bp, Panicum virgatum
  misc_feature: Ceres CLONE 1908073
  misc_feature: Encodes the peptide sequence at SEQ ID NO. 31916
acaccgcacccggcaccccccctcccggctgtgtggctcaccttcacctcttccccacaccaacaccgacaccaccgccgcggtgccccccagactcgagtgtgtcgaggctgacctccccgccgccgcccgcacccgcgatgccggcgccgaccaccgagacggcgctggcgggagccttcctctgcgtccctcccccgatgctctccgcggccgtccactgcgacggcgccctctaccctgagctctgcctgtgcacatctggccgacctcccggacctgcacaacaagccgctcccggacctctcctgcgccgccttgaaccacagcgaggacgtcgcggccgccaccgcctccaactgctcctgctacctaggggagaggttcctgaccccgcgcgacagcctcaccctcaacaactgcctggagctcctgtcgaacagcatggacgagctccaggacacggtcgcggagctgaagtcccccgccaccgacggcagtggtggctcggcgtcctcgtcatccgcggtgggcgccaggcgcgtgacgatggaccacgtgatg

SEQ ID NO: 31916 - protein, 39 aa, Panicum virgatum
  misc_feature: Ceres CLONE 1908073
  misc_feature: Useful for making plants with altered carbohydrate content
MDELQDTVAELKSPATDGSGGSASSSSAVGARRVTMDHV

SEQ ID NO: 31917 - DNA, 437 bp, Panicum virgatum
  misc_feature: Ceres CLONE 1908112
  misc_feature: Encodes the peptide sequence at SEQ ID NO. 31918
atctttctcgtccccgggacagggaggcgagccccagccctcaggagggagcaatggcggcggagtcgctctccggtttcttggacctccgctcggcggcgccgttcctggtggccgcggtggccttcttcttcctggtggagctactgtcgcatcaccgcactaagggccccctgccgggcccgccgctcgtcgtgccgttcctcgggagcgtcgcccccatgatccgcgacccgaacgggtactgggacgcgcaagcggcgcgcgccaaaaagtctggcgcgcggctcgcccacgacttcctggtcgggcggttcatcgttttcatccgccactctgagctgtggcgtcgcgtgttcgcccccgcccgccccgacgcgttccacctcatccgccaccccttcggcaagaagctcttcggggagcacaacctcttc

SEQ ID NO: 31918 - protein, 127 aa, Panicum virgatum
  misc_feature: Ceres CLONE 1908112
  misc_feature: Useful for making plants with altered sterol content
MAAESLSGFLDLRSAAPFLVAAVAFFFLVELLSHHRTKGPLPGPPLVVPFLGSVAPMIRDPNGYWDAQAARAKKSGARLAHDFLVGRFIVFIRHSELWRRVFAPARPDAFHLIRHPFGKKLFGEHNL

SEQ ID NO: 31919 - DNA, 650 bp, Panicum virgatum
  misc_feature: Ceres CLONE 1908113
  misc_feature: Encodes the peptide sequence at SEQ ID NO. 31920
aaaggcgagtctgccgttcgcgcgagtctgttgctcgagccaccacgaaggtggaggaaggcatattgaagaacgaagggatgcgagaggagggggctgagaagaagatgaggagcacggtggtgtgcgtcaccggcggcgccggctacatcgggagctggctcgtcaggaagctcctaggcagaggctgcgtcgtccacgccaccctgacgaacctcgaggacgacaagaaggccgggctgctgcgggcgctccccggcgcggcggagcggctgcggctgttccagacggacatgtaccacgcccacaccttcgagccggccatcgcggggtgcgagttcgtcttcctcgtcgccacgccgctggtgcacgaccccacgagcaccaagtacaagaacacgacggaggcgacggtggacgcggcgcgcatcatcctgcggcagtgcgagcgctccggcactgtgaggcgcgtcatctacacggcctcggtcacggccgcctcgccgctgagagagggcggcggcgggtacaaggacttcatcaacgaatcctgctggacgccgctcgacctctcctacgggttcaccaacgtccacctggacgcatacgtgtggtccaagactctgtcggataacgagctgctgcgctac

SEQ ID NO: 31920 - protein, 180 aa, Panicum virgatum
  misc_feature: Ceres CLONE 1908113
  misc_feature: SWISSPROT Homolog: EC 1.1.1.219 Dihydrokaempferol 4-reductase
MRSTVVCVTGGAGYIGSWLVRKLLGRGCVVHATLTNLEDDKKAGLLRALPGAAERLRLFQTDMYHAHTFEPAIAGCEFVFLVATPLVHDPTSTKYKNTTEATVDAARIILRQCERSGTVRRVIYTASVTAASPLREGGGGYKDFINESCWTPLDLSYGFTNVHLDAYVWSKTLSDNELLR

SEQ ID NO: 31921 - DNA, 696 bp, Panicum virgatum
  misc_feature: Ceres CLONE 1908119
  misc_feature: Encodes the peptide sequence at SEQ ID NO. 31922
atccagctcatacttccagttcaaacatcatttccaggcaagattaggggtggtaaagcgccctagatttcggcttagaaaatctaagggccaagtaataaaagggccgggctctaatcttatactattttgagctaaaacatttaagaatcttgttgggttgtgaagagaccactagggttatgacccattaccaccgagaccaaaccgatcagaaaggccgccgtctccagcacaagcagaggtggcagttaagtgcatcatgtgtcatttcaagcagctggcgaaagttgccatgcccatgcttatactattgccgttgctgctgctgtgctatggagttcgaaacatccattgctcaaccgttcatgataacagcggagatctgaaggcactcctcgatttcaggcagggcatccccagcgatccatatggagccatgagcaattggaccatgaactcccacttctgtcggtggaatggtatcacgtgcacctggacacgacgacagtggcgtgtcctgtcgctcaccctcaccgggaaaggtttatctggccaaatcagctcctctcttggcaaccttaccttccttaaatatcttgacctctctgacaataacttctttggtcccttgcctcttcttggtggcctccaccaactgcagaacctttatctttacagcaacaatttgtctgg

SEQ ID NO: 31922 - protein, 144 aa, Panicum virgatum
  misc_feature: Ceres CLONE 1908119
  misc_feature (38)..(78): Pfam Name: LRRNT_2 Pfam Description: Leucine rich repeat N-terminal domain
  misc_feature: SWISSPROT Homolog: EC 2.7.11.1 Non-specific serine/threonine protein kinase
MCHFKQLAKVAMPMLILLPLLLLCYGVRNIHCSTVHDNSGDLKALLDFRQGIPSDPYGAMSNWTMNSHFCRWNGITCTWTRRQWRVLSLTLTGKGLSGQISSSLGNLTFLKYLDLSDNNFFGPLPLLGGLHQLQNLYLYSNNLS

SEQ ID NO: 31923 - DNA, 695 bp, Panicum virgatum
  misc_feature: Ceres CLONE 1908132
  misc_feature: Encodes the peptide sequence at SEQ ID NO. 31924
atcaaaatagggcagcaattctccaccagagtggatattcttccacaggaatatgtggatcagttatctgagttacaggatcaagttcctccatttccttcagagacagctgtaaaaattgtcgaagaagagctgggggcatctgtcaatgagatatttgatagatttgattttgaaccaatagctgctgctagcctcggccaggttcatcgggcacgtctgaatggccaagaggttgtcatcaaagtgcaaagacctggtctgaaggagctgtttgatattgatctgaagaatttaagggtaatagctgaataccttcagaaagtggatccaaagtcagatggtgccaagagagactgggttgctatttatgatgaatgtgcatctgttttatatcaggaaattgactatacgaaggaagcatttaacgctgaaaagtttgctgagaacttcaaaaaattggattatgtgaaggttcctgaagtttactggaagtacactacacctcaggttctaacaatggagtatgtcccaggaattaaaattaacagaatacagcagttagacaaattaggagtcgatcggaaaagattaggccgttatgctgttgagtcctaccttgagcaaatcttgtcccatggatttttccatgctgacccgcatccaggaaatattgctgttgatgatgtcaatgg

SEQ ID NO: 31924 - protein, 231 aa, Panicum virgatum
  misc_feature: Ceres CLONE 1908132
  misc_feature (43)..(163): Pfam Name: ABC1 Pfam Description: ABC1 family
IKIGQQFSTRVDILPQEYVDQLSELQDQVPPFPSETAVKIVEEELGASVNEIFDRFDFEPIAAASLGQVHRARLNGQEVVIKVQRPGLKELFDIDLKNLRVIAEYLQKVDPKSDGAKRDWVAIYDECASVLYQEIDYTKEAFNAEKFAENFKKLDYVKVPEVYWKYTTPQVLTMEYVPGIKINRIQQLDKLGVDRKRLGRYAVESYLEQILSHGFFHADPHPGNIAVDDVN

SEQ ID NO: 31925 - DNA, 582 bp, Panicum virgatum
  misc_feature: Ceres CLONE 1908137
  misc_feature: Encodes the peptide sequence at SEQ ID NO. 31926
ttccttttccgctctcgcgcgctcccgccaccccaccccccccccttcctcgcttctccagactctagcctccctgaggtttcctgatcacgttgggagcgcacgacacgagcttggacggatggcgcccgtttccacggctgtctgcggcgtgcctatgccttgcttgaacagaccggaggctcccgccggccgccgattggccgcggcgccgaaggcccccaacgccaagcggggccccatcagctccctgtcggtctccggctcctgctccgtccccgggcgcggccagccttggacgactgccaccgccgtcgccgactccgcgccaattacagcgacgaagagggtgttccccttcggccaaggccagagatacggcaacgaggcgcctgaaccgatctgctgggcgggaagggcgccaacctggcggaaatgtctagcatcgcgttgtcgccgccgccggggttcacggcgtcgacggaggcgtgccagcagaatccgcacgctcggcgcgcgctgcctgcagggctctgggcagacatcctcgacggtctgacgtgagggaaggagtacatgggc

SEQ ID NO: 31926 - protein, 42 aa, Panicum virgatum
  misc_feature: Ceres CLONE 1908137
  misc_feature: SWISSPROT Homolog: EC 2.7.9.1 Pyruvate, phosphate dikinase
MSSIALSPPPGFTASTEACQQNPHARRALPAGLWADILDGLT

SEQ ID NO: 31927 - DNA, 679 bp, Panicum virgatum
  misc_feature: Ceres CLONE 1908146
  misc_feature: Encodes the peptide sequence at SEQ ID NO. 31928
tcactgtggccaccgcacagagcccaggatttggtgtgggcggccggcatggcgcatggaggcgcggcgtggtacctacatcggcgtgaacattggcacggccatgtcgtcggtgccggcgccgacgcagatcacgacgctgctccgctcgcagaacatccgccacgtccgcctctacgacgccgacccggcgatgctggcggcgctcgccaacaccggcatccgcgtcatcgtctccgtgcccaacgagcagctgctcgccatcggcagctccaacgcgacggcggccaattgggtggcgcgcaacgtggccgcgcacttacccgccgtcaacatcacggccattgccgtggggtccgaggtgctctccgcgcaggccaacgcggcgccgctgctcatgcccgccatgcgctacctccagaacgcgctggtggccgcggcgctggaccgatacatcaagatctccacgccgcactcgtcgtccatcatcctcgactccttcccgccgtcccaggccttcttcaaccggtcgctggacaacgtgctggtgccgatgctcaagttcctgcagtccacggggtcgccgctcatgctcaacgtgtacccctactacgactacatgcgctccaacggcgtcatcccgctggactacgcgctgttccggccgctgccgccccac

SEQ ID NO: 31928 - protein, 207 aa, Panicum virgatum
  misc_feature: Ceres CLONE 1908146
  misc_feature (9)..(207): Pfam Name: Glyco_hydro_17 Pfam Description: Glycosyl hydrolases family 17
  misc_feature: SWISSPROT Homolog: EC 3.2.1.73 Licheninase
  misc_feature: Useful for making plants with altered carbohydrate content
  misc_feature: Useful for making plants with altered cell wall content and/or composition
MEARRGTYIGVNIGTAMSSVPAPTQITTLLRSQNIRHVRLYDADPAMLAALANTGIRVIVSVPNEQLLAIGSSNATAANWVARNVAAHLPAVNITAIAVGSEVLSAQANAAPLLMPAMRYLQNALVAAALDRYIKISTPHSSSIILDSFPPSQAFFNRSLDNVLVPMLKFLQSTGSPLMLNVYPYYDYMRSNGVIPLDYALFRPLPP

SEQ ID NO: 31929 - DNA, 2913 bp, Panicum virgatum
  misc_feature: Ceres CLONE 1908153
  misc_feature: Encodes the peptide sequence at SEQ ID NO. 31930
aaccagccagccacatcgacgtcctacccggcgccatgccgcccgcccccgccctccccctcctcctcctcttcctcgccgccctcgccacccgcgccgccgccgcggcggccgaggtggacgcgctcctcgccttcaagagcgccctcaccgtccctcccgcggccgcgcccttcttcgccacgtgggacgccgccgcggccgacgcctgcggcttcgccggcgtcacgtgcggcggcgccggccgccgccgcgtcaccgccgtctccctgccgggcctcaacgtctctgcggcgtccgtgcccttcgccgacctctgcgccgcgctccaggagctcaccctcgcgttcaacggcttcgacggcgccatcccggacctctcgccgctcaccaggctccgcaacctcaacgtctcctccaaccgcttctccggcgccttcccgtgggcctcgctcgccgccatgcccgacctctccgtgctcgcgctcggcgacaacccgttcctcgcgcccacccacgcgttcccgcccgaggtcaccaggctcaccaacctcaccgtgctctacatgtccgccgccaagatcggcgaccccatcccgccggagatcggcgacctcgtcaacctcgtcgacctcgagctctccgacaacgacctcaccggcgagataccgccgacgatcgccaggctcaccaacctcacccagctcgagctctacaacaattacctccgcggagacctcccccccgggttccgcaacctcaccaagctgcagtacttggacgcctcccagaacatgctcaccggcaccctcgccgtgctcgcccccctcaagcggctcgtgtcgctgcagctcttcttcaactacttcaccggcgtggtgcccccggagttcggcgacttcaaggagctcgtcaacctgtccctttacagcaacaacctcaccggcgagctgccgcggagcctcgggagctgggcgcagttcaacttcatcgacgtctccaccaacgcgctctcgggccccatcccgccggacatgtgcaagcagggcaccatgctcaagctgctcatgctcgagaacaacttctccggcgggataccggcgacctacgcgagctgcaacacgctggtgaggttccgtgtcagcaagaaccagctctccggcgaggtgcccgaggggatgtgggccctccctaacgtcaacgtgatggaccttgccgggaaccagttcaccggcaccatcagcgacggcatcgggaacgccacggcgatgaccaatctcctcctggccgggaaccggttcaccggcgcgataccgccgtcgatcggcaacgcggcgagcctcgagatcatggacgtgtcgtcgaacgagctctccggcgagctgcccgagagcatcgggaggctgtcccgtctcaacagcctcaacattggggccaacgggatcggcggggccatcccggcgagcctcggctcgtgctcggcgcttagcacggtcaatttcacacggaacaagctcgccggcgcgatccctgcggagctgggcaacctgccgcggctgaattctttggaagtgtccagcaacgagctgaccggcgccgtgccggcgagcttcgcagcgctgaagctaagctacctgaacttgtccgacaaccggctcagcggccccgttccggaggcgctcgcgatctcggcctacggcgagagcttcatcgggaatcccgggctgtgcgccaccaacggcgccggcttcctccgccgctgcacgccgggctccggaagccggtcggcgaacgccgcgcgcctgatcgtgacctgcatcctcgccgtgacggcggtcctgctggcggtgctcggcgtgaccctatacctgaagaagcggcggcgggcggaggccgaggcggccggcgctctgggctccggcggtgcgaagctgttcgcaaagaagggctcttgggacatcaagtcgttccgggtcctggcgttcgacgagcgcgaaatcatcgatggcgtccgcgacgagaacctgatcggcagcggcgggtccgggaacgtgtaccgcgtgaagctcgggatcggcgcggtggtggcggtgaagcacgtgacccgcgcgcgcgccgccgccgcgagcgcggcggcgacggcggcgatgctgccggcgggccgggcgcggcgcacggcgtcggtgcggtgccgggagttcgactcggaggtggggacgctgagcgcgatccggcacgtgaacgtggtgaagctgctgtgcagcatcacgagcgaggacggcgcggcgagcctgctggtgtacgagcacctccccaacggcagcctctacgcgcggctgcacggggcggaggcgacgaagctgggcgggctcgggtgggcggagcgccacgacgtcgcggtgggcgcggcgaggggcctcgagtacctccaccacggctgcggccgccccatcctgcaccgcgacgtcaagtccagcaacatcctcctggacgagtccttcaagccccgcctcgccgacttcgggctggccaagatcctcagcggcgaggccgactcgtccggcggcgtcgtggccggcacgctcgggtacatggcgccggagtacgcgtacacgtggaaggtgacggagaagagcgacgtgtacagcttcggcgtggtgctgctggagctggtgacggggctgccggcggtggtgccggcggaggagggcagcggcgagagccgggacctggtgggctgggtgtcgcggcggctggagagccgggacaaggtgatgtccctggtggacgcgcgggtcaccgaggggtgggcccgggaggaggccgtgcgggtgctgcgcgtggccgtgctgtgcaccaaccggacgccgtccatgcggccgtcgatgcgctccgtcgtgcagatgctggagg

SEQ ID NO: 31930 - protein, 959 aa, Panicum virgatum
  misc_feature: Ceres CLONE 1908153
  misc_feature (659)..(958): Pfam Name: Pkinase Pfam Description: Protein kinase domain
  misc_feature (24)..(67): Pfam Name: LRRNT_2 Pfam Description: Leucine rich repeat N-terminal domain
  misc_feature (95)..(579): SWISSPROT Homolog: EC 2.7.11.1 Non-specific serine/threonine protein kinase
  misc_feature (714)..(881): SWISSPROT Homolog: EC 2.7.10.1 Receptor protein-tyrosine kinase
MPPAPALPLLLLFLAALATRAAAAAAEVDALLAFKSALTVPPAAAPFFATWDAAAADACGFAGVTCGGAGRRRVTAVSLPGLNVSAASVPFADLCAALQELTLAFNGFDGAIPDLSPLTRLRNLNVSSNRFSGAFPWASLAAMPDLSVLALGDNPFLAPTHAFPPEVTRLTNLTVLYMSAAKIGDPIPPEIGDLVNLVDLELSDNDLTGEIPPTIARLTNLTQLELYNNYLRGDLPPGFRNLTKLQYLDASQNMLTGTLAVLAPLKRLVSLQLFFNYFTGVVPPEFGDFKELVNLSLYSNNLTGELPRSLGSWAQFNFIDVSTNALSGPIPPDMCKQGTMLKLLMLENNFSGGIPATYASCNTLVRFRVSKNQLSGEVPEGMWALPNVNVMDLAGNQFTGTISDGIGNATAMTNLLLAGNRFTGAIPPSIGNAASLEIMDVSSNELSGELPESIGRLSRLNSLNIGANGIGGAIPASLGSCSALSTVNFTRNKLAGAIPAELGNLPRLNSLEVSSNELTGAVPASFAALKLSYLNLSDNRLSGPVPEALAISAYGESFIGNPGLCATNGAGFLRRCTPGSGSRSANAARLIVTCILAVTAVLLAVLGVTLYLKKRRRAEAEAAGALGSGGAKLFAKKGSWDIKSFRVLAFDEREIIDGVRDENLIGSGGSGNVYRVKLGIGAVVAVKHVTRARAAAASAAATAAMLPAGRARRTASVRCREFDSEVGTLSAIRHVNVVKLLCSITSEDGAASLLVYEHLPNGSLYARLHGAEATKLGGLGWAERHDVAVGAARGLEYLHHGCGRPILHRDVKSSNILLDESFKPRLADFGLAKILSGEADSSGGVVAGTLGYMAPEYAYTWKVTEKSDVYSFGVVLLELVTGLPAVVPAEEGSGESRDLVGWVSRRLESRDKVMSLVDARVTEGWAREEAVRVLRVAVLCTNRTPSMRPSMRSVVQMLE

SEQ ID NO: 31931 - DNA, 653 bp, Panicum virgatum
  misc_feature: Ceres CLONE 1908161
  misc_feature: Encodes the peptide sequence at SEQ ID NO. 31932
gtcccacacgcttcccattccactcacaacgcgccggagccgcggatcctgccgccaagaatggaggcatgtccggacgacttccggtgccccatcacgctggaggtcatgaccgaccccgtcatcctcccctctggccacaccttcgagcgccgcagcatccagcgctggctcgacggggggcacctcacctgccccgtcaccaacctcccgctcccgccctccccgccgctcatccccaaccacgcgctgcgccgcctcatagccgccgtcgcgccttcagcggtggccgcccccgtcccctctgaggggcctgcgcaggggagacaagaagcggcggcggcggcggcggttcagtcctcgtcgtccgtgccggcgctgctgaggctggccaagtccggcgccgccggacggagggaggtgctggagtccggaaacgcggcggtgctgctgcggcacgcggcggccggggacgaggcggcggcccgggcgctcctgctcctcaccctggacggcgacgacgcgcgcgtcgggctcgaggcggacggcgccgtcgacgcgctctccgccgcggtacgccgcgatggcgcagtcgccgctctcgcggccacagcgctcaccagcctcgctgccggatacttcaacagatgcag

SEQ ID NO: 31932 - protein, 197 aa, Panicum virgatum
  misc_feature: Ceres CLONE 1908161
  misc_feature (5)..(78): Pfam Name: U-box Pfam Description: U-box domain
MEACPDDFRCPITLEVMTDPVILPSGHTFERRSIQRWLDGGHLTCPVTNLPLPPSPPLIPNHALRRLIAAVAPSAVAAPVPSEGPAQGRQEAAAAAAVQSSSSVPALLRLAKSGAAGRREVLESGNAAVLLRHAAAGDEAAARALLLLTLDGDDARVGLEADGAVDALSAAVRRDGAVAALAATALTSLAAGYFNRC

SEQ ID NO: 31933 - DNA, 705 bp, Panicum virgatum
  misc_feature: Ceres CLONE 1908171
  misc_feature: Encodes the peptide sequence at SEQ ID NO. 31934
  misc_feature (633)..(633): n is a, c, t, g, unknown, or other
actcaaactgcagctgcttgctcgggatagagatgcgcctgtttagctgtttaacactccggccggctcatctccttgtccctaattttgcatagccttacaacctgcaagtcataattctgcatatgtgcagtcctttgttgttgactaaagttcaagtattttgccattcaagcagatgtatccaccgacggacactggtgttttgtggtgttctgggtcgtgccccgctcctcatccatcaaaatccggtgggcgagcctcaagaaccgcctcatgtccatgtgcccttcctcatactcagtccctttctaccctgaaatcagccagccagggccccccaagttctacctcctcaagctcatgctacctgaccgcaaaggactgttacatgacgtgacacatatactatcggagctggagcttttaatccacagagtgaaggtgtccaccacgcctgatggaagagttgtggatctcttctttatcactgacggcatggagctgttacatacgaaagaaaggcaagaagagacttgctcaacgcttattgctaccttgggtacttccataagctgtgaggttctgtcagcagaagggttccagcaaggattctcttctcttcctccgaanactgctgaggaactattcagggtggaactagctgacagtgagatctgctcaagttcacttagtgcagagttg

SEQ ID NO: 31934 - protein, 142 aa, Panicum virgatum
  misc_feature: Ceres CLONE 1908171
  misc_feature (25)..(89): Pfam Name: ACT Pfam Description: ACT domain
  misc_feature: SWISSPROT Homolog: EC 2.7.7.59 [Protein-PII] uridylyltransferase
  misc_feature (119)..(119): Xaa is any aa, unknown, or other
MSMCPSSYSVPFYPEISQPGPPKFYLLKLMLPDRKGLLHDVTHILSELELLIHRVKVSTTPDGRVVDLFFITDGMELLHTKERQEETCSTLIATLGTSISCEVLSAEGFQQGFSSLPPXTAEELFRVELADSEICSSSLSAE

SEQ ID NO: 31935 - DNA, 733 bp, Panicum virgatum
  misc_feature: Ceres CLONE 1908173
  misc_feature: Encodes the peptide sequence at SEQ ID NO. 31936
agaccacatagtagccaagcatcagcgtagagagaggagatggcggcgttagcggcggcgggcggcggcggcgagaggtggagcctcgccggcgcgacggcgctggtcaccggcgggagcaaggggatcgggcacgccatcgtggaggagctggcgcggctcggcgcgcgcgtgcacacgtgctcccgcaacacggcggagctggaggagtgccgccgccggtgggccgacaagggcctgcaggtcactgtctccgtctgcgacgtcgctgtgcgcgccaacagggcgaagctcatgggcacggtcggggacaccttcgccggcaagctcgatatcctagtgaacaacgcggcacaggtggtggccaagccggcggtggagtgcacggcggaggactactccggcctcatggcgaccaacctggagtcgtgcttccacctcagccagctcgcgcaccctctcctccggaactccgccatcgccggcgggggaagcatcgtgcacatctcctccatcgctagctatctgggctatccgggtgccgtgctctacagcatgtccaaaggaggaatgaaccagctaacaagaagcctggctgccgagtgggcccgcgacagcattcgtgtgaactgcatcgcaccaggcctggtcatgactgacatgatgacgaaagcggttggtatacaagacctgggagtcgtggagcaagaatttttaccgaaaattccattgc

SEQ ID NO: 31936 - protein, 231 aa, Panicum virgatum
  misc_feature: Ceres CLONE 1908173
  misc_feature (19)..(190): Pfam Name: adh_short Pfam Description: short chain dehydrogenase
  misc_feature: SWISSPROT Homolog: EC 1.1.1.206 Tropine dehydrogenase
MAALAAAGGGGERWSLAGATALVTGGSKGIGHAIVEELARLGARVHTCSRNTAELEECRRRWADKGLQVTVSVCDVAVRANRAKLMGTVGDTFAGKLDILVNNAAQVVAKPAVECTAEDYSGLMATNLESCFHLSQLAHPLLRNSAIAGGGSIVHISSIASYLGYPGAVLYSMSKGGMNQLTRSLAAEWARDSIRVNCIAPGLVMTDMMTKAVGIQDLGVVEQEFLPKIPL

SEQ ID NO: 31937 - DNA, 648 bp, Panicum virgatum
  misc_feature: Ceres CLONE 1908180
  misc_feature: Encodes the peptide sequence at SEQ ID NO. 31938
cccccagctcgccactcccctctccatctcgggctctcgtctctcccagctcgtcatctccatctcgccgccgtctcctctgccctcctcgcgccggcgccggaccaaggagcgctgaggcagacgcgccatgctccccacgccgtcctccgcgtcggcgtcgctggcgccggcggccccgcagcaggggctcctccccagcggcgcatggacgtcggacggcgccgccgcctcgcggcaccagctggccatcagcaacggggtgctcctggccgcggtcatcttcctcttcatggtcgtcgtcttcgtcttcctgctctacctctacgccaagcgctacctgggcacctccaacccgctgctggcgccgtccacgccgtcctcccgcttcctcttcgtcgccgcgtccccgctcccgcagcgcggcctgcccgccgccgtcctccgctccctccccgtcacggtctacggcgccgccggctcccccgcctcccccggcaaggagcggctcgagtgctcggtgtgcctgtccgaggtggccgacggcgagaagctgcggacgctgcccaagtgcgcgcacggcttccacgtcgagtgcatcgacatgtggttccagtcccacgacacctgcccgctctgccgcgcccc

SEQ ID NO: 31938 - protein, 172 aa, Panicum virgatum
  misc_feature: Ceres CLONE 1908180
  misc_feature (129)..(170): Pfam Name: zf-C3HC4 Pfam Description: Zinc finger, C3HC4 type (RING finger)
MLPTPSSASASLAPAAPQQGLLPSGAWTSDGAAASRHQLAISNGVLLAAVIFLFMVVVFVFLLYLYAKRYLGTSNPLLAPSTPSSRFLFVAASPLPQRGLPAAVLRSLPVTVYGAAGSPASPGKERLECSVCLSEVADGEKLRTLPKCAHGFHVECIDMWFQSHDTCPLCRA

SEQ ID NO: 31939 - DNA, 1336 bp, Panicum virgatum
  misc_feature: Ceres CLONE 1908181
  misc_feature: Encodes the peptide sequence at SEQ ID NO. 31940
cgccgccgctgcaccaccactcccccacaccaggcaccagtccacactccccaccgcgtggcgagcgagtgaccgggctccctgtcctccgctccactcccgccgcgcgcgctggtccgggcgagcctgggctgggtctgctctggctctcggttgatgcagcagcggggcctcgcccacaaccgccgctcccgcggcttctcccgctcccgcctcgccgtcgagggcgcctaaacgcacgaatccccccaacgcggcgctcacccccaacaaaaaaaaacaaagctttctattaactggagaacgaaagagaacagagaaaacaccgtcgagatggacgccgccggccgcgcccccgtgatggccgtcgcgaatgggatcggcgaggtggagcggaaggtgcagaagagctactgggaggagcactccaaggacctcaccgtcgagtccatgatgctcgactcccgcgccgccgacctcgacaaggaggagcgccccgagatcctgtcgttgcttccatcctacaaagggaaatcagttctagagcttggtgctggaataggacgctttactggagatctggcaaaagaagctgggcacattctagcactggattttatagaaagtgtgattaagaagaatgaaagcataaatggacacaacaagaacataactttcatgtgtgctgatgtaacatctcctgacttgaagattgaagacaactcctttgatctgatattttcaaactggctattaatgtacctttcagatgaggaggttgagaagcttgtggggaaaatggtaaaatggttaaaggtaggtggccatatattctttagagaatcatgttttcaccaatctggagattcgaaaagaaaagtgaacccaacacactacagagaaccaaggttttatactaaggtatttaaagagggccattcatatgataaaagtggaaattcttttgaactttctctagtgacttgtaagtgtattggggcttatgtcaaaaataagaagaatcaaaaccagatttgttggttatgggaaaaggtaaaatcaacagaagacagagattttcaaagattcctggacaacgtgcaatacaaaactagtggaatcctacgttatgagcgaatctttggtgaaggttatgtgagcactggtggagtcgagactactaaggaattcgtgggtatgctggatcttaaacctggccagaaagtacttgatgttggatgtggaattggaggaggcgacttttatatggctgagaactatgacgtccatgttcttggtattgatctttccattaacatggtttcatttgcaattg

SEQ ID NO: 31940 - protein, 334 aa, Panicum virgatum
  misc_feature: Ceres CLONE 1908181
  misc_feature (70)..(168): Pfam Name: Methyltransf_11 Pfam Description: Methyltransferase domain
  misc_feature: SWISSPROT Homolog: EC 2.1.1.103 Phosphoethanolamine N-methyltransferase
  misc_feature: The sequence is a functional homolog of SEQ ID NO 40 in US patent 7151202
MDAAGRAPVMAVANGIGEVERKVQKSYWEEHSKDLTVESMMLDSRAADLDKEERPEILSLLPSYKGKSVLELGAGIGRFTGDLAKEAGHILALDFIESVIKKNESINGHNKNITFMCADVTSPDLKIEDNSFDLIFSNWLLMYLSDEEVEKLVGKMVKWLKVGGHIFFRESCFHQSGDSKRKVNPTHYREPRFYTKVFKEGHSYDKSGNSFELSLVTCKCIGAYVKNKKNQNQICWLWEKVKSTEDRDFQRFLDNVQYKTSGILRYERIFGEGYVSTGGVETTKEFVGMLDLKPGQKVLDVGCGIGGGDFYMAENYDVHVLGIDLSINMVSFAI

SEQ ID NO: 31941 - DNA, 652 bp, Panicum virgatum
  misc_feature: Ceres CLONE 1908181-R
  misc_feature: Encodes the peptide sequence at SEQ ID NO. 31942
aacgtaccattggacgcaagtgctcggttgagtttgaggttgctgattgcaccacaaaggattacccggaaaatagttttgacgttatctacagccgtgacaccatccttcacatacaagacaagcctgctttgttcagaagcttcttcaaatggctgaaacccggtggcaaagtcctaatcagtgactactgtaagaatcctgggaaaccatcagaagaatttgctgcgtacattaggcagagaggttatgaccttcatgatgtgaaggcttatgggcagatgcttgagaatgctggttttcatgacgtcatcgcggaagaccgcactgaacagttccttagtgttctacggagggagctagctgaggttgaaaagaacaaagaggctttcctagcagacttcagccaggaggactacgacgacatcgtgaacggctggaacgcgaagctgaaacggagctctgccggtgagcagaggtggggtctgttcattgctaccaagtgattcagcctgcctggcaccggatggggctctatcttccgaataagaatggctgtggtcgtggcttctgcttctagatcggtgattcggcctagaagtagagaatcttcagaataaaaatgggtgctgctcgtgttgttgttgttgtt

SEQ ID NO: 31942 - protein, 167 aa, Panicum virgatum
  misc_feature: Ceres CLONE 1908181-R
  misc_feature: SWISSPROT Homolog: EC 2.1.1.103 Phosphoethanolamine N-methyltransferase
  misc_feature: The sequence is a functional homolog of SEQ ID NO 40 in US patent 7151202
RTIGRKCSVEFEVADCTTKDYPENSFDVIYSRDTILHIQDKPALFRSFFKWLKPGGKVLISDYCKNPGKPSEEFAAYIRQRGYDLHDVKAYGQMLENAGFHDVIAEDRTEQFLSVLRRELAEVEKNKEAFLADFSQEDYDDIVNGWNAKLKRSSAGEQRWGLFIATK

SEQ ID NO: 31943 - DNA, 677 bp, Panicum virgatum
  misc_feature: Ceres CLONE 1908190
  misc_feature: Encodes the peptide sequence at SEQ ID NO. 31944
gagtctccccccttcccccgtcccgtgttcctcgctcccccaaatccctcgccacgatggcccgcctcctcctccccctccccttcgccgccgccgcggcggcctccgcctcctcctcgctccacctcgcggcctcgcgcctccgcctccccgcggtctccgtggcgcggcgcgagggcctgttcgggggaagggcggtgggaggagcggtgagggcgcccgcgaggctggcgaggcgcgggctgtgcgccggcgcggagcccggcggctctgccggcacggcggtcagccaggaggaggccttggagtgggccaagaaggaccggaggcgcctgctccacgtcgtctaccgcgtcagcgacctcgacaagacgatcaagttctacacggagtgcctgggcatgaagctgctgcgaaagagggacatcccggaggagaggtacaccaatgcctttctggggtacggacctgaggattcacattttgttgtggagctcacttacaattatggtgtggagagctatgatatcgggactggtttcggccatttcgggattactgttgatgatgttgcaaaaactgtggaccttattaaagcaaaaggaggaacagtaacaagggagccaggtcctgtcaaaggtgggaaatcagtaattgcctttattgaggatcctgat

SEQ ID NO: 31944 - protein, 206 aa, Panicum virgatum
  misc_feature: Ceres CLONE 1908190
  misc_feature (92)..(206): Pfam Name: Glyoxalase Pfam Description: Glyoxalase/Bleomycin resistance protein/Dioxygenase superfamily
  misc_feature: SWISSPROT Homolog: EC 4.4.1.5 Lactoylglutathione lyase
MARLLLPLPFAAAAAASASSSLHLAASRLRLPAVSVARREGLFGGRAVGGAVRAPARLARRGLCAGAEPGGSAGTAVSQEEALEWAKKDRRRLLHVVYRVSDLDKTIKFYTECLGMKLLRKRDIPEERYTNAFLGYGPEDSHFVVELTYNYGVESYDIGTGFGHFGITVDDVAKTVDLIKAKGGTVTREPGPVKGGKSVIAFIEDP

SEQ ID NO: 31945 - DNA, 693 bp, Panicum virgatum
  misc_feature: Ceres CLONE 1908207
  misc_feature: Encodes the peptide sequence at SEQ ID NO. 31946
ggatcactggcctgcgaggcactgctgtgaacgtgcagtccatggtgttcggcaacatgggggacacttctggtactggtgtgctcttcaccaggaatcctagcactggagaaaagaagctgtacggcgagttcctggtgaatgctcagggtgaggacgtggttgctggaatcagaaccccagaggatcttgatgccatgaaggcccagatgccgcaggcttatgaagagctagttgagaactgcaatatattggagagccactacaaagacatgatggatattgaattcactgttcaggaaaataggctctggatgttgcagtgcagatcagggaaacgcacaggcaaaggagctgtaaagattgctgtggacgtggtcaatgagggtcttgttgatcgccgttcagccattaagatggtagagccaggccacctggaccagcttctccatcctcagtttgagaacatagcagcatacaaggatcaagtaatcgctacaggattgccagcttcacctggggctgctgtgggccagattgtatttactgctgaggacgctgaagcatggcatgcccaacggaaaccttgtattctggtgaggacagagaccagcccagaggatgttggtggcatgcacgcagcagttgggattcttacagcaaggggtggcatgacctctcatgcagctgtgg

SEQ ID NO: 31946 - protein, 230 aa, Panicum virgatum
  misc_feature: Ceres CLONE 1908207
  misc_feature (1)..(134): Pfam Name: PPDK_N Pfam Description: Pyruvate phosphate dikinase, PEP/pyruvate binding domain
  misc_feature (185)..(230): Pfam Name: PEP-utilizers Pfam Description: PEP-utilising enzyme, mobile domain
  misc_feature: SWISSPROT Homolog: EC 2.7.9.1 Pyruvate, phosphate dikinase
ITGLRGTAVNVQSMVFGNMGDTSGTGVLFTRNPSTGEKKLYGEFLVNAQGEDVVAGIRTPEDLDAMKAQMPQAYEELVENCNILESHYKDMMDIEFTVQENRLWMLQCRSGKRTGKGAVKIAVDVVNEGLVDRRSAIKMVEPGHLDQLLHPQFENIAAYKDQVIATGLPASPGAAVGQIVFTAEDAEAWHAQRKPCILVRTETSPEDVGGMHAAVGILTARGGMTSHAAV

SEQ ID NO: 31947 - DNA, 758 bp, Panicum virgatum
  misc_feature: Ceres CLONE 1908223
  misc_feature: Encodes the peptide sequence at SEQ ID NO. 31948
  misc_feature (601)..(601): n is a, c, t, g, unknown, or other
ctccttcctgcggcggcggccgatttcggggggcaattcgctatagcagatttcaacgaagggaaggaaccgaccggcgattcgctccgatcagatctgattctccatgatgcccttcaagaaggaattcaccttcgatgagaggctccaggaatccgccgccatgatcgccaactaccccgccagggtccccgtcatcgttgaaaggttttcaaggagtaatttaccagaaatggagaaaaggaagtacctggttccctgtgacatgcctgttgggcagttcattttcatactacggtccaggttacacctatctccaggaacagcgttatttgtgtttgtaaacaacactttaccccaaacagctagcctaatgggaagtgtatatgactcgtacaaggataaggatgatttcctatacatgtgctacagcagcgagaagacatttggctgccctggcctgacctgacgtaaaaatttgctttgcggtcaggtaagcccctgcatgtgatcacctctgtacgactgtacatataaaattgtcgggtactatgattaggggcaccctaatcaagggactaaaatcaccctaaaaacgcanacacatgctgggcaaccaggcccacgaaggcctacagcctccttccaattttgtgatcagggcagcattattcttacttttaccttgttattacacgtactgaagcgtttttttatggcgagtagtgctagttatccctgggtatcgtagcatgacc

SEQ ID NO: 31948 - protein, 120 aa, Panicum virgatum
  misc_feature: Ceres CLONE 1908223
  misc_feature (12)..(115): Pfam Name: MAP1_LC3 Pfam Description: Microtubule associated protein 1A/1B, light chain 3
  misc_feature: Useful for making plants with modulated nitrogen use efficiency
MMPFKKEFTFDERLQESAAMIANYPARVPVIVERFSRSNLPEMEKRKYLVPCDMPVGQFIFILRSRLHLSPGTALFVFVNNTLPQTASLMGSVYDSYKDKDDFLYMCYSSEKTFGCPGLT

SEQ ID NO: 31949 - DNA, 638 bp, Panicum virgatum
  misc_feature: Ceres CLONE 1908250
  misc_feature: Encodes the peptide sequence at SEQ ID NO. 31950
ggccggtgagggcgcgcgcgcggtgaagaaccaagccgagaccgacgaccggccatggcgagggcggggtggggctcgctcttcggctgcttcggctcctcctcctcatcctcctcccatggcggcggcggcgggaagaagggcgggaagaagaagaagaagagcaagaagaagcccaaggtgacggcggcggcgggcggtggcagcagcagcgggaagaagccgcgtctgcagagccggctgtcgttcacggagctgagcgggatggtgtcgcccgaggacctgtcgctctcgctggtgggctccaacctccacgtcttcaccatcgccgagctgcgcgccgtcacccgggacttctccatgaccaacttcatcggcgagggcggcttcggacccgtctacaagggctacgtcgacgacaagaccaagccaggcctgcgcgcgcagcccgtcgccgtgaagctgctcgacctcgagggctcccagggacacaccgaatggctgaccgaagtcatcttcctggggcagctgcggcaccctcatctcgtgaagctcatcggctactgctacgaggacgagcaccggctgctcgtctacgagttcatgaccaggggcagcctggagaaacatctcttcaa

SEQ ID NO: 31950 - protein, 194 aa, Panicum virgatum
  misc_feature: Ceres CLONE 1908250
  misc_feature: SWISSPROT Homolog: EC 2.7.11.1 Non-specific serine/threonine protein kinase
MARAGWGSLFGCFGSSSSSSSHGGGGGKKGGKKKKKSKKKPKVTAAAGGGSSSGKKPRLQSRLSFTELSGMVSPEDLSLSLVGSNLHVFTIAELRAVTRDFSMTNFIGEGGFGPVYKGYVDDKTKPGLRAQPVAVKLLDLEGSQGHTEWLTEVIFLGQLRHPHLVKLIGYCYEDEHRLLVYEFMTRGSLEKHLF

SEQ ID NO: 31951 - DNA, 1367 bp, Panicum virgatum
  misc_feature: Ceres CLONE 1908253
  misc_feature: Encodes the peptide sequence at SEQ ID NO. 31952
ctcgcgttccgtcacggcctgcccgcctcctcgcccgccatcgctcctcgcggcatcgcctcctcccctcccttccccctttccccccacgcgaataaaggcgccggaggcaacgcgcgcaccaagcaaagtctcccccgcgcgcgggatcgggagggagggcccccggcggagaagctgcgcgctagggcaggttaggccagggaggtcccggccgtctcgctcccgcggcgggcgaccgatgcgcggcgcatggcggcggtgaactgcctctacgtcgcggccgcctccacggcggccagcgccgccgcgctgcagtggtgggcgtcctcgcttctcgacggcgaggccggggcgggcgaggacggggactggctcggggccgtgctgcggtcgcgggtcaccgtcgcgctcctcgcgaatctggcagcgcacgtgttcctcgtcgccatcctcgcgctcaagactttattttttgttcagctaacttctttagagacaagaaaagtattggaacacatcattaactatgtaatttacaagggtacttttctcccactggttgtgcctcctagctctcaacaaattatcctttggtcaacttggttgatcattctttgttcactgaasatatttcaatcattggccagagaacgtcttgaacagctcaatgcgtctccctcagcgactccatcaaaatattttcgtgtgtactctgcgttgcttttggttttatcagctgatctgctatggatgaaattttgtgttgggttctgcagctcttgtaattccaagttattttggctcttgttctttgagccacttagtattgcctttgatacactgcagtctatcatggtgcatgggttccagttattcgacatctggcaacggcatctaatggaaagtggcgctgactttcttgatttccaaaaatcttataagcatgcagcaggatctttttctgaatggaggggcaagcttaccaggaattttggttttgcaattgacttgataagtttgttgatgtcacttggtcattactcgatgatcttttggctacgtggtatggcatttcatctggttgatgtagttctcttattgaacttgcgtgctcttattgtttcatttttgaagaggattaagacttatatcaagttacggaaggctcttagttcactcgatggagcacttccagatgctacatatgatgaaatttgcgcatatgatgatgagtgtgccatctgcaggggaccaatggctcgagctaaaaaattgtccctgcaccatctgtttcatctagcttgtttgcgatcatggttggatcaaggactaatggaaggttactcctgtccaacttgtcggag

SEQ ID NO: 31952 - protein, 371 aa, Panicum virgatum
  misc_feature: Ceres CLONE 1908253
  misc_feature (329)..(370): Pfam Name: zf-C3HC4 Pfam Description: Zinc finger, C3HC4 type (RING finger)
  misc_feature: SWISSPROT Homolog: EC 6.3.2.19 Ubiquitin--protein ligase
  misc_feature (126)..(126): Xaa is any aa, unknown, or other
MAAVNCLYVAAASTAASAAALQWWASSLLDGEAGAGEDGDWLGAVLRSRVTVALLANLAAHVFLVAILALKTLFFVQLTSLETRKVLEHIINYVIYKGTFLPLVVPPSSQQIILWSTWLIILCSLXIFQSLARERLEQLNASPSATPSKYFRVYSALLLVLSADLLWMKFCVGFCSSCNSKLFWLLFFEPLSIAFDTLQSIMVHGFQLFDIWQRHLMESGADFLDFQKSYKHAAGSFSEWRGKLTRNFGFAIDLISLLMSLGHYSMIFWLRGMAFHLVDVVLLLNLRALIVSFLKRIKTYIKLRKALSSLDGALPDATYDEICAYDDECAICRGPMARAKKLSLHHLFHLACLRSWLDQGLMEGYSCPTCR

SEQ ID NO: 31953 - DNA, 602 bp, Panicum virgatum
  misc_feature: Ceres CLONE 1908253-R
  misc_feature: Encodes the peptide sequence at SEQ ID NO. 31954
agtgcagtgaggccggtaggtctaaccggagttcagatgatgatgaggcagttggcttctgtgaccgacaattatggtcatgctgatggcacctggaacctatggcctgagacaatggcagggtcctctcttgttccatccacttcctcggttcctgataatgcagctgccgctggattgcggctccgaggcactgtaggtactactcgcaatggaagtctttctgaggtactcaccatggtagatagagtacgggaagttttacctcatatccctgatgagttaattatagaggatttgatgaggacaaataacataaatgctactgtgaataatctgctgctgatgcaatagtagagatgtcgacaatactacatataagtatgatgtttactggctataaaagcttacaagaaaagactgtatagttaaaggcgagcatgggtgtactctttggttctgtaataaaggccctttttccccgttgcttttgttaccagtggtttgtatagcaaccatagttgtataatatcatgctcgatatgctgtaggttagtgtatgtagaaggatgttaccatcgtaataaaatttgttttggggc

SEQ ID NO: 31954 - protein, 117 aa, Panicum virgatum
  misc_feature: Ceres CLONE 1908253-R
  misc_feature (76)..(117): Pfam Name: CUE Pfam Description: CUE domain
SAVRPVGLTGVQMMMRQLASVTDNYGHADGTWNLWPETMAGSSLVPSTSSVPDNAAAAGLRLRGTVGTTRNGSLSEVLTMVDRVREVLPHIPDELIIEDLMRTNNINATVNNLLLMQ

SEQ ID NO: 31955 - DNA, 2271 bp, Panicum virgatum
  misc_feature: Ceres CLONE 1908254
  misc_feature: Encodes the peptide sequence at SEQ ID NO. 31956
aaagcgcggcgctgcagatttcgatccggttcccaatgcctcccaggcccgtcgtcctgtagctcccgcctccgcttctccatctgccgcggcggccagggaacggcgcctggatccggcgagcgcctggcctgaagccccagatccgagcgaagacgagctttccgtggcggcctctcggctctagctcgggggttggcagctgccattgcccccctccccttcttcttcgagatttcaaggccggtctgtccatctttggtggcatttgaggttgttcgtggtttttcttcgatttagtttgcctctgcatggtccagatttagctgcattccccggattgtgctcctccgtgacaaaaatctaagcttgtttcctcggaagtgtcttgctatcgcattagagtagcgttagatctttttggttagtagccctggttcttgctccatcatgtgctaatcttggtacattggcgacgagctctactgttgccatggtgttggtgtgaaaaaaagggttttatttttatcgaagatgtggaaacaatttctcagcaagctgccccggaagtccccggcctccggggactcaggtcagtgcagcaatggcaccgggatacagcgcacaaccagctgtggaagcatcccgcctggccggccggcttccgccattaggcgcatgtcgtctgccgtcttcccctcaagtgttgtggctggcattgagccgttggtttccttcaaggatgtcccaaactcggagaagcagaacctgtttgtgagcaagttgagcctgtgctgtgtcgtctttgatttctcagacccgaacaagagttcggtggagaaggatatcaaaaggcaggcattgttggatcttatagagtttgttgaatctagcagcgctcgcttctcggaggcggcgattgctgcctgtgctaggatgtgtgccatcaacctgttccgggcattccctccaaattacaggtctggttcatctggtggtggtgagggtgatgaggacgaaccgatgtttgatcctgcatggtgtcatctgcagcttgtgtatgagctactgctgaaatttattggatcctcatccttggatgcgaaggtagggaagaagcactttgatcattcattcattgtgaagctccttaatcttctcgattccgaggatccaagagaaagggattgtttgaagaccatcctgcacagggtatatgggaagtttatggtacaccgtcctttcatccgcaaagcagtgagcaatatattctaccagtttgtctttgagactgatcggcataatgggatcgctgagctgctggaggtatttggcagtgtcattagtggctttgcattgcctttgaaggaagaacacaagatctttctttggagagttttgattcctttacacaaaccgaaatcagttggtttgtatctccagcagttgacctactgtgtgacgcagtttctagaaaaggacccgaaacttgcaagctcagtaataattggtttgttaagatattggccaataacaaattgtcagaaggaagtgatgtttcttagtgagatcgaagagatcttggagtctaccagccaggcagaatttcagaaatgtatggttccattgtttcggcggattgctcattgcatcaccagttctcatttccaggttgctgaaagagcactctttgtatggaacaatgatcacattatcagcttgattgcgcaaaaccgccaagcgataatgccactcgttgttccagcactagaacagaatattcagaatcactggaaccaagcagtcctgaatctgacaatgaatgtaaaaaagatgttttctgagatggacgaggatctcttctcatcatgcctggataaatacaaggaggacgaagaaaagcgagcgtcgttagaagtgaagcggaagctgacctgggagaagcttgagtcagctgcagctttccagccagtgaccggccatacagccgtcctagtaggacaccagctgtccgcaaaaatgatcgccaccctgatctagcttatgccttatgcatgcgggggagaatcaacggtgctcttcacccttttggcgaagtgcagcaagtgtagcgtttgctatttggttcttgtttatttttccatttgtcagtatgagtaatcagtgttgtaagttgtaactattttcatatgtttatgctctctaggcaagcatacctgtaatgtaagactgctgagtgctggcactctttacatgtaaccttgcctgcct

SEQ ID NO: 31956 - protein, 501 aa, Panicum virgatum
  misc_feature: Ceres CLONE 1908254
  misc_feature (64)..(476): Pfam Name: B56 Pfam Description: Protein phosphatase 2A regulatory B subunit (B56 family)
MWKQFLSKLPRKSPASGDSGQCSNGTGIQRTTSCGSIPPGRPASAIRRMSSAVFPSSVVAGIEPLVSFKDVPNSEKQNLFVSKLSLCCVVFDFSDPNKSSVEKDIKRQALLDLIEFVESSSARFSEAAIAACARMCAINLFRAFPPNYRSGSSGGGEGDEDEPMFDPAWCHLQLVYELLLKFIGSSSLDAKVGKKHFDHSFIVKLLNLLDSEDPRERDCLKTILHRVYGKFMVHRPFIRKAVSNIFYQFVFETDRHNGIAELLEVFGSVISGFALPLKEEHKIFLWRVLIPLHKPKSVGLYLQQLTYCVTQFLEKDPKLASSVIIGLLRYWPITNCQKEVMFLSEIEEILESTSQAEFQKCMVPLFRRIAHCITSSHFQVAERALFVWNNDHIISLIAQNRQAIMPLVVPALEQNIQNHWNQAVLNLTMNVKKMFSEMDEDLFSSCLDKYKEDEEKRASLEVKRKLTWEKLESAAAFQPVTGHTAVLVGHQLSAKMIATLI

SEQ ID NO: 31957 - DNA, 1451 bp, Panicum virgatum
  misc_feature: Ceres CLONE 1908307
  misc_feature: Encodes the peptide sequence at SEQ ID NO. 31958
attcacaccagtttcaattgctcgctcgcacgcacgcgcaaacgccgcctcttcctcctcccgtcctccccccactcgccgcacccgtttccccagatcccaaggaacgaacccaccccgctcgccgcgggcatcttcccgaacacccagcgcgcgcgcgggcgctcccccgccgccgcccatgggctccctcccggttaacgcctcgccggaatgcgccccgcaggggcgcgccacggtgtcggcgtcggacctggcgccgctcttctccgcgcagcgccggcacctggaccacttcttcgaccgcctcgacatgtcgcaggcggcggcgttcgcgcaggcgctgctcgacgcgcccggggccgtcttcttcacgggcgtcggcaagtccggcatcgtggcgcggaagatcgcgcagacgctggcgtcgctgggcttcgcgcgggcaggattcctggcccccgtcgacgcgctccacggcgacatcggcgcgctcttcccgggggacgtcctcgtgctgctctccaagtccggcgcctccgacgagctgctcgcgctcgcgccctgcgcgcgcgccaagggcgcctacctcatctcgctcacctcggcggcgtcgggggccgactgcccgctcgccgccgcctgcgacctcaatgtgcacctgccgctgcagggggaggtctgccccttcggcctcgcgcccgtcacctccaccgccatccagatggtgttcggggacaccgtcgtcgccgccatcatggaggcgcgccgactctccagggaccagtacgcctgcaaccaccccgccggcaagattggcaagaccctcatcttcaaggttaaagatgttatgaagaaacagaatgaacttcctctgtgcaaggagggagatatgataatggaccaactcacagagctcaccagtaaaggttgtgggtgtctgcttgtggttgatgaagagcatcatttgattggcaccttcactgatggtgatctccggcgtacattgaaggcaagcggcccagctattttcaatctcacagttggagagatgtgcaacaggaatccaaggacaatcactgccgatgcaatggcagtcgaagccatggagaagatggaatcacgtccttcacctgtgcagttcttgcctgtcgtcgacgacaacaacgtcatgtgtgggatcattacactgcacggattggtctctgctggattgtagacttctgtggcatcatcaccttctgctggattacaaatttctgtaccagcttactgggttcttaatgattccgtttgtctacgtctatttggctctagactgccaattgcatgtattcttgccgttcagtttatacctgaacgtgttctgtcgctacagtattgtgtgtagcctagactgtcagtgtacccatatgtatagtgcatgataagaggaatatgcccgtgtaccc

SEQ ID NO: 31958 - protein, 345 aa, Panicum virgatum
  misc_feature: Ceres CLONE 1908307
  misc_feature (224)..(345): Pfam Name: CBS Pfam Description: CBS domain pair
  misc_feature (54)..(191): Pfam Name: SIS Pfam Description: SIS domain
  misc_feature: SWISSPROT Homolog: EC 5.3.1.13 Arabinose-5-phosphate isomerase
MGSLPVNASPECAPQGRATVSASDLAPLFSAQRRHLDHFFDRLDMSQAAAFAQALLDAPGAVFFTGVGKSGIVARKIAQTLASLGFARAGFLAPVDALHGDIGALFPGDVLVLLSKSGASDELLALAPCARAKGAYLISLTSAASGADCPLAAACDLNVHLPLQGEVCPFGLAPVTSTAIQMVFGDTVVAAIMEARRLSRDQYACNHPAGKIGKTLIFKVKDVMKKQNELPLCKEGDMIMDQLTELTSKGCGCLLVVDEEHHLIGTFTDGDLRRTLKASGPAIFNLTVGEMCNRNPRTITADAMAVEAMEKMESRPSPVQFLPVVDDNNVMCGIITLHGLVSAGL

SEQ ID NO: 31959 - DNA, 674 bp, Panicum virgatum
  misc_feature: Ceres CLONE 1908318-R
  misc_feature: Encodes the peptide sequence at SEQ ID NO. 31960
agagtggaagaaaaagacagttgaatcaaaatcttcgtcctggggctttgccgaagcaaagtgcatatctaagattgagagagaggatgcaaaaattaccgcatgggagaatattcaaaaagcaaaagctgaggcagcaattcagaagttagtgattaagctcgagaagaaaagatcgtcttcgctggacaagattttgaacaccctcaagtctgctcaaagaaaagcgcaggtgatgcgtgagcgtgatgcagcaacagcaaaccaagatgaaaaaggctctaggaagggaaaaaaggcagcacagcttagcaagaatggccaaatcagttcactgagtggctgtttcacttgccatgctttctgatacatgtgcttccaccccataatagagagttggaacctgaggaattccttcctattctctccaacaaaaccagggtgaagttcatagatccatcacatttcagtacaaaatagcgatacatctgcatgtggagcttacgtactcaaatcttcagaagatgctagctgcagctgctatgatagggaccaggcaatatctacagttctgctctgtgttaagcccctatttagatccaaaacggaaaatgcaatttttttttaaatcgcttgcatggtgctaaatgtagtcgaaaaataaatcgcatgac

SEQ ID NO: 31960 - protein, 121 aa, Panicum virgatum
  misc_feature: Ceres CLONE 1908318-R
  misc_feature (2)..(114): Pfam Name: Remorin_C Pfam Description: Remorin, C-terminal region
  misc_feature: The sequence is a functional homolog of SEQ ID NO 933 in the 11/479,226 US patent application
EWKKKTVESKSSSWGFAEAKCISKIEREDAKITAWENIQKAKAEAAIQKLVIKLEKKRSSSLDKILNTLKSAQRKAQVMRERDAATANQDEKGSRKGKKAAQLSKNGQISSLSGCFTCHAF

SEQ ID NO: 31961 - DNA, 1334 bp, Panicum virgatum
  misc_feature: Ceres CLONE 1908318
agtggtaagcacaacgctgtaaccagctcacactttggattcttactagtgtctcaatcggcctgagagcaacctgatagccctttaaaacgagttgggttcataagcttctgcagccttcacggagcggcaggacgacgaggaggtgctatgcggggtgaaggaagaggagtgggcgaaggtacaagaaccggccaaaaatccggcaggccgttccaccccaggtactgtgttagttttcagtcctcaattggctgggttgtgcgaagttgtcattttttgtatgcttgtatgctgttcgacagaatgccacaaccagcagcaccgaacggaggctactgttcttttgcacagtaggaagggatcgaaacagcggccagcctcgctcgacttcggtagccctgggttccatggagccacattttcaccgaatttcgtggttggtggtgtgggtttgatgaataagggacttgtagcatcacacatcaggtcagacgtgtttcatagtcctggaacaccgaactattcgcggcaccgtgcatcagtgttggggttccagaaagggtggtgctctgagagagtgccgcatccttccaaaggaagtagaaggtaccctgggagcagcatggcatttccttacagcagtgggaggacattgccctcgaaatgggaggacgcagagaggtggatattcagtcctaattccagtgaagctctcggaagaagcacggttgctcatgctcggcaaccaaagtctaaaagtggccctctgggacctccgggaagacttggcggacagtattcatctgtttcttcagtgtcactgcttgacagtgggagagctggacctattacatcaaattcaccttttgtggcaggagtactaatgccagaacatgtttgtggagggaagaatgcaaatggaacatattcgggtagaccagctggtgatgaaaccactattggaagcaatgtcaggttttgtccaccgaatggtggatctcatgctattcgatcttccagagttcgtcgtcgattagatgctgccattgaatcatcttcttcattgcctagcaccagagaatctatccaaggtgagcaggttgaaatcacagaagattcggctactactttcgcctcgatgatttccaggaaagatgctgcaactcaaactagcccagagctaagtaggtcctcttcgcccaacaacactagaccaacatttacccgttcgcggtcgacgcaacaagtcaaagagagcgagagctgtttctcagatcttgagatcagggatgttcagatggatgatcgagtgactctgactaggtggtcaa

SEQ ID NO: 31962 - DNA, 598 bp, Panicum virgatum
  misc_feature: Ceres CLONE 1908325
  misc_feature: Encodes the peptide sequence at SEQ ID NO. 31963
aaaaagtcaatagttcctccagccaggcaggcgcagcgacctccttcttcctcgaacgcgccggtgcctcgtctcgccgcgcccagtcgccggtggccgatcgacgcgacgcgccttcggatccgggaagggagggagcgagagcgatgggggagaagcgcgcggtgctggtggggatcaactacccgggcaccaaggcggagctcaagggctgccacaacgacgtcgcccgcatgcgccgctgcctcgtcgagcgcttcggcttcgacgagtccggcatccgcgtcctcgtcgacgacggcggctccgggacgcagcccacgggggccaacatccggcgggagctccagcgcctcgtcggggacgcggggaccggggacctgctcttcttccactacagcgggcacggcacgcggctgcccaccgagaccggccaggacgatgacaccgggtacgacgagtgcatcgtgccctgcgacatgaaccttatcacataccaagatttcacggagcttgtgcgaaaagtccccgagggatgtctattcaccatagtatctgattcgtgccacagcggtggactacttgacaaaaccaagga

SEQ ID NO: 31963 - protein, 150 aa, Panicum virgatum
  misc_feature: Ceres CLONE 1908325
  misc_feature (4)..(150): Pfam Name: Peptidase_C14 Pfam Description: Caspase domain
MGEKRAVLVGINYPGTKAELKGCHNDVARMRRCLVERFGFDESGIRVLVDDGGSGTQPTGANIRRELQRLVGDAGTGDLLFFHYSGHGTRLPTETGQDDDTGYDECIVPCDMNLITYQDFTELVRKVPEGCLFTIVSDSCHSGGLLDKTK

SEQ ID NO: 31964 - DNA, 485 bp, Panicum virgatum
  misc_feature: Ceres CLONE 1908350
  misc_feature: Encodes the peptide sequence at SEQ ID NO. 31965
gtgctctctcagaggtgggttggcttctcctccccctccagttcggttcggttcgggttcgtgaggttcttggggttccgttcgggggtgagaggaagagatggaggcgtcggatgttgagtaccgctgcttcgtcggcggccttgcctgggccaccgacgacaactcgctccacaacgccttcagcacctacggcgaggtcctcgagtccaagatcatcctcgatcgtgagacccagaggtcccgcggcttcggcttcgtcaccttctcgagcgagcaggcgatgcgcgacgccatcgaggggatgaacggcaaggagctggacggccgcagcatcaccgtcaacgaggcccagtcccgcggcggcccgcgctccggcggcggcggcggctacgggcgccgcgagggcggcggtggctacggcggcggcggcggctaccgtcgcctctagggtgagggcgctgacagtggcggcggtggcgcac

SEQ ID NO: 31965 - protein, 116 aa, Panicum virgatum
  misc_feature: Ceres CLONE 1908350
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with altered alkaloid content
  misc_feature: Useful for making plants with altered lignin content
  misc_feature: Useful for making plants with modulated nitrogen use efficiency
  misc_feature: Useful for making plants with modulated flowering time
  misc_feature: Useful for making plants with modulated biomass
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
  misc_feature: The sequence is a functional homolog of SEQ ID NO 1042 in the 10/374,780 US patent application
  misc_feature: The sequence is a functional homolog of SEQ ID NO 852 in the 10/666,642 US patent application
MEASDVEYRCFVGGLAWATDDNSLHNAFSTYGEVLESKIILDRETQRSRGFGFVTFSSEQAMRDAIEGMNGKELDGRSITVNEAQSRGGPRSGGGGGYGRREGGGGYGGGGGYRRL

SEQ ID NO: 31966 - DNA, 840 bp, Panicum virgatum
  misc_feature: Ceres CLONE 1908354-R
  misc_feature: Encodes the peptide sequence at SEQ ID NO. 31967
catcgctctccctcgggcgccggctctcggaggcctccctggccgccctcgccgcgcgcctctccccgcaccgcggctccgtcgccgtcgtggtcacggcgccggacgtcctcgtcgacgggttctgcctctcccgctgcggcctccacgcatcggccacctcgtccgccgctgccgccgccgcgccagtggcggcccacggcgccggagccccgcccgcacccgccgcccgcgggcgcggccgtttcgcgtacgtgtgggtggggaactcggcggaccagtgccccggggagtgcgcgtggccgttccaccagccggcgtacggcccgaaggcgccgccgctggtggcgccgaacgcggacgtcgggatggacggcttggtgatcaacctcgcgacgctgctggccggcgccgtgaccaacccgtacggcggcgggttcttccagggccccgccgaggcgccgctggaggccgtgacggcgtgcacgggcgtgttcggcgcgggcgcctacccggggtaccccgggcagctgccggtcgacgccgccaccggcgccagctacaacgcggtcggcgtcgccggccggcttttcctcctcccggccatgtgggaccccaagacctcgcagtgctccaccctcgtgtagcggacgctacgtacactaggatcggaggtagaggtcggacgaaatgggtgttggcttggtgtaaatgatgacgatcgaagggtgcggagctccgctggtagactcggtggcggcctttgtggtttctcatgatctcgtcctgtcattgttctcgttcttgtggatagcgtcgaacttgaaatgaaacccccag

SEQ ID NO: 31967 - protein, 214 aa, Panicum virgatum
  misc_feature: Ceres CLONE 1908354-R
  misc_feature (1)..(214): Pfam Name: Phi_1 Pfam Description: Phosphate-induced protein 1 conserved region
SLSLGRRLSEASLAALAARLSPHRGSVAVVVTAPDVLVDGFCLSRCGLHASATSSAAAAAAPVAAHGAGAPPAPAARGRGRFAYVWVGNSADQCPGECAWPFHQPAYGPKAPPLVAPNADVGMDGLVINLATLLAGAVTNPYGGGFFQGPAEAPLEAVTACTGVFGAGAYPGYPGQLPVDAATGASYNAVGVAGRLFLLPAMWDPKTSQCSTLV

SEQ ID NO: 31968 - DNA, 521 bp, Panicum virgatum
  misc_feature: Ceres CLONE 1908354
atcgaagctccctagccccgcccacgctgatggcccaccagtgcccccaccgctgcctcgccgccctcctcatcctcctcgccgcggccgccggcgccggcgcggccacgccgaggcagctgttcctcgttaccccggcgcccgtgacgctgaccagccaccacggccagctgctcacgggcaactactccgtgaacctgctctggtacggccgcttcaccccggcgcaacgcgccgtcgtggccgacttcctcctctccctctcggcgccctccgtggccccggcctccgcggccgcgcccaccgtggcggcctggtgggccaccacggcgcggtaccacccgggcgcggcgcggctgacgctcggccgccaggtgctcgacccatcgctctccctcgggcgccggctcacggaggcctccctggccgccctcggcgggcgccgctccacgcaccgcggctgcgccggcgtcgaggacaaggcctcggactaggtcgacatctgcttctgcacctcgatc

SEQ ID NO: 31969 - DNA, 718 bp, Panicum virgatum
  misc_feature: Ceres CLONE 1908355
  misc_feature: Encodes the peptide sequence at SEQ ID NO. 31970
accggccgtcagagtccggcagctgtgagctgggaactcgcaactagatggcgtccgggtggagaggcatcctgggcttcgactacggcatcgtgcaggcgccgctcggccccgacatctcgggccccgagcttgccgccgccgtcgccaatgccggcgccatcggccttatccgcctccccgactttccggcgccagattacgtgagggagatgatacggaagacgaggagcctgacgtcgaagccgttcggggcggccattgtgctgccgttcccgtacggcgagaacctgagggtcgtgctggaggagaagcttgccgtgctgcaggtgtactggggcgagttcccgagggagcgggtcgaagaggcgcaccgcgcaggcgtcaaagtcttgcatcaggtcggcagccttgaggaggcagcgaaagctaaagaagccggtgtagatggaatcattattcagggccgtgaggcagggggtcatgtaattggtcaggaaggactattcccactgttgccaagagtagtagatcttgtttcggactctggcattccagttatcgctgctgggggaatcgtagacggccgtggctatgttgccgcgttggcacttggtgctcaaggtgtttgcttaggaacaaggttcctggctactgaggaaagctttgcacatcctatttataaggaaaagctgactgagatgagctgcacagacta

SEQ ID NO: 31970 - protein, 223 aa, Panicum virgatum
  misc_feature: Ceres CLONE 1908355
  misc_feature (2)..(223): Pfam Name: NPD Pfam Description: 2-nitropropane dioxygenase
  misc_feature: SWISSPROT Homolog: EC 1.13.11.32 2-nitropropane dioxygenase
MASGWRGILGFDYGIVQAPLGPDISGPELAAAVANAGAIGLIRLPDFPAPDYVREMIRKTRSLTSKPFGAAIVLPFPYGENLRVVLEEKLAVLQVYWGEFPRERVEEAHRAGVKVLHQVGSLEEAAKAKEAGVDGIIIQGREAGGHVIGQEGLFPLLPRVVDLVSDSGIPVIAAGGIVDGRGYVAALALGAQGVCLGTRFLATEESFAHPIYKEKLTEMSCTD

SEQ ID NO: 31971 - DNA, 1418 bp, Panicum virgatum
  misc_feature: Ceres CLONE 1908372
  misc_feature: Encodes the peptide sequence at SEQ ID NO. 31972
gccgcggggggtgggaggaggaggcatgggcaacgccagcggccgcgaggaggacgtcgcggccgtggacggcgacggcgccgacgtggaggacggcggcggggactcgtcggtccgctcgtcggagcgcggcttcccgccgtacggcagcgggggagcaaaccacgtgcggcgcgcgtgctcggtgagcgtcgtcggtggcggaggcggcgccggttcgccgcccgggagccccggccgctcgctctctccgcggatgttcgtgccccagacccctgtgcctccactgcaaagagctgctgatgtaaccccattattcaaccagatattgatgaatgaacaagaagaagaatatgatggtccccctccaaaggaaatccatgctttaattgtgtggacccttggagggaagaatgtatatgttgaaggatcatgggataactggaaatcaagaaaggccatgcaaaaatctgggaaagaccactctcttctgctggtactcccatctggagtttaccgatacagatttgttgtagatggagaaaggagatgtcttcctgatcttccctgtgaaactgatgcaatgggcaacgcagttaaccttcttgatgttaatgactttgttcctgaaagtgtcgagagtgtgacagaatttgagccgcccccgtctccagactccagctatagtttccaggcacctgaggacaaggactttgctaaggagcctcctgctcttccgtcccagctccatctcggtgttcttaactcacagaactcggaagaaaattgcgcgcggccgcagcacatagtcctcaaccacctcttcatcgagaagggctggggcgcccacccgctggtggcgctcggtctaacccacaggttcgagtctaaatatgtaactgtcgtcctgtataagcccatcgaacgatagcaaaagtagcccgcacatgaagagtgaaagttaatgcttgacaactcactgcgagagcagcgatgaacaacgcagagggtacatgcttgtaaaagcggttgaggctgaggagtattttttccgtgcctttgacagcttgcagaacctctggctgatgttgtacatgctgcactatcatgaggttggcctcctggtttgtttatcctgtcacagggagccatggcacccttagttcctactacatgtccgcctgttgtcatttgttccccgccccccagggatgaaatgtgagtagaggtgtcactgaaaaccgtggaaatccacagaagttaggtgccagatatagatcatgtgattcctagatttttgtgttgtttttgactagtgaaagacgatgtcgttgtgtaataactaataagatcagagcagtttacaaatgggatacgttgtgttttgtctcctttcgaaaaaagcgttgtgttttgtc

SEQ ID NO: 31972 - protein, 301 aa, Panicum virgatum
  misc_feature: Ceres CLONE 1908372
  misc_feature (213)..(299): Pfam Name: AMPKBI Pfam Description: 5'-AMP-activated protein kinase, beta subunit, complex-interacting region
MGNASGREEDVAAVDGDGADVEDGGGDSSVRSSERGFPPYGSGGANHVRRACSVSVVGGGGGAGSPPGSPGRSLSPRMFVPQTPVPPLQRAADVTPLFNQILMNEQEEEYDGPPPKEIHALIVWTLGGKNVYVEGSWDNWKSRKAMQKSGKDHSLLLVLPSGVYRYRFVVDGERRCLPDLPCETDAMGNAVNLLDVNDFVPESVESVTEFEPPPSPDSSYSFQAPEDKDFAKEPPALPSQLHLGVLNSQNSEENCARPQHIVLNHLFIEKGWGAHPLVALGLTHRFESKYVTVVLYKPIER

SEQ ID NO: 31973 - DNA, 1068 bp, Panicum virgatum
  misc_feature: Ceres CLONE 1908373
  misc_feature: Encodes the peptide sequence at SEQ ID NO. 31974
gccttctcggtgaagacaagcgagaagcgagcattcttgcctctgtccctcctcaccctctcctgctttccttcttgtcctgtttctactagtagcagcagcagccagccgccgcctctgcctgtgcgggagtaggaagaggggttgggagggagggagagatgagcgtgaccaagttcatcaagtgcgtgacggtgggcgacggcgcggtgggcaagacctgcatgctcatctgctacaccagcaacaagttccccacggactacatccctacggtgttcgacaacttcagcgccaacgtctccgtggatggcaacatcgtcaacttgggcctctgggacactgctgggcaagaggactacagcaggctgaggccgctgagctacaggggcgcagacgtgttcgtgctggccttctccctgatcagcagggcaagctatgagaatgttcttaagaagtgggtgccagagctgcgcagatttgcacccaatgttccagttgttcttgttgggaccaagttagatctccgtgaccacagagcctaccttgctgaccatcccggagcttcaacaatcacaacggcacagggtgaagaactgaggaagcagattggtgctgcagcttacatcgagtgcagttccaaaacgcagcagaatgtcaaggctgtctttgatactgccatcaaagtggtccttcagccccctcggagaagggaggcaatgcctgcaaggaggaaaagtaggcgcggctctggatgctccattatgaacctgatgtgtggcagcacgtgtgctgcttaggaggtcgtggcctcgaggaagttgaagactcgaaaagcggtgtgtatgtgttttggcaagtgaatttgctatagaatgggacagcatggatgcctgcttctcttgttttccttggctcttctgtatgcttgagtttttaggcttagtgcgtcagactctttgaggactgactgataagacttcagtgtcatgtaacaagtttgttagacgaggatcgctgtaatgttctgcaggtgggatgtggtataagtacttggtactaagatat

SEQ ID NO: 31974 - protein, 212 aa, Panicum virgatum
  misc_feature: Ceres CLONE 1908373
  misc_feature (8)..(179): Pfam Name: Ras Pfam Description: Ras family
  misc_feature (8)..(121): Pfam Name: Miro Pfam Description: Miro-like protein
  misc_feature: Useful for making plants with modulated nitrogen use efficiency
MSVTKFIKCVTVGDGAVGKTCMLICYTSNKFPTDYIPTVFDNFSANVSVDGNIVNLGLWDTAGQEDYSRLRPLSYRGADVFVLAFSLISRASYENVLKKWVPELRRFAPNVPVVLVGTKLDLRDHRAYLADHPGASTITTAQGEELRKQIGAAAYIECSSKTQQNVKAVFDTAIKVVLQPPRRREAMPARRKSRRGSGCSIMNLMCGSTCAA

SEQ ID NO: 31975 - DNA, 753 bp, Panicum virgatum
  misc_feature: Ceres CLONE 1908378
  misc_feature: Encodes the peptide sequence at SEQ ID NO. 31976
cgtgataagtcttatcttaagcaactatctgattatatagttccagcccttgtagaggtcatgcacaaagaacctgagccacaaatttgtgcaagcatactggaatcattgaatgagtccatacaggtatctggaacacttcttgaggaaaatcaagtaagatctgtagtggagggagtaaaagaagttatagttgcaagcgctaataggaggatagaacgaacagagagggtgaaggctgaagactttgattctgaagaagaggaactacttagagaagaaaacgaacaggaggatgaaatttttgaccaagttggtgattgtctaggcactcttgccaaaacattcaagacttattttcttccgtttttcgatgaactctccatgtatttaacacctatgttgggcaaggatagaacatcagaagaaagaaggattgccatatgcatttttgatgatgtcgctgagcattgccgtgaagcagcaattaggtattatgatgcatatcttccttctctattagaagcctgcacaagtgaaaatccagatgtcaggcaggctgcagtttatggaattggcatttgtgctgaatttggcggttctgcatttagacctcacactggggaggccctatccagattatacaatgtaatcaaacatcctaatgcgctggatttggataacgcgatggcatatgacaatgctgtttctgctcttggaagatatgccaatttcatcatgatagcatcgatc

SEQ ID NO: 31976 - protein, 250 aa, Panicum virgatum
  misc_feature: Ceres CLONE 1908378
  misc_feature (163)..(199): Pfam Name: HEAT Pfam Description: HEAT repeat
RDKSYLKQLSDYIVPALVEVMHKEPEPQICASILESLNESIQVSGTLLEENQVRSVVEGVKEVIVASANRRIERTERVKAEDFDSEEEELLREENEQEDEIFDQVGDCLGTLAKTFKTYFLPFFDELSMYLTPMLGKDRTSEERRIAICIFDDVAEHCREAAIRYYDAYLPSLLEACTSENPDVRQAAVYGIGICAEFGGSAFRPHTGEALSRLYNVIKHPNALDLDNAMAYDNAVSALGRYANFIMIAS

SEQ ID NO: 31977 - DNA, 725 bp, Panicum virgatum
  misc_feature: Ceres CLONE 1908380
  misc_feature: Encodes the peptide sequence at SEQ ID NO. 31978
aacgacatcaaccaaccaacaagccgagaccatcatggcggcggctccgtcagtggcggcggcggcggcgggggcgtcaacggcggtgctcgcctccaggccagggcctaccagcgcgctcctccggcgcacccaggtcacccctctccgccataccgccctgaaatgccgccgcgctgggcccctcaaccccatggcggctgcggccgcagccgctgggggcggcggctccccgtcgtcggccgtcttccacggcgaggtattcgtggtgggcgacaacatcgacaccgaccagatcatccccgcggagcacctcaccctggtgccgtccaagcccgacgagtaccgcaagctcggctccttcgccttcgcggggctcccctccgcggcctacccgacgcccttcgtcgccccgggtgaggagtccacccgttacgccgtcatcatcggcggggccaacttcgggtgcggctcctcccgcgagcacgcgcccgtcgcgctcggggccgccggcgcgcgcgctgtcgtggcggagagctacgcgcgcatcttcttccgcaactccgtggccacaggagaggtctaccctctggagctcaccgacgccggagcctggaaggagtgcaagactggggatgtcgtcaccgtggaccttggcaattccgtctttattaaccacacatccggcaaggagtacaagttgaaacctattggcgatgctggaa

SEQ ID NO: 31978 - protein, 230 aa, Panicum virgatum
  misc_feature: Ceres CLONE 1908380
  misc_feature (69)..(191): Pfam Name: Aconitase_C Pfam Description: Aconitase C-terminal domain
  misc_feature: SWISSPROT Homolog: EC 4.2.1.33 3-isopropylmalate dehydratase
MAAAPSVAAAAAGASTAVLASRPGPTSALLRRTQVTPLRHTALKCRRAGPLNPMAAAAAAAGGGGSPSSAVFHGEVFVVGDNIDTDQIIPAEHLTLVPSKPDEYRKLGSFAFAGLPSAAYPTPFVAPGEESTRYAVIIGGANFGCGSSREHAPVALGAAGARAVVAESYARIFFRNSVATGEVYPLELTDAGAWKECKTGDVVTVDLGNSVFINHTSGKEYKLKPIGDAG

SEQ ID NO: 31979 - DNA, 775 bp, Panicum virgatum
  misc_feature: Ceres CLONE 1908397
  misc_feature: Encodes the peptide sequence at SEQ ID NO. 31980
aggtcgcctttgcctcgctgccgccgcgtccgagccgaacacggggaagagaagagaagcccgtgcgccatgttcaagaagttctcttcggaagatatatctgggcagaatcaagttaaggcctctgtacagcgaaggattcggcaaagtattgctgatgagtaccctagccttgaacctttgctagatgacttactccccaagaagtcacctatgattgttgttaaatgccaaaaccatctgaatcttgtggtggtgaataatgttccactgtttttcaacatccgggatggtccttatatgccaaccttgcgtcttcttcatcaatatcctgatatcatgaaaaagttccaagtggacagaggtgctatcaaatttgtgctctctggtgcaaacataatgtgtcctggattgacatcaccaggtggtgtcttggatgatgaagtcgaggaggaaacaccagtggctataatggcggaaggaaaacaacatgcactggcaattgggtttacaaagatgtcagcgaaggacataaggaccatcaacaaagggattggagttgacaatatgcactatctaaatgatggcctatggaagatggagaagctggaatgaggataattcagtgaggggtgctgagcttgcgttattctcgtattgagatgtaaggaccagtagaattatgtatctgcacagctagttttgtttaaacagatgaagttgccagaagctacattttccggatagaagttgagtttactccatccctttggtg

SEQ ID NO: 31980 - protein, 181 aa, Panicum virgatum
  misc_feature: Ceres CLONE 1908397
  misc_feature (92)..(170): Pfam Name: PUA Pfam Description: PUA domain
MFKKFSSEDISGQNQVKASVQRRIRQSIADEYPSLEPLLDDLLPKKSPMIVVKCQNHLNLVVVNNVPLFFNIRDGPYMPTLRLLHQYPDIMKKFQVDRGAIKFVLSGANIMCPGLTSPGGVLDDEVEEETPVAIMAEGKQHALAIGFTKMSAKDIRTINKGIGVDNMHYLNDGLWKMEKLE

SEQ ID NO: 31981 - DNA, 1442 bp, Panicum virgatum
  misc_feature: Ceres CLONE 1908405
  misc_feature: Encodes the peptide sequence at SEQ ID NO. 31982
aaaaaaattccagcccattctcacagacttaaaccgaaagagcaatcttctcctttccccgtccacgagtcgagagctctcgctcccgcctcgctatcccctaaccctagccgccgccgcctaaaccctcgccgcactaactcgcagcgacctcccggcagcgatggcgaaggagaagaagcggaagcagcctgcctccgactcggcggtgcctccgggcgacgagggcgagggaaggagggatcgcaagggcaagaaggcgaagaaggataaggcagaggcgatactgccgtcgcagatcaagaacaaggacaagcgcagcgagctgcacgccaagctcaagcgcgagaagaagtccgagaagcgcaagctctcccgcgagcgcagccaggccatccgccgcgccgaagagcttggggaacagccgccggagaggcaggtgcctcggacgatcgagaacaccagggagcctgatgagaccgtgtgccggcctgatgaccaggagctatttgcaggaaatgatgcagatgaattcaacgctgttctaaaacagcacataattccgaaagtactgattaccacatgccgcttcaattcagggaggggacctgcctttattgaggagctaatgcaagtgataccaaattcgcattatgttaaaaggggaacatatgaactcaagaaaattgtggactatgcgaagaatagggatttcacctcacttattgttgttcacacaaatcggagggaacctgatgctctacttatcattggattacctgatggccccactgcacatttcaaactatccaaacttgttctacggaaggacataaagaaccatggcaaccctaccagtcataagccagagctagtgttgaacaatttcactacacgccttggtcatcgtgttggaaggatgatacaatccctctttccccaagaccccaatttccgtgggcgccgcgtcgtgaccttccataatcagcgagactacatatttttccgtcatcacaggtacatctttgagacaaaagaaagcaaggttgcttcgaaggacaagaaagctaagacatctgaaagcaaaagacaacctgagaagcaagtgatttgtcgcctgcaggaatgtggtcctcgcttcactctgaagctgctcaccttgcaacatgggaccttcgacacgaaaggcggggagtacgagtgggttcacaagccggacatggatacaagcaggagaagattcttcttgtgatgatggagcatggagactgtgatgcccaaacgggcggaattgttctgttgagtctttcaaatttatgtagagaggatgctacgttggcacgtagaatcgataaatgggtgcaacagacgttgatgcctgtccaagcaattttgtggatccaaccaagaagatgagctaatagaactttgttcccgtcttc

SEQ ID NO: 31982 - protein, 362 aa, Panicum virgatum
  misc_feature: Ceres CLONE 1908405
  misc_feature (137)..(333): Pfam Name: Brix Pfam Description: Brix domain
MAKEKKRKQPASDSAVPPGDEGEGRRDRKGKKAKKDKAEAILPSQIKNKDKRSELHAKLKREKKSEKRKLSRERSQAIRRAEELGEQPPERQVPRTIENTREPDETVCRPDDQELFAGNDADEFNAVLKQHIIPKVLITTCRFNSGRGPAFIEELMQVIPNSHYVKRGTYELKKIVDYAKNRDFTSLIVVHTNRREPDALLIIGLPDGPTAHFKLSKLVLRKDIKNHGNPTSHKPELVLNNFTTRLGHRVGRMIQSLFPQDPNFRGRRVVTFHNQRDYIFFRHHRYIFETKESKVASKDKKAKTSESKRQPEKQVICRLQECGPRFTLKLLTLQHGTFDTKGGEYEWVHKPDMDTSRRRFFL

SEQ ID NO: 31983 - DNA, 1096 bp, Panicum virgatum
  misc_feature: Ceres CLONE 1908415
  misc_feature: Encodes the peptide sequence at SEQ ID NO. 31984
ggctacagtttcacgcacgcgtgcgcgggcgggcgggcaagcgctagagaggaaagccggggcggcgcggcgagcgagcggcccaccaccgccgaccgatcgactgcctccttcgctttgccatttttgcttaattggtcggggagcggcggagggatcggccggccaggatggtgcgggggaagacggagatgaagcggatagagaacgcgacgagccggcaggtgaccttctccaagcgccgcaacgggctgctcaagaaggcgttcgagctctccgtgctctgcgacgccgaggtcggcctcatcgtcttctccccgcgcggcaagctctacgagttcgccagcgcctccagcctccagaaaacaatcgaccgctataagtcatatacaagagaaaatctcagtaacaaggctatacaacaacaggatatacagcaagtaaaagcagatgccttaagcttggcaaatagacttgaagcccttgaaaagtccaagaggaagtttttgggtgaaaatttagaagattgctctattgaagaactgcatagtttggaggtcaaactggagaagagtctccacgtcattagaggaaagaagacccaactgctggagcagcagatagccaagctgaaggagaaggagaggaccctgctcaaagacaacaaagaattacgcgaaaagcaacgcgacgttcagccgccgccggtggctcccgccgtgacccgctgccttcccccgtggccgcggaatctgccggcgccttgcaacgacgacgtggacgtcgagacggagctctacattgggttacccggcagggagcgctccgccaaccgggattcgggttcggggtgaagtacatacacatccgatgcccggatgccgcagctgccggccacgcctggtggttcttcctgagcccatccatgcctataggaataagcaaaggtcactgcaagcaccccccagtcacatcgatcagctccgaggttttttcccctacaagttgtctaaaaaaatcaagctgtatgtgtattgcaaagatggatggatggaacaaccctcctgagacctgaaaatccatgcagcgtttaccc

SEQ ID NO: 31984 - protein, 227 aa, Panicum virgatum
  misc_feature: Ceres CLONE 1908415
  misc_feature (9)..(59): Pfam Name: SRF-TF Pfam Description: SRF-type transcription factor (DNA-binding and dimerisation domain)
  misc_feature (75)..(174): Pfam Name: K-box Pfam Description: K-box region
  misc_feature: The sequence is a functional homolog of SEQ ID NO 1368 in the 10/666,642 US patent application
  misc_feature: The sequence is a functional homolog of SEQ ID NO 422 in the 11/435,388 US patent application
  misc_feature: The sequence is a functional homolog of SEQ ID NO 122 in the 10/666,642 US patent application
  misc_feature: The sequence is a functional homolog of SEQ ID NO 406 in the 10/412,699 US patent application
  misc_feature: The sequence is a functional homolog of SEQ ID NO 1364 in the 10/666,642 US patent application
  misc_feature: The sequence is a functional homolog of SEQ ID NO 1728 in the 10/412,699 US patent application
  misc_feature: The sequence is a functional homolog of SEQ ID NO 919 in the 10/666,642 US patent application
  misc_feature: Useful for making plants with modulated flowering time
  misc_feature: Useful for making plants with altered alkaloid content
  misc_feature: Useful for making plants with altered terpenoid content
  misc_feature: Useful for making plants with modulated biomass
  misc_feature: The sequence is a functional homolog of SEQ ID NO 1701 in the 10/412,699 US patent application
  misc_feature: The sequence is a functional homolog of SEQ ID NO 1949 in the 10/412,699 US patent application
  misc_feature: Useful for making plants with altered lignin content
  misc_feature: The sequence is a functional homolog of SEQ ID NO 1967 in the 10/412,699 US patent application
  misc_feature: The sequence is a functional homolog of SEQ ID NO 1965 in the 10/412,699 US patent application
  misc_feature: The sequence is a functional homolog of SEQ ID NO 1963 in the 10/412,699 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
MVRGKTEMKRIENATSRQVTFSKRRNGLLKKAFELSVLCDAEVGLIVFSPRGKLYEFASASSLQKTIDRYKSYTRENLSNKAIQQQDIQQVKADALSLANRLEALEKSKRKFLGENLEDCSIEELHSLEVKLEKSLHVIRGKKTQLLEQQIAKLKEKERTLLKDNKELREKQRDVQPPPVAPAVTRCLPPWPRNLPAPCNDDVDVETELYIGLPGRERSANRDSGSG

SEQ ID NO: 31985 - DNA, 1557 bp, Panicum virgatum
  misc_feature: Ceres CLONE 1908416
  misc_feature: Encodes the peptide sequence at SEQ ID NO. 31986
atacaaaagccgcgagaagcggcggagacgaggaggaggaccacccttttgcgccccggacgcctcccgttccggcattcgcgacctccacccgctcgaggaggagccatgggcgtggaggaggcggggcgcgcccgcggcggcggcaagaagctggcgctggcgagcatcggcttcgcggacgtccgcgtgggcgccgccgggggtgccggctacagggaggacctgctcgaggtggggctgcccctgcccgggcccaaggacgacgggggcctggccgtcaggctgccggacgttagcgccgccgtcaggacttttctgaggaatagagaagttgcagaattcgtcagtggagcaatggccggtgcaatgaccaaggctgttctagctcctctagaaactatcaggacaagaatggttgttggggtaggatcaaaacatatttttggtagttttgtggagatcattgaacaaaatggctggcaaggactctgggcaggtaatactataaatatgctccggattatcccaactcaagcaattgagctcgggacatttgagtgtgtcaaaaggagtatgacatctgcacaagagaaatggaaagaggatgggtgccccaagatacaacttggcaatttgaaaatcgagcttccatttcacttattatcaccgattgccattggaggtgcagctgctggaatagctagcactttagcatgccatcctcttgaggttcttaaggaccgtatgactgtcaatcgtgaggcttatcctagtattgccattgccttcaacaagatctaccgtgctgatggcattggtggcctttatgctggcctctgcccaacattagttggcatgcttccttatagcacatgctactatttcatgtacgagacaatcaagacttcttactgccgtgcacagaaaaagaaatctttaagccgtcctgagctactggctattggggctctttcaggcctgactgcaagcacaatcagcttccctctggaagtcgcaagaaagcggcttatggtgggagccatacaagggaagtgcccaccccacatgattgcggctttagccgaggtggttcaagaggagggcttcaaggggcttttccgtggatgggcagcaagctccctgaaggtcatgccaacgtccggtgtcacctggatgttttatgaggcgtggaaggatatccttttggctccacggctccatgtctagcaagatcacgcaactcaacaagggcattagcactgctgcaaaataaatttgtcctgctgtgtggccgtgtgtgtgtgtgtgggatttccaatctttttttctcttttcaaatcccacatgtgccaacgatgtaggcaaaagaaggccatcttgtattcttgtgcggtttggccgatgatcagaagcattagttgtttgtcctctgctaacctggattgtctaattagtagcaactgttaacagacagtctctgggctgggaatgcattggccccaaccattgttattgtgaaactttcactaatgaataaataagttacctcttctc

SEQ ID NO: 31986 - protein, 373 aa, Panicum virgatum
  misc_feature: Ceres CLONE 1908416
  misc_feature (78)..(161): Pfam Name: Mito_carr Pfam Description: Mitochondrial carrier protein
  misc_feature (279)..(370): Pfam Name: Mito_carr Pfam Description: Mitochondrial carrier protein
  misc_feature (187)..(273): Pfam Name: Mito_carr Pfam Description: Mitochondrial carrier protein
MGVEEAGRARGGGKKLALASIGFADVRVGAAGGAGYREDLLEVGLPLPGPKDDGGLAVRLPDVSAAVRTFLRNREVAEFVSGAMAGAMTKAVLAPLETIRTRMVVGVGSKHIFGSFVEIIEQNGWQGLWAGNTINMLRIIPTQAIELGTFECVKRSMTSAQEKWKEDGCPKIQLGNLKIELPFHLLSPIAIGGAAAGIASTLACHPLEVLKDRMTVNREAYPSIAIAFNKIYRADGIGGLYAGLCPTLVGMLPYSTCYYFMYETIKTSYCRAQKKKSLSRPELLAIGALSGLTASTISFPLEVARKRLMVGAIQGKCPPHMIAALAEVVQEEGFKGLFRGWAASSLKVMPTSGVTWMFYEAWKDILLAPRLHV

SEQ ID NO: 31987 - DNA, 1043 bp, Panicum virgatum
  misc_feature: Ceres CLONE 1908434
  misc_feature: Encodes the peptide sequence at SEQ ID NO. 31988
cttcctccgctctcctcttcttgcccgtggaattgttctctcctcgcttgcccggcggcgcggtgaggatgcgacggctctggcgatggtaccagcagtgcctggcctcgcacccggtgcgcacgcaggtcgtcagctccggcatcctctgggcctccggtgacatcggcgcccaggccgtcacccactactccgcacgccgtcgcgccaacaacaaacccgtggataaagataaagttaaagagttcaaagttgattggaggagggtggccatcacaagttcctttggatttgcttttgttggaccagttggacattactggtatgagtacctggaccgttttatccggcggagatttcagcctaatacattcaaatttgttgcctcaaaggttgctgcagatggtttcctctttggaccattagatcttctcttgttcttctcatatgtgggtctcggccaaggaaggagtgtagagcaagtgaaggaagacgtgaaaagagatttcattcccgctctggtactaggtgggatgatctggccagccgtgcagatcgcgaacttccgcttcattcccgtgcggtaccagctcctgtatgtcaacttgttctgcctcttggacagttgtttcctatcatggattgagcagcagggagacgcttcatggaagcagtggttcacatcgttccataaaatcgaagaccataagagtaaggtttgattttactagttataatccatggtgttcatgcagatcaacatttaaaactctactggctgaagcactattaacttgctgtaagataaaagggggccaaagttgtccgggagagggttacaggggatcatgtgtttcccagacagggatacggatgttgataagctgaagatgcgtgcttgactgcttgtggctagtggctgaggcattgttaacttgctgtaaccggatctgagctttatgtctctgtggttgtctgaaaattcagtccaatacggtgtcccacttatgctgcggccgtggaaacatttctgcgttttgtgg

SEQ ID NO: 31988 - protein, 217 aa, Panicum virgatum
  misc_feature: Ceres CLONE 1908434
  misc_feature (128)..(198): Pfam Name: Mpv17_PMP22 Pfam Description: Mpv17 / PMP22 family
MRRLWRWYQQCLASHPVRTQVVSSGILWASGDIGAQAVTHYSARRRANNKPVDKDKVKEFKVDWRRVAITSSFGFAFVGPVGHYWYEYLDRFIRRRFQPNTFKFVASKVAADGFLFGPLDLLLFFSYVGLGQGRSVEQVKEDVKRDFIPALVLGGMIWPAVQIANFRFIPVRYQLLYVNLFCLLDSCFLSWIEQQGDASWKQWFTSFHKIEDHKSKV

SEQ ID NO: 31989 - DNA, 673 bp, Panicum virgatum
  misc_feature: Ceres CLONE 1908435
  misc_feature: Encodes the peptide sequence at SEQ ID NO. 31990
gaccacctctcagcagtcccattctctcacatcacgagctatcgccacctccaattaatcagaccaattagactgccgctctatccctcgtgttgctgcttgtacggctgtacctgcggtatccggcataatcgaccgggatggaatcgtacacgaaaaatggcgtctccgcccgccagaaccttggaccgtgtacaatctcatgtactacatgtgctccctgcgcgagaggattctcatgatcgatggctctcatgagagtgcggcctctggtttgtgtacgtcagaacgattcaaacaagaaaggaaaatccatcgatcgactttggcaagcatctgctccgcactcgtctatgagtgtcactgcaaataagagtcatttggatccctgttcaagtagacatgaatgctcaagtatgatttcatcattggcaaggactgaacatggaactgggagtaacgattacatgtcatttaaccaattcgatgttgttcaagatttctctgatcaccactatgcaaaaacatcaccaggaaaggccaccaaagattgggtgaaggcaatccaaagtgaatggagtcttctacagaaaaatctacctgagtctatatatgttagagtttatgaggacaggatcgatctgctcacggctgctatagttgggccagctgg

SEQ ID NO: 31990 - protein, 142 aa, Panicum virgatum
  misc_feature: Ceres CLONE 1908435
  misc_feature: SWISSPROT Homolog: EC 6.3.2.19 Ubiquitin--protein ligase
MALMRVRPLVCVRQNDSNKKGKSIDRLWQASAPHSSMSVTANKSHLDPCSSRHECSSMISSLARTEHGTGSNDYMSFNQFDVVQDFSDHHYAKTSPGKATKDWVKAIQSEWSLLQKNLPESIYVRVYEDRIDLLTAAIVGPA

SEQ ID NO: 31991 - DNA, 545 bp, Panicum virgatum
  misc_feature: Ceres CLONE 1908439
  misc_feature: Encodes the peptide sequence at SEQ ID NO. 31992
agatgccccccggcgctccccagcaccatcaaattatcaaaacgagaggcgcccttggccggcccccgctcgccccggacacagaggagagagcgtcgcgtccctcctgcctcgcgcgcgcgcagtgtgagctagtgagcgagtggtctgatcgagcagcgagcgagcgcgcgatggccttgcaggttaccggcggcgtgacctgccgctgccctcctgcgctccccggcggcggcgggcggcgggcgcgctgccgcccgccccgcgcggtaggcgtccggcgcggcggcgacagtttactaggccgagggcagtgggcggctggacgattgcctgttcctcttcaccaatctccggatcctggatcggttctgaggcgagggcttgtcatggaacaactcctagcgagacctatgtcaagcgagagagctacatgctgcagccgctcacagtcttccttgtggactgaccgtgatacatccatgaacttcgtcaaggtgcatgatgttttcctggactgtgtctgtgattctattatatggctt

SEQ ID NO: 31992 - protein, 123 aa, Panicum virgatum
  misc_feature: Ceres CLONE 1908439
  misc_feature: SWISSPROT Homolog: EC 3.5.4.19 Phosphoribosyl-AMP cyclohydrolase
MALQVTGGVTCRCPPALPGGGGRRARCRPPRAVGVRRGGDSLLGRGQWAAGRLPVPLHQSPDPGSVLRRGLVMEQLLARPMSSERATCCSRSQSSLWTDRDTSMNFVKVHDVFLDCVCDSIIW

SEQ ID NO: 31993 - DNA, 641 bp, Panicum virgatum
  misc_feature: Ceres CLONE 1908439-R
  misc_feature: Encodes the peptide sequence at SEQ ID NO. 31994
ccctgatatacagaactcccgagttgaatggtgtgaaagcagcttgtgatgagctcggcatcaccttgatgccctattccccaattgcccaaggtgttctgacagggaaatacactccagaaaatcccccaactggcccacgagcaaatacatacactcctgaattcctcaccaagctccaaccacttatgagcaggatcaaagagattggagcaagctatggcaagagtccaacccaggtgtctctgaactggctgacctgccaggggaacgtggtgccgatccccggggccaagaatgccagccaggctaaggagttcgctggcgctcttgggtggagcctgaccagcgacgaggtcgaagagcttcggactctggcgcgcgagatcaagggcatcaagatgcccatcgaggagtcgtaaattttctgcatttcaccctccaatggtatatcgttgataggagattaacgttttgaagagagagagagaaaacgctatgatgcagacatgaaccagaagttgcatgcagcgtgtgtaagtagcaaatggtatatatatagctgcccatcattctcaatttctcatgcctaaacgctgtatatgtaatgatgtaagtatgtaacatactgttcatttgcc

SEQ ID NO: 31994 - protein, 139 aa, Panicum virgatum
  misc_feature: Ceres CLONE 1908439-R
  misc_feature: SWISSPROT Homolog: EC 1.1.1.65 Pyridoxine 4-dehydrogenase
LIYRTPELNGVKAACDELGITLMPYSPIAQGVLTGKYTPENPPTGPRANTYTPEFLTKLQPLMSRIKEIGASYGKSPTQVSLNWLTCQGNVVPIPGAKNASQAKEFAGALGWSLTSDEVEELRTLAREIKGIKMPIEES

SEQ ID NO: 31995 - DNA, 757 bp, Panicum virgatum
  misc_feature: Ceres CLONE 1908449
  misc_feature: Encodes the peptide sequence at SEQ ID NO. 31996
aagaacagagacgccttcccggcctagcatcccaccaaccacagcgaaacagaaggggagggaactagaactctctgtttaaagcacgaggccaccatacgtgctctacacgcttctcacgtctctctcaagtctcaactcctgtcgctcgatcgacgagctgtccgtggcgggcggagagcgcgagccgccaccgtacagtccgggagaaggaggcggagggagaggagggaggagagcccgggcgagatggccgcggcctggctgggcgtgaaggcggcgccgttcacgtacgcggcgcacgcgctggcggcggtggcggcggtgctggtgctggtgtggtgcgtccacttccgcggcggcctcgcgctcgaggcccagaacaagaacctcgtcttcaacgttcaccctgtgctgatgctaattggttacattatcctcggcagtgaagccattatgatctacaaggtgttcccaaaactgaaccacgacaccgccaagctgacgcacctgatcctccatgcgattgccactgttcttggcgccttcgggatctactgcgcgttcaagtaccacaacgacagcgggatcgcaaacctctacagccttcactcctggctcgggatcggaaccatctccctgtacggcattcagtgggttttcggattcgtgaccttcttcttccccggcgcggcgccgagcgtgaggcgcagtgcgctgccgtggcacgcgctgctcgggctcttcgtctacgtgc

SEQ ID NO: 31996 - protein, 169 aa, Panicum virgatum
  misc_feature: Ceres CLONE 1908449
  misc_feature (14)..(169): Pfam Name: Cytochrom_B561 Pfam Description: Cytochrome b561
MAAAWLGVKAAPFTYAAHALAAVAAVLVLVWCVHFRGGLALEAQNKNLVFNVHPVLMLIGYIILGSEAIMIYKVFPKLNHDTAKLTHLILHAIATVLGAFGIYCAFKYHNDSGIANLYSLHSWLGIGTISLYGIQWVFGFVTFFFPGAAPSVRRSALPWHALLGLFVYV

SEQ ID NO: 31997 - DNA, 514 bp, Panicum virgatum
  misc_feature: Ceres CLONE 1908452
  misc_feature: Encodes the peptide sequence at SEQ ID NO. 31998
gtcgcgggtgtgcgctgggatgaggacgtctggacattctcgcgagcgatcaagatgacgtcgaggcggagaggcgtccccggatcctctcgggatgcggatgtttgtactcacccgccccggcgagaccatgcgcttggacgtggagtcgtctgacgggattgaccctggggaggcccgcatgctcgacgaggggggcctgcggccggagcggcgccggctgatcttccgggggccgcggctggtcgatggccccgccctggtggacgcccccaaccccagtgactccaccgtccacatggggctccgcctgcgtggtggtctgccgatttttgtgaagaccctcacaggaaaaattttctggttggacgtggagtcttctgactgcttcaattgtgtggacgctaggatggaagactgggtgggtttcccgatcgagcaataactgctgatcttcactggccatgcgctggtggatggccgacccctgtctgatgatggcattcccatcgag

SEQ ID NO: 31998 - protein, 116 aa, Panicum virgatum
  misc_feature: Ceres CLONE 1908452
  misc_feature: Useful for making plants with modulated cold sensitivity
MRMFVLTRPGETMRLDVESSDGIDPGEARMLDEGGLRPERRRLIFRGPRLVDGPALVDAPNPSDSTVHMGLRLRGGLPIFVKTLTGKIFWLDVESSDCFNCVDARMEDWVGFPIEQ

SEQ ID NO: 31999 - DNA, 689 bp, Panicum virgatum
  misc_feature: Ceres CLONE 1908471
  misc_feature: Encodes the peptide sequence at SEQ ID NO. 32000
aagaggaaggccaaaagggtgccaaaaaggccttgccgtctccctctcccgcttcgcgctcttcgtcatcttcctcttcctccgcttgggggctgggctctccactccagggttcggttcagattcagattggggcgccgccgcagtcctaccgtgctgctctccctcaccacgacgaggatggggcaggacggccaccagatccgccgccacaagctcatcatcgacacggatcccggcatcgatgatagcatggcaatcctaatggcgttcagagaaccaagcgtggaaatcattgggttgacgaccatatttggcaacgttagcacggagggtgcaacacgtaatgcgctgttgctgtgtgagagagcagggcattctgaagttccagtagcagagggaagccctgagcccctaaagggaggaaaaccccgtattgctgattttgttcatgggtcagatggcattgggaatctgtttgttcctgaacccactactaggaaggttgaggaaagtgctgctgagttcttggtcaataaggtctctgagtttcctggagaggtctctgtactcgctttggggcccctgacaaatgtagcattggctgtcaaaagagacccttcctttgcaagcaaggtgaagaaaatagttgtactaggtggagctttctttgcggcaggaaatgtcaa

SEQ ID NO: 32000 - protein, 169 aa, Panicum virgatum
  misc_feature: Ceres CLONE 1908471
  misc_feature (10)..(169): Pfam Name: IU_nuc_hydro Pfam Description: Inosine-uridine preferring nucleoside hydrolase
  misc_feature: SWISSPROT Homolog: EC 3.2.2.8 Ribosylpyrimidine nucleosidase
MGQDGHQIRRHKLIIDTDPGIDDSMAILMAFREPSVEIIGLTTIFGNVSTEGATRNALLLCERAGHSEVPVAEGSPEPLKGGKPRIADFVHGSDGIGNLFVPEPTTRKVEESAAEFLVNKVSEFPGEVSVLALGPLTNVALAVKRDPSFASKVKKIVVLGGAFFAAGNV

SEQ ID NO: 32001 - DNA, 1271 bp, Panicum virgatum
  misc_feature: Ceres CLONE 1908481
  misc_feature: Encodes the peptide sequence at SEQ ID NO. 32002
ctctcctcccctacccaaccagggacgtcccccaaccagaccgcgcgcgccgccaatctagggtttcccccgccgtcctccctcccctcgccgacgaggtgccggtcaagttcgggcgatgaagctcgcggggctcaagtcggtggacggcgcccacgaggaatccatctgggcggcggcgtgggcgcccgccgccgaccaccgccccacggcggtgctcctgacgggcgcgctcgacgagaccgtccgcgcctggcgccccgacgacctcgccgccgcggggccccccacgaggggccacgcgctgggggtcgtctccctcgccacccaccccgcgggcgcgctcgccgccgccgtgtcgctcgacagcttcgtccgcgtcttcgacgtcgactcgggggcctccgtcgccacgctcgaggcgccgccgtccgaggtctggggcgtccagttccaccccaagggtaatgctctggctgcagctggtggtggtagtgggtcagtaaagctctgggacacagagaagtggcagccaattaccagccttgccatcccacgtcccgagggagctcgccctgacaagacaggcagtggcaagtttgttctatcagttgcctggagccctgatggaaagctcttggcctgtgattccatggacggcaccatcgctgtgtacgacgcaatccgcatgaagttcctccaccaccttgaggggcaccacatgccggtgcggtccatggtattctcccctgtagacccccatgtgctcttcacggcctgtgacgaccgccacatccacatctatgatgccaaggagaaggccctcatcggggctatgtcaggccacgcgagctgggtgctgagcatcgacgtgagccccgacggcttggtggtggcaacgggatccagtgaccgcacagtccggctctgggacatcaacatgaagagttcggtgcagacaatgagcaaccactctgaccaggtctgggccgttgccttccgaccacctggtggagccggagtccgtgcaggccggctggccagcgtgtcagatgacaaaagcatctccctgtatgattactcatagtttttcataccgctgcaaggcctctattgtagtttgttgaagtccaacaagagaaactcatttggctgtgaaggttggaggacctgttgtacaatcctaattgagctcctatcttgcaagcaaagcaagttttacttcctgttattgacttgtctcaaaggtcgttgagttgcatacttatccc

SEQ ID NO: 32002 - protein, 322 aa, Panicum virgatum
  misc_feature: Ceres CLONE 1908481
  misc_feature (234)..(272): Pfam Name: WD40 Pfam Description: WD domain, G-beta repeat
  misc_feature (191)..(230): Pfam Name: WD40 Pfam Description: WD domain, G-beta repeat
  misc_feature (276)..(320): Pfam Name: WD40 Pfam Description: WD domain, G-beta repeat
  misc_feature (94)..(133): Pfam Name: WD40 Pfam Description: WD domain, G-beta repeat
  misc_feature (4)..(47): Pfam Name: WD40 Pfam Description: WD domain, G-beta repeat
  misc_feature: SWISSPROT Homolog: EC 2.3.1.48 Histone acetyltransferase
  misc_feature: Useful for making plants with modulated flowering time
MKLAGLKSVDGAHEESIWAAAWAPAADHRPTAVLLTGALDETVRAWRPDDLAAAGPPTRGHALGVVSLATHPAGALAAAVSLDSFVRVFDVDSGASVATLEAPPSEVWGVQFHPKGNALAAAGGGSGSVKLWDTEKWQPITSLAIPRPEGARPDKTGSGKFVLSVAWSPDGKLLACDSMDGTIAVYDAIRMKFLHHLEGHHMPVRSMVFSPVDPHVLFTACDDRHIHIYDAKEKALIGAMSGHASWVLSIDVSPDGLVVATGSSDRTVRLWDINMKSSVQTMSNHSDQVWAVAFRPPGGAGVRAGRLASVSDDKSISLYDYS

SEQ ID NO: 32003 - DNA, 809 bp, Panicum virgatum
  misc_feature: Ceres CLONE 1908510-R
  misc_feature: Encodes the peptide sequence at SEQ ID NO. 32004
tatctcgagttaccagtgttgcatccttctttgtcagccgagttgacacccttattgataaaatgctcgaaaagattggaacacctgaggcactttcccttagaggaaaggctgctgtagcacaggcaaaattagcaaatcagctctaccagaagaaattctctggcccgagatgggaagctttggctaagaaaggtgccaagaagcagagattgttgtgggcatccactggcgtcaagaaccctgcttatcctgacaccctttatgtggacagtctgattggacctgacacggtcaacacgatgcctgaccaagcgttgcatgcattcatagaccacggcactgtttcaaggacagttgatgcgaatgtgtcggaggcagaaggtgtatacagtgccctggagaagcttggcatcgactgggatgaggtggggaagcagcttgagctggaaggagtggactcgttcaagaagagctttgacagcctacttgtgagtctccaggaaaagggcaacagcctcaagacggcaagcgtgtaaaactgaaatgatgtggtaccggctggtgaacgattactaaataaaatgctagctcgctggctctccttagttttgtgactctgcggatgctcttgattctgtgaatcagctttgtattctagtcttgcctggctgtcattgtgtaaccaatgttcatggcttgtaactgttatgcgctatccaatgaataatttttgagcaagtttatagagtccggacatattgtctttgttttatagaatttttatctgggaaggtacatcttatttc

SEQ ID NO: 32004 - protein, 178 aa, Panicum virgatum
  misc_feature: Ceres CLONE 1908510-R
  misc_feature: SWISSPROT Homolog: EC 2.2.1.2 Transaldolase
SRVTSVASFFVSRVDTLIDKMLEKIGTPEALSLRGKAAVAQAKLANQLYQKKFSGPRWEALAKKGAKKQRLLWASTGVKNPAYPDTLYVDSLIGPDTVNTMPDQALHAFIDHGTVSRTVDANVSEAEGVYSALEKLGIDWDEVGKQLELEGVDSFKKSFDSLLVSLQEKGNSLKTASV

SEQ ID NO: 32005 - DNA, 677 bp, Panicum virgatum
  misc_feature: Ceres CLONE 1908510
actctctagaccgtagcttgcataaatctcaccacgatgaaccaagagaaccaaacaatcgagccgctactgcaacatcagcagcaagaagaagatggcacgacgacgacggccacgcaaggcggcggcggcgcggcggccggtcaccaccgcgggagcaagctcacgctcctcccgctcgtcttcctcatctacttcgaggtcgccggcgggccgtacggggccgagcgcgcggtcaaggcgtcgggcccgctcttcgcgctcctgggcttcctcgtcttccccttcgcgtggggcgtcccggagtcgctcgtcaccgccgagctcgccgccgcgctcccgggcaacggcggcttcgtcctgtgggccgaccgcgccttcggcccgctggccggctcactgctcgggacctggaagtacttcagctgcgtcgtcaacatcgccgcgtacccggcgctcgtcgccgactacctcggccaggtcgtccccggcagcagggcgcgcacgggcacggtggtcggcatgacggcgctgctgtccctggtgaactgcgcggggctcagcattgtcgggtggggcgccgtggcgctggggctcgtgtccctggcgccgttcgtgctcatgatggggttggcggcgccaatggtgcggccgcggcggtggacggcggtgcaggt

SEQ ID NO: 32006 - DNA, 666 bp, Panicum virgatum
  misc_feature: Ceres CLONE 1908521
  misc_feature: Encodes the peptide sequence at SEQ ID NO. 32007
ataatcatctcccaatctctctgcaagtctgaaactcccagggataacccgaagcaaccatggaacaacaacggcagcaaggggccccggccaggcggaaggccaccctcccctcccacctgcccccgcaacccccatcctctcaccctcagaaggaagaaggacccctcctaatgggatccaattggcgtgcaaaaggggccgcgcccggcttcaaagtcccgatcttaggtgcagctgggggaatccggcaaccactcccgctactgaagaaaaagaaccctctcctttccgtgctccatctatatgaagtcctccacacacctggtgtcacaactgaaattaaccacatggatactggtgctgtggtgcgtggattccttggcccaccacaattggaaaatgctctaactgggatggatcttgtgataattcctgctggtgtccctccgaaacctgggaagaacagggatgatctgtttaacatcaatgctggaatcccccgtactctttgtgaaggaattgcaaaatgctgccccaaagcgaatgtgaatgtgatcaataatcctgtccattccaccgttcccattgctgctgaagttttcaagaaagctgggacatatgatcccaagcggcttttgggggttaccacacttgatgtaatga

SEQ ID NO: 32007 - protein, 164 aa, Panicum virgatum
  misc_feature: Ceres CLONE 1908521
  misc_feature (14)..(157): Pfam Name: Ldh_1_N Pfam Description: lactate/malate dehydrogenase, NAD binding domain
  misc_feature: SWISSPROT Homolog: EC 1.1.1.37 Malate dehydrogenase
MGSNWRAKGAAPGFKVPILGAAGGIRQPLPLLKKKNPLLSVLHLYEVLHTPGVTTEINHMDTGAVVRGFLGPPQLENALTGMDLVIIPAGVPPKPGKNRDDLFNINAGIPRTLCEGIAKCCPKANVNVINNPVHSTVPIAAEVFKKAGTYDPKRLLGVTTLDVM

SEQ ID NO: 32008 - DNA, 693 bp, Panicum virgatum
  misc_feature: Ceres CLONE 1908568
  misc_feature: Encodes the peptide sequence at SEQ ID NO. 32009
gcaagttcccagttgagaaggatgccaaagaggaagtgcagctcttcctggggaatgctggaactgcaatgcggccattgacagcagctgtgactgctgctggtggaaatgcaacttatgtccttgatggggtaccgagaatgagggagagacccattggtgacttggttgtcggattgaaacagctgggtgcggatgttgattgtttccttggcactgactgcccacctgttcgtatcaagggaattggagggctacctggcggcaaggttaagctgtcaggctccatcagcagtcaatacttgagtgccttgttgatggctgctcctttagctcttggggatgtggagattgaaatcattgataagctaatctccattccctatgttgaaatgacattgagattgatggagcgttttggcgtgaaagcagagcattctgatagctgggacaggttctacatcaagggaggtcaaaagtacaagtcccctaaaaatgcatatgtggaaggtgatgcctcaagtgcaagctatttcttggctggtgctgcaattactggagggactgtgactgttgaagggtgtggcaccaccagtctgcagggtgatgttaaatttgctgaggtactggagatgatgggagcgaaggttacatggaccgagacaagtgtaactgttactggtccaccgcggg

SEQ ID NO: 32009 - protein, 230 aa, Panicum virgatum
  misc_feature: Ceres CLONE 1908568
  misc_feature (1)..(230): Pfam Name: EPSP_synthase Pfam Description: EPSP synthase (3-phosphoshikimate 1-carboxyvinyltransferase)
  misc_feature: SWISSPROT Homolog: EC 2.5.1.19 3-phosphoshikimate 1-carboxyvinyltransferase
KFPVEKDAKEEVQLFLGNAGTAMRPLTAAVTAAGGNATYVLDGVPRMRERPIGDLVVGLKQLGADVDCFLGTDCPPVRIKGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPR

SEQ ID NO: 32010 - DNA, 716 bp, Panicum virgatum
  misc_feature: Ceres CLONE 1908573
  misc_feature: Encodes the peptide sequence at SEQ ID NO. 32011
atctcattccgctttgagcttgcttgcagctccagctcccctcgtctcttggtggctacgccatgaccaccgtagtcctgatgagctgcagcctccgcgcgccggccagcagcggcttatctggcgtccgcgccgccccggcaccggccatcgtcgccatgcccgccgccaagcagcaggttgttggccgcggcgccaggctgcgcgcgcaggccacctacaacgtgaagctcatcacgcccgacggcgaggtagagctgcaggtgcccgacgacgtgtacatcctggaccaggccgaggaggaagggatcgacctgccctactcgtgccgcgcggggtcctgctcctcctgcgccggcaaggtcgtctccggcagcgtcgaccagtccgaccagagcttcctcgaagacgaccaggtcgccggcggctgggtgctcacctgcgccgcctaccccacctccgacgtcgtcatcgagacgcacaaggaggaggagctcacctcctcttcgtaatccgatccagtatatgcggctttcattgcttattaattatctcagctcccttgattatatatatatatataaatataattaaaccctacgtcgtgcgtgctatagctatagctatagctatagctatactatactttaattggtttgcaattcagctatatgcataatgcatgctagctgtggctatttatatctggtttattt

SEQ ID NO: 32011 - protein, 149 aa, Panicum virgatum
  misc_feature: Ceres CLONE 1908573
  misc_feature (58)..(133): Pfam Name: Fer2 Pfam Description: 2Fe-2S iron-sulfur cluster binding domain
MTTVVLMSCSLRAPASSGLSGVRAAPAPAIVAMPAAKQQVVGRGARLRAQATYNVKLITPDGEVELQVPDDVYILDQAEEEGIDLPYSCRAGSCSSCAGKVVSGSVDQSDQSFLEDDQVAGGWVLTCAAYPTSDVVIETHKEEELTSSS

SEQ ID NO: 32012 - DNA, 643 bp, Panicum virgatum
  misc_feature: Ceres CLONE 1908588
  misc_feature: Encodes the peptide sequence at SEQ ID NO. 32013
gtcctcaagcatccacactaccagtccccaccaccacagctgcgacgcgcctggctggcttcttctagctcagttgctcgcaacaagacacacatcagctgagagaactctgatccgctcttgctcctgcgcggggtcggtggctagcagctagctagccttttgttgttgcccaccgcctcagctcactcacagcgcttctgcctgctgaggaagaggtcgatctctcttagcttggttattgatcgatcgttcgacgacgacgacgctatggtgaggccgccgtgctgcgacaaggagggcgtcaagaagggcccgtggacgccggaggaagacctcgtcctcgtctcctacatccaggagcacggccccggcaactggcgcgccgtcccgaccagaaccgggctgatgcgctgcagcaagagctgccggctccggtggaccaactacctccgcccgggcatcaagcgcggcaacttctccgaccaggaggagaagctcatcgtccacctccaggctctcctcggcaacaggtgggctgccatcgcgtcgtacctgccggagcggacggacaacgacatcaagaactactggaacacgcacctcaagcgtaaactgcagagcggaggcgacggggcggcca

SEQ ID NO: 32013 - protein, 124 aa, Panicum virgatum
  misc_feature: Ceres CLONE 1908588
  misc_feature (67)..(112): Pfam Name: Myb_DNA-binding Pfam Description: Myb-like DNA-binding domain
  misc_feature (14)..(61): Pfam Name: Myb_DNA-binding Pfam Description: Myb-like DNA-binding domain
  misc_feature: The sequence is a functional homolog of SEQ ID NO 1072 in the 10/412,699 US patent application
  misc_feature: The sequence is a functional homolog of SEQ ID NO 1073 in the 10/412,699 US patent application
  misc_feature: The sequence is a functional homolog of SEQ ID NO 588 in the 10/374,780 US patent application
  misc_feature: The sequence is a functional homolog of SEQ ID NO 589 in the 10/374,780 US patent application
  misc_feature: The sequence is a functional homolog of SEQ ID NO 730 in the 11/435,388 US patent application
  misc_feature: The sequence is a functional homolog of SEQ ID NO 794 in the 11/435,388 US patent application
  misc_feature: The sequence is a functional homolog of SEQ ID NO 792 in the 11/435,388 US patent application
  misc_feature: The sequence is a functional homolog of SEQ ID NO 726 in the 11/435,388 US patent application
  misc_feature: The sequence is a functional homolog of SEQ ID NO 1074 in the 10/412,699 US patent application
  misc_feature: The sequence is a functional homolog of SEQ ID NO 590 in the 10/374,780 US patent application
  misc_feature: The sequence is a functional homolog of SEQ ID NO 592 in the 10/374,780 US patent application
  misc_feature: The sequence is a functional homolog of SEQ ID NO 786 in the 11/435,388 US patent application
  misc_feature: The sequence is a functional homolog of SEQ ID NO 788 in the 11/435,388 US patent application
  misc_feature: Useful for making plants with modulated low light sensitivity
  misc_feature: The sequence is a functional homolog of SEQ ID NO 594 in the 10/374,780 US patent application
  misc_feature: The sequence is a functional homolog of SEQ ID NO 784 in the 11/435,388 US patent application
  misc_feature: The sequence is a functional homolog of SEQ ID NO 743 in the 10/666,642 US patent application
  misc_feature: The sequence is a functional homolog of SEQ ID NO 796 in the 11/435,388 US patent application
  misc_feature: The sequence is a functional homolog of SEQ ID NO 1031 in the 11/479,226 US patent application
  misc_feature: The sequence is a functional homolog of SEQ ID NO 1804 in the 10/412,699 US patent application
  misc_feature: The sequence is a functional homolog of SEQ ID NO 2050 in the 10/374,780 US patent application
  misc_feature: The sequence is a functional homolog of SEQ ID NO 444 in the 10/412,699 US patent application
  misc_feature: The sequence is a functional homolog of SEQ ID NO 598 in the 10/225,066 US patent application
  misc_feature: The sequence is a functional homolog of SEQ ID NO 620 in the 11/435,388 US patent application
  misc_feature: The sequence is a functional homolog of SEQ ID NO 790 in the 11/435,388 US patent application
  misc_feature: The sequence is a functional homolog of SEQ ID NO 593 in the 10/374,780 US patent application
  misc_feature: The sequence is a functional homolog of SEQ ID NO 782 in the 11/435,388 US patent application
  misc_feature: The sequence is a functional homolog of SEQ ID NO 263 in the 11/479,226 US patent application
  misc_feature: The sequence is a functional homolog of SEQ ID NO 478 in the 11/435,388 US patent application
  misc_feature: The sequence is a functional homolog of SEQ ID NO 54 in the 10/666,642 US patent application
  misc_feature: The sequence is a functional homolog of SEQ ID NO 1071 in the 10/412,699 US patent application
  misc_feature: The sequence is a functional homolog of SEQ ID NO 587 in the 10/374,780 US patent application
  misc_feature: The sequence is a functional homolog of SEQ ID NO 728 in the 11/435,388 US patent application
  misc_feature: The sequence is a functional homolog of SEQ ID NO 184 in the 10/412,699 US patent application
  misc_feature: The sequence is a functional homolog of SEQ ID NO 397 in the 11/479,226 US patent application
  misc_feature: The sequence is a functional homolog of SEQ ID NO 46 in the 10/374,780 US patent application
  misc_feature: The sequence is a functional homolog of SEQ ID NO 590 in the 11/435,388 US patent application
  misc_feature: The sequence is a functional homolog of SEQ ID NO 6 in the 10/225,068 US patent application
  misc_feature: The sequence is a functional homolog of SEQ ID NO 1075 in the 10/412,699 US patent application
  misc_feature: The sequence is a functional homolog of SEQ ID NO 591 in the 10/374,780 US patent application
  misc_feature: The sequence is a functional homolog of SEQ ID NO 1040 in the 10/225,066 US patent application
  misc_feature: The sequence is a functional homolog of SEQ ID NO 2864 in the 10/374,780 US patent application
  misc_feature: The sequence is a functional homolog of SEQ ID NO 296 in the 11/479,226 US patent application
  misc_feature: The sequence is a functional homolog of SEQ ID NO 569 in the 10/374,780 US patent application
  misc_feature: The sequence is a functional homolog of SEQ ID NO 824 in the 10/412,699 US patent application
  misc_feature: The sequence is a functional homolog of SEQ ID NO 2564 in the 10/374,780 US patent application
  misc_feature: The sequence is a functional homolog of SEQ ID NO 276 in the 10/225,066 US patent application
  misc_feature: The sequence is a functional homolog of SEQ ID NO 818 in the 10/412,699 US patent application
  misc_feature: The sequence is a functional homolog of SEQ ID NO 2572 in the 10/374,780 US patent application
  misc_feature: The sequence is a functional homolog of SEQ ID NO 636 in the 10/225,066 US patent application
  misc_feature: The sequence is a functional homolog of SEQ ID NO 838 in the 10/412,699 US patent application
  misc_feature: The sequence is a functional homolog of SEQ ID NO 1052 in the 11/479,226 US patent application
  misc_feature: The sequence is a functional homolog of SEQ ID NO 456 in the 10/412,699 US patent application
  misc_feature: Useful for making plants with altered alkaloid content
  misc_feature: Useful for making plants with altered lignin content
  misc_feature: Useful for making plants with modulated nitrogen use efficiency
  misc_feature: The sequence is a functional homolog of SEQ ID NO 156 in the 10/412,699 US patent application
  misc_feature: The sequence is a functional homolog of SEQ ID NO 164 in the 10/412,699 US patent application
  misc_feature: The sequence is a functional homolog of SEQ ID NO 1754 in the 10/412,699 US patent application
  misc_feature: The sequence is a functional homolog of SEQ ID NO 1978 in the 10/374,780 US patent application
  misc_feature: The sequence is a functional homolog of SEQ ID NO 353 in the 11/479,226 US patent application
  misc_feature: The sequence is a functional homolog of SEQ ID NO 369 in the 11/479,226 US patent application
  misc_feature: The sequence is a functional homolog of SEQ ID NO 40 in the 10/374,780 US patent application
  misc_feature: The sequence is a functional homolog of SEQ ID NO 776 in the 10/225,066 US patent application
  misc_feature: The sequence is a functional homolog of SEQ ID NO 1680 in the 11/479,226 US patent application
  misc_feature: The sequence is a functional homolog of SEQ ID NO 202 in the 10/666,642 US patent application
  misc_feature: The sequence is a functional homolog of SEQ ID NO 852 in the 10/412,699 US patent application
  misc_feature: The sequence is a functional homolog of SEQ ID NO 110 in the 10/412,699 US patent application
  misc_feature: The sequence is a functional homolog of SEQ ID NO 259 in the 11/479,226 US patent application
  misc_feature: The sequence is a functional homolog of SEQ ID NO 1684 in the 11/479,226 US patent application
  misc_feature: The sequence is a functional homolog of SEQ ID NO 2582 in the 10/374,780 US patent application
  misc_feature: The sequence is a functional homolog of SEQ ID NO 30 in the 11/375,241 US patent application
  misc_feature: The sequence is a functional homolog of SEQ ID NO 854 in the 10/412,699 US patent application
  misc_feature: The sequence is a functional homolog of SEQ ID NO 134 in the 10/412,699 US patent application
  misc_feature: The sequence is a functional homolog of SEQ ID NO 321 in the 11/479,226 US patent application
  misc_feature: The sequence is a functional homolog of SEQ ID NO 822 in the 10/412,699 US patent application
  misc_feature: The sequence is a functional homolog of SEQ ID NO 271 in the 11/479,226 US patent application
  misc_feature: The sequence is a functional homolog of SEQ ID NO 430 in the 10/412,699 US patent application
  misc_feature: The sequence is a functional homolog of SEQ ID NO 995 in the 11/479,226 US patent application
  misc_feature: The sequence is a functional homolog of SEQ ID NO 58 in the 10/666,642 US patent application
  misc_feature: Useful for making plants with altered cell wall content and/or composition
  misc_feature: The sequence is a functional homolog of SEQ ID NO 1064 in the 10/374,780 US patent application
  misc_feature: The sequence is a functional homolog of SEQ ID NO 1306 in the 10/412,699 US patent application
  misc_feature: The sequence is a functional homolog of SEQ ID NO 990 in the 11/435,388 US patent application
  misc_feature: The sequence is a functional homolog of SEQ ID NO 1069 in the 10/374,780 US patent application
  misc_feature: The sequence is a functional homolog of SEQ ID NO 988 in the 11/435,388 US patent application
  misc_feature: The sequence is a functional homolog of SEQ ID NO 116 in the 10/412,699 US patent application
  misc_feature: The sequence is a functional homolog of SEQ ID NO 280 in the 11/479,226 US patent application
  misc_feature: The sequence is a functional homolog of SEQ ID NO 1041 in the 11/479,226 US patent application
  misc_feature: The sequence is a functional homolog of SEQ ID NO 112 in the 10/225,066 US patent application
  misc_feature: The sequence is a functional homolog of SEQ ID NO 20 in the 11/375,241 US patent application
  misc_feature: The sequence is a functional homolog of SEQ ID NO 2052 in the 10/374,780 US patent application
  misc_feature: The sequence is a functional homolog of SEQ ID NO 450 in the 10/412,699 US patent application
  misc_feature: The sequence is a functional homolog of SEQ ID NO 1072 in the 10/374,780 US patent application
  misc_feature: The sequence is a functional homolog of SEQ ID NO 996 in the 11/435,388 US patent application
  misc_feature: The sequence is a functional homolog of SEQ ID NO 1011 in the 11/479,226 US patent application
  misc_feature: The sequence is a functional homolog of SEQ ID NO 434 in the 10/412,699 US patent application
  misc_feature: The sequence is a functional homolog of SEQ ID NO 112 in the 10/412,699 US patent application
  misc_feature: The sequence is a functional homolog of SEQ ID NO 267 in the 11/479,226 US patent application
  misc_feature: The sequence is a functional homolog of SEQ ID NO 1070 in the 10/374,780 US patent application
  misc_feature: The sequence is a functional homolog of SEQ ID NO 992 in the 11/435,388 US patent application
  misc_feature: The sequence is a functional homolog of SEQ ID NO 1002 in the 11/435,388 US patent application
  misc_feature: The sequence is a functional homolog of SEQ ID NO 18 in the 11/375,241 US patent application
  misc_feature: The sequence is a functional homolog of SEQ ID NO 426 in the 10/374,780 US patent application
  misc_feature: The sequence is a functional homolog of SEQ ID NO 458 in the 10/225,066 US patent application
  misc_feature: The sequence is a functional homolog of SEQ ID NO 1004 in the 11/435,388 US patent application
  misc_feature: The sequence is a functional homolog of SEQ ID NO 1068 in the 10/374,780 US patent application
  misc_feature: The sequence is a functional homolog of SEQ ID NO 984 in the 11/435,388 US patent application
  misc_feature: The sequence is a functional homolog of SEQ ID NO 2221 in the 10/666,642 US patent application
  misc_feature: The sequence is a functional homolog of SEQ ID NO 998 in the 11/435,388 US patent application
  misc_feature: The sequence is a functional homolog of SEQ ID NO 1000 in the 11/435,388 US patent application
  misc_feature: The sequence is a functional homolog of SEQ ID NO 2223 in the 10/666,642 US patent application
  misc_feature: The sequence is a functional homolog of SEQ ID NO 168 in the 10/412,699 US patent application
  misc_feature: The sequence is a functional homolog of SEQ ID NO 377 in the 11/479,226 US patent application
  misc_feature: The sequence is a functional homolog of SEQ ID NO 1073 in the 10/374,780 US patent application
  misc_feature: The sequence is a functional homolog of SEQ ID NO 122 in the 10/412,699 US patent application
  misc_feature: The sequence is a functional homolog of SEQ ID NO 126 in the 11/375,241 US patent application
  misc_feature: The sequence is a functional homolog of SEQ ID NO 148 in the 10/286,264 US patent application
  misc_feature: The sequence is a functional homolog of SEQ ID NO 34 in the 10/374,780 US patent application
  misc_feature: The sequence is a functional homolog of SEQ ID NO 438 in the 10/225,066 US patent application
  misc_feature: The sequence is a functional homolog of SEQ ID NO 1901 in the 11/479,226 US patent application
  misc_feature: The sequence is a functional homolog of SEQ ID NO 310 in the 10/374,780 US patent application
  misc_feature: The sequence is a functional homolog of SEQ ID NO 842 in the 10/225,066 US patent application
  misc_feature: The sequence is a functional homolog of SEQ ID NO 1065 in the 10/374,780 US patent application
  misc_feature: The sequence is a functional homolog of SEQ ID NO 1307 in the 10/412,699 US patent application
  misc_feature: The sequence is a functional homolog of SEQ ID NO 986 in the 11/435,388 US patent application
  misc_feature: The sequence is a functional homolog of SEQ ID NO 108 in the 10/412,699 US patent application
  misc_feature: The sequence is a functional homolog of SEQ ID NO 1740 in the 10/412,699 US patent application
  misc_feature: The sequence is a functional homolog of SEQ ID NO 1964 in the 10/374,780 US patent application
  misc_feature: The sequence is a functional homolog of SEQ ID NO 255 in the 11/479,226 US patent application
  misc_feature: The sequence is a functional homolog of SEQ ID NO 908 in the 11/435,388 US patent application
  misc_feature: The sequence is a functional homolog of SEQ ID NO 1006 in the 11/435,388 US patent application
  misc_feature: The sequence is a functional homolog of SEQ ID NO 1008 in the 11/435,388 US patent application
  misc_feature: The sequence is a functional homolog of SEQ ID NO 1681 in the 10/374,780 US patent application
  misc_feature: Useful for making plants with altered carbohydrate content
  misc_feature: The sequence is a functional homolog of SEQ ID NO 148 in the 10/412,699 US patent application
  misc_feature: The sequence is a functional homolog of SEQ ID NO 2266 in the 10/374,780 US patent application
  misc_feature: The sequence is a functional homolog of SEQ ID NO 341 in the 11/479,226 US patent application
  misc_feature: The sequence is a functional homolog of SEQ ID NO 58 in the 11/375,241 US patent application
  misc_feature: Useful for making plants with altered terpenoid content
  misc_feature: Useful for making plants with modulated biomass
  misc_feature: The sequence is a functional homolog of SEQ ID NO 1094 in the 10/225,066 US patent application
  misc_feature: The sequence is a functional homolog of SEQ ID NO 386 in the 10/374,780 US patent application
  misc_feature: The sequence is a functional homolog of SEQ ID NO 442 in the 10/412,699 US patent application
  misc_feature: The sequence is a functional homolog of SEQ ID NO 1067 in the 10/374,780 US patent application
  misc_feature: The sequence is a functional homolog of SEQ ID NO 1309 in the 10/412,699 US patent application
  misc_feature: The sequence is a functional homolog of SEQ ID NO 1071 in the 10/374,780 US patent application
  misc_feature: The sequence is a functional homolog of SEQ ID NO 994 in the 11/435,388 US patent application
  misc_feature: The sequence is a functional homolog of SEQ ID NO 1100 in the 10/225,066 US patent application
  misc_feature: The sequence is a functional homolog of SEQ ID NO 158 in the 10/412,699 US patent application
  misc_feature: The sequence is a functional homolog of SEQ ID NO 2268 in the 10/374,780 US patent application
  misc_feature: The sequence is a functional homolog of SEQ ID NO 357 in the 11/479,226 US patent application
  misc_feature: The sequence is a functional homolog of SEQ ID NO 480 in the 11/435,388 US patent application
  misc_feature: The sequence is a functional homolog of SEQ ID NO 178 in the 10/412,699 US patent application
  misc_feature: The sequence is a functional homolog of SEQ ID NO 389 in the 11/479,226 US patent application
  misc_feature: The sequence is a functional homolog of SEQ ID NO 1010 in the 11/435,388 US patent application
  misc_feature: The sequence is a functional homolog of SEQ ID NO 1411 in the 11/479,226 US patent application
  misc_feature: The sequence is a functional homolog of SEQ ID NO 2492 in the 10/374,780 US patent application
  misc_feature: The sequence is a functional homolog of SEQ ID NO 52 in the 10/225,066 US patent application
  misc_feature: The sequence is a functional homolog of SEQ ID NO 2570 in the 10/374,780 US patent application
  misc_feature: The sequence is a functional homolog of SEQ ID NO 634 in the 10/225,066 US patent application
  misc_feature: The sequence is a functional homolog of SEQ ID NO 832 in the 10/412,699 US patent application
  misc_feature: The sequence is a functional homolog of SEQ ID NO 2394 in the 10/374,780 US patent application
  misc_feature: The sequence is a functional homolog of SEQ ID NO 544 in the 10/225,066 US patent application
  misc_feature: The sequence is a functional homolog of SEQ ID NO 999 in the 11/479,226 US patent application
  misc_feature: The sequence is a functional homolog of SEQ ID NO 1656 in the 11/479,226 US patent application
  misc_feature: The sequence is a functional homolog of SEQ ID NO 834 in the 10/412,699 US patent application
  misc_feature: The sequence is a functional homolog of SEQ ID NO 1066 in the 10/374,780 US patent application
  misc_feature: The sequence is a functional homolog of SEQ ID NO 1308 in the 10/412,699 US patent application
  misc_feature: The sequence is a functional homolog of SEQ ID NO 428 in the 10/374,780 US patent application
  misc_feature: The sequence is a functional homolog of SEQ ID NO 54 in the 11/375,241 US patent application
  misc_feature: The sequence is a functional homolog of SEQ ID NO 870 in the 10/225,066 US patent application
  misc_feature: The sequence is a functional homolog of SEQ ID NO 186 in the 10/412,699 US patent application
  misc_feature: The sequence is a functional homolog of SEQ ID NO 1917 in the 10/374,780 US patent application
  misc_feature: The sequence is a functional homolog of SEQ ID NO 136 in the 10/412,699 US patent application
  misc_feature: The sequence is a functional homolog of SEQ ID NO 325 in the 11/479,226 US patent application
  misc_feature: The sequence is a functional homolog of SEQ ID NO 1118 in the 10/225,066 US patent application
  misc_feature: The sequence is a functional homolog of SEQ ID NO 1396 in the 11/479,226 US patent application
  misc_feature: The sequence is a functional homolog of SEQ ID NO 2488 in the 10/374,780 US patent application
  misc_feature: The sequence is a functional homolog of SEQ ID NO 658 in the 10/412,699 US patent application
  misc_feature: The sequence is a functional homolog of SEQ ID NO 200 in the 10/666,642 US patent application
  misc_feature: The sequence is a functional homolog of SEQ ID NO 830 in the 10/412,699 US patent application
  misc_feature: The sequence is a functional homolog of SEQ ID NO 1660 in the 11/479,226 US patent application
  misc_feature: The sequence is a functional homolog of SEQ ID NO 840 in the 10/412,699 US patent application
  misc_feature: The sequence is a functional homolog of SEQ ID NO 112 in the 11/375,241 US patent application
  misc_feature: The sequence is a functional homolog of SEQ ID NO 2398 in the 10/374,780 US patent application
  misc_feature: The sequence is a functional homolog of SEQ ID NO 466 in the 10/412,699 US patent application
  misc_feature: The sequence is a functional homolog of SEQ ID NO 580 in the 10/225,066 US patent application
  misc_feature: Useful for biocontainment applications
  misc_feature: The sequence is a functional homolog of SEQ ID NO 836 in the 10/412,699 US patent application
  misc_feature: The sequence is a functional homolog of SEQ ID NO 170 in the 10/412,699 US patent application
  misc_feature: The sequence is a functional homolog of SEQ ID NO 1756 in the 10/412,699 US patent application
  misc_feature: The sequence is a functional homolog of SEQ ID NO 1980 in the 10/374,780 US patent application
  misc_feature: The sequence is a functional homolog of SEQ ID NO 750 in the 10/225,066 US patent application
  misc_feature: The sequence is a functional homolog of SEQ ID NO 2556 in the 10/374,780 US patent application
  misc_feature: The sequence is a functional homolog of SEQ ID NO 272 in the 10/225,066 US patent application
  misc_feature: The sequence is a functional homolog of SEQ ID NO 528 in the 11/435,388 US patent application
  misc_feature: The sequence is a functional homolog of SEQ ID NO 1626 in the 10/412,699 US patent application
  misc_feature: The sequence is a functional homolog of SEQ ID NO 979 in the 10/666,642 US patent application
  misc_feature: The sequence is a functional homolog of SEQ ID NO 1434 in the 10/666,642 US patent application
  misc_feature: The sequence is a functional homolog of SEQ ID NO 1850 in the 10/412,699 US patent application
  misc_feature: The sequence is a functional homolog of SEQ ID NO 848 in the 10/412,699 US patent application
  misc_feature: The sequence is a functional homolog of SEQ ID NO 1056 in the 11/479,226 US patent application
  misc_feature: The sequence is a functional homolog of SEQ ID NO 144 in the 10/374,780 US patent application
  misc_feature: The sequence is a functional homolog of SEQ ID NO 458 in the 10/412,699 US patent application
  misc_feature: The sequence is a functional homolog of SEQ ID NO 756 in the 10/225,066 US patent application
  misc_feature: The sequence is a functional homolog of SEQ ID NO 1692 in the 11/479,226 US patent application
  misc_feature: The sequence is a functional homolog of SEQ ID NO 188 in the 10/412,699 US patent application
  misc_feature: The sequence is a functional homolog of SEQ ID NO 2274 in the 10/374,780 US patent application
  misc_feature: The sequence is a functional homolog of SEQ ID NO 704 in the 10/225,066 US patent application
  misc_feature: The sequence is a functional homolog of SEQ ID NO 266 in the 10/374,780 US patent application
  misc_feature: The sequence is a functional homolog of SEQ ID NO 536 in the 11/435,388 US patent application
  misc_feature: The sequence is a functional homolog of SEQ ID NO 640 in the 10/225,066 US patent application
  misc_feature: The sequence is a functional homolog of SEQ ID NO 856 in the 10/412,699 US patent application
  misc_feature: The sequence is a functional homolog of SEQ ID NO 1033 in the 10/412,699 US patent application
  misc_feature: The sequence is a functional homolog of SEQ ID NO 540 in the 10/374,780 US patent application
  misc_feature: The sequence is a functional homolog of SEQ ID NO 124 in the 10/412,699 US patent application
  misc_feature: The sequence is a functional homolog of SEQ ID NO 1742 in the 10/412,699 US patent application
  misc_feature: The sequence is a functional homolog of SEQ ID NO 1966 in the 10/374,780 US patent application
  misc_feature: The sequence is a functional homolog of SEQ ID NO 299 in the 11/479,226 US patent application
  misc_feature: The sequence is a functional homolog of SEQ ID NO 446 in the 10/412,699 US patent application
  misc_feature: The sequence is a functional homolog of SEQ ID NO 168 in the 10/225,066 US patent application
  misc_feature: The sequence is a functional homolog of SEQ ID NO 2718 in the 10/374,780 US patent application
  misc_feature: The sequence is a functional homolog of SEQ ID NO 1572 in the 10/374,780 US patent application
  misc_feature: The sequence is a functional homolog of SEQ ID NO 1408 in the 11/479,226 US patent application
  misc_feature: The sequence is a functional homolog of SEQ ID NO 664 in the 10/412,699 US patent application
  misc_feature: The sequence is a functional homolog of SEQ ID NO 504 in the 10/666,642 US patent application
  misc_feature: The sequence is a functional homolog of SEQ ID NO 896 in the 11/435,388 US patent application
  misc_feature: The sequence is a functional homolog of SEQ ID NO 1916 in the 10/412,699 US patent application
  misc_feature: The sequence is a functional homolog of SEQ ID NO 2176 in the 10/374,780 US patent application
  misc_feature: The sequence is a functional homolog of SEQ ID NO 2 in the 10/225,068 US patent application
  misc_feature: The sequence is a functional homolog of SEQ ID NO 22 in the 10/225,068 US patent application
  misc_feature: The sequence is a functional homolog of SEQ ID NO 230 in the 10/225,066 US patent application
  misc_feature: The sequence is a functional homolog of SEQ ID NO 258 in the 10/374,780 US patent application
  misc_feature: The sequence is a functional homolog of SEQ ID NO 442 in the 11/435,388 US patent application
  misc_feature: The sequence is a functional homolog of SEQ ID NO 842 in the 10/412,699 US patent application
  misc_feature: The sequence is a functional homolog of SEQ ID NO 98 in the 11/375,241 US patent application
  misc_feature: The sequence is a functional homolog of SEQ ID NO 1914 in the 10/412,699 US patent application
  misc_feature: The sequence is a functional homolog of SEQ ID NO 2174 in the 10/374,780 US patent application
  misc_feature: The sequence is a functional homolog of SEQ ID NO 956 in the 10/225,066 US patent application
  misc_feature: The sequence is a functional homolog of SEQ ID NO 126 in the 10/412,699 US patent application
  misc_feature: The sequence is a functional homolog of SEQ ID NO 1015 in the 11/479,226 US patent application
  misc_feature: The sequence is a functional homolog of SEQ ID NO 138 in the 10/374,780 US patent application
  misc_feature: The sequence is a functional homolog of SEQ ID NO 436 in the 10/412,699 US patent application
  misc_feature: The sequence is a functional homolog of SEQ ID NO 60 in the 11/375,241 US patent application
  misc_feature: Useful for making plants with enhanced nutritional value
  misc_feature: Useful for making plants with modulated heat sensitivity
  misc_feature: The sequence is a functional homolog of SEQ ID NO 1688 in the 11/479,226 US patent application
  misc_feature: The sequence is a functional homolog of SEQ ID NO 1852 in the 10/412,699 US patent application
  misc_feature: The sequence is a functional homolog of SEQ ID NO 2094 in the 10/374,780 US patent application
  misc_feature: The sequence is a functional homolog of SEQ ID NO 1540 in the 10/374,780 US patent application
  misc_feature: The sequence is a functional homolog of SEQ ID NO 1634 in the 10/412,699 US patent application
  misc_feature: The sequence is a functional homolog of SEQ ID NO 2574 in the 10/374,780 US patent application
  misc_feature: The sequence is a functional homolog of SEQ ID NO 278 in the 10/225,066 US patent application
  misc_feature: The sequence is a functional homolog of SEQ ID NO 36 in US patent 7193132
  misc_feature: The sequence is a functional homolog of SEQ ID NO 232 in the 10/225,066 US patent application
  misc_feature: The sequence is a functional homolog of SEQ ID NO 264 in the 10/374,780 US patent application
  misc_feature: The sequence is a functional homolog of SEQ ID NO 534 in the 11/435,388 US patent application
  misc_feature: The sequence is a functional homolog of SEQ ID NO 1541 in the 10/374,780 US patent application
  misc_feature: The sequence is a functional homolog of SEQ ID NO 1635 in the 10/412,699 US patent application
  misc_feature: The sequence is a functional homolog of SEQ ID NO 2696 in the 10/374,780 US patent application
  misc_feature: The sequence is a functional homolog of SEQ ID NO 344 in the 10/225,066 US patent application
  misc_feature: The sequence is a functional homolog of SEQ ID NO 116 in the 11/375,241 US patent application
  misc_feature: The sequence is a functional homolog of SEQ ID NO 1648 in the 11/479,226 US patent application
  misc_feature: The sequence is a functional homolog of SEQ ID NO 2566 in the 10/374,780 US patent application
  misc_feature: The sequence is a functional homolog of SEQ ID NO 632 in the 10/225,066 US patent application
  misc_feature: The sequence is a functional homolog of SEQ ID NO 650 in the 11/435,388 US patent application
  misc_feature: The sequence is a functional homolog of SEQ ID NO 826 in the 10/412,699 US patent application
  misc_feature: The sequence is a functional homolog of SEQ ID NO 1566 in the 10/374,780 US patent application
  misc_feature: The sequence is a functional homolog of SEQ ID NO 1564 in the 10/374,780 US patent application
  misc_feature: Useful for making plants with modulated flowering time
  misc_feature: The sequence is a functional homolog of SEQ ID NO 1563 in the 10/374,780 US patent application
  misc_feature: The sequence is a functional homolog of SEQ ID NO 176 in the 10/412,699 US patent application
  misc_feature: The sequence is a functional homolog of SEQ ID NO 385 in the 11/479,226 US patent application
  misc_feature: The sequence is a functional homolog of SEQ ID NO 1565 in the 10/374,780 US patent application
  misc_feature: The sequence is a functional homolog of SEQ ID NO 196 in the 10/225,066 US patent application
  misc_feature: The sequence is a functional homolog of SEQ ID NO 2900 in the 10/374,780 US patent application
  misc_feature: Useful for making plants with modulated drought sensitivity
  misc_feature: The sequence is a functional homolog of SEQ ID NO 2178 in the 10/374,780 US patent application
  misc_feature: The sequence is a functional homolog of SEQ ID NO 1672 in the 11/479,226 US patent application
  misc_feature: The sequence is a functional homolog of SEQ ID NO 846 in the 10/412,699 US patent application
  misc_feature: The sequence is a functional homolog of SEQ ID NO 1746 in the 10/412,699 US patent application
  misc_feature: The sequence is a functional homolog of SEQ ID NO 1970 in the 10/374,780 US patent application
  misc_feature: The sequence is a functional homolog of SEQ ID NO 452 in the 10/225,066 US patent application
  misc_feature: The sequence is a functional homolog of SEQ ID NO 584 in the 11/435,388 US patent application
  misc_feature: The sequence is a functional homolog of SEQ ID NO 156 in the 10/225,068 US patent application
  misc_feature: The sequence is a functional homolog of SEQ ID NO 262 in the 10/374,780 US patent application
  misc_feature: The sequence is a functional homolog of SEQ ID NO 282 in the 10/225,066 US patent application
  misc_feature: The sequence is a functional homolog of SEQ ID NO 2898 in the 10/374,780 US patent application
  misc_feature: The sequence is a functional homolog of SEQ ID NO 494 in the 10/225,066 US patent application
  misc_feature: The sequence is a functional homolog of SEQ ID NO 160 in the 10/412,699 US patent application
  misc_feature: The sequence is a functional homolog of SEQ ID NO 214 in the 10/225,068 US patent application
  misc_feature: The sequence is a functional homolog of SEQ ID NO 2270 in the 10/374,780 US patent application
  misc_feature: The sequence is a functional homolog of SEQ ID NO 361 in the 11/479,226 US patent application
  misc_feature: The sequence is a functional homolog of SEQ ID NO 462 in the 10/225,066 US patent application
  misc_feature: The sequence is a functional homolog of SEQ ID NO 482 in the 11/435,388 US patent application
  misc_feature: The sequence is a functional homolog of SEQ ID NO 1863 in the 10/374,780 US patent application
  misc_feature: The sequence is a functional homolog of SEQ ID NO 132 in the 10/412,699 US patent application
  misc_feature: The sequence is a functional homolog of SEQ ID NO 1968 in the 10/374,780 US patent application
  misc_feature: The sequence is a functional homolog of SEQ ID NO 309 in the 11/479,226 US patent application
  misc_feature: The sequence is a functional homolog of SEQ ID NO 582 in the 11/435,388 US patent application
  misc_feature: The sequence is a functional homolog of SEQ ID NO 454 in the 10/374,780 US patent application
  misc_feature: The sequence is a functional homolog of SEQ ID NO 568 in the 11/435,388 US patent application
  misc_feature: The sequence is a functional homolog of SEQ ID NO 90 in the 10/225,068 US patent application
MVRPPCCDKEGVKKGPWTPEEDLVLVSYIQEHGPGNWRAVPTRTGLMRCSKSCRLRWTNYLRPGIKRGNFSDQEEKLIVHLQALLGNRWAAIASYLPERTDNDIKNYWNTHLKRKLQSGGDGAA

SEQ ID NO: 32014 - DNA, 763 bp, Panicum virgatum
  misc_feature: Ceres CLONE 1908591
  misc_feature: Encodes the peptide sequence at SEQ ID NO. 32015
agttccgagagagagagagagagagagagagagagcggtgctgattgctgaggggcgcggtggccggtggatggcgatggccggcggtgggggactgaaccggtcgtcgtcgagggggcagctgccgccacaagagcttctcgacgatctctgcagccgcttcctgctgaacgtgcccaaggaggagctcgagtcgttcgagcggatcctgttccttctggagcaggcgcactggttctacgaggacaactccgtcgagcacaaccccaacctcaaatccctctccttcaaggacttcacctccctcatgttcaagagctgcactgctctcaggccctacatcgcgcacctggatgatatctacaaggacttcaacaactacaagttccgcgtccctgtgtccggcgccatcatcctggatgacacctatgagaggtgcttgcttgttaagggatggaaagctggggccagctggagctttcctcgtggaaagaggaataaagatgaggaagatcacacctgtgctgttagagaagttctggaggaaactgggtgtgatgtttctacactattaaatttggatgattacattgaagtttcaattgggcaacaaaaagttcggctctatatcataactggcgttaagagagatactgtgtttgcacctcaaacaaagaaggaaatcagtgaaatctcatggcacagaattgatgatcttctaccagctagtgatgatgcggtatctcgtggagttaatggaatg

SEQ ID NO: 32015 - protein, 230 aa, Panicum virgatum
  misc_feature: Ceres CLONE 1908591
  misc_feature (21)..(105): Pfam Name: DCP2 Pfam Description: Dcp2, box A domain
  misc_feature (107)..(230): Pfam Name: NUDIX Pfam Description: NUDIX domain
MAMAGGGGLNRSSSRGQLPPQELLDDLCSRFLLNVPKEELESFERILFLLEQAHWFYEDNSVEHNPNLKSLSFKDFTSLMFKSCTALRPYIAHLDDIYKDFNNYKFRVPVSGAIILDDTYERCLLVKGWKAGASWSFPRGKRNKDEEDHTCAVREVLEETGCDVSTLLNLDDYIEVSIGQQKVRLYIITGVKRDTVFAPQTKKEISEISWHRIDDLLPASDDAVSRGVNG

SEQ ID NO: 32016 - DNA, 1200 bp, Panicum virgatum
  misc_feature: Ceres CLONE 1908593
  misc_feature: Encodes the peptide sequence at SEQ ID NO. 32017
accgccgcgccgtgccgtgccagcacaacgtgagaactccgtggcggcttgcgcgacgctgccacgagaggggacatgctaccgcgcgccgctctctctctctctctctctctctctctctctctctctctctctcgagctccgtcactcttttaagccccagaggcccagaggacatcatcgtcatccatcactagctcggatcggagcagaatctgttcgtcccttccccgagaggcaacctaccacgctagctagcgagcgagctgccgggatgctgatgcagctctccggcggcggccgccggagcatggtcctgccgtggctcgccgtggtggcggccgcggccgcgctggccgccgccccgcgcggggcggaggcgtaccggaactacaccgtcggcgacgacaagggctggtacgacggcctcaccctgcccggggtcgactaccaggcctgggccgacggcatcaagaacttcagcctcggggacttcctcatcttcaacacggacaagaaccactcggtggtgcagacgcggaacgggacgctgtacaagagctgcgactacaacgactcgggccccgacgacaccctcgagtggtccgccgccgcgccggagttcacaaaggacgccgtcaccgtcgccgtgccgctcctcagggagggccgcacctacttcttctcgggcaactacgacggcgagcagtgcgagaacggccagcgcttcgccatcgacgtcgcgcacggccagggcctgccgccggacctcaggccgcccgccgccgccgccgcgcccgcgccctccgccgggcccgccgacggcgccgccgtgctcgacttcagccaccccaagaacgtcaccacgcccagcgcttcggacgacgacgaccgcgagagcggcggtgatggagacacctcgggcgccggccggactctggccgggatcggctccggcctggccctgacgacgctggtcgccaccgtgctccttgcagtgtagtaggttagtttctcgttttagtgacgcctgatgtatgtgatttgttgttgtaatgtgtttactactagtcaaagtagaagggtttctacaaggtgacatgttttagttagtgaagtgctttcacttgtacattgtgcaatttctttgatatgtactgggtttgctaaataataataattccattctttggatcgacc

SEQ ID NO: 32017 - protein, 242 aa, Panicum virgatum
  misc_feature: Ceres CLONE 1908593
  misc_feature (48)..(150): Pfam Name: Cu_bind_like Pfam Description: Plastocyanin-like domain
MLMQLSGGGRRSMVLPWLAVVAAAAALAAAPRGAEAYRNYTVGDDKGWYDGLTLPGVDYQAWADGIKNFSLGDFLIFNTDKNHSVVQTRNGTLYKSCDYNDSGPDDTLEWSAAAPEFTKDAVTVAVPLLREGRTYFFSGNYDGEQCENGQRFAIDVAHGQGLPPDLRPPAAAAAPAPSAGPADGAAVLDFSHPKNVTTPSASDDDDRESGGDGDTSGAGRTLAGIGSGLALTTLVATVLLAV

SEQ ID NO: 32018 - DNA, 1651 bp, Panicum virgatum
  misc_feature: Ceres CLONE 1908595
  misc_feature: Encodes the peptide sequence at SEQ ID NO. 32019
accagccagcgccgcttcttccttggaacccctcaccaccgctcgtttatacgccagcgacgccgcctcccccctcctcgagcaaaggcgagcgcgagagaaacctgaagccactccccaccccgcttcccccccctcgctgcgatctcctcacatggcagtgctgcgcctccgcgagccactcaagaggaacggcccctgcttctgcttctccgacccctgtccctgcgccgacccgcgccgccccagccccaaccccgatctcgccgcccccttcccctttcttcgcgtccatcgcacctgctcctgatcccactctcttcctcaccctcctcgctccgtgattcgcggttctgattctactgacgcggcttgtctcaaggttcctgtgagagtctgagttttggttccgtctcacgccggtctctcgccatggggaaaagcaaaaagagcaaggcccgcggcggtggggacgatctgctcgacagcagcgacgccgacagcgtaagctcctcgtccaccgctctgtcggatctctccatctcgtacgccaccgagcacgtcaactcgcaggagttcgtcctcgacaagtacatcgacgacctctacgaaaagaggggatctacaagagaggcagcattggttaaactggttgatgccttcgaaagttttatgcttcatggtcttgtggagaacaagtatgctactctgctaagtcaattcaacaattctgtgaaaaaaggatctactaaggaggtttttctggcatctcgtgccatcgggttattggccattacgctcggtgctgggagcagttcacatgaaattatggaggagtcacatccccaactttgtagagtacttcaagcttggtccgatgctgcaaagatgatatctgcacttgattgtttggctgtcatcacatttgttggtgtaactgatctgactgaaacagagttatctttgaaagcaatgtgggatgtgattcatccaaagtctggttcaaatgtgggaactgttaggaaacctaagcctcctgtgttagcagctgctatatctgcatggacatttctcctgactactattggttcatggaggataaatcccaacagttggaaagagcccatcgcatttctctctactcttttagaagcagaggatcgtgctgttcgaatggctgctggtgaagcattggttttgtgctttgagttaaatctgctcgatgtttcttcttgtgaagatggtgatgccaacacaggaggaactggtggttctaagaacaagcttttcttggatatgcaagctttaaaagccaaaatatctggtctagcgtctaatctctctgcagaggctgggggtaaaggcgcagacaagaaaaaccttactgatcaaagagacttgtttcaacgaatcttggattttgtcaagtatggagaatcccctgaagaatcaatcaagattgctggaaagcgtgatgtcttaagggtttcatcatggtctgaactaatccagttgaatttcttaaagcggttccttgggaaaggctttctgaagcatgtgaaggagaatggacttcttcaagatatatttgacattaaagttgacactactgaaactttgtcatccactgataagaaaatctttaggtctg

SEQ ID NO: 32019 - protein, 406 aa, Panicum virgatum
  misc_feature: Ceres CLONE 1908595
  misc_feature (20)..(332): Pfam Name: IFRD Pfam Description: Interferon-related developmental regulator (IFRD)
MGKSKKSKARGGGDDLLDSSDADSVSSSSTALSDLSISYATEHVNSQEFVLDKYIDDLYEKRGSTREAALVKLVDAFESFMLHGLVENKYATLLSQFNNSVKKGSTKEVFLASRAIGLLAITLGAGSSSHEIMEESHPQLCRVLQAWSDAAKMISALDCLAVITFVGVTDLTETELSLKAMWDVIHPKSGSNVGTVRKPKPPVLAAAISAWTFLLTTIGSWRINPNSWKEPIAFLSTLLEAEDRAVRMAAGEALVLCFELNLLDVSSCEDGDANTGGTGGSKNKLFLDMQALKAKISGLASNLSAEAGGKGADKKNLTDQRDLFQRILDFVKYGESPEESIKIAGKRDVLRVSSWSELIQLNFLKRFLGKGFLKHVKENGLLQDIFDIKVDTTETLSSTDKKIFRS

SEQ ID NO: 32020 - DNA, 1373 bp, Panicum virgatum
  misc_feature: Ceres CLONE 1908621
  misc_feature: Encodes the peptide sequence at SEQ ID NO. 32021
caaatcgggcgggccaactgcgagccaactgattcgaacaaacgagcgccgagaaagcaacagagagggaaaaacagagagagggagggagccggagcggccatggcgacagcggtcagcggccggtggacgtgcgtccgcacgctgggccgcggcgcgtcgggcgcggtggtctcgctcgccgccgacgcggcctcgggcgcgctcttcgccgtcaagtccgccgcggcgggcgccgccggggcggagcagctgcggcgcgagggggccatcctctccgcgctccgctcgccgcacgtcctcccctgcctcggcttccgcgccgccgccgaggccgggggcgagtgccagctcttcctcgagtttgcgccggggggctccctcgccgacgtcgcggccaggggcggcggcgggcggctgggcgagcgcgccgtccgggcgtacgcggcggacgtggccaggggcctggcgtacctccacgggcgctcgctcgtgcacggcgacgtcaaggccgccaacgtcgcggtcggcgccgacggccgcgccaagctcgcggacttcgggtgcgccagggcggcggggtccgcgcgccccatcggcggcacgccggcgttcatggcgcccgaggtggcgcgcggggaggagcagggccccgccgccgacgtctgggcgctggggtgcaccgtcctcgagctggccacggggcgcgccccgtggagcgacctgggcgacctcctcgcggccgtgcaccggatcgggtacacggacgccgcgccggaggtgcccgcgtggatgtccgcggaggccagggacttcctgtcccggtgcttcgcgaggaacccgcgcgaccggtgggcggcggcgcagctcctggagcacccgttcctggcgtccgccgggaaggcagaggaggtcgcggcggaatgggtgtcccccaagagcacgctggacgcggcgctctgggagtccgactccgacgacgagggcgacgtgccggagagccccgcccggagaatcaaggaattggcgggcgcctgctcggccttgcccgactgggattccgacgagggcgactggatccaggtgctcgacgagcaatgtcaggcctgcgatcctgaggcggccaaggagatggccggcgaagacaagtgccagctgctgagcgaagcatcggaaacggaggttggtttcatcgacgccgatgcagagggcgatgttgatcccgagtgttccgtagctctaggatcattagctgctccgtcagctgggcagctgcagcaggaagagccgtgtagcggttcttggagtgatccatctgtatttgctgttgcgacctgtcagagaattgaaatgtcagagccatctttactgcc

SEQ ID NO: 32021 - protein, 423 aa, Panicum virgatum
  misc_feature: Ceres CLONE 1908621
  misc_feature (9)..(262): Pfam Name: Pkinase Pfam Description: Protein kinase domain
  misc_feature: SWISSPROT Homolog: EC 2.7.11.25 Mitogen-activated protein kinase kinase kinase
MATAVSGRWTCVRTLGRGASGAVVSLAADAASGALFAVKSAAAGAAGAEQLRREGAILSALRSPHVLPCLGFRAAAEAGGECQLFLEFAPGGSLADVAARGGGGRLGERAVRAYAADVARGLAYLHGRSLVHGDVKAANVAVGADGRAKLADFGCARAAGSARPIGGTPAFMAPEVARGEEQGPAADVWALGCTVLELATGRAPWSDLGDLLAAVHRIGYTDAAPEVPAWMSAEARDFLSRCFARNPRDRWAAAQLLEHPFLASAGKAEEVAAEWVSPKSTLDAALWESDSDDEGDVPESPARRIKELAGACSALPDWDSDEGDWIQVLDEQCQACDPEAAKEMAGEDKCQLLSEASETEVGFIDADAEGDVDPECSVALGSLAAPSAGQLQQEEPCSGSWSDPSVFAVATCQRIEMSEPSLL

SEQ ID NO: 32022 - DNA, 1130 bp, Panicum virgatum
  misc_feature: Ceres CLONE 1908635
  misc_feature: Encodes the peptide sequence at SEQ ID NO. 32023
gaaccgccccggctgcacgcccctcgacccaaccaaccctaatggcgctctcgctcgcgcgcagcccccaccccgccgcggcgctcccggccccgcgggtttcccagtttgcccctcctctggccccgctccgctcccctcgccgccagcaccgggcgcgcctgcgcctccgcttcccgggcaccgccgccgccgtcgccgtcgcggcctcgtcgcaggcggcccccgcggcggcggatgaggagcagggggagaagcggcggaagctgtacgtggccaacctgccctggtccctgcccgcgccggaggtcgagaagctcttcgcgcagtgcggcaccgtcaaggacgtcgagctgatcaaggggaaggatgggaggaacagggggttcgcgttcgtgacgatgtcgacggcggaggaggcggccgcggccgtggagaagctgaactcgcatgatgtaatggggcgttcaatcaaggtggagttttcaaagagcttcaggaaacccgctccacctcctcctccgggcaccattatagagaggcacaagctttatgtgtccaatcttccatggaaaacgagagctcctgatgtcaaggaattcttctcaaattttaacccgctttctgctaacattatcttcgataatggaaaagcagctggctacggttttgtttcctttgggacaaaacaagaagcagaggctgctctcagtgagcttgatggaaaggaactcatgggaagacctgttattttgaaatggaaggaaagtggcgatgataaggatgaggttgtaaaagctggttctaatgaatagtaggtgggcccccctaccgttaaaaaaaaggttttaaaagctgacggtgaagttgaaacagaaaatactgaaggagcaagtgtggatgatgccagcgatgatggaggtgaagataaacaggaatagtcaaaaacactatactgtcctacaggaagaaagtttcttctgccatattgatataagcacagatatggagccttgttgtacagctagaagttttttccccatacttcttggtgtgtgagtgcatcaccattgtgcctttaattgcacttatcactcatggttggtacttgaattaatttgtttctgtcg

SEQ ID NO: 32023 - protein, 257 aa, Panicum virgatum
  misc_feature: Ceres CLONE 1908635
  misc_feature (76)..(146): Pfam Name: RRM_1 Pfam Description: RNA recognition motif. (a.k.a. RRM, RBD, or RNP domain)
  misc_feature (170)..(238): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MALSLARSPHPAAALPAPRVSQFAPPLAPLRSPRRQHRARLRLRFPGTAAAVAVAASSQAAPAAADEEQGEKRRKLYVANLPWSLPAPEVEKLFAQCGTVKDVELIKGKDGRNRGFAFVTMSTAEEAAAAVEKLNSHDVMGRSIKVEFSKSFRKPAPPPPPGTIIERHKLYVSNLPWKTRAPDVKEFFSNFNPLSANIIFDNGKAAGYGFVSFGTKQEAEAALSELDGKELMGRPVILKWKESGDDKDEVVKAGSNE

SEQ ID NO: 32024 - DNA, 1341 bp, Panicum virgatum
  misc_feature: Ceres CLONE 1908647
  misc_feature: Encodes the peptide sequence at SEQ ID NO. 32025
atcgacccccccaactcgccatccctcccccccactccggcggggacctacacccatctcgctcgtacgtcttcctcgtatcagaggatgatgatgccccagagcggcggcagcctcgatctcgggctcagcctcgggctcacctcccagggcagcctctcctcctccaccacctccggcgcgctctccccctgggccgccgccctcagctccgtcgatggggacgcgatgacgaggagggacgcgcacgcgcagcagcagcagcagcacggcgccgccgcggcggcgatggatcccgaccgcgcggcgatgcgcgcgtccacgtcgcccgacagcgccgccgcgctctccagcggcgccagcggggacaacaacaagcgggagcgcggcgagctcgagcgcaccggctccggcggcgtgcgcagcgacgaggaggacggcgcggacggtgccggcggccgcaagaagctgcgcctctccaaggaccaggccgccgtgctcgaggactgcttcaagacgcacagcacgctcaatcccaagcagaaggtcgccctggccaaccgcctgggcctgcggccgcggcaggtggaggtgtggttccagaaccgccgcgcccggaccaagctcaagcagacggaggtcgactgcgagtacctcaagcgctggtgcgagcgcctcgccgacgagaacaagcgcctcgagaaggagctcgccgacctccgggcgctcaaggccgcgccctcgcccgccgcgcagcccgcctcccccgccgccaccctcacaatgtgcccctcctgccgccgcgtcgccgccgccgccggcgcccctgccgctaaccaccaccagcaatgccaccccaaatctaacgctgccgctgccggcaacgtcgtgcccagccactgccagttcttcccggccgccgtcgaccggacagggcagagcacgtggaacgccgccgccgcgccgctcgtcaccagggagctgttctagggtcgatcggatcgatcgatctcgccatggtgacgtcaaccaagtgcggaaggcgatggatcgaccgattcgacggttgattagaaggacaagctctgattaggatcttggcggtcgcagtaattaattacgattaatcaggagaggagattttcttttggtttcctttttttccttttcttttcgattaattaattcatcagttgggtttctgaaaacgacgacgacgaagaaggatgaacaacaaacaaagatggctgtctgctttttcctggacggcgtgtaaaccagttcacctaatctgctggttggtgaaataacagcgtgattgattgtactaattgattggtg

SEQ ID NO: 32025 - protein, 299 aa, Panicum virgatum
  misc_feature: Ceres CLONE 1908647
  misc_feature (125)..(179): Pfam Name: Homeobox Pfam Description: Homeobox domain
  misc_feature (180)..(224): Pfam Name: HALZ Pfam Description: Homeobox associated leucine zipper
  misc_feature: The sequence is a functional homolog of SEQ ID NO 254 in the 10/412,699 US patent application
  misc_feature: The sequence is a functional homolog of SEQ ID NO 550 in the 11/479,226 US patent application
MMPQSGGSLDLGLSLGLTSQGSLSSSTTSGALSPWAAALSSVDGDAMTRRDAHAQQQQQHGAAAAAMDPDRAAMRASTSPDSAAALSSGASGDNNKRERGELERTGSGGVRSDEEDGADGAGGRKKLRLSKDQAAVLEDCFKTHSTLNPKQKVALANRLGLRPRQVEVWFQNRRARTKLKQTEVDCEYLKRWCERLADENKRLEKELADLRALKAAPSPAAQPASPAATLTMCPSCRRVAAAAGAPAANHHQQCHPKSNAAAAGNVVPSHCQFFPAAVDRTGQSTWNAAAAPLVTRELF

SEQ ID NO: 32026 - DNA, 470 bp, Panicum virgatum
  misc_feature: Ceres CLONE 1908664
  misc_feature: Encodes the peptide sequence at SEQ ID NO. 32027
acgctccatctctcgagcacagagcactgcaccctctcatccgccggtgcttgctcctcctccccacttcagctagtagcctcttcttgagagaatcatcaggaagaggccgggatatcgagggatcgagcaagatgatgagcggcaaggctctccttgtcgccgtgctcttggtgggcgtcgcctcccggtgctccggcagcaggggcctgcagtggggtcacatcgctgagcagaagtacggtggcggtggggacggtggcggcggcggcggatacggtggcggcggtgggtacggcggcggaggtggtggtggtgggtatggaggcgacagcttctacacgacccgatagtccggagccaggacctgcgactaggggatgatccacgcggacgccatcgtcttgcgcgtcctgtcgctcggcaacaacgtggggtctgttgacgacgtgtgtatcttctccggctct

SEQ ID NO: 32027 - protein, 72 aa, Panicum virgatum
  misc_feature: Ceres CLONE 1908664
  misc_feature (2)..(67): Pfam Name: GRP Pfam Description: Glycine rich protein family
  misc_feature: Useful for making plants with altered lignin content
MMSGKALLVAVLLVGVASRCSGSRGLQWGHIAEQKYGGGGDGGGGGGYGGGGGYGGGGGGGGYGGDSFYTTR

SEQ ID NO: 32028 - DNA, 450 bp, Panicum virgatum
  misc_feature: Ceres CLONE 1908668
  misc_feature: Encodes the peptide sequence at SEQ ID NO. 32029
ccgccgccctgtcctcacctgttgacttgctttaattgttcttgctcatcctcctctccaccgaccttgagctccataggcctttctagacatgggtaaggagaaggttttcatcttcatcctggtcatcggccatgtttactctggattgtcccccacccccggccacctcatctaccatctgggaggcatcgacaaccgcgtcatcgacacgtgcgagaaggaggctgcccagatgaacaagaggtccttcaagtacgcctgggtactcaacaagctcagagacgagcgcgagaggggcatcaccatcgacattgccctgtggaagttcgagaccaccaattactactgcaccgtgatcgacgcccctgggcacagtgacttcatcaagaaaatgatcaccgggacctcccaggcctattgcgccgtgctcatcatcatactccacca

SEQ ID NO: 32029 - protein, 119 aa, Panicum virgatum
  misc_feature: Ceres CLONE 1908668
  misc_feature (5)..(119): Pfam Name: GTP_EFTU Pfam Description: Elongation factor Tu GTP binding domain
  misc_feature: SWISSPROT Homolog: EC 2.7.7.4 Sulfate adenylyltransferase
MGKEKVFIFILVIGHVYSGLSPTPGHLIYHLGGIDNRVIDTCEKEAAQMNKRSFKYAWVLNKLRDERERGITIDIALWKFETTNYYCTVIDAPGHSDFIKKMITGTSQAYCAVLIIILH

SEQ ID NO: 32030 - DNA, 684 bp, Panicum virgatum
  misc_feature: Ceres CLONE 1908675
  misc_feature: Encodes the peptide sequence at SEQ ID NO. 32031
aaaaaaaaaacgccccgttttcgtcccctcccctcccccgattccgaacgagagaaaatccgataggaaatgcggccccgcagacccccattccgccgtgggggtccaaatctcgctggtacatgacgccgacgccgctcagcccttccttctcacgacatcggttccaaggcaccgccgccgccgcctccgagcaaccctgcgtcacgctgttcgagtggtggctggagagagtggaaggggatgaccagaaggtcgccgtcgcagggaaatttgaaaggaatcaaacagtctacgaattcggttctgcaaccattgcaaagcgccacgaagctcgcgttcttgaaactgaaggtggaattctacttctcatctatggcacacacaaccgttcgcggatgctagccggcggatactcaagtgaggtctacgaaaagttcaagatcggatttccatactgctgggaagattgcatccagctttatcccaaggtggcacaaacaggatcggatagtgctataaatgaaaatgctgttgtctcaaatgatggcggagaaagacatgaagctgcacgtaatgaggcgtataatgtggaaacagacttgattgcatgcagagctttaagagaaagagatgatggtggcatagatactaatgcatctttagtgcatataggtggagtgt

SEQ ID NO: 32031 - protein, 187 aa, Panicum virgatum
  misc_feature: Ceres CLONE 1908675
  misc_feature (28)..(118): Pfam Name: SANTA Pfam Description: SANTA (SANT Associated)
MTPTPLSPSFSRHRFQGTAAAASEQPCVTLFEWWLERVEGDDQKVAVAGKFERNQTVYEFGSATIAKRHEARVLETEGGILLLIYGTHNRSRMLAGGYSSEVYEKFKIGFPYCWEDCIQLYPKVAQTGSDSAINENAVVSNDGGERHEAARNEAYNVETDLIACRALRERDDGGIDTNASLVHIGGV

SEQ ID NO: 32032 - DNA, 1559 bp, Panicum virgatum
  misc_feature: Ceres CLONE 1908678
  misc_feature: Encodes the peptide sequence at SEQ ID NO. 32033
tacttccgcccaatcccaccaccgaagctgccgagcttgcttccagtacctgtgctcatccgatcgatcgatcgatcagtaccaacaaacaaaactaactcggacttgatctcacacgctgctgctcgcccgctcgatcgctagctcacctcgcaacaaggcagcatgcaggcgcagtcccgcctcggcttgagcggcggcggcatgtcggcgtcggaggccgagctcgaggcggtgatccgcgagctgacgcgcgggcggcagctgacggcgcggctgcgggcggaggccctgcgcgcgctgcgcgggcagggccaggccgaggccaccgccgcattaatcctgcaggaggtgtcccgcgccttcaccgtctgcctcaacatcatggggtcgcccgccggcgccccgcccccgccgggaatgcccgggctgggcgccgccgcggccgcggccgcgccgccttccctgctggccccgccgcgccggaaccgggaggacagcatccccagagagcagacggtgacaccctcgccgcactacgacgggtaccagtggcggaagtacggccagaagaggatcaccaagacacactacccaaggtgctactacaggtgcagcttccaccgcgagcgcggctgccgggccaccaagcaggtgcagcagtgcagcggcggcgaccagccgcagtacctcgtcatctacttctacgagcacacctgcgacacggcggcctggaagcccgaggcgccggcgaaccggccggcggcgacggtgcggcggctcgacctgcccggggccgccctgctggacgaacgcggcgtccaggaggagcaggtgctcgtctcgacgctcgcgtgcgtgctggggggccagcagcagttccaccaggctccccctgctcctgatgcggcggccaccagcgccgccatcgccgtcaacgaggagcctgcgccggtcgttgacgcggctgcggggatgccgcggcttgacgtggacggggtggggctggatgtcatggactacgaggacgtggcgagcgagctgtgcttcggcgatggcgattcctacggcctacctggcagcggcggcggcggcggcttgccgttttgagggcgcaggcggcggcggcaactattctcgcgcaacgggtcggtcagactcgggagggttcagacttcagaccaggcgcgacggatcactgaatctttggtgtacagtgatctacagtgactactgcttcagatacacgtagggcatacgaatacgagtaccgtacgtatgcacgcacgcgcataccgtgtcttagaaatatactgtaattagtgcaagagttaagtagtaacaattatacttgcactagattacggcgaggggttgcgtatctccagtttaagttttggtcaggctggcgtgattaattccgcacgtgcttttgtgtctcaaccagcacgtagtaatacccaattcaggtaatgtaatagtagctctttatcgttttggctgttattattatttttgcaattttcagcaaaaaggtatatatataccagcatattatt

SEQ ID NO: 32033 - protein, 314 aa, Panicum virgatum
  misc_feature: Ceres CLONE 1908678
  misc_feature (124)..(187): Pfam Name: WRKY Pfam Description: WRKY DNA -binding domain
MQAQSRLGLSGGGMSASEAELEAVIRELTRGRQLTARLRAEALRALRGQGQAEATAALILQEVSRAFTVCLNIMGSPAGAPPPPGMPGLGAAAAAAAPPSLLAPPRRNREDSIPREQTVTPSPHYDGYQWRKYGQKRITKTHYPRCYYRCSFHRERGCRATKQVQQCSGGDQPQYLVIYFYEHTCDTAAWKPEAPANRPAATVRRLDLPGAALLDERGVQEEQVLVSTLACVLGGQQQFHQAPPAPDAAATSAAIAVNEEPAPVVDAAAGMPRLDVDGVGLDVMDYEDVASELCFGDGDSYGLPGSGGGGGLPF

SEQ ID NO: 32034 - DNA, 729 bp, Panicum virgatum
  misc_feature: Ceres CLONE 1908692
  misc_feature: Encodes the peptide sequence at SEQ ID NO. 32035
gtctcagcagatcgcgcgagcgcgagaccgagaggagcatgggatcggaggggcggggctggaacggcgcggccgccggagccggcgccggcgacggcgccaggggcggggaggagaaaccgaccaccaccgcggcggtggccgcaggggcgccggcggacgtgcccacgtcggcggcctccgtcgacatctcgctgccgctcccggagatgacgcctcacatcataggtctctgcaagggatcggtcaaagggtggtcgtcgctggacagctcgtgcttctccatcgagacggtgtctggcggcatcacgaatctattgctgaaggtatctataaaagaagatactggaaatgagttttctgtgactgttcgtttgtatggaccaaatacagacttggtgattgatcggaaaagggaattgcaggcgataccatatctctcagctgcagggttcggggctcgactacttggaatttttgagaatggagtagttcagtcattcatcaatgctcgaacactgtcacctgcagaaatgagagaacctagaatagcagctgagattgccaaggagctccacagattccatcaagtagacattccagggtgtaaagaaccacaactgtggaatgatatattcaagtttttgaaaaaagcttcagcattgaattttgaggataatgagaagcggaagagatatgaaacaatctcatttagagaaatacaagacg

SEQ ID NO: 32035 - protein, 230 aa, Panicum virgatum
  misc_feature: Ceres CLONE 1908692
  misc_feature (105)..(230): Pfam Name: Choline_kinase Pfam Description: Choline/ethanolamine kinase
  misc_feature: SWISSPROT Homolog: EC 2.7.1.32 Choline kinase
MGSEGRGWNGAAAGAGAGDGARGGEEKPTTTAAVAAGAPADVPTSAASVDISLPLPEMTPHIIGLCKGSVKGWSSLDSSCFSIETVSGGITNLLLKVSIKEDTGNEFSVTVRLYGPNTDLVIDRKRELQAIPYLSAAGFGARLLGIFENGVVQSFINARTLSPAEMREPRIAAEIAKELHRFHQVDIPGCKEPQLWNDIFKFLKKASALNFEDNEKRKRYETISFREIQD

SEQ ID NO: 32036 - DNA, 751 bp, Panicum virgatum
  misc_feature: Ceres CLONE 1908705
  misc_feature: Encodes the peptide sequence at SEQ ID NO. 32037
atctcaccatatccgccgccgtcttctcgtcctcgacctcgcggcatctagatcccatctccccccgtctctcgtcgtcgcggcacccttcgccatgggcaagattaagatcggaatcaacggtttcggaaggatcggcaggctcgtggcccgtgtcgccctccagagcgaggatgtcgagctcgtcgccgtcaacgaccccttcatcaccactgagtacatgtggggtatgggtattgtcggtaccctacaactggggtacccactcctactgtgccaagactcgcgtagttatccgtaactacgccctaaggagctgagcagccggactcctgggttccgactccatctcaccggaccaacggtcccggacccgcttcccgtttggggacgggtccggtgtcaccacgtgtcccagaggtggaaatgctcagcacctgtggtcgcggacccggacccccgcaggcgggtccgggacttccacgtgccatccggactcccgcaggcgggtccgggacctccacgtgcctatccggacccccgtgagctctcggctcagcaagctgctcgggtggggtccggagccgccacgtgtcacgcagacgcgggcgcgggcgccagccttctgctggaaactccctcacccacccgcattaagtgcgaagtgggttgaggcgggatctgctgcctctgggcacgaggcagcttttgtcagtccacactgtggatcgccagataccgagacaagcat

SEQ ID NO: 32037 - protein, 68 aa, Panicum virgatum
  misc_feature: Ceres CLONE 1908705
  misc_feature: SWISSPROT Homolog: EC 1.2.1.12 Glyceraldehyde-3-phosphate dehydrogenase (phosphorylating)
MGKIKIGINGFGRIGRLVARVALQSEDVELVAVNDPFITTEYMWGMGIVGTLQLGYPLLLCQDSRSYP

SEQ ID NO: 32038 - DNA, 752 bp, Panicum virgatum
  misc_feature: Ceres CLONE 1908706
  misc_feature: Encodes the peptide sequence at SEQ ID NO. 32039
agtagcagactatctaatggctgctcctagcggcggcagcttagtggttctgtacgtgaccatctgctcccttgtgttcatcgcctccaagatgctcatctccttcctgctctacaagaggtgggcgcgcaagaagcggatcatcgacaacagcctggccggcggcaagctggtgatcttccgctccggcggcggcggcggcaagacgctgcagtcgctgagccccaagtcgttcctgggcttgctcatgggcctctccagcaaggacgtcatcggcgccggcggctacggcaccgtgtaccgcctccgcttcggcggcggcgacgacaataataataatagtaagcagcaggaggcggcggccttcgccgtgaagaggctcaaccggggcagcgccgacctggaccgcggcttcgagcgcgagctggacaccatgggcgacatcaagcaccgcaacatcgtcccgctctgcggctactacgcggcgccacacttcaacctgctcatctacgagctcatgcccaacggcaacctgcaggacgccctgcggcagcagcagcggcagcaggtgttggactggccggctcgctaccgcatcgccctgggcgttgctcgcggcctctcctacctccaccacgactgcatcccgcacgtcatccaccgcgacatcaagtccagcaacatcctcctcgaccgcgacatggaggcgcgcctctccgacttccgcctcgccacgctcatgaggcccaacg

SEQ ID NO: 32039 - protein, 245 aa, Panicum virgatum
  misc_feature: Ceres CLONE 1908706
  misc_feature (80)..(245): Pfam Name: Pkinase_Tyr Pfam Description: Protein tyrosine kinase
  misc_feature: SWISSPROT Homolog: EC 2.7.11.1 Non-specific serine/threonine protein kinase
MAAPSGGSLVVLYVTICSLVFIASKMLISFLLYKRWARKKRIIDNSLAGGKLVIFRSGGGGGKTLQSLSPKSFLGLLMGLSSKDVIGAGGYGTVYRLRFGGGDDNNNNSKQQEAAAFAVKRLNRGSADLDRGFERELDTMGDIKHRNIVPLCGYYAAPHFNLLIYELMPNGNLQDALRQQQRQQVLDWPARYRIALGVARGLSYLHHDCIPHVIHRDIKSSNILLDRDMEARLSDFRLATLMRPN

SEQ ID NO: 32040 - DNA, 1279 bp, Panicum virgatum
  misc_feature: Ceres CLONE 1908730
  misc_feature: Encodes the peptide sequence at SEQ ID NO. 32041
aacaaagcaagctaggcagccgctccccgctccccgctccccgctcctgataaagtgataaaccccgagcagagaaggtcgggggggcgccccctcccaaattcgccgacccgcccaccggcagccgcggagccctgctccggctgatcatctctaccggcactgggcatccgggctcggactggcttcccctctccttggtacgcccggcactgagttcagacatgggagaaggtggtgaagagaaatcattcaatttccttcaggttttgctcgagggcagcatagctggaggaaccgctggtgttgtggttgaaacagcgctgtacccaattgacacgataaaaaccaggcttcaggctgctcgaggtggaagcaaaattgaatggaaaggcctctattctggattagctggaaatcttgctggtgttctcccggcttctgcgatatttgtgggagtgtatgaaccgactaaaagaaaactattggagacacttcctgaaaatttgagtgctgttgcccattttactgctggggccattggaggtatcgctgcttctcttgtccgtgtccctacagaggtggtgaaacaaagaatgcaaactggtcaattcaagaaagcacctgatgctgttcgcctcattgttgctaaagaaggattcaaagggctatatgctggttatggttcctttctacttcgagatcttccattcgacgccattcaattctgcatatacgagcaacttcgaattggttacaaacttgtggcgaagagggagttgaatgatccagagaatgcgcttattggtgcttttgctggtgccattactggagctattacaacgccccttgatgtcatgaagacaagactgatggttcagggacaaggaactcagtactcaggaattgtaaattgtgctcagactatcttaagagaggaaggccctagggctttcttgaaggtaaagcgccacctgcactgcatgaacagcttcgacattgagccgcgagttctgtggatcggcattggtgggtccatcttctttggcgttctggagaaaactaagtctatgctagctgagaggtggaaccgcgagctacgggacctcaaggacgaatgagtgaagatcggttgattgatttacgttgcatcttaattcctttttgccgatgaatcttcttctgtgtaactaatatacgaaataaaaagttttctatttggtccatagcatttttgtaataacacttggttcataaatcatcagagcattgttggttg

SEQ ID NO: 32041 - protein, 298 aa, Panicum virgatum
  misc_feature: Ceres CLONE 1908730
  misc_feature (96)..(182): Pfam Name: Mito_carr Pfam Description: Mitochondrial carrier protein
  misc_feature (187)..(288): Pfam Name: Mito_carr Pfam Description: Mitochondrial carrier protein
  misc_feature (15)..(91): Pfam Name: Mito_carr Pfam Description: Mitochondrial carrier protein
MGEGGEEKSFNFLQVLLEGSIAGGTAGVVVETALYPIDTIKTRLQAARGGSKIEWKGLYSGLAGNLAGVLPASAIFVGVYEPTKRKLLETLPENLSAVAHFTAGAIGGIAASLVRVPTEVVKQRMQTGQFKKAPDAVRLIVAKEGFKGLYAGYGSFLLRDLPFDAIQFCIYEQLRIGYKLVAKRELNDPENALIGAFAGAITGAITTPLDVMKTRLMVQGQGTQYSGIVNCAQTILREEGPRAFLKVKRHLHCMNSFDIEPRVLWIGIGGSIFFGVLEKTKSMLAERWNRELRDLKDE

SEQ ID NO: 32042 - DNA, 755 bp, Panicum virgatum
  misc_feature: Ceres CLONE 1908735
  misc_feature: Encodes the peptide sequence at SEQ ID NO. 32043
catatcaaatggagaacatggactttgggatgaagtatcttcagttttccctgagagtcatcatggctactgtgtggagtttcttgttgaagaatttaagacgcaactggatgatgcatggactgaggaactaaaagaagccatggttgagcatcttaagaaagccatatattcatgcacagctgacgagttcaatcactatattgagctcatcaaaggtgaatctgacaagctagctgattggcttatggagatcaaacctgggcattggtcagatgcctattttgagggatcacgtcatggacagtattcttgcaatatttttggcactgtttctgagtggattcccacgagatatgaactttcggttgtgcagttggttgacacaataagatgcaagctgatggagatgatgtacactcgcagggagtcttctaatgcatggactgaggtattaacacctgcagctaatctgaagctgcaggaagagctgctcaaagctcacacgctcaacgtcctcccagcagaaaatgatgaaagcggtagtaacacgtttaaagtctgcgatgactcggttaatgttgtgaaccttaacaaattggaatgcacctgccgaaagtggtatgtttctgggttgccgtgcatgcatgcaatcgcagtatttgagcgcaccggacaatatccatatgactactgcctgaagtacttcacaacggaattctaccgcttgacctactccttgtcataaaccccat

SEQ ID NO: 32043 - protein, 248 aa, Panicum virgatum
  misc_feature: Ceres CLONE 1908735
  misc_feature (193)..(225): Pfam Name: SWIM Pfam Description: SWIM zinc finger
ISNGEHGLWDEVSSVFPESHHGYCVEFLVEEFKTQLDDAWTEELKEAMVEHLKKAIYSCTADEFNHYIELIKGESDKLADWLMEIKPGHWSDAYFEGSRHGQYSCNIFGTVSEWIPTRYELSVVQLVDTIRCKLMEMMYTRRESSNAWTEVLTPAANLKLQEELLKAHTLNVLPAENDESGSNTFKVCDDSVNVVNLNKLECTCRKWYVSGLPCMHAIAVFERTGQYPYDYCLKYFTTEFYRLTYSLS

SEQ ID NO: 32044 - DNA, 2223 bp, Panicum virgatum
  misc_feature: Ceres CLONE 1908745
  misc_feature: Encodes the peptide sequence at SEQ ID NO. 32045
gtaaccaaacactactcatctcaatttagtcaagcggccaatggtcaagctgacctctggtctttccctgatctgaattgtgtgctaggcaacatatacatccagattagttaattgtttgtatatcaatttgtttgttaatatttttcttttgcttcctttgacctggcaggtgatctccgttgatgtggcaggccttcttgctggacaagtataccgtggacaatttgaagcaagaataaagaatctcttgcgagaggttaagcggtctggcaacataatactcttcatcgacgaggttcacacgctagtaggagcaggaacataccgagagagtgctttggacgttgctaatatgtttaagccagcattagccagaggtgaactgcagtgtattggggccactacacatgatgagtacaagaagcacatcgagaaagatgcggcgctggaaaggcgtttcggacctgtcaaaattccagagccgacagttgatgaaaccataggaattctaagaggtcttcgagagcgatatgaaaaacatcatcaggtccaatatgccgatgaagcacgcactcggagcagctgccgagctctcgcacaagtacatcaggttgctggtttgttattgttgttgtcgtctcatttctctccgtagccagattccagacaagcccttcataatttggcggctgctgctgctgctgctgcttgtttgctttgcagtgatcgttttctcccagacaaagccatcgacctaatcgaccaagcaggttcccttgccagtctacgacatgcccagaatccatcaaaggacgtcaaagatcttgaagcagagctcagcagggtcatcaaggagaaggacaatgccgttctcggtgagagctacaaaagggcaaaggagcttcaccatcgtgaactggagctcaagtccctgattgacaagggtaaagagatggcaaccacaacagagcaggtgaagaacaatactggcggcgcgtctgtcaggccagtagtagtggtcaccgaagaagacatccgtcacgtcgtttcctgcaggaccggcgtgcccgtccagaagatcaccaccgacgaaaccaacaagctgttgaacatggaggagaccctgcaccggcgcatcgttggccaagacgcagcggtggtggcgatcagccgcgccatccggcgtgcccgcgcaggtctcaaggagccaggccggccaatcgggagcttcatattcgccggcccaaccggcgtcgccaagacggagcttgcctcctactacggttcggaggacgccatggtccggcttgacatgagcgagttcatggaaaaacactcggtttccagactgatcggcatgtccccaggctgcatcgggcacgaagagggcggccagctgacagaagcggtgcagcagcggcctcacactctgatcctgttggacgagatcgagaaggcgcacccgcaggtgctcgacatcatgctgcagatcctggacgacggccggctgacggacggcacggggaggacgttggatttcaagaacacgctcatcgtcatgacatccaacatcggcggcggcgccgttgtcgccagcggccacggcgccagctacgacgcgatcagggagctggtgggcgaggagatgaagcggcacttccggcccgagttcctgaaccggctggacgagacgatcgtgttcaggcacctcaccagggccgaggtcaaggagatcgctggcatcttgctgagcaacgttgccgcccgggttgggaggaaggggatcgagctgcagctgacggagaggttcaaggagcgcgtggtggaggaaggcttcgacacgagctacggtgtgaggccgctgaagagagccatcgtgaggctgctggaggacacactcgcggacaagatgctcgccggggagatcaaggaaggggatttggtgaccgtcgatgttgatctggctggaaatgtcgtgttcaggcattaagcagatctgaaataattatgcagttgcgtggcttagttataccatgttttggcatggttcatcatttgtacatattcaccgactggaagtcactgcatagttggtaggcatttcaatgtacgcgtacttagaggtggtaataggccacgatcctaatgatttcttcacaatcctaattggtccttaatcttttagttcaaaattatataatattagaatatatttctttt

SEQ ID NO: 32045 - protein, 345 aa, Panicum virgatum
  misc_feature: Ceres CLONE 1908745
  misc_feature (88)..(247): Pfam Name: AAA_2 Pfam Description: ATPase family associated with various cellular activities (AAA)
MATTTEQVKNNTGGASVRPVVVVTEEDIRHVVSCRTGVPVQKITTDETNKLLNMEETLHRRIVGQDAAVVAISRAIRRARAGLKEPGRPIGSFIFAGPTGVAKTELASYYGSEDAMVRLDMSEFMEKHSVSRLIGMSPGCIGHEEGGQLTEAVQQRPHTLILLDEIEKAHPQVLDIMLQILDDGRLTDGTGRTLDFKNTLIVMTSNIGGGAVVASGHGASYDAIRELVGEEMKRHFRPEFLNRLDETIVFRHLTRAEVKEIAGILLSNVAARVGRKGIELQLTERFKERVVEEGFDTSYGVRPLKRAIVRLLEDTLADKMLAGEIKEGDLVTVDVDLAGNVVFRH

SEQ ID NO: 32046 - DNA, 746 bp, Panicum virgatum
  misc_feature: Ceres CLONE 1908748
  misc_feature: Encodes the peptide sequence at SEQ ID NO. 32047
aggctttggcagcggcagcagggagagccgcctggggagcgcggggtcttctttccggccggcctgcttccgatctccatgctgaacaagagcgtctggccgggcggcgcacggttgctgtgccggaggaggagctcatcactcccactgtaagagagcttgagccggcacggcagtagctactacctcgagttcaggcgcaaagctagcaagaagctatagcaggcgagaagaaggtagcatcggtacggtcacaaaggtagcaagcaattcagcccatggacaaccagccgctgccctactccaccggccagcccccggcgaccggcggagccccggtgcccggcgtgcctggcgcggccgggcccccgccggtgccgcaccaccacctgctccagcagcagcaggcccagctgcaggcgttctgggcgtaccagcggcaggaggcggagcgcgcgtcggcgtcggacttcaagaaccaccagctgccgctggcccggatcaagaagatcatgaaggccgacgaggacgtgcgcatgatctccgcggaggcgcccgtgctgttcgccaaggcctgcgagctcttcatcctcgagctcaccatccgctcctggctgcacgccgaggagaacaagcgccgcaccctgcagcgcaacgacgtcgccgccgccatcgcgcgcaccgacgtcttcgacttcctcgtcgacatcgtgccgcgcgaggaggcccaaggaggagccggggag

SEQ ID NO: 32047 - protein, 155 aa, Panicum virgatum
  misc_feature: Ceres CLONE 1908748
  misc_feature (68)..(132): Pfam Name: CBFD_NFYB_HMF Pfam Description: Histone-like transcription factor (CBF/NF-Y) and archaeal histone
  misc_feature: SWISSPROT Homolog: EC 2.7.7.7 DNA-directed DNA polymerase
  misc_feature: The sequence is a functional homolog of SEQ ID NO 1107 in the 10/374,780 US patent application
  misc_feature: Useful for making plants with altered alkaloid content
  misc_feature: Useful for making plants with altered lignin content
  misc_feature: The sequence is a functional homolog of SEQ ID NO 1908 in the 11/479,226 US patent application
  misc_feature: The sequence is a functional homolog of SEQ ID NO 2126 in the 10/374,780 US patent application
  misc_feature: The sequence is a functional homolog of SEQ ID NO 314 in the 10/374,780 US patent application
  misc_feature: The sequence is a functional homolog of SEQ ID NO 846 in the 10/225,066 US patent application
  misc_feature: The sequence is a functional homolog of SEQ ID NO 1188 in the 10/412,699 US patent application
  misc_feature: The sequence is a functional homolog of SEQ ID NO 835 in the 10/374,780 US patent application
  misc_feature: The sequence is a functional homolog of SEQ ID NO 102 in the 10/225,068 US patent application
  misc_feature: The sequence is a functional homolog of SEQ ID NO 230 in the 10/714,887 US patent application
  misc_feature: The sequence is a functional homolog of SEQ ID NO 230 in the 11/435,388 US patent application
  misc_feature: The sequence is a functional homolog of SEQ ID NO 310 in the 10/412,699 US patent application
  misc_feature: The sequence is a functional homolog of SEQ ID NO 727 in the 11/479,226 US patent application
  misc_feature: The sequence is a functional homolog of SEQ ID NO 94 in the 10/374,780 US patent application
  misc_feature: The sequence is a functional homolog of SEQ ID NO 1190 in the 10/412,699 US patent application
  misc_feature: The sequence is a functional homolog of SEQ ID NO 837 in the 10/374,780 US patent application
  misc_feature: The sequence is a functional homolog of SEQ ID NO 1109 in the 10/374,780 US patent application
  misc_feature: Useful for making plants with altered terpenoid content
  misc_feature: The sequence is a functional homolog of SEQ ID NO 1108 in the 10/374,780 US patent application
  misc_feature: The sequence is a functional homolog of SEQ ID NO 712 in the 11/479,226 US patent application
  misc_feature: The sequence is a functional homolog of SEQ ID NO 1189 in the 10/412,699 US patent application
  misc_feature: The sequence is a functional homolog of SEQ ID NO 836 in the 10/374,780 US patent application
  misc_feature: Useful for making plants with modulated cold sensitivity
MDNQPLPYSTGQPPATGGAPVPGVPGAAGPPPVPHHHLLQQQQAQLQAFWAYQRQEAERASASDFKNHQLPLARIKKIMKADEDVRMISAEAPVLFAKACELFILELTIRSWLHAEENKRRTLQRNDVAAAIARTDVFDFLVDIVPREEAQGGAG

SEQ ID NO: 32048 - DNA, 715 bp, Panicum virgatum
  misc_feature: Ceres CLONE 1908756
  misc_feature: Encodes the peptide sequence at SEQ ID NO. 32049
gtcatcgtgctctcggagttcgtcggttgctcgccgtcgctcagcggcgcgatccgcgtgaacccgtggagcgtggagtccgtcgcggaggccatgaacgccgcgctgcggatgcccgaggcggagcagcggctgcggcacgagaagcactacaagtacgtgagcacccacgacgtcgcctactgggccaggtcgtttgaccaggacctacagcgcgcctgcaaggaccacttctcgcggcggcattgggggatcggcttcggcatgagcttcaaggtggtggcgctcggccccaacttccggcggctctccgtcgagcacattgtgccgtcgtaccggaggacggagaaccggctgattctcctagactacgacggcaccgtgatgccggagaattcgatcgacaaagcgcccagcagcgaggtcatttccgtcttgaatcgcctctgcgaggaccccaagaacagagtgttcatcgtgagcgggcggggcaaggacgagctgagcaagtggttcgcgccctgcgagaagctcggcatcgccgcggagcacggttacttcaccaggtggagcagggacgcgccatgggagacctcatcgttggccgccgacttcgattggaagaagacggccgagccggtgatgcagctgtacacggaggcaacagatggctcctccatcgagcacaaggagagcgccttagtctggcaccaca

SEQ ID NO: 32049 - protein, 238 aa, Panicum virgatum
  misc_feature: Ceres CLONE 1908756
  misc_feature (121)..(238): Pfam Name: Trehalose_PPase Pfam Description: Trehalose-phosphatase
  misc_feature: SWISSPROT Homolog: EC 3.1.3.12 Trehalose-phosphatase
  misc_feature: Useful for making plants with altered carbohydrate content
VIVLSEFVGCSPSLSGAIRVNPWSVESVAEAMNAALRMPEAEQRLRHEKHYKYVSTHDVAYWARSFDQDLQRACKDHFSRRHWGIGFGMSFKVVALGPNFRRLSVEHIVPSYRRTENRLILLDYDGTVMPENSIDKAPSSEVISVLNRLCEDPKNRVFIVSGRGKDELSKWFAPCEKLGIAAEHGYFTRWSRDAPWETSSLAADFDWKKTAEPVMQLYTEATDGSSIEHKESALVWHH

SEQ ID NO: 32050 - DNA, 678 bp, Panicum virgatum
  misc_feature: Ceres CLONE 1908759
  misc_feature: Encodes the peptide sequence at SEQ ID NO. 32051
tctttctttctcctttgtccgcagccaactttagcttttctcttcctcctctcctcttcctccctccctctctctgcaagctagacatatctggccgcagctgcgggctagttagggttggtgcttggagagaggtaccctttcctcccttgcatatcaagccttgagatcacccctcaccttttttgatcccctaaacacaaagttagtagtccttggttggtggggtactagagcaaggcagatcaaggaggaggggtgcagaaagaaagagggatcagctctagctagaggaggaaggagaggcacttgttagctgcttgactgtagctagatttatacacctccatacatagcgagcgagggccgaggatcttgtacagatgtctcaggcgatgtcgggtggcaccggcggcggcggcgcagggcagttcggggacacgacgttcaccaaggtgttcgtggggggccttgcctgggagacgcacaaggagggcatgcgggcctacttcgagcagttcggcgatatccttgaggcggtcgtcatcactgacaagaacaccggtagatccaagggatacggatttgtaactttccgcgagccggaggcagcactgagagcttgcatcgatcagtacccggtaatcgatggaaggagggccaactgcaaccttgcct

SEQ ID NO: 32051 - protein, 94 aa, Panicum virgatum
  misc_feature: Ceres CLONE 1908759
  misc_feature (21)..(91): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with modulated biomass
MSGGTGGGGAGQFGDTTFTKVFVGGLAWETHKEGMRAYFEQFGDILEAVVITDKNTGRSKGYGFVTFREPEAALRACIDQYPVIDGRRANCNLA

SEQ ID NO: 32052 - DNA, 684 bp, Panicum virgatum
  misc_feature: Ceres CLONE 1908760
  misc_feature: Encodes the peptide sequence at SEQ ID NO. 32053
gcccgcggccgcggccgctctggcccgcgccacgatgctccagctccgacaactcccagccctcgccgccgccgccctccactgcggcggccggcggcatccgtcgcctggtgctcccgcctgagggccgcgcgaagctggacccgcgccccgaccgcgacttctacgggttcccgcggctcgtgacgcacgtggtcgacggcttcatcgccgcgctcacgggcctctaccgggagcgcctccgcgccgggtgggacgtgctcgacctcatgagctcctgggtcagccacctgccgccggaggtccggttccgccgcgtcgtcggccacgggctcaacgcgcaggagctcgccaggaacccgcgcctggactccttcttcgtcaaggacctcaacgaggagcagcagctcgcgctcgagggcggcagcttcgacgccgtgctctgcaccgtcagcgtgcagtacctgcagtaccctgaaaaggtcttcgcggagatcttccgggtgctgaagccgaggggagtgtgcatcgtgagcttcagcaaccggatgttctacgagaaggcgatcggcgcgtggcgcgagggcaccgcgtacagccgcgtccagctcgtgatgcagtacttccagtgcgtggaggggttcacgcagcccgaggtggtcagggagctgccgggcgggcggc

SEQ ID NO: 32053 - protein, 227 aa, Panicum virgatum
  misc_feature: Ceres CLONE 1908760
  misc_feature (104)..(177): Pfam Name: Methyltransf_11 Pfam Description: Methyltransferase domain
PRPRPLWPAPRCSSSDNSQPSPPPPSTAAAGGIRRLVLPPEGRAKLDPRPDRDFYGFPRLVTHVVDGFIAALTGLYRERLRAGWDVLDLMSSWVSHLPPEVRFRRVVGHGLNAQELARNPRLDSFFVKDLNEEQQLALEGGSFDAVLCTVSVQYLQYPEKVFAEIFRVLKPRGVCIVSFSNRMFYEKAIGAWREGTAYSRVQLVMQYFQCVEGFTQPEVVRELPGGR

SEQ ID NO: 32054 - DNA, 438 bp, Panicum virgatum
  misc_feature: Ceres CLONE 1908761
  misc_feature: Encodes the peptide sequence at SEQ ID NO. 32055
acgagcgccagccagtcaccacctacccgaagccgccgcgaccgatcgagccgagcgccccgcccccacgccgcgccgcgccgcgccgccaccgaaaccctagctcctcctcctcctcctcagccatggccaccgtctcgctcacgccgcaggtggtcttctccaccgagtcgggcggcgccctctcctccgccacaatcctccgtttcccgccaaacttcgtgcgccagctcagcaccaaggcccgccgcaactgcagcaacatcggcgtcgcgcagatcgtcgccgcggcgtggtcggactgccccgccggccgcccccactccggcggcggcggcggccgcgcccgcggcgtggcctcgtgcgaagacgaggccgccgccgtcgagatggtcgatgttgtataggagggaatgactggacgacgacgcggatttg

SEQ ID NO: 32055 - protein, 93 aa, Panicum virgatum
  misc_feature: Ceres CLONE 1908761
  misc_feature: SWISSPROT Homolog: EC 2.5.1.48 Cystathionine gamma-synthase
MATVSLTPQVVFSTESGGALSSATILRFPPNFVRQLSTKARRNCSNIGVAQIVAAAWSDCPAGRPHSGGGGGRARGVASCEDEAAAVEMVDVV

SEQ ID NO: 32056 - DNA, 1027 bp, Panicum virgatum
  misc_feature: Ceres CLONE 1908787
  misc_feature: Encodes the peptide sequence at SEQ ID NO. 32057
agggcctgtcagttgccatctcgtccacgaaacgtacgaagtacgggcatcgacaccaactccaacgcaccgcaccgtccccgcgcccaccggcgacatgaatccgcccgcagcagccgcgtccaccggcggaggagaccgcgccgcggcagccccggagtacgcggcctacccgaggctcacgccggaggacgtggccccgcctccgccgccgtcttaccatgccgccaccgccgcgccgcctccctacggcggcaacccctacgtctccacccccgccggcggcgccgcgaccgcccccaagaatacgatggactcggtgaaggacgtgctcgggaagatggggaagaggttcggcgaggcggcccggaagaccgagaacatcaccggcaacttctggcagcacttgaaaactggcccaagcattactgatgcagcaatgggcaggatctcccaggtcaccaaagtcattgcagaaggtggatatgaaaaaattttccatcaaacctttgaggtcgctccgggcgaaaaactcaagaagccatatgcatgctatttgtcaacctcggctggacctgttatgggtgtactttacctgtccaatgtaaaactggccttctgcagtgataacccacttgcataccaggttggagacaaaacggagtggagctactacaaggtggtcattccccttgctcaactgcgatcagttaactcctcgacaagcagaacaaacacatcagagaaatacattcaggtggtttcagttgataaccatgagttttggttcatgggctttgtttactacgacagtgctgtaaagaatctgcaggaagcacttcaggaggctcagaatttgcgtgcttagtgatgcccatagattggtagtagcatgtcttataaactacagttgtaatatacttggtgtcgactgttgtccagatttagttggataggtattgggactattggctctgctgtgatttgtaccaacttgaaccatttttcaatcggtgacatcttgtgc

SEQ ID NO: 32057 - protein, 256 aa, Panicum virgatum
  misc_feature: Ceres CLONE 1908787
  misc_feature (132)..(209): Pfam Name: GRAM Pfam Description: GRAM domain
MNPPAAAASTGGGDRAAAAPEYAAYPRLTPEDVAPPPPPSYHAATAAPPPYGGNPYVSTPAGGAATAPKNTMDSVKDVLGKMGKRFGEAARKTENITGNFWQHLKTGPSITDAAMGRISQVTKVIAEGGYEKIFHQTFEVAPGEKLKKPYACYLSTSAGPVMGVLYLSNVKLAFCSDNPLAYQVGDKTEWSYYKVVIPLAQLRSVNSSTSRTNTSEKYIQVVSVDNHEFWFMGFVYYDSAVKNLQEALQEAQNLRA

SEQ ID NO: 32058 - DNA, 754 bp, Panicum virgatum
  misc_feature: Ceres CLONE 1908792
  misc_feature: Encodes the peptide sequence at SEQ ID NO. 32059
gcatctcgctccgcgcgccctcctcggcttccggcggttccagcccgctcgctggccacagagacgacctgacctgctggtggtggaagccgacgagcgagccgcgagtgcgtgagccacccaggcagcgagcgcagcgcatcctcactcttgggttcggcatgacgctggacaccccggccgccgtggtgctggagctcatgaccatggggcagcagtccgcggcgcacctcggggacctgctccgggccgcgtccccggcgtcgccgccccaggagctcgccgccgagatcctccgctgctgcggccgcgtcatcgacatgatcagggccaccagcgccggccgcaagaggaaggcggccgagtaccaagcgccggggccaggagcctggtctcctcctcctcctccggggccgccgcccaaaagaagggggcgcggcgcggaggctgtcaaggaggtggtgacaagctgcacgacggtggacggcttcatctggaggaagtacgggcagaaggacatcaacggccacaagcacccgaggctctactaccgctgtgcgcaccggcagcagggctgcaacgccacccggcgggtgcagcggacgcgggaccagcccgcggcgtacgagatcgcctactacggggagcacacgtgccggggcgccgccgcgtgccagccgcacggagcggcgccgccgcccgccgtcgtcgacttcggctctaactccttgggggtcgccgacgcgggcagggg

SEQ ID NO: 32059 - protein, 197 aa, Panicum virgatum
  misc_feature: Ceres CLONE 1908792
  misc_feature (106)..(167): Pfam Name: WRKY Pfam Description: WRKY DNA -binding domain
MTLDTPAAVVLELMTMGQQSAAHLGDLLRAASPASPPQELAAEILRCCGRVIDMIRATSAGRKRKAAEYQAPGPGAWSPPPPPGPPPKRRGRGAEAVKEVVTSCTTVDGFIWRKYGQKDINGHKHPRLYYRCAHRQQGCNATRRVQRTRDQPAAYEIAYYGEHTCRGAAACQPHGAAPPPAVVDFGSNSLGVADAGR

SEQ ID NO: 32060 - DNA, 701 bp, Panicum virgatum
  misc_feature: Ceres CLONE 1908809
  misc_feature: Encodes the peptide sequence at SEQ ID NO. 32061
acccccgccccgcctgtccgaatcgcgcgccccggtcgagtttcgcgagggaccgagatggcgtccgagctcacctaccgcggcggcggggcgtccccggtcgccggcgccggcgccggcgcggagggatactccgcgaagccgtccaagccgctcgcgtggctgccccgcgccgcgcgctacgccgccgccgagcaccgcccggtcttcgcgctcgccgggatgctcatcgccgccgccgtcatctgcatcgcctccccgtccgctccctcctcctccgccgccgccgccgccgtgtcctcctactcctcctcctccggcattaccaacaacccgctcgcccgcttctccgtcgagccggcggcgcgccaccgcgagctggccggcgcgcggcacttcgtcggcggcaaggtgccgctgggcctcaagcgcaaggcgctccgcgtgctcgtcaccggcggcgccggcttcgtcggcagccacctcgtcgaccgcctcctcgagcgcggcgacagcgtcatcgtcgtcgacaacctcttcaccggccgcaaggacaacgtcgtgcaccacttcgccaaccccaacttcgagatgatccgccacgacgtcgtcgagcccatcctgctcgaggtcgaccagatctaccacctcgcctgcccggcgtcgcccgtccactacaagtacaaccccgtcaagacaat

SEQ ID NO: 32061 - protein, 214 aa, Panicum virgatum
  misc_feature: Ceres CLONE 1908809
  misc_feature: SWISSPROT Homolog: EC 4.1.1.35 UDP-glucuronate decarboxylase
  misc_feature: Useful for making plants with altered carbohydrate content
  misc_feature: Useful for making plants with altered cell wall content and/or composition
MASELTYRGGGASPVAGAGAGAEGYSAKPSKPLAWLPRAARYAAAEHRPVFALAGMLIAAAVICIASPSAPSSSAAAAAVSSYSSSSGITNNPLARFSVEPAARHRELAGARHFVGGKVPLGLKRKALRVLVTGGAGFVGSHLVDRLLERGDSVIVVDNLFTGRKDNVVHHFANPNFEMIRHDVVEPILLEVDQIYHLACPASPVHYKYNPVKT

SEQ ID NO: 32062 - DNA, 1087 bp, Panicum virgatum
  misc_feature: Ceres CLONE 1908817
  misc_feature: Encodes the peptide sequence at SEQ ID NO. 32063
gaggcgacgtgaggattggttagagagggaaccaggaggacttggttgagaggaggcggcgatggggcgcgggaaggtgcagctgaagcggatcgagaacaagatcaaccgccaggtgaccttctccaagcgccgctcggggttgctcaagaaggcgcacgagatctccgtgctctgcgacgccgaggtcgcactcatcatcttctccaccaaggggaagctctacgagtacgccacagacacatgtatggacaaaattcttgaacggtatgaacgctactcctatgcagaaaaggttctcgtttcagcagaatctgaaactcagggcaactggtgccatgaatatacaaagctaaaggcgaaggttgagacgatacagaaatgtcaaaagcacctcatgggagaggatcttgaaactctgaatctcaaggagcttcagcaactagagcagcagctagagagttcactgaaacatatcagatccagaaagagccagcttatgatggagtcaatttcggagcttcaacggaaggagaagtccctgcaggaggagaacaagattctgcagaaggagcccgcagagaagcagaaagctcagcgacagcaagcgcaatgggaccagaatcaacaacaaacaagctcgtcttcctcgtccttcatcatgagagaagctcccccagcaacaaatatcagcagctaccctgtgcctgtggcagcaggcgggagggtggagcgggcagcagcgcagccgcaggctctcattgggctgccagcgtggatgcttagccacatcagcagctgaactgaaggctttcctctcgcccgtgtcggtgcgcgagcccaaaaatccagcaacgcaacggtagcatgctcacccccggctgccccgcggctccacctgatgaattattatcgtcgatcttgtcgtgatcgccaccggcagcagtagcaggggtttatcataatttgagcagcatataagtaccaatcttcgctgtgtatattttgcttttgttcatcgccgtttccgctgagccgaccgtacgatgaataatttacccatgtaatatataatataatatgcgca

SEQ ID NO: 32063 - protein, 246 aa, Panicum virgatum
  misc_feature: Ceres CLONE 1908817
  misc_feature (75)..(174): Pfam Name: K-box Pfam Description: K-box region
  misc_feature (9)..(59): Pfam Name: SRF-TF Pfam Description: SRF-type transcription factor (DNA-binding and dimerisation domain)
  misc_feature: The sequence is a functional homolog of SEQ ID NO 6 in US patent 7279615
  misc_feature: Useful for making plants with modulated biomass
  misc_feature: Useful for making plants with modulated flowering time
  misc_feature: Useful for making plants with modulated phosphate use efficiency
  misc_feature: The sequence is a functional homolog of SEQ ID NO 2 in US patent 7273968
  misc_feature: Useful for making plants with altered alkaloid content
  misc_feature: The sequence is a functional homolog of SEQ ID NO 46 in the 10/666,642 US patent application
  misc_feature: The sequence is a functional homolog of SEQ ID NO 1360 in the 10/666,642 US patent application
  misc_feature: The sequence is a functional homolog of SEQ ID NO 22 in the 10/666,642 US patent application
  misc_feature: The sequence is a functional homolog of SEQ ID NO 730 in the 10/666,642 US patent application
  misc_feature: Useful for biocontainment applications
  misc_feature: The sequence is a functional homolog of SEQ ID NO 707 in the 10/666,642 US patent application
  misc_feature: The sequence is a functional homolog of SEQ ID NO 36 in the 10/666,642 US patent application
  misc_feature: The sequence is a functional homolog of SEQ ID NO 60 in the 10/412,699 US patent application
  misc_feature: Useful for making plants with altered terpenoid content
  misc_feature: The sequence is a functional homolog of SEQ ID NO 1701 in the 10/412,699 US patent application
  misc_feature: The sequence is a functional homolog of SEQ ID NO 1955 in the 10/412,699 US patent application
  misc_feature: The sequence is a functional homolog of SEQ ID NO 1949 in the 10/412,699 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: The sequence is a functional homolog of SEQ ID NO 1967 in the 10/412,699 US patent application
  misc_feature: The sequence is a functional homolog of SEQ ID NO 1965 in the 10/412,699 US patent application
  misc_feature: The sequence is a functional homolog of SEQ ID NO 1963 in the 10/412,699 US patent application
MGRGKVQLKRIENKINRQVTFSKRRSGLLKKAHEISVLCDAEVALIIFSTKGKLYEYATDTCMDKILERYERYSYAEKVLVSAESETQGNWCHEYTKLKAKVETIQKCQKHLMGEDLETLNLKELQQLEQQLESSLKHIRSRKSQLMMESISELQRKEKSLQEENKILQKEPAEKQKAQRQQAQWDQNQQQTSSSSSSFIMREAPPATNISSYPVPVAAGGRVERAAAQPQALIGLPAWMLSHISS

SEQ ID NO: 32064 - DNA, 461 bp, Panicum virgatum
  misc_feature: Ceres CLONE 1908817-R
aaaaacaagggttttttttttttccttttttttgggggggggctccccccccccaaaatttccggggctccccttctctctggcccccggggggggggggggggggggccccccgcccccccccgttttttttggggggcccgggggggggtttttcccccccccggggggggagggggggtttttttttccccggggggggggggggggccccaaattcccccccccccgggggggggttttcccccccggggcccccgggggccccccgggggatttttttttttttttttttttgggtccccccccccccccgggggggggggtttttttttttttggggcccctttaggccccctttttccgggggttttttttttttttttttttccccttttccggggggcccccccgggggggaattttttccccccttttttttttttttttttgggcccccc

SEQ ID NO: 32065 - DNA, 451 bp, Panicum virgatum
  misc_feature: Ceres CLONE 1908831
  misc_feature: Encodes the peptide sequence at SEQ ID NO. 32066
ggctcggtggtgcgagcaggcatggccgcggccctgccgcggcactgtcctccgaggagctcatgcccacggagcgggactgcagcgcccactcctcccatccgatccccatggtattctccaaaggagaatgttcacacctagtggaccctgaaggcaacaaatacattgattttctctctgcttattctgcagtccatcacggtcattgccatcctaaagttctgagagctttcatagaacacgcagaaaggcttacactcagttctcgagctttctacaatgataaattccctatctttgcggaatttctgacacgcatgtttggatatgacttgatgttaccgatcaatactggagctgatggagttgaaactgctatcaagttggctaggatctggggttatgagaagaaaaagataccaaacaatgaggctttgcttgtctcttg

SEQ ID NO: 32066 - protein, 149 aa, Panicum virgatum
  misc_feature: Ceres CLONE 1908831
  misc_feature: SWISSPROT Homolog: EC 2.6.1.13 Ornithine aminotransferase
LGGASRHGRGPAAALSSEELMPTERDCSAHSSHPIPMVFSKGECSHLVDPEGNKYIDFLSAYSAVHHGHCHPKVLRAFIEHAERLTLSSRAFYNDKFPIFAEFLTRMFGYDLMLPINTGADGVETAIKLARIWGYEKKKIPNNEALLVS

SEQ ID NO: 32067 - DNA, 1393 bp, Panicum virgatum
  misc_feature: Ceres CLONE 1908845
  misc_feature: Encodes the peptide sequence at SEQ ID NO. 32068
cattcatttcaggctatgagcattgcggccatcaccagaaaatgatccgtcatctcctcgagtagttcagtgccacgcacttcccgtgcttcgatagaaatctctgcgtggcgtggccaccaaagtctcttgctttaccaggtggagaaaccaaagcatagcccaagatttataaacaggcagcagtctctagcggtaaggtacggtgcaggttcaagaagagctctcgtggcgtcatggtctctggaaggtcagagatggatgtcgagctgggcgaggacgtgctcaccgagatcctcgcgaggctgccgtacaggtcgctggcgcggttccagtgcgtctccacctcgtggcgccgcatcatctccagcgactacctccgccgaaggctgacgctcatcacatcgggggtgctctaccacggcggcggcggcggcggcgacggcgcgaggcggccgtacacgtacgcgtgcgctccggacggcggccgcggcggcgtcgcggaggccggcgacatgggcttcttcccgtgccacgacgcgtcgaccatcatcgacgggtgcaacggcctgctgctctactacgcgtcgcgcccggcggcgttccacgtcgtgaacccgaccacgcggcggtgggcggcgctgccggcgccgcgcgcgaggacgctgctctccgtgctggcgttcgaccccagcgcctcgccgcgctacagggtggtgtgcttcacgggctggctgccccggggcgcgaccatcgaggtgttcgactccgagcgcggcgcgtggcggggccacgaggtcgacttcgggctcgacactgacgccatgacggccaccatgcactactccggcggcgcgctccacgtgctggcctactcgggtcacgtcgtccgcgtcgacctggacaccatggcgtgcgcgatcaccgcgctcccggcgcccgtcagctgccgggcgcgcgccgggcactgccgcggccgcctgcggttcgcgtccagcgacggcgcgcgcctcaggatctgggagctccaggacgcgggcgcgggggagtgggcgctgaagcgcgagatcggggtcggcgacgtcgcccccggcggctcgagccaggccatcaccttcctgttcatggcgttccacccgaagagggaggtggtgtacctgtggtcgccgtggaagctgctggcgttcgacatggtcgagagacgcgtcgaggaggagtgggcgttcgggtcagagaaagaaggcgcgcatctcatacagatttggctgtttccgttctcgcgccatttggccaacgccctggcctgactaggcttgtcgacgcgctgaaaatggcatggggggcaatactggaaagaatgtggccgcgtccaagtatgcaggaaggtaaaaag

SEQ ID NO: 32068 - protein, 356 aa, Panicum virgatum
  misc_feature: Ceres CLONE 1908845
  misc_feature (7)..(54): Pfam Name: F-box Pfam Description: F-box domain
MVSGRSEMDVELGEDVLTEILARLPYRSLARFQCVSTSWRRIISSDYLRRRLTLITSGVLYHGGGGGGDGARRPYTYACAPDGGRGGVAEAGDMGFFPCHDASTIIDGCNGLLLYYASRPAAFHVVNPTTRRWAALPAPRARTLLSVLAFDPSASPRYRVVCFTGWLPRGATIEVFDSERGAWRGHEVDFGLDTDAMTATMHYSGGALHVLAYSGHVVRVDLDTMACAITALPAPVSCRARAGHCRGRLRFASSDGARLRIWELQDAGAGEWALKREIGVGDVAPGGSSQAITFLFMAFHPKREVVYLWSPWKLLAFDMVERRVEEEWAFGSEKEGAHLIQIWLFPFSRHLANALA

SEQ ID NO: 32069 - DNA, 695 bp, Panicum virgatum
  misc_feature: Ceres CLONE 1908846
  misc_feature: Encodes the peptide sequence at SEQ ID NO. 32070
cctaccattaatcttaatattgaggagtttacacaaaacttgaagaattatattgaagcaaacaatctcgagattgaagatgctgacatgtcaaaggcattggttgccattacccctgaagctgcttccattccaactccaaagctcaagaatattagtcgcctgaggacagaacaccaagtttatgaactgccagattcacatccacttctggaaggattcgaacagagggaaccagatgatccctgcccgtatcttctttctatatggaccccaggtgaaacagcacaatcaactgatgcacccaagacattctgcaactctggggatactggtagattgtgtggaagttcaacatgctttagttgcaacagtatacgagaaatgcaggctcagaaagtcagaggaacgcttctgataccatgccgaacagcaatgagaggaagcttcccacttaatgggacatattttcaagttaatgaggtgtttgctgatcattactcaagccaaaatccaattgatgttccacgaagttggatatgggacctcccaagacgaactgtttactttggaacctcagttcctacaatatttagaggtttaacgactgaagagatacagcaatgcttttggagaggatttgtgtgtgtgaggggctttgataggacactgagggcaccaaggccgctttatgc

SEQ ID NO: 32070 - protein, 231 aa, Panicum virgatum
  misc_feature: Ceres CLONE 1908846
  misc_feature: Useful for making plants with modulated endosperm cell number
  misc_feature: Useful for making plants with modulated endosperm cell size
  misc_feature: Useful for making plants with modulated seed quality
PTINLNIEEFTQNLKNYIEANNLEIEDADMSKALVAITPEAASIPTPKLKNISRLRTEHQVYELPDSHPLLEGFEQREPDDPCPYLLSIWTPGETAQSTDAPKTFCNSGDTGRLCGSSTCFSCNSIREMQAQKVRGTLLIPCRTAMRGSFPLNGTYFQVNEVFADHYSSQNPIDVPRSWIWDLPRRTVYFGTSVPTIFRGLTTEEIQQCFWRGFVCVRGFDRTLRAPRPLY

SEQ ID NO: 32071 - DNA, 1115 bp, Panicum virgatum
  misc_feature: Ceres CLONE 1908857
  misc_feature: Encodes the peptide sequence at SEQ ID NO. 32072
agctcagctcagaaccaccacacacgggagataactcaactcaactcaactcaactgggacttgggccatgctgccgaccttctcgccgacggcgagcgcctcggcgacgcctccgccgcggccgataccaggcagctacggcccgccggtgatcggcgcgctccgggaccgcctcgactacttctggttccagagccaggacgagttcttccgccgccgcgccgccgcgaaccggagcaccgtgttccgcaccaacatcccgcccacgttccccttcttcgtcggcatcgacccgcgcgtggtcgccgtcgtcgacgccgccgccttcaccgcgctcttcgacagcaccctcgtcgacaagcgcgacgtcctcatcggcccctacaaccccggcgccggcttcaccggcggcacccgcgtcggcgtctacctcgacaccgaggaggtgcgcgcggtgatgcgcgccagcggcggcgacgccgcgttcgggttcaaggccgtccgggagatgccgctggtgcggtcgacggtgtacgagatgctccggatgcagccgccggtgccgctgcagttcgggcgcgcgcgcaaggacttcgtgctccgctcccacggcggcgccgccttccaggtggccaagggcgaggtgctgtgcgggtaccagccgcttgcgatgcgggacccggaggtgttcgagcggccggaggagttcgtgccggagcggttcctcggcgaggaggggcaggcgctgctgcagcacctcttctggtccaacgggccggagacctcgcagccggcggccgggaacaagcagtgcgccgccaaggaggtggtggtggacacggcgtgcatgctggtggcggagctgttccgccggtacgacgacttcgaggtggagggcacgtccttcaccaagctcgtcaagaggcagccggcgccgagcttgtcccccgcagccgccggagccaactgagtctgtatgtgtaggccccgccttgccagtctctgttcgatgtctgtctcccggccgttgaaaataagcacttgtgccattgcaaaagtgtatacacactgtatagtgaattagtgatgcaaacaaacaactgtatatctcctc

SEQ ID NO: 32072 - protein, 300 aa, Panicum virgatum
  misc_feature: Ceres CLONE 1908857
  misc_feature: SWISSPROT Homolog: EC 4.2.1.92 Hydroperoxide dehydratase
  misc_feature: Useful for biocontainment applications
  misc_feature: Useful for making plants with modulated nitrogen use efficiency
MLPTFSPTASASATPPPRPIPGSYGPPVIGALRDRLDYFWFQSQDEFFRRRAAANRSTVFRTNIPPTFPFFVGIDPRVVAVVDAAAFTALFDSTLVDKRDVLIGPYNPGAGFTGGTRVGVYLDTEEVRAVMRASGGDAAFGFKAVREMPLVRSTVYEMLRMQPPVPLQFGRARKDFVLRSHGGAAFQVAKGEVLCGYQPLAMRDPEVFERPEEFVPERFLGEEGQALLQHLFWSNGPETSQPAAGNKQCAAKEVVVDTACMLVAELFRRYDDFEVEGTSFTKLVKRQPAPSLSPAAAGAN

SEQ ID NO: 32073 - DNA, 722 bp, Panicum virgatum
  misc_feature: Ceres CLONE 1908862
  misc_feature: Encodes the peptide sequence at SEQ ID NO. 32074
accttgcccgcgtcggcgaaaaccccccctcccctggacgccactaccttggaatcgggtcgatcgcttcgttcctgggcggtgggcagctgattgaggaggacagaaccataaagcgatgttctccttgttctatggcctatggaatcatgtcttcagcaagacagagttccatgtgcttatccttggagttcataaggctgggaagacgaccttgctagaaaagttgaagtcgatctacctgaagggagaaggtcttccgcatgatcgtattgttccaacagttgggcttaatattgggcgtattgaagatgcgaatgtaaagcttgtcttctgggacctgggaggtcagcctggcctacgaacaatatgggagaaatattatgaggaggcacatgctgtaatatatgttatcgactcttctgctgctgcatcatttgaggatgccaaatcctctcttgagaaagttctccgccatgaagatctgcaaggagcgccaatactcatatttgcaaataagcaggattcaccagcagctgtctcggaggaagaattggcgagacatctgcatgttaaagagttagatgagaggccatgcatgttccaggctggttctgcttttgatgggacagggatcaaacatggtgttgactggctggtagaagaaatggagaggagtaaacgcactgaattgctgaggatgcgtacagaagcagctggga

SEQ ID NO: 32074 - protein, 201 aa, Panicum virgatum
  misc_feature: Ceres CLONE 1908862
  misc_feature (1)..(184): Pfam Name: Arf Pfam Description: ADP-ribosylation factor family
MFSLFYGLWNHVFSKTEFHVLILGVHKAGKTTLLEKLKSIYLKGEGLPHDRIVPTVGLNIGRIEDANVKLVFWDLGGQPGLRTIWEKYYEEAHAVIYVIDSSAAASFEDAKSSLEKVLRHEDLQGAPILIFANKQDSPAAVSEEELARHLHVKELDERPCMFQAGSAFDGTGIKHGVDWLVEEMERSKRTELLRMRTEAAG

SEQ ID NO: 32075 - DNA, 1686 bp, Panicum virgatum
  misc_feature: Ceres CLONE 1908898
  misc_feature: Encodes the peptide sequence at SEQ ID NO. 32076
gacaaaggcgcgcgaggataggcacggccttcgtcctcgccgtttcgcccgccccccaccccctccctcccgcatcactcccaagccgatcgaaaccctaacccgacctccctcccctgggctgtaggttcccagggatcccctcgcgatgtcggacgtcaccgccgactcggcgcagagccgccgctcgccgcccccgccgtcgccggccccgtcgatggcgcgcttccagcagcagccgagcgggcgccagccgcccccgccgggcgccgaccccttcgcctttggcgtcgtcgccttcatcggcatctgcttcgtcctaatttcactctcagttccatcaagcgttctgcatcaagttcctgaaggacatgttggggtatactggagaggaggtgctcttctgaagacaatcactcctccagggtttcatctgaagctcccttggatcacccagtatgaggcaatacaggttacacttcaaacagaccaggtcagagatattccttgtggaacaaaaggtggtgttatgataagctttgacaagatagaggttgtaaaccgcctccgtaaagactatgtgcatgaaacactactcaactatggcgtgcactatgacaagacatggatatatgataaaattcatcatgagataaaccagttctgcagtgctcacagtttgcagcaagtttacattgatatgtttgatcggattgatgaaacaatgaaagaagctattcaaagagactgcacacgctatgctcctggaattgaaatcatcaatgttcgtgttacaaagccaaatatacctcctagcattaggagaaattttgaacttatggaggaggagcgtacaaaggcactgattgctattgagaagcaaaaggtagcagaaaaggaggcagaaacacagaagaagattgcgctatctgaagcagagaagaacgcacaggtgagcaagatcctgatggagcagaagctgatggagaaggacagttccaagaggcaggagcagattgacaacgaaatgtaccttgcacgagagaaagcactggcagatgcaaactactacaggatcttgaaggaagctgaggctaataggctcaaacttacaccagaatatcttgagctgaggttcattgaatccattgccaataactcaaagatcttctttggtgaaaagattccaaacatgatcatggatcaaaggttgcttaagaactaccttgatgatgtttcgaggaaggaccattccgaattatagaagctcctttccatgaatcagaagcagcgcaggctatttttgtgaccccacgtggtagataggataggaatcccaggaagccgccaggagaccacagaaaaggaggggagaaatcaggagtcgcccctaaagattagaactggcagttggtgttatgcaagaaaacctttggtttattttttgtgtagtgttagcgttagcatagatggagcaatctgcaatcggctgacattgatgctaccatcagacattgttgggcttggacgtgtcctagacgggtggctaaggtcactcgtttctactccatctttgttattacgtaataagggaggcacgtgcggctggcagagttcgcctttagatgttagcgtaattatgctattatgtgacttctaaagtttttacgtattacctgtccacgg

SEQ ID NO: 32076 - protein, 348 aa, Panicum virgatum
  misc_feature: Ceres CLONE 1908898
  misc_feature (46)..(229): Pfam Name: Band_7 Pfam Description: SPFH domain / Band 7 family
MARFQQQPSGRQPPPPGADPFAFGVVAFIGICFVLISLSVPSSVLHQVPEGHVGVYWRGGALLKTITPPGFHLKLPWITQYEAIQVTLQTDQVRDIPCGTKGGVMISFDKIEVVNRLRKDYVHETLLNYGVHYDKTWIYDKIHHEINQFCSAHSLQQVYIDMFDRIDETMKEAIQRDCTRYAPGIEIINVRVTKPNIPPSIRRNFELMEEERTKALIAIEKQKVAEKEAETQKKIALSEAEKNAQVSKILMEQKLMEKDSSKRQEQIDNEMYLAREKALADANYYRILKEAEANRLKLTPEYLELRFIESIANNSKIFFGEKIPNMIMDQRLLKNYLDDVSRKDHSEL

SEQ ID NO: 32077 - DNA, 721 bp, Panicum virgatum
  misc_feature: Ceres CLONE 1908901
  misc_feature: Encodes the peptide sequence at SEQ ID NO. 32078
aaacccgaacccaagcccagaccgatctatcccgcatccaattctagggtttcgattcccctccacaggatgtccgaccccgccgccggcggcgcaatcgtccccgccgccgcctccggcggcatcgcgtgggcgaacggcggcccccgcttcggcgacatggtctggggcaaggtgaagtcccacccgtggtggccgggccacatctacagcgtcgacctcaccgacgacgcggaggtccacagcggacgccgcgacgggctcgtccttgtcgccttcttcggcgactccagctacggctggttcgatccgcaggagctggtcccatttgaggaccacttcgccgagaaggcggcccagggcggcacctcccgcagcagcttcgccgccgccgtcgcggaagccgtcgacgaggtcgcccgccgcagcgcgcttgcgctgctctgcccgtgtcgggaacccgatgcgttccgtccccaccccagcgacggcagattcttcctggtcgacgtcccgggattcggcaccgacgcagactaccaccccgaccagatccaggcggcacgggatcgattcgtgccgcggggggcgctggactacctgctggatgccgccgtgacgcagcgcaacgcggcggaagtcgccgcgcgcaccgtgccgggtatggagatgggcggtctgttcatggcgtaccgccgcacagtgtttgcgccgcgcgacg

SEQ ID NO: 32078 - protein, 217 aa, Panicum virgatum
  misc_feature: Ceres CLONE 1908901
  misc_feature (25)..(99): Pfam Name: PWWP Pfam Description: PWWP domain
  misc_feature: SWISSPROT Homolog: EC 2.1.1.37 DNA (cytosine-5-)-methyltransferase
MSDPAAGGAIVPAAASGGIAWANGGPRFGDMVWGKVKSHPWWPGHIYSVDLTDDAEVHSGRRDGLVLVAFFGDSSYGWFDPQELVPFEDHFAEKAAQGGTSRSSFAAAVAEAVDEVARRSALALLCPCREPDAFRPHPSDGRFFLVDVPGFGTDADYHPDQIQAARDRFVPRGALDYLLDAAVTQRNAAEVAARTVPGMEMGGLFMAYRRTVFAPRD

SEQ ID NO: 32079 - DNA, 707 bp, Panicum virgatum
  misc_feature: Ceres CLONE 1908905
  misc_feature: Encodes the peptide sequence at SEQ ID NO. 32080
gccccccaacgacccttaccttctacggccacgcgccgctttgcctccgccatttccgcatttagaagccagatagtttcttcttctttaagctgcctgccaggatacatatttaagcagcgggaagggagtgaaagaggggatggcggcgggcggcggcgcggcggcgccgttcgtgtggaagacgtacatgatggtggaggaccccgggacgaacggggtcatcggctggggccgggggaacaacagcttcgtcgtcgccgaccccttcgtcttctcgcagacgctgctgcccgcgcacttcaagcacaacaacttctccagcttcgtgcgccagctcaacacctatggtttccgcaaggttgatccggaccggtgggagttcgcgcacgcgtcgttcctgcgcggccagacgcacctcatgcgcaacatcgtccgccgcggcagcagcgccgccgcgggaggaggaggcggcggcggcggcggcaagaggaaggacgccggctccgcggagccctccgcggacgacatggccatggtggccacggaggtggtgcgcctcaagcaggagcagcgcgccatcgacgaccgggtggcctccatgtggcgccgcgtgcaggagaccgagcgccggcccaagcagatgctcgccttcctcctcaaggtcgtcggcgaccgcgacaggctgcaccgcctcgtcggcgacg

SEQ ID NO: 32080 - protein, 188 aa, Panicum virgatum
  misc_feature: Ceres CLONE 1908905
  misc_feature (9)..(172): Pfam Name: HSF_DNA-bind Pfam Description: HSF-type DNA-binding
MAAGGGAAAPFVWKTYMMVEDPGTNGVIGWGRGNNSFVVADPFVFSQTLLPAHFKHNNFSSFVRQLNTYGFRKVDPDRWEFAHASFLRGQTHLMRNIVRRGSSAAAGGGGGGGGGKRKDAGSAEPSADDMAMVATEVVRLKQEQRAIDDRVASMWRRVQETERRPKQMLAFLLKVVGDRDRLHRLVGD

SEQ ID NO: 32081 - DNA, 728 bp, Panicum virgatum
  misc_feature: Ceres CLONE 1908913
  misc_feature: Encodes the peptide sequence at SEQ ID NO. 32082
ctcccccacctgtccatcccgcgccgccaccccccctcaggtaaggaggaggcgaggatgtcgcaccgcaagttcgagcacccgaggcacggttccctcggcttcctccccaggaagcgcgcctcccgccaccggggcaaggtgaagtccttccccagggatgaccccaagaagccatgccacctcactgccttccttggctacaaggctggcatgacacacattgtccgtgaggtcgagaagcctggatccaaactccacaagaaggaaacctgcgaagctgttaccatcattgaaactcctcctgttgtcattgttggtcttgtggcatatgtgaagactcctcgtggcctccgcaccctcaactctgtctgggcacagcacttgagtgaggaagtgaggaggaggttctacaagaactggtgcaagagcaagaagaaggctttcactaagtatgctctaaagtatgacagtgatgcaggcaagaaggaaattcagctgcagcttgagaagatgaagaagtatgcttctgttatccgcgtgattgcccacacccagattaggaagatgaagggtttgaagcagaagaaggctcacctcatggagatccaggtcaatggtggtaccattgccgacaaggtggactatggctacaagttcttcgagaaggaggttccggttgacgctgtgttccagaaggatgagatgattgacatcattggtgtgac

SEQ ID NO: 32082 - protein, 223 aa, Panicum virgatum
  misc_feature: Ceres CLONE 1908913
  misc_feature (50)..(223): Pfam Name: Ribosomal_L3 Pfam Description: Ribosomal protein L3
MSHRKFEHPRHGSLGFLPRKRASRHRGKVKSFPRDDPKKPCHLTAFLGYKAGMTHIVREVEKPGSKLHKKETCEAVTIIETPPVVIVGLVAYVKTPRGLRTLNSVWAQHLSEEVRRRFYKNWCKSKKKAFTKYALKYDSDAGKKEIQLQLEKMKKYASVIRVIAHTQIRKMKGLKQKKAHLMEIQVNGGTIADKVDYGYKFFEKEVPVDAVFQKDEMIDIIGV

SEQ ID NO: 32083 - DNA, 494 bp, Panicum virgatum
  misc_feature: Ceres CLONE 1908938
  misc_feature: Encodes the peptide sequence at SEQ ID NO. 32084
atcatcagttttggagttcatggcaaagctttctgcaactagtccagttttaattttaagctacccgcaaaaaaaaagttttaattttaagccggtttttcgcagcagctgaagctcgtgaagtgaactgaacatgcaccgtaactcattacgttcgttcactattgacagcgtcgcagtcgttcatcggcgtcaactacgggacgattgccgacaacctcccgccgccggcgtcgacggccagcctgctcatgtccacgtccatcggcaagctccgcctctacgagccccagccggagctggtcgcggcgctcgcgggctccaacatctccatcctgctgggcatccccaacggcgacgtgccgaacctcgcgtcctcccccgccgccgccgcgtcctgggccgccgccacatccccaccacggtgaccgtctccgccatctccgtcggcaacgagctgctcaactccggcgaccccaccctcgcgccccagc

SEQ ID NO: 32084 - protein, 58 aa, Panicum virgatum
  misc_feature: Ceres CLONE 1908938
  misc_feature: SWISSPROT Homolog: EC 3.2.1.39 Glucan endo-1,3-beta-D-glucosidase
  misc_feature: Useful for making plants with altered carbohydrate content
  misc_feature: Useful for making plants with altered cell wall content and/or composition
MSTSIGKLRLYEPQPELVAALAGSNISILLGIPNGDVPNLASSPAAAASWAAATSPPR

SEQ ID NO: 32085 - DNA, 1317 bp, Panicum virgatum
  misc_feature: Ceres CLONE 1908942
  misc_feature: Encodes the peptide sequence at SEQ ID NO. 32086
gattttcagttcagttcaaccactcccccagccatcgcctcgcgcaggcgcacgccgagctcgccctcctccctccttccccttccccttccgcgccccggcctcggttccccaaggcccaaaccctagcgaaggaggagggagctgcgtggggggcgaatggagctgcaggtgttccacagggcgctcgggctctcgctcgtcggcggcctcagcaccgccataggtgcgctgtttgtagttttgaatccaacccctaaccttaagatgcttgggcttctacagggttttgctgctgggcttatgctgagcatctcctttctggatctggcacacaatgcaataaattctattggcttcttgaagggcaacctctggttttttgcaggagttcttttctttggtttcattgtcaagtttattccagagccagccttttcaccacaagctgatccaagtgagaaaaaggctgatgatggtgggtcgggtaaagatatgatgagaaagcatcgccggcaagtgttattcagtggtattatcactgctgttggaattagcttgcacaattttccagagggaatggctgtatttcttgggtctgtgaagggtcttcatgtgggtttgaacttggctgttgctattgctttacataacataccagagggggttgctgtagctcttccaatctattttgctaccaggagcaaatggcaggcattttatgtggcagcaggatctggtttggctgagccagtaggagtaattgctgtagcttacttgttcccaagcagcttgaatcctgaaattcttgaaggcctacttggatctgttggtggcgttatggctttcctcactctgcatgaaatgctgcctcttgcgtttgactattgtggccagaagcgagcaatcaaagcagtatttttgggcatggcatgcatgtctgcaagcttgtacttcctggagatcagcctaccaaaggagataagcttgtagcatcacatctgtagcgccgcaagtgctccacctccacagtgttacctgaattctgaagctgagagcttgtcagtaaatcctgatttctggcaggggaatgtttgctcctggaacagtcaatcatatgaccatgtgtttaggcagtaggcatcacaccaaaacatcagaactgaaagcaagaacggctagatgtgtcgggggaggggaaaactgcatttccccaggatgtaaaagccaaattagttgtcagaagatgcgtagcaactaaaaacaatcgaaaaactgtatccgatggtcgacaatgaaagcttcaaaagtacaccg

SEQ ID NO: 32086 - protein, 277 aa, Panicum virgatum
  misc_feature: Ceres CLONE 1908942
  misc_feature (10)..(264): Pfam Name: Zip Pfam Description: ZIP Zinc transporter
MELQVFHRALGLSLVGGLSTAIGALFVVLNPTPNLKMLGLLQGFAAGLMLSISFLDLAHNAINSIGFLKGNLWFFAGVLFFGFIVKFIPEPAFSPQADPSEKKADDGGSGKDMMRKHRRQVLFSGIITAVGISLHNFPEGMAVFLGSVKGLHVGLNLAVAIALHNIPEGVAVALPIYFATRSKWQAFYVAAGSGLAEPVGVIAVAYLFPSSLNPEILEGLLGSVGGVMAFLTLHEMLPLAFDYCGQKRAIKAVFLGMACMSASLYFLEISLPKEISL

SEQ ID NO: 32087 - DNA, 733 bp, Panicum virgatum
  misc_feature: Ceres CLONE 1908958
  misc_feature: Encodes the peptide sequence at SEQ ID NO. 32088
cctccgcccgaccgcccccatgcgctttgcctccgcagggaggaggttctccttcggggatggcagtgccgcgaccggggacgcgcacgctgagcaagggagcgtggagatggaggcggatcggggacgggatcgcgcagatggacgtgtgcaacgcgcagagatgacgtcggccgggggcgttagcgacggcgacggccttctctccggtcctaaaagccacagcccaacattgtttcggattctattgattttgctaaaggggacgtcgatgtccagattaccaaattcacaagccttgtgccaatcgacttgaagttcggagcctcactaatcatactaaatgattgtgcctatatatgttgatatagattgtggagaggcatgctaggaacctcctcagctacgaatctcttgtgctctgtattaaaggttgacttcataccaaactttgataactcacagagggagccatctctgctgctggctcgtgttccatctctattgttgaatggttcttctgggattgcggttggaatggcaacaaacattcctcctcacaatctgggggagcttgttgatgcactttctgttataattcaaaagcctgaagccacaaaccacccagcggctgagattgctgctctgccgccgctggccaccactgacaccgaggaggatcgcgcagcggccgccacaccagccgacaacgatccctccatcacagtaccgg

SEQ ID NO: 32088 - protein, 116 aa, Panicum virgatum
  misc_feature: Ceres CLONE 1908958
  misc_feature: SWISSPROT Homolog: EC 5.99.1.3 DNA topoisomerase (ATP-hydrolyzing)
MLGTSSATNLLCSVLKVDFIPNFDNSQREPSLLLARVPSLLLNGSSGIAVGMATNIPPHNLGELVDALSVIIQKPEATNHPAAEIAALPPLATTDTEEDRAAAATPADNDPSITVP

SEQ ID NO: 32089 - DNA, 736 bp, Panicum virgatum
  misc_feature: Ceres CLONE 1908965
  misc_feature: Encodes the peptide sequence at SEQ ID NO. 32090
gccacatctcctccgtccccttcttctcgccgccacccgccgccgccgccatggcaccaggcctctacgccgacatcggcaagaagaccagagatctgctgtacaaggactacaacacgcaccagaagttctccttcaccacctgctccccccacggcgtcgcaatcacagctgcaggaacaaggaaaaatgagtccatatttggcgagcttcacacccagattaagaacaagaagttgacagttgatgtcaaagcaaactcagagtcagatcttttgacaacaatcactgtggatgagtttggaacgccagggctcaaatcgattctcagcttggttgttccagaccagagatcaggaaagcttgagctccagtacttgcatgcatttgctggtgtgaatgcaagcattgggcttaatcccaaccctatggttaacttttctggtgtctttggaagcaaagcactctcggttggcgttgatgtttcatttgatacggcaactagcaatttcaccaagtacaatgcggcactgagccttaccaatccagatcttattgcttccctccatttgaataaccatggtgataccatggttgcatcctactaccacttggtaaagcatcattcaggcaccgctgtcggggctgagctgtcacacagcttctctagaaatgagagcacgctgatctttggttctcagcattcgttggatccccacaccatcgtaaaggcacg

SEQ ID NO: 32090 - protein, 228 aa, Panicum virgatum
  misc_feature: Ceres CLONE 1908965
  misc_feature (2)..(228): Pfam Name: Porin_3 Pfam Description: Eukaryotic porin
  misc_feature: Useful for making plants with modulated drought sensitivity
MAPGLYADIGKKTRDLLYKDYNTHQKFSFTTCSPHGVAITAAGTRKNESIFGELHTQIKNKKLTVDVKANSESDLLTTITVDEFGTPGLKSILSLVVPDQRSGKLELQYLHAFAGVNASIGLNPNPMVNFSGVFGSKALSVGVDVSFDTATSNFTKYNAALSLTNPDLIASLHLNNHGDTMVASYYHLVKHHSGTAVGAELSHSFSRNESTLIFGSQHSLDPHTIVKA

SEQ ID NO: 32091 - DNA, 735 bp, Panicum virgatum
  misc_feature: Ceres CLONE 1908972
  misc_feature: Encodes the peptide sequence at SEQ ID NO. 32092
ttccagttcgggctcgtgggcatcgcgctcacgctcaacttctcgtggtgggccaccgccgccatgctcttcgcctacgtctcctgcggcgggtgcccggagacgtggcacggcttctccgtcgaggccttcgcggggatgtgggagttcgtcaagctgtcctccgcctcaggcgtcatgctatgcttggagaactggtactacaggatcctagtcttgctgactggaaacctcaagaacgcggcgattgcagtggatgcgctctccatctgcatgagtattaacgggtgggagatgatgattccgctggcattcttcgcaggcaccggggtgcgtgtggcgaacgagctcggcgccggcaacggcgcgggcgccaggttcgcgacaatcgtgtcgtccgtcacctcgctggtgatcgggctcttcttctgggtgctcatcatgggcctccacgacaagttcgccttcatcttcacctccagctccgtcgtgctcgacgccgtcgaccacctctccgttctcctcgccttcaccgtcctcctcaacagcatccagcccgtcctctcaggtgtggccgttgggtccggttggcaatccatggtggcctacgtcaacatcggctgctactacctcatcggcattcccctcggcatcctgctcggatggctcttcaacctcggcgtgctggggatctgggcgggcatgattggcggaaccgccgtccagacgctcatc

SEQ ID NO: 32092 - protein, 244 aa, Panicum virgatum
  misc_feature: Ceres CLONE 1908972
  misc_feature (56)..(219): Pfam Name: MatE Pfam Description: MatE
FQFGLVGIALTLNFSWWATAAMLFAYVSCGGCPETWHGFSVEAFAGMWEFVKLSSASGVMLCLENWYYRILVLLTGNLKNAAIAVDALSICMSINGWEMMIPLAFFAGTGVRVANELGAGNGAGARFATIVSSVTSLVIGLFFWVLIMGLHDKFAFIFTSSSVVLDAVDHLSVLLAFTVLLNSIQPVLSGVAVGSGWQSMVAYVNIGCYYLIGIPLGILLGWLFNLGVLGIWAGMIGGTAVQTL

SEQ ID NO: 32093 - DNA, 686 bp, Panicum virgatum
  misc_feature: Ceres CLONE 1908981
  misc_feature: Encodes the peptide sequence at SEQ ID NO. 32094
gccgcagcacggcagcaggcagacaagacgctagacgcccccactactagtagcagctaggccacaacaatcgccggccagccatggccatggcgctcgtctccgcctccggcacggcggccccgctgcagctcctgctcctcgcgctgctgctgctcgccgcgtcggccgcggccttgccggccaggtggcaggtggtcgacagggtggtcagccggcgaggcccctccctgggcctcgtcatgtcctacgtcgacgaggccaccgcgctgcaggcctccggctacttcacgccctggcgcgtcctcccgttcattgacctctacggacgacggtttcacatcggtagcattcgtggcgtgaatgttatatacgcattgacaggacaacgcaggttgaatgcagctgtcactgtacagactctcatcgatgtctttagcgtgtctggcattgttcattacggcacagcagggagttctaatgattccatgtcgtttggcgacgtcagtgtccccaagcttgttgcttacacaggtgcctggacatggaagaagttcagatcaccaaaagagtcatcagcagaactcagctttggagaatataataccccaaatggaggagagaacctgctaggatctctgacattcagaaacgaggagctatactctgtggggtagcctatggaa

SEQ ID NO: 32094 - protein, 197 aa, Panicum virgatum
  misc_feature: Ceres CLONE 1908981
  misc_feature: SWISSPROT Homolog: EC 3.2.2.9 Adenosylhomocysteine nucleosidase
MAMALVSASGTAAPLQLLLLALLLLAASAAALPARWQVVDRVVSRRGPSLGLVMSYVDEATALQASGYFTPWRVLPFIDLYGRRFHIGSIRGVNVIYALTGQRRLNAAVTVQTLIDVFSVSGIVHYGTAGSSNDSMSFGDVSVPKLVAYTGAWTWKKFRSPKESSAELSFGEYNTPNGGENLLGSLTFRNEELYSVG

SEQ ID NO: 32095 - DNA, 714 bp, Panicum virgatum
  misc_feature: Ceres CLONE 1908990
  misc_feature: Encodes the peptide sequence at SEQ ID NO. 32096
agcttctatccatctcgccattgaacaatctccgatagctagcagcttgcctgattgatcctcccggaagatcaaacactccaaggacactgaagaaaagatggcggagcgttcagagaacgcggcgggggaaatgatgagcaacatcatggacgccatcgccgagaacctcccgagcaagaagtccgtcaggttcgacgacggcgagggctccatctccgaccaggcccggaagctgttgggcggcaagaagtccgtccaccacgtcctgggcggcgggaagtccgccgacgtgctgctgtggcggaacaagaagatctcgtcgagcgtgctgggcgtggcgacgctggcctgggtcttcttcgagtggctcgactaccacctgctcaccatcgccagcttcgcgctcgtgctcggcatggccgtgcagctcgcctggtctgccctcgcctcgaacgtgccccgcctcgaggtgccggaggagctgttcgcggacgccggcaaggccgccggcgcgcaggtgaaccgggccctcggcgcgctccaggacatctcctgcgggcgagacctgaggcggttcctcattgtaagcgatccatccaagtggccggctcaactgaacgtgcctgctgcattccttcactaagagcgtttgcagcatcagaccgtgcagggctagcttacccccctccatccgtttctctttcaggcgat

SEQ ID NO: 32096 - protein, 181 aa, Panicum virgatum
  misc_feature: Ceres CLONE 1908990
  misc_feature (62)..(176): Pfam Name: Reticulon Pfam Description: Reticulon
MAERSENAAGEMMSNIMDAIAENLPSKKSVRFDDGEGSISDQARKLLGGKKSVHHVLGGGKSADVLLWRNKKISSSVLGVATLAWVFFEWLDYHLLTIASFALVLGMAVQLAWSALASNVPRLEVPEELFADAGKAAGAQVNRALGALQDISCGRDLRRFLIVSDPSKWPAQLNVPAAFLH

SEQ ID NO: 32097 - DNA, 706 bp, Panicum virgatum
  misc_feature: Ceres CLONE 1908993
  misc_feature: Encodes the peptide sequence at SEQ ID NO. 32098
tttgccattcgcccccagaaggctcatctctctctctctctctctctctctctctcggtgacccgcccctttcccctcggtcctctcttgcctcctctcctcggctcgccatggcgttcttctctcaccaccatctccagcagccgcacccgcagcagcccccgccgccgccgcagcatcagcaacagccggtgcttccttccttcaggaacgcgctgccagtgccggtggatggccagatcccggcgccctttgccttcttcaacccgccgcctgccttcccggagcagccgccgcaggcaccgctggtggatgcggtggggttgacggcggccgcgggacttgggtggaggcagccgagggagcaagagctgcttagggagaactcccagatgtcgtccatcgatttcctgcagacgggctcggccgtgtcgacggggctggcgctgtctctggaggacctgcgccacggcgggggcgggggcggcggggctgggaactcctcgggcgattccccgctgctcctgctgcccatgctggacgatgacatctcccgcgaggtgcagcggcttgatgctgatatggaccggttcattaaagctcagagtgaacggctgaggcagtctatattggagaaagttcaggcaaagcaatttgaggcactggcctctgttgaggacaagatactacgaaaaatacgggataa

SEQ ID NO: 32098 - protein, 198 aa, Panicum virgatum
  misc_feature: Ceres CLONE 1908993
  misc_feature: Useful for making plants with altered lignin content
MAFFSHHHLQQPHPQQPPPPPQHQQQPVLPSFRNALPVPVDGQIPAPFAFFNPPPAFPEQPPQAPLVDAVGLTAAAGLGWRQPREQELLRENSQMSSIDFLQTGSAVSTGLALSLEDLRHGGGGGGGAGNSSGDSPLLLLPMLDDDISREVQRLDADMDRFIKAQSERLRQSILEKVQAKQFEALASVEDKILRKIRD

SEQ ID NO: 32099 - DNA, 427 bp, Panicum virgatum
  misc_feature: Ceres CLONE 1909000
  misc_feature: Encodes the peptide sequence at SEQ ID NO. 32100
acacccgggcgcgactcgcagctccgctcctgactcctgctgctctcgcccgccgcgccgcgccgccccgccccgccccgcccctccggttcttcgcgagcaattcttgtagggcattgccatcacctcttgcaatgggtggaagccagtacgatgatgactgggtattgcccagtgccgatatcactcttgttcttgtcggcaaacttggctatggcaagagtgcaactggaaatagcatccttggacgggaagcatttgtatctgattactcccatgctagtgttactaatacttgtcagatgggaagcactaccctgaaggatggtcgcaccatcaatgttatcgatacaccagggttgtttgatatgaccatttcatccgatgatgctggtaaagaggttgttaagtgtatgaacatggctaa

SEQ ID NO: 32100 - protein, 97 aa, Panicum virgatum
  misc_feature: Ceres CLONE 1909000
  misc_feature (17)..(97): Pfam Name: AIG1 Pfam Description: AIG1 family
MGGSQYDDDWVLPSADITLVLVGKLGYGKSATGNSILGREAFVSDYSHASVTNTCQMGSTTLKDGRTINVIDTPGLFDMTISSDDAGKEVVKCMNMA

SEQ ID NO: 32101 - DNA, 1075 bp, Panicum virgatum
  misc_feature: Ceres CLONE 1909014
  misc_feature: Encodes the peptide sequence at SEQ ID NO. 32102
ctctctctcgctcgctctcgtccccctcctcccgcagcggttcttccctcccttcctctcgccgccgccgccgccgccgttgccgtgttccgtttccttgcagatggcttccgccaagttcggtgctgtcgcgcaggtggagaaccgaggcgcgctgtccaagaggtcgcgcaacgacgtgtctgtaaaggagggggactggaattgtcctcagtgtggtaatgtcaacttcagttttagaaatgtttgcaaccgtggagcctgtggtgcaccgcgtccatcaccgagtccaagtccaagaatgatgccagcacctcctgctgctggatatgagcggtcacctctattttacggagggggtggtggggcgccatctccaatccctcttggatctggtagctatggtggtccatatccacaccttgggatgcgttatggttatggtccaccagtaggagctcctggttcatatggccttttctcttcgtatggtcaacctggaccgatgggtggcatgggatatggccctggacctgagctaggccgatacaactatgggtttagaggatctccaatgccggtttctagcccatggtctggtggagcattagtggaaaacaatgataacattgcttcacgaaagcgccgtggaggcccagatggactttctgagggtgactggacctgtcccaaatgtgacaatattaacttttccttcagaaccacctgcaacatgaagaaatgtggagccccgaggccaactcctggagctaacatgagttcagctcgcaaagacaaggatgcccctgaaggaagctggacctgcccagagtgcaacaacctgaactacccattccgcacggtgtgtaacaggaaagggtgctcatacagcgagccgaccccggccaacaactgaacccaacctttccgttcattgtcgaaatattgttgtaccctagattgtgacctatatcagtcgtgttaaactgcagagacgtttttcctgttccgttaggagattctgttcgtgatgtttgattttacgtatacctttttaagtgtttgggagagtttt

SEQ ID NO: 32102 - protein, 270 aa, Panicum virgatum
  misc_feature: Ceres CLONE 1909014
  misc_feature (29)..(60): Pfam Name: zf-RanBP Pfam Description: Zn-finger in Ran binding protein and others
  misc_feature (189)..(220): Pfam Name: zf-RanBP Pfam Description: Zn-finger in Ran binding protein and others
MASAKFGAVAQVENRGALSKRSRNDVSVKEGDWNCPQCGNVNFSFRNVCNRGACGAPRPSPSPSPRMMPAPPAAGYERSPLFYGGGGGAPSPIPLGSGSYGGPYPHLGMRYGYGPPVGAPGSYGLFSSYGQPGPMGGMGYGPGPELGRYNYGFRGSPMPVSSPWSGGALVENNDNIASRKRRGGPDGLSEGDWTCPKCDNINFSFRTTCNMKKCGAPRPTPGANMSSARKDKDAPEGSWTCPECNNLNYPFRTVCNRKGCSYSEPTPANN

SEQ ID NO: 32103 - DNA, 703 bp, Panicum virgatum
  misc_feature: Ceres CLONE 1909026
  misc_feature: Encodes the peptide sequence at SEQ ID NO. 32104
gatgatgagaaatcgctgattatgtctcaaatgagcttggagaagagatttggccagtccagtgtttttgtagcctctactctgatggaatatggtggtgttccacaatctgcaactccagaatctcttctgaaagaagctatccatgtcatcagttgtggctatgaggacaaaactgactggggatctgagattggatggatctatggttctgttacagaagatattctcactgggttcaagatgcatgctcgaggctggcgatcgatctactgcatgcctaagcgaccagctttcaagggatctgctcctatcaatctttcagatcgtctgaatcaagtgcttcgatgggctcttggttccattgaaattcttttcagcaggcattgtcccatatggtatggctatggaggacggcttaaattcctggagagatttgcatatgtgaacaccacaatttatccacttacctcaatcccactccttttgtactgcatattgccggctgtttgtcttctcactgggaagttcatcatcccagagattagcaactttgccagtatttggtttatattgctttttatttcgatctttgccactggtatccttgagatgaggtggagtggtgttggcattgatgaatggtggaggaatgagcagttttggggtattggtggtatttctgcccatttatttgccgtgt

SEQ ID NO: 32104 - protein, 234 aa, Panicum virgatum
  misc_feature: Ceres CLONE 1909026
  misc_feature: SWISSPROT Homolog: EC 2.4.1.12 Cellulose synthase (UDP-forming)
  misc_feature: The sequence is a functional homolog of SEQ ID NO 6 in US patent 7285702
  misc_feature: Useful for making plants with altered carbohydrate content
  misc_feature: Useful for making plants with modulated biomass
  misc_feature: Useful for making plants with altered cell wall content and/or composition
  misc_feature: The sequence is a functional homolog of SEQ ID NO 26 in US patent 7312377
  misc_feature: The sequence is a functional homolog of SEQ ID NO 2 in US patent 7049481
  misc_feature: Useful for making plants with modulated plant growth and development
DDEKSLIMSQMSLEKRFGQSSVFVASTLMEYGGVPQSATPESLLKEAIHVISCGYEDKTDWGSEIGWIYGSVTEDILTGFKMHARGWRSIYCMPKRPAFKGSAPINLSDRLNQVLRWALGSIEILFSRHCPIWYGYGGRLKFLERFAYVNTTIYPLTSIPLLLYCILPAVCLLTGKFIIPEISNFASIWFILLFISIFATGILEMRWSGVGIDEWWRNEQFWGIGGISAHLFAV

SEQ ID NO: 32105 - DNA, 1350 bp, Panicum virgatum
  misc_feature: Ceres CLONE 1909033
  misc_feature: Encodes the peptide sequence at SEQ ID NO. 32106
acacaccgaacccacccccgcacccaccgccgcacccgccgtggccgccgcggcagcgcccctcccggcggtgagcgcagcccactgtgcacgccgcggccgccgccgcgctcggggcgcccagatctagggctggtagaggcgtgctcgcccccccgcggcagctccatggcgccgcgacagccgtggtggacggcgctgctcttacccttcctcctcgccggcgtcgggccctccaccgccgcctcgattcctaccgatgcgtgccgggtccctactatcgtggaatccgttctcgggactcccgagatgtgctcggcgctggatcgccttttcggcgacccggtcggcgtcatcgagggagatgaggtcacattggcaaaggcagttaatcttcttcacatgaacaaggatgactatattgctgtccttttttatgcatcatggtgcccattctcacaagaatgcaaaccaaattttgaggcattagcttccttattcccaactattcggcattttgcatttgaggaatctgcaattaggccaagcataatatcgagatatggaattcatggttttccaacactgtttctcttgaattcgaccatgagagtgcggtatcatggaccaaggactgtaaaatcacttgctgctttctacactgatgtctcaggtatcaatgcttcggtgaagtcaactgcaggggaggccatagtacattcattagatgatattgagcataaaaaggatgctgaacaggaaaattgcccattctggtgggcgcgttcgccagagaaaatacttcagcaggatacttacctggcattggcaaccacatttgtaatcttgaggttgctgtatcttcttttcccgaagatagattcctttgccagatgggcatggaggaggcataatctctttgcaaacttgacgagtgcacatgaatatttcctcacctaccttgagcaagcaagacagaaattccataggctatacccttcaagttcaaagcgggggaatttgcaagagggggcaatgaacgccaccgcttgggcctcaaagtcattagcatctgtatcgattggagaaccaagcgccatcggaaggacaaactctacaagtgagctaagatgaactgtaacttctttttgtccgcagggatatatgtacagtacagtagagtgatcaggatatgaacaccaagaatctgttgtaacggctgtatgactcattgtaacatcctccatagaataatcacattcaccgtttcagcctttgtttttcattgttgttacagccgactcattgtaacatcctccatagaataatcacattcaccgtttcagcctt

SEQ ID NO: 32106 - protein, 321 aa, Panicum virgatum
  misc_feature: Ceres CLONE 1909033
  misc_feature: SWISSPROT Homolog: EC 5.3.4.1 Protein disulfide-isomerase
MAPRQPWWTALLLPFLLAGVGPSTAASIPTDACRVPTIVESVLGTPEMCSALDRLFGDPVGVIEGDEVTLAKAVNLLHMNKDDYIAVLFYASWCPFSQECKPNFEALASLFPTIRHFAFEESAIRPSIISRYGIHGFPTLFLLNSTMRVRYHGPRTVKSLAAFYTDVSGINASVKSTAGEAIVHSLDDIEHKKDAEQENCPFWWARSPEKILQQDTYLALATTFVILRLLYLLFPKIDSFARWAWRRHNLFANLTSAHEYFLTYLEQARQKFHRLYPSSSKRGNLQEGAMNATAWASKSLASVSIGEPSAIGRTNSTSELR

SEQ ID NO: 32107 - DNA, 674 bp, Panicum virgatum
  misc_feature: Ceres CLONE 1909036
  misc_feature: Encodes the peptide sequence at SEQ ID NO. 32108
aaaacaacccccgctccctccactccgtgtctccctctctcgccgtcgcactcgcactcacgccgccaccgccgcgttgtgatcgagcctgtggagcggcgagcgaggccggaaatgcagatggactcctatttgtacgccggcttcttccacgacgaggccgcgttctacccgcagggcgccgtgccgccctccccggagctgcccttcggcctcattgcctcgccgggggagcccgcgccgcccttccagccgccggaggcgccgaggcccgccgcgttccaggactactccgtggcggagccggagctgctggcgcaggccgtgggcgccggagagccacactacgggagctcgggcccgagcgcgaacatgcgggtggtcgacgcgctgggcggggaccctgtgcatgatcagacaatgggggaggagtgggaggaggagccgcggcggcagcgccagcagcagcagcagcagccggcgggcgccgccgtggagagcagccgcgggttccggcacatgatgcgggagcggcagcggcgcgagaagctgagccagagctacgccgacctctacgccatggtcgccgcccggtccaagggcgacaagaactccatcgtgcagtccgcagcgatctacatccacgagctcaagggcgcgcgggagcagctgct

SEQ ID NO: 32108 - protein, 186 aa, Panicum virgatum
  misc_feature: Ceres CLONE 1909036
  misc_feature (134)..(180): Pfam Name: HLH Pfam Description: Helix-loop-helix DNA-binding domain
MQMDSYLYAGFFHDEAAFYPQGAVPPSPELPFGLIASPGEPAPPFQPPEAPRPAAFQDYSVAEPELLAQAVGAGEPHYGSSGPSANMRVVDALGGDPVHDQTMGEEWEEEPRRQRQQQQQQPAGAAVESSRGFRHMMRERQRREKLSQSYADLYAMVAARSKGDKNSIVQSAAIYIHELKGAREQL

SEQ ID NO: 32109 - DNA, 699 bp, Panicum virgatum
  misc_feature: Ceres CLONE 1909040
  misc_feature: Encodes the peptide sequence at SEQ ID NO. 32110
  misc_feature (594)..(594): n is a, c, t, g, unknown, or other
atcatcactgcgacaaccaaccagacacctggtctgaatgtgatcactgagtatgtcatgggactaattatgccgggctatcctattgcgaacgtctgcttcaaggtttatggctacatgagcatgtcacaggctgttgctttcctctcagacttcaagcttggccactatatgaagatccctcccaagtccatgttccttgttcagtttgttggtactatcgtggctggcacggttaacattgggacggcatggtggctgctcggctccatcaaggacatctgctcagattcactcccaccagacagcccatggacatgccctggtgaccgtgtgttcttcgatgcatcagtgatctggggccttgttggtccgatgcgcatctttgggtcagctgggaattacagcgtcctcaactggtttttcctcattggcgcagcaggcccagttattgtatacgctctccacaggatgttccccaaccagaggtggataccattgatcaatctgccagtactccttggtgcaacggccttcatgcccccagcaacgcctgtgaactataactcatggctgttcattggcaccatcttncatttctttgtgttccggtaccggaagaagtggtggacaaggtacaactacattctctctgctgcgcttgacgctggagttgcattcatggggggtggtgctgta

SEQ ID NO: 32110 - protein, 232 aa, Panicum virgatum
  misc_feature: Ceres CLONE 1909040
  misc_feature (1)..(232): Pfam Name: OPT Pfam Description: OPT oligopeptide transporter protein
  misc_feature (198)..(198): Xaa is any aa, unknown, or other
IITATTNQTPGLNVITEYVMGLIMPGYPIANVCFKVYGYMSMSQAVAFLSDFKLGHYMKIPPKSMFLVQFVGTIVAGTVNIGTAWWLLGSIKDICSDSLPPDSPWTCPGDRVFFDASVIWGLVGPMRIFGSAGNYSVLNWFFLIGAAGPVIVYALHRMFPNQRWIPLINLPVLLGATAFMPPATPVNYNSWLFIGTIXHFFVFRYRKKWWTRYNYILSAALDAGVAFMGGGA

SEQ ID NO: 32111 - DNA, 705 bp, Panicum virgatum
  misc_feature: Ceres CLONE 1909060
  misc_feature: Encodes the peptide sequence at SEQ ID NO. 32112
atccaccgatcccgcggctcctcctcttcctcccagtcccagctaggtagccccgccttcaccacttcacctcccggctccctcctccccccaccagagctgaaaacccgttggaggagagcggagagggaaggcgatggaccacgcggcggaggcgcagcggacggacctgatgacgatcacgcggcacgtgctcaacgagcagggccgccacccggagtcccgcggcgacttcaccatcctcctctcccacatcgtcctcggctgcaagttcgtcgcctccgccgtcaacaaggccgggctcgccaagctcgtcggcctcgccggggagaccaacgtccagggtgaggagcagaagaagctcgatgtgctgtccaacgaggtctttgtcaaggcgctcgtcagcagcggccgcacctgcgttcttgtgtctgaagagaacgaggaggccatattcgtcgacccggcactccgtgggaagtactgcgtttgtttcgatccgctggatggctcctccaacatcgactgtggtgtctccatcggaacaatcttcgggatttacatgatcaaagataaggataatgtgactttgggtgatgtgctgcaacctggaacaaacatgcttgctgctggctactgcatgtacgggagttcctgcacgcttgtgttgagcactgggaatggagtcaatgggtttcctcttga

SEQ ID NO: 32112 - protein, 189 aa, Panicum virgatum
  misc_feature: Ceres CLONE 1909060
  misc_feature (13)..(189): Pfam Name: FBPase Pfam Description: Fructose-1-6-bisphosphatase
  misc_feature: SWISSPROT Homolog: EC 3.1.3.11 Fructose-bisphosphatase
  misc_feature: Useful for making plants with modulated biomass
MDHAAEAQRTDLMTITRHVLNEQGRHPESRGDFTILLSHIVLGCKFVASAVNKAGLAKLVGLAGETNVQGEEQKKLDVLSNEVFVKALVSSGRTCVLVSEENEEAIFVDPALRGKYCVCFDPLDGSSNIDCGVSIGTIFGIYMIKDKDNVTLGDVLQPGTNMLAAGYCMYGSSCTLVLSTGNGVNGFPL

SEQ ID NO: 32113 - DNA, 682 bp, Panicum virgatum
  misc_feature: Ceres CLONE 1909090
  misc_feature: Encodes the peptide sequence at SEQ ID NO. 32114
acacgaatcctatccgccgacgccgccatggacgacgatcctcccgtcatcctcgaccgcgcctcccgcgccacccgaggaaagaggataaccaagctcctcgaggacgagatcgagcaggacgaggttttctggaatcacgacgccctcaaggatgaggaaaacgatgacaactacgaggaagagcgggatgctggcgacgaattcgacagtgattttgatcgagttgaatctgaacctgatgatgagccagaaaaggaagaacgtgagagattaccaatcaaagagcgccttatgttccccggcgagacgttgagaaagaccaatgccaagaagaagaaggtgatcccaaaactagaagatgacacaaaagctgacaagccaagtgcatccacacaagcggatgttcctgatgaattagagacagagaagaccataaggaaatcaaccagaacgtcggttattgtcagacaagcggaaagagaagcaatacgtgctgaaaaagaagcagcagtcaagccaattaagaagaaaaaggaaggagaagaaaagcggatgacacaagaggagatgcttttggaagcagctgacacagagatcatgaacttgagaaatctagatcgtgtactggcaagagaggaggaagtcaagacaaaagctgttgttcataaggacacctatg

SEQ ID NO: 32114 - protein, 218 aa, Panicum virgatum
  misc_feature: Ceres CLONE 1909090
  misc_feature (8)..(217): Pfam Name: YL1 Pfam Description: YL1 nuclear protein
MDDDPPVILDRASRATRGKRITKLLEDEIEQDEVFWNHDALKDEENDDNYEEERDAGDEFDSDFDRVESEPDDEPEKEERERLPIKERLMFPGETLRKTNAKKKKVIPKLEDDTKADKPSASTQADVPDELETEKTIRKSTRTSVIVRQAEREAIRAEKEAAVKPIKKKKEGEEKRMTQEEMLLEAADTEIMNLRNLDRVLAREEEVKTKAVVHKDTY

SEQ ID NO: 32115 - DNA, 974 bp, Panicum virgatum
  misc_feature: Ceres CLONE 1909109
  misc_feature: Encodes the peptide sequence at SEQ ID NO. 32116
gcgattcgccagcgtccgagccccaggcacgaaacctagcccatcagaccagccgagcccccgggatccgaagcggcggccatggagcccactcccgtcggcgccggcggcacggcggagcggtggggcgcggaggcgtcgcgggcgttccagcactacctggaccgcgcggcgccgcacacggccgggcggtgggcgggcacgctcgtggccgcggcggtgtacgcgctgcgggtgtacttcgtgcggggcttctacgtggtcacctacggcctgggaatctacctgctcaacctcctcatcggcttcctctcccccatggtcgacccggagctcgaggcgctcgacgcagggcctgggctccccacccgcggctccgaggagttcaagcccttcatccgccgccttcccgagttcaagttctggtatgccatcacgaaagcatttttcattgctttcatcatgaccttcttctctgtattcgatgttcctgtcttctggccaatactcctctgttattggattgtgctctttgtcctgacaatgaagcgacagattgtgcatatgattaagtacaagtatgtgccattcagctttggaaagcagaggtatgacggaaagaaaggcccagcagccagtgcatctaaagactgaagactgatgatcttggacctggagagcaaatgcctgtgcatctttaggcaactatcctgctggcatggtgttattttgaataccagctactgatagtgaatgcacccaccgtattcactagtggagagaagctaagcagacttttgcatcggttgatgattcttgtttcttgcatatcggtagtttgtgtacaatggctcggacatagctagtagattactctccagttcatctgttgtactgcacttttgtggacaagttacgcacctgttgaatcggtgcaactgcaatgcaactatgcagatgaaaaccgagaggac

SEQ ID NO: 32116 - protein, 190 aa, Panicum virgatum
  misc_feature: Ceres CLONE 1909109
  misc_feature (3)..(180): Pfam Name: Rer1 Pfam Description: Rer1 family
MEPTPVGAGGTAERWGAEASRAFQHYLDRAAPHTAGRWAGTLVAAAVYALRVYFVRGFYVVTYGLGIYLLNLLIGFLSPMVDPELEALDAGPGLPTRGSEEFKPFIRRLPEFKFWYAITKAFFIAFIMTFFSVFDVPVFWPILLCYWIVLFVLTMKRQIVHMIKYKYVPFSFGKQRYDGKKGPAASASKD

SEQ ID NO: 32117 - DNA, 761 bp, Panicum virgatum
  misc_feature: Ceres CLONE 1909121
  misc_feature: Encodes the peptide sequence at SEQ ID NO. 32118
aataacaactcttcttccaccgcacccgcgccgcgaccccacctcccggatctcatctgcgacgacctccccctcccgtcccgatcccgcctccgcctccgcctccgcctccgcccgcggcgcgccaccgctgcccgcaccccacaccgaggtcctctcgtctccggcggcggcggcgaagatgtacgggtgggagatgctgtcgttcaacatccacgacgggttcctggaggccatcgtgcgggggaaccgctcgggcctcctcaccgccgccgactacaacaacctctgccagtgcgagaccctcgacgacatcaagatgcacctcaccgccaccgagtacgggccctacctccagaacgagccttctcccttgcacacaacaacaattgtggagaagtgcacgcttaaactggttgatgagtacaagcacatgctatgccaggctactgaaccactatctacattcttgcagtatataacgtacgggcatatgattgataatgttgtccttattgtaaccgggacattgcatgagagagatgttaatgaactgttggagaaatgccacccattgggcatgtttgacagcattgcatcacttgctgttgctcaaaatatgcgtgagctttatagattggttctggtcgatacacccttggccccatacttctcggagtgcattacatctgaggatctggatgacatgaatattgagattatgagggacactctgtacaaagcatatcttggaggatttt

SEQ ID NO: 32118 - protein, 193 aa, Panicum virgatum
  misc_feature: Ceres CLONE 1909121
  misc_feature (15)..(193): Pfam Name: vATP-synt_AC39 Pfam Description: ATP synthase (C/AC39) subunit
  misc_feature: SWISSPROT Homolog: EC 3.6.3.14 H(+)-transporting two-sector ATPase
MYGWEMLSFNIHDGFLEAIVRGNRSGLLTAADYNNLCQCETLDDIKMHLTATEYGPYLQNEPSPLHTTTIVEKCTLKLVDEYKHMLCQATEPLSTFLQYITYGHMIDNVVLIVTGTLHERDVNELLEKCHPLGMFDSIASLAVAQNMRELYRLVLVDTPLAPYFSECITSEDLDDMNIEIMRDTLYKAYLGGF

SEQ ID NO: 32119 - DNA, 684 bp, Panicum virgatum
  misc_feature: Ceres CLONE 1909137
  misc_feature: Encodes the peptide sequence at SEQ ID NO. 32120
atttcgcggattcacaacagcccagggcaagaagaaaacctggccgaaacgccaccgtcggcgagccgccgccttggcaaactcttttggcccgggcgcggccacggctacccgatcgcgcgcagcgccacggcgcacaacacgatccccggcgcaaacctacaaaaactaaccagcgagccttcccccggcctccttcctcagctccggtgtctccgaccctctccagaagccttgcccgccgtccaagctcctcctatgccgatgcccgtcgcgtccgtggccgccctccggactgccggcggctccggccgccgccgcggcgcgggttccccgcaggtcggcctcaacggcggcaggttcttgatgatgcagaggagggagctggtgaccaaggccgggatcgccctcgccgtctcctgctcgatggccacctccccggcctccgccaacggctccgcgcaagggctggagattctgccgttcaaaccggacgggtacaacttctggacgtggcgcggccgccggattcactacgtcgagcaaggcgccgggcgacccatcgtgctcatccacggcttcggcgcctccgccttccactggaggtacaacatcgcggagctggcgaagaagtacaaggtgtacgccatcgacctgctggggttcggctggagcgagaaggcg

SEQ ID NO: 32120 - protein, 139 aa, Panicum virgatum
  misc_feature: Ceres CLONE 1909137
  misc_feature: SWISSPROT Homolog: EC 3.3.2.10 Soluble epoxide hydrolase
MPVASVAALRTAGGSGRRRGAGSPQVGLNGGRFLMMQRRELVTKAGIALAVSCSMATSPASANGSAQGLEILPFKPDGYNFWTWRGRRIHYVEQGAGRPIVLIHGFGASAFHWRYNIAELAKKYKVYAIDLLGFGWSEK

SEQ ID NO: 32121 - DNA, 1065 bp, Panicum virgatum
  misc_feature: Ceres CLONE 1909152
  misc_feature: Encodes the peptide sequence at SEQ ID NO. 32122
acacaacacaagcacgtacgcacgcacgtggcacctaccaccacgcacgacgcagtgatgagggctctcccggcgacggccggccgcggggcggtggcctgcgccgccgcgcccgtcccccggaggtccctgctcctctccaccgccgccgcaggtgcggcgctgaacgcggagcagctgccgctgcggctgaccgggggcgcggcggcgaagatccgggccccggcggacgcggcgcaggcggtcaccttcaccagcacggacgacgccctggcgtggaccaacaaggacaaccggcgcctcctccacgtcgtctaccgcgtcggcgacctcgacaagacaatcaagttctacaccgagtgcctggggatgaaggtgctgaggaagagggacatccccgaggagaagtacaccaacgcgttcctcggctacgggcccgaggactcgcacttcgccatcgagctcgcttacaactacggggtcgacaagtacgacatcggcgcaggtttcggccatttcggtatcggagtcaatgatgtggccaagacagttgagctcgtgagagcaaagggaggcaaggtgaccagggagcccgggcctgtcaagggcggcaagaccgtgatcgccttcgtcgaggaccctgacggctacaagtttgagatccttgagaggccgggcaccccggagcccctgtgccaggtcatgctccgcgtcggcgatctcgaccgcgccataagcttctacgagaaggcttgtggcatggagctgttacggaagagagataatcctgaatacaagtatacggtggccatgatggggtacgggcctgaagagaagaatgcagtcctggagctgacctacaactacggcgtctccgagtacaccaaggggaacgcgtacgcgcagatcgccatcggcaccgacgatgtctacaagacggccgaggtggtgaagctgttcggggggcaggtggtgagggagccggggccattgccggggatcagcaccaagatcacggccatcctggaccctgatggctggaaatcggtaccaggctccaggctc

SEQ ID NO: 32122 - protein, 335 aa, Panicum virgatum
  misc_feature: Ceres CLONE 1909152
  misc_feature (81)..(202): Pfam Name: Glyoxalase Pfam Description: Glyoxalase/Bleomycin resistance protein/Dioxygenase superfamily
  misc_feature (211)..(332): Pfam Name: Glyoxalase Pfam Description: Glyoxalase/Bleomycin resistance protein/Dioxygenase superfamily
  misc_feature: SWISSPROT Homolog: EC 4.4.1.5 Lactoylglutathione lyase
  misc_feature: Useful for making plants with modulated nitrogen use efficiency
MRALPATAGRGAVACAAAPVPRRSLLLSTAAAGAALNAEQLPLRLTGGAAAKIRAPADAAQAVTFTSTDDALAWTNKDNRRLLHVVYRVGDLDKTIKFYTECLGMKVLRKRDIPEEKYTNAFLGYGPEDSHFAIELAYNYGVDKYDIGAGFGHFGIGVNDVAKTVELVRAKGGKVTREPGPVKGGKTVIAFVEDPDGYKFEILERPGTPEPLCQVMLRVGDLDRAISFYEKACGMELLRKRDNPEYKYTVAMMGYGPEEKNAVLELTYNYGVSEYTKGNAYAQIAIGTDDVYKTAEVVKLFGGQVVREPGPLPGISTKITAILDPDGWKSVPGSR

SEQ ID NO: 32123 - DNA, 755 bp, Panicum virgatum
  misc_feature: Ceres CLONE 1909152-R
  misc_feature: Encodes the peptide sequence at SEQ ID NO. 32124
acaaaatgaaagaggatgccgtgaaggaactccttcgtgtcagcgacaaccaccatgaatacaggaaccttttgaaagatctaatcgttcagggcttgctccggttgaaagagccagcagtactgctccgttgccgtaaagaggaccaccatcacgtggaatctgtactgcattcagcaaagcatgagtatgcatcaaaagcagatgtccatcaaccagagataattgttgaccatgatgtgtacctgccacctgccccaagccatcatgatgctcatggccagttttgctctggaggtgttgtcctggcttctcgagatggaaagattgtgttcgagagtacacttgatgcaaggctggaagttgttttccgcaagaaattgccagagatccggaagcttctttttagcaagaatgcagtctaatagacgttcctacgagggtacagctgcttctatgtaattgctgctgccctgcagccttaagcgactccacctgtttttggcaaattgattgtttaaagtattcatcccctatgtacaaactacctatttgttcattattatcgccgagcaccgactgtttgcactatgtttgctccgaggaataaggataaagcaccgccagactttccactgcgaagctgaataaatattgtaaatcatttgctgtgctaaactgtctgttttgggcctgtcgagctgtatattcagttcttgtcggattggattcctttggaaaaagttcgtgtgtgc

SEQ ID NO: 32124 - protein, 140 aa, Panicum virgatum
  misc_feature: Ceres CLONE 1909152-R
  misc_feature (1)..(135): Pfam Name: vATP-synt_E Pfam Description: ATP synthase (E/31 kDa) subunit
  misc_feature: SWISSPROT Homolog: EC 3.6.3.14 H(+)-transporting two-sector ATPase
KMKEDAVKELLRVSDNHHEYRNLLKDLIVQGLLRLKEPAVLLRCRKEDHHHVESVLHSAKHEYASKADVHQPEIIVDHDVYLPPAPSHHDAHGQFCSGGVVLASRDGKIVFESTLDARLEVVFRKKLPEIRKLLFSKNAV

SEQ ID NO: 32125 - DNA, 723 bp, Panicum virgatum
  misc_feature: Ceres CLONE 1909158
  misc_feature: Encodes the peptide sequence at SEQ ID NO. 32126
aagttccattccccatccgccatcacccaagccgaaccgaaaactgaccccaaacccaacccgcgaatcgcacccaattcgaccggggaatcgcgccatccgccaccatgagcttctcgtccatgagcaagcagcaggtgctggacgccggcgagggcgcgggggaggaggtcgtggagctcatcccgggcctgccggaggaggtggccgagaagtgcctcctccacctgcccttcctctaccaccgcctcttccgcaccgtctcctccacctggaaccgcttcctcaccgacgcccccgccaagccgccgctgctcgcccccgcccccgccgcggcggcggccgcggtgtcggtatccttctcgctgccgttcctcttcgccttcgcgtttgaacccgcgtcgcggcgcctccagtgccaggcgctcgacccgttctcccggaggtggctcctgctgccgccggtgcccggcggcgccgcggccgggtcgttcgcggtggttgggctcccccgccgcggcgagatctacgtgattgggggcgtcgaggagggcggcgacaaggccgtgcgcagcgtggccgtgtacagcgccgcgcggaacgggtgggaggcggcggcggcgatgcggacgccccgcgggtacatggcggccggggaggtgggcgggcgcgtggtggtggccggggaggacggcgaggcggatgtgttcgacccggaggccg

SEQ ID NO: 32126 - protein, 205 aa, Panicum virgatum
  misc_feature: Ceres CLONE 1909158
  misc_feature (24)..(71): Pfam Name: F-box Pfam Description: F-box domain
MSFSSMSKQQVLDAGEGAGEEVVELIPGLPEEVAEKCLLHLPFLYHRLFRTVSSTWNRFLTDAPAKPPLLAPAPAAAAAAVSVSFSLPFLFAFAFEPASRRLQCQALDPFSRRWLLLPPVPGGAAAGSFAVVGLPRRGEIYVIGGVEEGGDKAVRSVAVYSAARNGWEAAAAMRTPRGYMAAGEVGGRVVVAGEDGEADVFDPEA

SEQ ID NO: 32127 - DNA, 1089 bp, Panicum virgatum
  misc_feature: Ceres CLONE 1909161
  misc_feature: Encodes the peptide sequence at SEQ ID NO. 32128
atacatacatatatatccacctgtgcttatgctgccttgagtgatcacttagcagtaggattagcatagggagtgtgtgtagttagttgattagaggtgaggtgaggtggaacgaagatgttggcggtgttcggcggcgaggtggtgggggtgccggcggagctggtggcggcgggcagccggacgccgtcccccaagacgcgggcgtcggagctggtgagccgctttctgggcggcgccggcgccgagccggccgtgtcgctgcagctgggcgccctcggcaccctcgcctactcccacgccagccagccgctcctccgtccgaggtcgtttgctgcgaaggacgagatcttctgcctgttcgaggggttgctggacaacctgggccggctggggcagcagtacgggctgtgcaaggtcgccaacgaggcggtcctcgccatcgaggcctacaagactctgcgcgaccgggggccatacccggccagcttcatgctctcgcagctcgccggcggctacgccttcgtcctcttcgacaagtccacctcctccctgctcgtcgcatccgatcccgagggcaaggtgccgttctactgggggatcactgctgatggatgcgtcgccttctctgacgacgtcgacatgctcaaagggtcctgtggcaagtccctcgcgccttttccgcagggttgcttctactctaacactcttggaggcttgaagtgctatgagaaccccaagaacaaggtgactgctgttcctgcagacgaggaagaaatctgtggtgcgactttccaggtggaagcctctacaatcctctcagcactgcattaggagatttcagtctgggtttgtggttcaagcttcaggctctacacggtggtgtaacataatggcaaggcatgcagctgatctgtacatcttctataaaaggagaagtgaagccaacatggcaagcacttccgtgctgtatgttgtgtatcatgactatgaagctttgtaatcttcagcgaataagcggttctcactgtcactatgaggctatctgatgcgtgtagatagttgctgctgattttacatcagaccatg

SEQ ID NO: 32128 - protein, 238 aa, Panicum virgatum
  misc_feature: Ceres CLONE 1909161
  misc_feature: SWISSPROT Homolog: EC 6.3.5.4 Asparagine synthase (glutamine-hydrolyzing)
MLAVFGGEVVGVPAELVAAGSRTPSPKTRASELVSRFLGGAGAEPAVSLQLGALGTLAYSHASQPLLRPRSFAAKDEIFCLFEGLLDNLGRLGQQYGLCKVANEAVLAIEAYKTLRDRGPYPASFMLSQLAGGYAFVLFDKSTSSLLVASDPEGKVPFYWGITADGCVAFSDDVDMLKGSCGKSLAPFPQGCFYSNTLGGLKCYENPKNKVTAVPADEEEICGATFQVEASTILSALH

SEQ ID NO: 32129 - DNA, 470 bp, Panicum virgatum
  misc_feature: Ceres CLONE 1909213
  misc_feature: Encodes the peptide sequence at SEQ ID NO. 32130
tctctcttgctgatccgatccccacaagtccagccaaagctgtgtggtcatggacaagaagcgggtggccatcgtcggcgccggcgtgagcggcctggccgcgtgcaagcacctcctggagcgcggctgccgccccgtggtgttcgaggccgacaccgtcctcggcggcgtgtggccgcccgtgcccaattgcacggccctgcagacgccgcggccgctgtaccagtactcggacttcccgtggccggaggccgtcacggaggtgttcccggaccaccgccaggtgatgacctacctggactcgtacgcccgccgcttcggcgtgctcggccgcgtccggttccgccgccgggtggtcgggatggagtaccgcggcgtcggctaagaggacgtggcggcctgcgaggagtgggccgggaacggcgacgccttccgctcccgcgacggggagaggcccctcacgggggccg

SEQ ID NO: 32130 - protein, 111 aa, Panicum virgatum
  misc_feature: Ceres CLONE 1909213
  misc_feature: SWISSPROT Homolog: EC 1.14.13.8 Flavin-containing monooxygenase
MDKKRVAIVGAGVSGLAACKHLLERGCRPVVFEADTVLGGVWPPVPNCTALQTPRPLYQYSDFPWPEAVTEVFPDHRQVMTYLDSYARRFGVLGRVRFRRRVVGMEYRGVG

SEQ ID NO: 32131 - DNA, 1850 bp, Panicum virgatum
  misc_feature: Ceres CLONE 1909223
  misc_feature: Encodes the peptide sequence at SEQ ID NO. 32132
acaaccctcctccatctcatctctctctctctctcctccagctagcttctcactctccagagtccagaacgcgtgcagttcgaagctaagctaggcgtgcgtccaggtccatccttctctagttgcgttcgaccacatccttccttctcgggcttcttgccttggtaaatcaatgttctttccttgggttcttgagccactacggatcagatagattgcatgcttgcttgggtttagcagccaagacgatttcttgatgcgcaagcgcaaggccttaccatggggggcaaggtctgggtttgatctataggcttgccacagcatgcacattgcctggcctgatcgaccggctcctgtgatcatgcatatagaggttcagacatctcaggttggatcatgcacagccacacggcacctttctgttgaatctgccggcaaaatgtgcgatcgccagcacaagcccttcatttgtcttccaacagataaaacttggcttctcaaatgccttgtgtttttgtttctaactcttctttaatggaaaggcagagcacgtgccattgtccctaaaaaaaatttgccttgtactatgcgtagtagcctctggaaatatggattggaatttcaaacttggaatgaagctagtagtatgattctaaccaaaccaagttccaattgcaggtatgcaggaccagctgatctgcagcggctgcaagcgtgttcttcagtaccgcaggggagccgccggcgtctgctgcccaggctgcaacactttcaccgccgccaaccagtcaggaccggacatgtctgaactcgtctgcggcggctgcttcaccatgctcgtgcacaaccgcggcgccgccaacattcgctgcccgcactgcggcagggtcaactcaacaagatcagagaaccagattggtcacctgtcatgcgggcattgccggactactctggcgtacccaccgggagcctcgacggtcggatgcccaacttgtcgctgcgtcaatcctgtcaggaacaacaactctggtggctctgcacggcctgcaccatcggtacgttctcctggcttttccaagtttcagtggtcactgcaatgttctgcaatagggcaaaatctaataggcgatactgcttgcatcaagaaacgtatggagccatcgagcaatcaatggccgcaacgcaaccatccttttttttgttgcgtcaaccagcaataaggttgtcctccccaaaagatcacaacattggtaggttcaggttgctccatggtttcagaggaatcagttccttggtaggcaagtagcaatgattagcacacctcgatgcttagatttttcgcttgaaatcctctggaccatgcatgtctagtatcaggatgaaagcgctggtccattggggtttgagcaaacagtctgaatctagctagactgatgtcaaatgttcgacggtgatgacacgtacgggctttattcgctgaactttcatgttcctacttgcaggatgctcggccccagacggttcttgtggagaatcctaagacgctggatgaaaagggcaaactggtgagcaatgtcgccgttggtgtcacctcatggaaaagatgaccaagaactcctccgcggcatcatcccaaggatctactgataaacccttggtgatggacatgtaaaactatcataatcaaactaatgtgaaatcaagtgtgttttgaagcttgatataagaaaaaaaatgtaacagttgagaagcaaaagatctgaagatgtaaatatgctagccggccgtgtgtgcgctagcctatgtactccaagccaaaaaggaatggaaaggagcgaagcattgtgttc

SEQ ID NO: 32132 - protein, 179 aa, Panicum virgatum
  misc_feature: Ceres CLONE 1909223
  misc_feature (84)..(108): Pfam Name: zf-LSD1 Pfam Description: LSD1 zinc finger
  misc_feature (46)..(70): Pfam Name: zf-LSD1 Pfam Description: LSD1 zinc finger
  misc_feature (7)..(31): Pfam Name: zf-LSD1 Pfam Description: LSD1 zinc finger
MQDQLICSGCKRVLQYRRGAAGVCCPGCNTFTAANQSGPDMSELVCGGCFTMLVHNRGAANIRCPHCGRVNSTRSENQIGHLSCGHCRTTLAYPPGASTVGCPTCRCVNPVRNNNSGGSARPAPSVRSPGFSKFQWSLQCSAIGQNLIGDTACIKKRMEPSSNQWPQRNHPFFCCVNQQ

SEQ ID NO: 32133 - DNA, 2839 bp, Panicum virgatum
  misc_feature: Ceres CLONE 1909257
  misc_feature: Encodes the peptide sequence at SEQ ID NO. 32134
agtcctctctcccggcggcgcctccacatctcgtctctcagatcgggaggcgaaaccaagaaggaaaatatatatttgtagtgtgatcttcaaaagaagtcaagatggtgaagttcacggcagaggagctccgcgccatcatggacaaaaagaacaacattcgtaatatgtctgttattgctcatgtggaccacggcaagtctacccttacagactcccttgtggcagctgctgggattattgcccaggaagttgctggtgatgtccgcatgactgatactcgcgctgatgaagcaaagcgtggtattacaatcaaatccaccggtatctctctctactatgagatgactcctgagtcactgaagaattacaagggtgagagagatggcaaccagtatttgatcaaccttatcgactcacctgggcacgtcgatttttcttcggaagtgacagctgcccttcgtatcaccgatggtgctctggtggtggttgactgtattgaaggtgtctgcgtgcaaactgagactgtgcttcgacaggctcttggtgagaggattaggccagtccttactgtgaacaagatggacaggtgcttccttgagcttcaggttgagggtgaggaagcctaccagactttctcccgtgtgattgagaatgccaacgtcattatggcaacatatgaagataagctccttggtgatgtccaagtctacccggagaagggaactgttgctttctctgctggtctgcacggctgggccttcaccctcaccaactttgccaagatgtatgcatctaagtttggagttgatgaaactaagatgatggagaggctctggggtgagaacttctttgatccagccacgaagaagtggaccaccaagaacacaggctcagctacctgcaagagaggatttgttcagttctgctatgagcccatcaagcagatcatcaacacctgcatgaacgaccagaaggataagttgtggcccatgcttcaaaagctcaatgttaccatgaaggctgatgagaaggaattggttggcaaggctttgatgaagcgtgttatgcaaacctggttgccagctagtaccgcactgcttgagatgatgatattccaccttccttccccatcaaaggcgcagaagtatcgtgtggagaacctgtacgagggaccccttgatgatatctatgctactgccatcaggaactgtgatccggagggtcctctcatgctgtatgtttcaaagatgattccagcttctgacaaagggcggttctttgccttcggtcgtgtcttctccgggaaggttgctaccggtatgaaggttcggatcatgggtcccaactatgtgcctggccagaagaaggatctgtatgtcaagagtgtccaacgcactgttatctggatgggaaagaaacaagagtctgttgaggatgttccctgtggtaacaccgttgctatggtcggtctggatcagttcatcacgaagaatgccacactcaccaatgagaaggaagttgatgcatgcccaatcagagcaatgaagttctcagtgtctcctgttgtgcgtgttgctgttcagtgcaaggttgcctctgacctcccgaagctagttgaaggtttgaagcgtctggccaagtctgatcctatggtcctctgttccattgaagaatctggtgagcatattattgctggagctggtgagcttcaccttgagatctgcctgaaggatctgcaggaagacttcatgggtggtgctgaaattattgtttcccctcctgttgtctctttccgtgaaactgttcttgagaagtcctgcagaacagtcatgagcaagtctcccaacaagcacaaccgtctttacatggaagcccggccgttggaagagggtcttcctgaggctattgatgagggacgcattggcccacgtgatgatcccaaggtgcgctccaagatcctctctgaggagtttgggtgggacaaggatctggccaagaagatttggtgctttggacctgagaccacaggcccaaacatggtcgtcgatatgtgcaagggagtacagtatctcaatgaaatcaaggattcggttgtggctggtttccagtgggcctcaaaggagggagcacttgctgaggagaacatgcgtggcatttgctttgaggtctgtgatgttgttcttcatgctgatgccattcacaggggtggtggccaggtcattccaactgccaggagggtcatctatgcttctcagctcactgccaagccaaggctgctggagccagtgtaccttgtggagatccaggctcctgagaatgctcttggtggtatctatggtgttctgaaccagaagagagggcacgtgtttgaggagatgcagaggccgggtaccccgctctacaacatcaaggcttacctccctgtcatcgagtcctttgggttctccagccaactgagggccgcaacctctggtcaggcgttccctcagtgtgtgtttgaccactgggacatgatgggctctgatcctttggaggctggctcccaggctgctcagctggtgttggacatccgcaagaggaagggtctcaaggaacagatgaccccgctttccgagttcgaggacaagctctaaatttttggccttctgtggtactgttaccctctgctggtttaatcacccgttgtgactactgtagtgggaactacttttgattttctttagtggtccaatgcttctgtttctgaacatcattagccatatggtagtgtcctgcaaaaactactttgttatccatcgtgatgtaacagatgaaacagagttggtatttgtggttt

SEQ ID NO: 32134 - protein, 843 aa, Panicum virgatum
  misc_feature: Ceres CLONE 1909257
  misc_feature (17)..(342): Pfam Name: GTP_EFTU Pfam Description: Elongation factor Tu GTP binding domain
  misc_feature (605)..(722): Pfam Name: EFG_IV Pfam Description: Elongation factor G, domain IV
  misc_feature (724)..(812): Pfam Name: EFG_C Pfam Description: Elongation factor G C-terminus
  misc_feature (391)..(468): Pfam Name: GTP_EFTU_D2 Pfam Description: Elongation factor Tu domain 2
MVKFTAEELRAIMDKKNNIRNMSVIAHVDHGKSTLTDSLVAAAGIIAQEVAGDVRMTDTRADEAKRGITIKSTGISLYYEMTPESLKNYKGERDGNQYLINLIDSPGHVDFSSEVTAALRITDGALVVVDCIEGVCVQTETVLRQALGERIRPVLTVNKMDRCFLELQVEGEEAYQTFSRVIENANVIMATYEDKLLGDVQVYPEKGTVAFSAGLHGWAFTLTNFAKMYASKFGVDETKMMERLWGENFFDPATKKWTTKNTGSATCKRGFVQFCYEPIKQIINTCMNDQKDKLWPMLQKLNVTMKADEKELVGKALMKRVMQTWLPASTALLEMMIFHLPSPSKAQKYRVENLYEGPLDDIYATAIRNCDPEGPLMLYVSKMIPASDKGRFFAFGRVFSGKVATGMKVRIMGPNYVPGQKKDLYVKSVQRTVIWMGKKQESVEDVPCGNTVAMVGLDQFITKNATLTNEKEVDACPIRAMKFSVSPVVRVAVQCKVASDLPKLVEGLKRLAKSDPMVLCSIEESGEHIIAGAGELHLEICLKDLQEDFMGGAEIIVSPPVVSFRETVLEKSCRTVMSKSPNKHNRLYMEARPLEEGLPEAIDEGRIGPRDDPKVRSKILSEEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPENALGGIYGVLNQKRGHVFEEMQRPGTPLYNIKAYLPVIESFGFSSQLRAATSGQAFPQCVFDHWDMMGSDPLEAGSQAAQLVLDIRKRKGLKEQMTPLSEFEDKL

SEQ ID NO: 32135 - DNA, 668 bp, Panicum virgatum
  misc_feature: Ceres CLONE 1909299
  misc_feature: Encodes the peptide sequence at SEQ ID NO. 32136
tccccgtcggtcctctgcccacattctctcttctctccccgtgacccatccagtccacccgtcgccaccggaggagcggcggcggcggtggccgaggaggaggagggggaggtattgacgagcggcccgactctggatggccaggaacccgtctggactgcgatcagctgaacgagagtgtccagagggtgcagtacgcggtgcgcggggagctctacctccgcgcctccgagctccgcacggagggcaagaagatcctcttcacctgcgtcggctacccgcacgccctcggacagaaccctctcaccttcccccgcccggtggtggctctctgccctgctccgttcctgctctatgatcccaacgtcggtctcttgttgccggcggatgccatcgcgcgggccttgctcttcctctccctggcgcccggcggtttatgtgcttacagtgattcccgtgctatccctggaattatgaaggaggttgctgacttcgtccagaggcgtgatggatatccgactgatccagacctcatttacttgactgatggtgctagccaaggtgtgatgcagatgttgatcgccattatcacaaacgagagatatgggattttggtccttgtgtctcaatacccattttattccactgccatttccctctttggtgac

SEQ ID NO: 32136 - protein, 64 aa, Panicum virgatum
  misc_feature: Ceres CLONE 1909299
  misc_feature: SWISSPROT Homolog: EC 2.6.1.2 Alanine transaminase
  misc_feature: Useful for making plants with modulated nitrogen use efficiency
MKEVADFVQRRDGYPTDPDLIYLTDGASQGVMQMLIAIITNERYGILVLVSQYPFYSTAISLFG

SEQ ID NO: 32137 - DNA, 707 bp, Panicum virgatum
  misc_feature: Ceres CLONE 1909304
  misc_feature: Encodes the peptide sequence at SEQ ID NO. 32138
gaaacctgaattcacgctcaccacctgatccccatggcctccggcgagggtgccggcgatccgcgggccgcggccgccagcggtgaggcagaggccaagatggagacgggggagcaggaggggccggtgctgtgcctcgacctgacgagctaccagctgcacgatctgagcgaggtggagatcccgcccacgctggaggaggtcgacctcaccgccaaccgcctctcttccgtcgacccgcgcatcggccgactcgccggcctccgcaagctctccttccgccagaacctcctcgacgatgccgccgtggcgccgctctcgtcctgggatgcaatcgccggattgcaggagttggtccttagagataacaaacttacaaggattcctgatgccaccatcttcaaaggtctcctgattttcgatgtatcattcaatgagatatcttccttgactgggctgtccaaggtttccagcacattgaaggaactttatgtttcaaaaaatgaagtggcaaagatggaagaacttgaacacttccatgcattggaaattcttgaacttggcagcaacagattaagggtgatggaaaatcttgaaagcttgacaaatctacaagagctatggctgggaagaaatcgaattcgaactgtaaacttgtgtggtttgaaactgatcaagaaaataagtttgcaaagcaacagattaac

SEQ ID NO: 32138 - protein, 224 aa, Panicum virgatum
  misc_feature: Ceres CLONE 1909304
  misc_feature: SWISSPROT Homolog: EC 4.6.1.1 Adenylate cyclase
MASGEGAGDPRAAAASGEAEAKMETGEQEGPVLCLDLTSYQLHDLSEVEIPPTLEEVDLTANRLSSVDPRIGRLAGLRKLSFRQNLLDDAAVAPLSSWDAIAGLQELVLRDNKLTRIPDATIFKGLLIFDVSFNEISSLTGLSKVSSTLKELYVSKNEVAKMEELEHFHALEILELGSNRLRVMENLESLTNLQELWLGRNRIRTVNLCGLKLIKKISLQSNRL

SEQ ID NO: 32139 - DNA, 704 bp, Panicum virgatum
  misc_feature: Ceres CLONE 1909324
  misc_feature: Encodes the peptide sequence at SEQ ID NO. 32140
cttcaatatggtaaggatgataatgctatgcctcaacatactacaagcatgcaacgtgtaaggtcagctattgtctttccgtctgcattttgtgtaatgccggtccttacaaaattcaatttattacgtgtcctgaacttacaagattgtgatatttcacgaggttacagcctcgagtaccttgagaatttattttacttgaggtacctaggattatgtggcacacacatttctcagcttcctgaagaaataggaaacctagaatttctacaaactttggatgtgaggggcaacaatatgtttagcttgccgtcaactattgttcagctcacaaacttgatgtgcctgtacattgatgagtttacaagagtgccaaatgggattgggagcctaacaaatcttgaagtgctgtcaactttagacattactgtctccatggacattatagaagagttgggccagctaatggaactgagggtgcttcatattttgctgttcattggctggagtgggaagctggtggagtgcctatgcaagctgcaaaatatcgaatatctatacatcaagatctttggagatcatcaatcagacttttgtggattggatgcctgggttgcccctagacatctctatagattggatatagaatggccatgctggttctcaacactgccagcatggatgaatcagtcttatctactgga

SEQ ID NO: 32140 - protein, 234 aa, Panicum virgatum
  misc_feature: Ceres CLONE 1909324
  misc_feature: SWISSPROT Homolog: EC 2.7.11.1 Non-specific serine/threonine protein kinase
LQYGKDDNAMPQHTTSMQRVRSAIVFPSAFCVMPVLTKFNLLRVLNLQDCDISRGYSLEYLENLFYLRYLGLCGTHISQLPEEIGNLEFLQTLDVRGNNMFSLPSTIVQLTNLMCLYIDEFTRVPNGIGSLTNLEVLSTLDITVSMDIIEELGQLMELRVLHILLFIGWSGKLVECLCKLQNIEYLYIKIFGDHQSDFCGLDAWVAPRHLYRLDIEWPCWFSTLPAWMNQSYLL

SEQ ID NO: 32141 - DNA, 699 bp, Panicum virgatum
  misc_feature: Ceres CLONE 1909329
  misc_feature: Encodes the peptide sequence at SEQ ID NO. 32142
gcgtcgtcgtcgaaaccctttgcccctcccaaatcgcggaaaccctagcccccaaatcatacagcagcagcagcagcagctgatactgaaccctatcctctcgccgaggcctcgactccctcccccacccaaaaacccagaccccccccctctaatccgattctttctttgcagccaccgccgctccaatcccccttacttccccagcgccgctcgctagatccattcatgatgggagagaccaaggagaacgacgtatacgaggaggagctcctggactacgaggaggacgacgacaagacagtcgatggctccgccgccaagcccaccggagaggtcgcgaagaagggctacgtcggcatccacagttccgggttcagagacttcctcctcaagccagaactgcttcgtgctatccaggactgcggttttgagcatccatccgaagtgcaacacgagtgcatccctcaagcaattcttgggatggatgtcatatgtcaagcaaaatctgggatggggaagactgcagtttttgtcctatcatccctccaacagattgatcctgttgcgggtcaggtagcagcacttgtattgtgccacacaagggaactcgcctaccagatctgccatgagtttgagaggttcagcaaatatctgcctgaagttaaagttgctgtcttctatggaggagttcacatc

SEQ ID NO: 32142 - protein, 156 aa, Panicum virgatum
  misc_feature: Ceres CLONE 1909329
  misc_feature: Useful for biocontainment applications
  misc_feature: Useful for making plants with modulated biomass
  misc_feature: Useful for making plants with modulated cold sensitivity
MMGETKENDVYEEELLDYEEDDDKTVDGSAAKPTGEVAKKGYVGIHSSGFRDFLLKPELLRAIQDCGFEHPSEVQHECIPQAILGMDVICQAKSGMGKTAVFVLSSLQQIDPVAGQVAALVLCHTRELAYQICHEFERFSKYLPEVKVAVFYGGVH

SEQ ID NO: 32143 - DNA, 739 bp, Panicum virgatum
  misc_feature: Ceres CLONE 1909331
  misc_feature: Encodes the peptide sequence at SEQ ID NO. 32144
cccgtctgctctctctctctcttttcgtccgtcgcctgctgctgcttccccgtccggcggtttcattcgcgatcgttgcttctccgatccatcacgtattgacatggcggcggaggccaagcacttcaagtacgtcatcctcggcggcggcgtcgcggcggggtacgcggcgagggagttcggcaagcagggcgtcaaccccggcgacctcgccatcatctccaaggaacccgtggccccgtacgagcgccccgcactcagcaagggatacctcttccctcagaatgccgcaagactgcctgggttccacacgtgtgtggggagcggcggagagaggctacttcctgaatggtactcagagaaaggcattgagctgatcctgagcactgagattgtgaaggctgaccttgcctccaagaccctaacaagtgcagctggggcaaactttacatatgagaccttgctcattgctactggctcctcggtcataaagctcacggactttggcgttcagggagcagaatccaacaacatattgtatctaagggatattgccgatgcggacaagttggtcgcagctatgcaagcaaagaaggatggaaaggctgtgattgttggaggtggttacatagggcttgagcttagtgcagccttgaaaatgaacaactttgatgtcactatggtgtaccctgaaccctggtgcatgccccgtctcttcacctccggtatcgctcatttc

SEQ ID NO: 32144 - protein, 211 aa, Panicum virgatum
  misc_feature: Ceres CLONE 1909331
  misc_feature (9)..(196): Pfam Name: Pyr_redox_2 Pfam Description: Pyridine nucleotide-disulphide oxidoreductase
  misc_feature: SWISSPROT Homolog: EC 1.6.5.4 Monodehydroascorbate reductase (NADH)
MAAEAKHFKYVILGGGVAAGYAAREFGKQGVNPGDLAIISKEPVAPYERPALSKGYLFPQNAARLPGFHTCVGSGGERLLPEWYSEKGIELILSTEIVKADLASKTLTSAAGANFTYETLLIATGSSVIKLTDFGVQGAESNNILYLRDIADADKLVAAMQAKKDGKAVIVGGGYIGLELSAALKMNNFDVTMVYPEPWCMPRLFTSGIAH

SEQ ID NO: 32145 - DNA, 405 bp, Panicum virgatum
  misc_feature: Ceres CLONE 1909337
  misc_feature: Encodes the peptide sequence at SEQ ID NO. 32146
aactcgcctcctcgtcttagctcagcccatcgccctcagcggaagcaggacttgatggctgcgcccgctcctctgctcgtcgtcctcctcggcctgacattattgccactgctcttcttccccggtgcagaagcgggcgaggtgggcgtgtgctgggggactgtggcggacaacctgccgagcccagcggcggtggtgcagctgctgaagcggcaaagcatcacgatggtgaggatctacgacaccgaccgtggggtgatcagagctctggccaacaccggcatcaagctcatggtgtcgctgcccaacgagcagctggcctccgcggcctccagcccgccgttcgcgcgccagtgggtgcaagaaaacctgggggcctttttaccccaccaagcggatcaaccg

SEQ ID NO: 32146 - protein, 116 aa, Panicum virgatum
  misc_feature: Ceres CLONE 1909337
  misc_feature: SWISSPROT Homolog: EC 3.2.1.39 Glucan endo-1,3-beta-D-glucosidase
  misc_feature: Useful for making plants with altered carbohydrate content
MAAPAPLLVVLLGLTLLPLLFFPGAEAGEVGVCWGTVADNLPSPAAVVQLLKRQSITMVRIYDTDRGVIRALANTGIKLMVSLPNEQLASAASSPPFARQWVQENLGAFLPHQADQ

SEQ ID NO: 32147 - DNA, 1647 bp, Panicum virgatum
  misc_feature: Ceres CLONE 1909343
  misc_feature: Encodes the peptide sequence at SEQ ID NO. 32148
atcgcgagcccagagctcggcctccttcgacacggcgcggcagcactctgaatggcctgactctgagtctctcaccactccggtcctccgtcccagtcgcctcgctcctgaagtcgctaggtagacacgggcgacgagagggtttcgaattggcgccaaccattccccacaatcccgccttccagcactagggtttccagccactgccatggcgggagccaccgccgccactcccatggacatcgacgccgccgcgccgcccccttcgccggccggggcggcggcgaagggcaaggcgccgctcagtgcccccgggagggccgcgccctgggtcgagaagtaccggccccagtccctcaccgacgtcgccgcccaccgcgacatcgtcgacaccatcgacaggctcaccaatgagaatagacttccacatttgttgctatatgggccacctggcactgggaaaacatcgacgatactggcagttgcaaggaagctatatgggtctcagtatagcaacatgattctggaactcaatgcatcagatgaacgtggtattaatgttgtaaggcagcagatccaggattttgctggagcacgcagcctctcttttggggcaaggccttctgttaagttggtcctcttggatgaagcagacgcaatgactaaggatgcacaatttgcattgcgaagagtcattgaaaagtatacaaggagcacaaggtttgcactcatatgcaaccatgtcaacaaaattatccctgcactacaatcaaggtgcactaggtttagatttgctccgcttgatggcagtcatgttagagagcgtcttcagcatataataaaatctgaggggctcagtgtagatgagggtggcttgacagccctagtgcggttaagcaatggtgatatgaggaaggctttgaatatattgcagtcaacacacatggcatcccaacaaatcacagaagaagctgtctatctttgcacaggaaaccccatgccaaaagatattgaggagatagcattttggctactaaacgagccattttcaaccagcttcaaatatatatctgacatgaagatgagaaaagggctggccttggttgatatcatacgggaggttactatgtttgtattcaaaatacaaatgccatctgatgttcgtgtaaaactgattaatgacctggctgatattgagtacaggctaagctttgcgtgcaatgacaagctgcagctgggcgcaatgatatcaactttcaccaatgctcgcacggctacggttgctgctgccagctaatgcagtaatgagatggatctttttgttgccctttgctgccctcactggaacctggagatgaagcacagctacctttgtgggtgaccaatctagtctgtagttatcaagctgtgggtgtctttgtctgtagttagcaagctgtgggtcacgtcttgtctgtagttagcaagctgaaaagggtgagggtttttcttagatctgtatgctgccaggatgcgatgtcctggaacttgagagtctcccatgactgaatgctgtcaggcgttgttgagctatgatgcatgtaagattttatccagtagtgaagtaactataaccaaacctcctcattgataaagtatgtgaaattg

SEQ ID NO: 32148 - protein, 353 aa, Panicum virgatum
  misc_feature: Ceres CLONE 1909343
  misc_feature (252)..(341): Pfam Name: Rep_fac_C Pfam Description: Replication factor C
  misc_feature (65)..(238): Pfam Name: AAA Pfam Description: ATPase family associated with various cellular activities (AAA)
  misc_feature: SWISSPROT Homolog: EC 2.7.7.7 DNA-directed DNA polymerase
MDIDAAAPPPSPAGAAAKGKAPLSAPGRAAPWVEKYRPQSLTDVAAHRDIVDTIDRLTNENRLPHLLLYGPPGTGKTSTILAVARKLYGSQYSNMILELNASDERGINVVRQQIQDFAGARSLSFGARPSVKLVLLDEADAMTKDAQFALRRVIEKYTRSTRFALICNHVNKIIPALQSRCTRFRFAPLDGSHVRERLQHIIKSEGLSVDEGGLTALVRLSNGDMRKALNILQSTHMASQQITEEAVYLCTGNPMPKDIEEIAFWLLNEPFSTSFKYISDMKMRKGLALVDIIREVTMFVFKIQMPSDVRVKLINDLADIEYRLSFACNDKLQLGAMISTFTNARTATVAAAS

SEQ ID NO: 32149 - DNA, 2138 bp, Panicum virgatum
  misc_feature: Ceres CLONE 1909354
  misc_feature: Encodes the peptide sequence at SEQ ID NO. 32150
agccatcatcgccaccaccgagcgcactgcgcacccacggcccgacggcgacgacacgcccggatcggagcagacgccggtgagcgagcggccgccggacagatatacagtgcggcgcggcatgggggtgaccacggccggggaggcggtcaagtccccggtgcgggcgtctggcgtcgtcaagctcaacgcggcgttcctcgccctgttcctcctcgcgtacatggcgctcctcctccaccccaggtactcgtacctcctcgaccgcggcgccacctccctcgtccgctgcaccttcagcgacgacgcctgcccgccatcgatgacccagctctcacggaagctgggaggaggcgtgcgcggcgaacaaggtggcggcggagcggatcgtgaacgcggggcgcgcgccggccatgttcgacgagctccggggccggctgcggatgggcctggtgaacatccgccgcgaggacgtgctggcgctgggcgtggagggcgaggcgatgcgcgtggacctggagcgcgtctccgacgtgttccggtggtcggacctgttcccggagtggatcgacgaggaggaggacgacgaggggccgtcctgcccggagctccccatgcctgacctgtcccggatcgacggcgaggtggacgtggtggtggcgtccctgccgtgcaaccgcaccgcgcccggcgggtggaaccgcgacgtgttcaggctgcaggtgcacctggcggcggcgcgggtggcggcgcgcaagggccggcgcgacggcggcggggccgtgcgcgtcgtgctgcggagcgagtgcgagccgatgatggacctgttccggtgcgacgaggcggtgggccgggagggggactggtggatgtacagggtcaacgtggagcgcctcgaggagaagctccggctgcccgtcgggtcctgcaacctcgcgctgccgctctggggatcaggaggcatccacgaggtgttcaacgtgtcgtcggagccgccgacgacgacggggcgccgcccccgtcgcgaggcgtacgcgacggtgctgcactcgtcggacacgtacctgtgcggcgcgatcgtgctggcgcagagcatccggcggtcgggctccacccgcgacctggtcctcctccacgaccacacggtgtccaagccggcgctccgggcgctgtcggcggcggggtggaccccgcgcaggatcaagcgcatccgcaacccgcgcgcggcgcggggctcctacaacgagtacaactacagcaagttccggctgtggcagctgaccgagtacgaccgcgtggtgttcgtggacgccgacatcctggtgctccgcaacctggacgcgctgttcgggttcccgcagctctccgcggtgggcaacgacgggcccctcttcaactcgggcgtgatggtgatcgagccgtcggcgtgcacgttcgaggcgctggtccggaagcggcgcacggtgcggtcgtacaacggcggcgaccaggggttcctgaacgaggtgttcgtgtggtggcaccggctgccgcggcgcgtcaactacctcaagaacttctgggccaacaccaccggggagcgcgcgctcaaggggcgcctgttccgggcggaacccgccgaggtgtgggccatccactacctggggatgaagccgtggacgtgctaccgggactacgactgcaactggaacgtggcggaccagcgggtgtacgccagcgacgaggcgcacgcgcggtggtggcaggtgtacgaccggatgggggagcccatgcgcgggccctgcaggctctcggagcggaggaaggtggagatcgcgtgggacaggcacgtcgcccaggagatgggattcgcggaccagcactggaagatcaacatcaccgacccgcggaaatgggaataatatatatgactgctcaagatcatcggccttgcatcgccttgagcgagaggaagaagctaggccggcgacgcatctgatcgagctcgatcggtagtaggtcgccacattttgattgtattaattcgtgagtttctttttttatttttcctttgttgatgtgcatacatacataagggagaagtacgcatgcaggtcgaactcggatcgattgaataaagaataactcgagttccaggc

SEQ ID NO: 32150 - protein, 495 aa, Panicum virgatum
  misc_feature: Ceres CLONE 1909354
  misc_feature (208)..(419): Pfam Name: Glyco_transf_8 Pfam Description: Glycosyl transferase family 8
  misc_feature: SWISSPROT Homolog: EC 2.4.1.186 Glycogenin glucosyltransferase
  misc_feature: Useful for making plants with altered carbohydrate content
  misc_feature: Useful for making plants with altered cell wall content and/or composition
MFDELRGRLRMGLVNIRREDVLALGVEGEAMRVDLERVSDVFRWSDLFPEWIDEEEDDEGPSCPELPMPDLSRIDGEVDVVVASLPCNRTAPGGWNRDVFRLQVHLAAARVAARKGRRDGGGAVRVVLRSECEPMMDLFRCDEAVGREGDWWMYRVNVERLEEKLRLPVGSCNLALPLWGSGGIHEVFNVSSEPPTTTGRRPRREAYATVLHSSDTYLCGAIVLAQSIRRSGSTRDLVLLHDHTVSKPALRALSAAGWTPRRIKRIRNPRAARGSYNEYNYSKFRLWQLTEYDRVVFVDADILVLRNLDALFGFPQLSAVGNDGPLFNSGVMVIEPSACTFEALVRKRRTVRSYNGGDQGFLNEVFVWWHRLPRRVNYLKNFWANTTGERALKGRLFRAEPAEVWAIHYLGMKPWTCYRDYDCNWNVADQRVYASDEAHARWWQVYDRMGEPMRGPCRLSERRKVEIAWDRHVAQEMGFADQHWKINITDPRKWE

SEQ ID NO: 32151 - DNA, 1441 bp, Panicum virgatum
  misc_feature: Ceres CLONE 1909355
  misc_feature: Encodes the peptide sequence at SEQ ID NO. 32152
atatctatcactcccaagctgcaatttcacactgcaatagctaggaatcaaaatatagagccttgcagcccttgctctcgcctaagttgtctagctagctagttttgaaggagggggttgagcccgagtggttcctagagccccctcccacgccggcagcccgggttcgatccccggggccggcaccggggggcacctatgcagccctcctactgaaaaaaaaagctagctagttttgagtagcgtcgttgttatacttgctactacctagagctagctaacaatggccgccgcacctgcacgcaccttctccgtgcgctccgtggagcctcttcccgtttcagcttcgctggcggcaaccagaaacaacgaccagcgaggccgcccccgtggccgttccatcatcgcttcggcggcggcgtcgaaaacgctgctgcccagtgattttgacctccagctccaggagggcctgacaagcgtgcaaaagattctgcaggaacgtaggaacagcgcccgggagattatggccaccatcgacaacctcaagcgcctctgcatcgaccactacttccaggaagagatccagagcgccatgggcgcgtgcttgaatctcatccacagcgatgatctcttcgatgcgacacttgcattcaagctcgtgagagaggccggccatgatgtttcagcagatgatgttctacggaggttcactgacgacaccggcgagttcaagcttgctcttagcaaagacatcagagggctcctgagcctccacgacatgtcacacctggacatgggagaggagccatcactgcacaaggcaaaggagttctcaagcaagcaccttgcatctgccatcaggtacctggagccaggcctcgcaaggtacgtgaggcagtccctcgaccacccctaccacctgagcctgatgcagtacaaggccaggcaccacctcagctacctgcagagcctgcccactagggacactgcaatggaggggctagcaattgcagagttccagctcagcaaacagctgcatcaggaagaaatgcaggaggttaaaagatggtggatggatcttggattgtctcatgagataccagtggtgcgggaccaggtgcccaaatggtacgtgtgggccatgacaagcctccagggaccctccttgtccggatatcggattgataccacaaagataatctcactcgtctatgttgtggatgacatttttgatcttgttggcacaccggaggagctttccctcttcacccaggcaatcaaaatgtggaatactgcggttgccgattcactccccagtggcatgagatcatgctacaaggctatttacaacaccacgaatgagatcgctgatatggttgaagtggagcatggattcaaccctgtcaatcatctcaggaatgcatgggcggcgctgtttgat

SEQ ID NO: 32152 - protein, 385 aa, Panicum virgatum
  misc_feature: Ceres CLONE 1909355
  misc_feature (51)..(231): Pfam Name: Terpene_synth Pfam Description: Terpene synthase, N-terminal domain
  misc_feature (235)..(385): Pfam Name: Terpene_synth_C Pfam Description: Terpene synthase family, metal binding domain
  misc_feature: SWISSPROT Homolog: EC 4.2.3.13 (+)-delta-cadinene synthase
MAAAPARTFSVRSVEPLPVSASLAATRNNDQRGRPRGRSIIASAAASKTLLPSDFDLQLQEGLTSVQKILQERRNSAREIMATIDNLKRLCIDHYFQEEIQSAMGACLNLIHSDDLFDATLAFKLVREAGHDVSADDVLRRFTDDTGEFKLALSKDIRGLLSLHDMSHLDMGEEPSLHKAKEFSSKHLASAIRYLEPGLARYVRQSLDHPYHLSLMQYKARHHLSYLQSLPTRDTAMEGLAIAEFQLSKQLHQEEMQEVKRWWMDLGLSHEIPVVRDQVPKWYVWAMTSLQGPSLSGYRIDTTKIISLVYVVDDIFDLVGTPEELSLFTQAIKMWNTAVADSLPSGMRSCYKAIYNTTNEIADMVEVEHGFNPVNHLRNAWAALF

SEQ ID NO: 32153 - DNA, 723 bp, Panicum virgatum
  misc_feature: Ceres CLONE 1909355-R
aaccccccacctcccccctcaagctgacgtgaactcattgttcatggcagctgagtgaggtgaggggagacgaatttttgctttttttttgaaaaaaggttagttatttttctttataacttatcaattaatttttagaaacagttattacttgatttagtttatacatgtgataattatttttatttgtagcatcttattgtagttatatgcgttatcaatttatttgatatttgaatactatcaaattattgtatttatatgttttatcaatttatttgataagtgaatagtatctatttattatagttatatgcattatcaattatataaatatattgttataaattggtagtatgaatgaactatttgtacagtataatgatgtatataaatgtattgtggacccagatgagtcggcaatggatgtacatggccgaccggcgttcaaaggagttcatggatggcgtgcatgaattcatagaagcggccgagaaacacaagtatggcggtttcgttcgttgtccatgcaaattctgtaagaatgagaaggattactcatcatcaataaccatctatagtcacttgttcaatagtggtttcatgccgaactactatgtttggaccaagcatggcggaagaggaattgtgctggataataatgtagaagaagaggacatgattcctgactttgcaaacaattataattcctttttcaatgac

SEQ ID NO: 32154 - DNA, 1365 bp, Panicum virgatum
  misc_feature: Ceres CLONE 1909388
  misc_feature: Encodes the peptide sequence at SEQ ID NO. 32155
aatctcatatcctctcatcgttcggagcgcacaacccccgttccaaatccaaatcgctcttctcgtgaccctcggcgatccttcccccgtttcaaggtacggagatccgctcccccatcctctcgccccctctcctcctctagattggcgtggtttggtagttctgcttggtctgtggctaggaactgggccgaggcgttcatgctagatccgcgtgttccctgatccttgatggctgggaggtggggttttcgtgtagatctgataggttctgctgtttatcttgtagtgctccttcgatttgtggggattttaggtcgttgatctgggaatcgtagggttgcttctaggttgttcgtagatgaggtcgttctcacgatctgctggatcgctgcctaggtttagctaggtctgctgtttatcttgtcgtgctcctgcgatttgtggggattttaggtcgttgatctgggaatggtggggttgcttatagattgttcgtagatgaggtcgttctcacgatctgctgggtcgctgcataggtttagtggtgctagctaggattaaacatctgattcctccgatcgattattttgttcgcatgtgtaaggtttggtcgttgtctgattgctgtagatcagagtagaaataaggtcgtcacgctcctggcttattttgaatctgcatgtgtggcatgattaagatgattacgcagtttctatatgtttgaatatgatgcagtaacttttaactgagttacacacgtttcatgttgtttaattatattgcatggtagatgaggatatatactgctacatgagtttgatgattctctggtacctcatgatcagctagctcatgtgcttaaattgaaattgcatgtgaattgcatgtgccacatgattaagatgctaagattggtgaagatatatgctgttgttcctataggatcctgtagcttttacctggtcaacatgcatcatcctgttatggatctctatgcatgatagatcaagatatgtacggccaatttgatgattcttttgtacacctgatgattatgcatgctgtttgcccttaatttgatatacttggacgatgccatgcttagtactaatgaagtgatgaacacacgtggcctattggtatctgattgaatatgctgttgctgtttgcttgagatggttctgtttgtttaataggtacttatcctgttctctggctatcttctgcagatgcagatctttgtgaagaccttgaccggcaagactatcaccctcgaggtggagtcctccgacaccattgataacgtcaaggcaaagatccaggacaaggagggcatccccccgaccagcagaggcttatctt

SEQ ID NO: 32155 - protein, 44 aa, Panicum virgatum
  misc_feature: Ceres CLONE 1909388
  misc_feature: Useful for making plants with modulated nitrogen use efficiency
  misc_feature: Useful for making plants with modulated cold sensitivity
  misc_feature: Useful for making plants with modulated flowering time
MQIFVKTLTGKTITLEVESSDTIDNVKAKIQDKEGIPPTSRGLS

SEQ ID NO: 32156 - DNA, 703 bp, Panicum virgatum
  misc_feature: Ceres CLONE 1909388-R
  misc_feature: Encodes the peptide sequence at SEQ ID NO. 32157
acaacatccagaaggagagcaccctccacctggtgctccgcctgaggggaggcatgcagatcttcgtgaagaccttgaccggcaagactatcaccctcgaggtggagtcctccgacaccattgacaacgtcaaggcaaagatccaggacaaggagggcatccccccggaccagcagaggcttatcttcgctggcaagcagctggaggatggccgcacccttgcggactacaacatccagaaggagagcaccctccacctggtgctccgcctgaggggagggatgcagatctttgtgaagaccttgactggcaagactatcactcttgaggttgagagctccgacaccattgacaacgtgaaggccaagatccaggacaaggagggcatccccccggaccagcagcgtctgatcttcgccggcaagcagctggaggatggccgcactcttgcggactacaatatccagaaggagtccactctccacctggtgcttcgtctccgtggtggccagtaagccatcggtcgtctaagctgctgctgtacctgggtctcctggtctctgccatgaagggtgtcgtcttttaagtatctgtgtcatttgacgtcgaatttgtgtatggtttcatgaactggttgtctacctaaaacagttattgcagtgcagcagtatggcttaagcatgaataaatgatgtttgaactt

SEQ ID NO: 32157 - protein, 170 aa, Panicum virgatum
  misc_feature: Ceres CLONE 1909388-R
  misc_feature (23)..(91): Pfam Name: ubiquitin Pfam Description: Ubiquitin family
  misc_feature (99)..(167): Pfam Name: ubiquitin Pfam Description: Ubiquitin family
  misc_feature: Useful for making plants with modulated nitrogen use efficiency
  misc_feature: Useful for making plants with modulated cold sensitivity
  misc_feature: Useful for making plants with modulated flowering time
NIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 32158 - DNA, 695 bp, Panicum virgatum
  misc_feature: Ceres CLONE 1909408
  misc_feature: Encodes the peptide sequence at SEQ ID NO. 32159
aaaaaggacggaaacactcattcggttcaatcgatcactcgggtgaacctgatcccaggggcagcctgctgcaaagccctacctagttcgctcgctcgctcctggaggtggaagctagctagtattcttgagcaaaaaaagctaaaacaatggcctctgctaccctgctcaattcctccttccttcccaaaaagtccaaagggggcgccagcaggcaggtccccgcgcccaggccggtcaccgtgtccttggccgccgtcccccccaccgcctaccccaataacctcgtcaaaacggcaaaaacgggggcgtcgccggggcggggcttcctggccttgaacaattcaaacgcaacgtgcggaaagcggctggcgtccttcgggttgaaaaacacggaggcaaaccggcaggcgtaccgaaccctgctggtgaccgcgccggggctcgggcagtacttctcgggcaccttcctcttcaaggaaaccctgtaccagtcggccgtgaacgggcgcaaaatcttgaacttcctggcgaagcagggcatcttgcccggaatcaaggtcaacaagggcctcgtcccgctcgccggctccaacaacaagtcgggttgccaggggttcgacggcctcgccgcccgcaaggccgcctactaccaggcggacgcccgcttcgccaagtggcgcaccgtggtcagc

SEQ ID NO: 32159 - protein, 181 aa, Panicum virgatum
  misc_feature: Ceres CLONE 1909408
  misc_feature (45)..(181): Pfam Name: Glycolytic Pfam Description: Fructose-bisphosphate aldolase class-I
  misc_feature: SWISSPROT Homolog: EC 4.1.2.13 Fructose-bisphosphate aldolase
  misc_feature: Useful for making plants with modulated biomass
MASATLLNSSFLPKKSKGGASRQVPAPRPVTVSLAAVPPTAYPNNLVKTAKTGASPGRGFLALNNSNATCGKRLASFGLKNTEANRQAYRTLLVTAPGLGQYFSGTFLFKETLYQSAVNGRKILNFLAKQGILPGIKVNKGLVPLAGSNNKSGCQGFDGLAARKAAYYQADARFAKWRTVV

SEQ ID NO: 32160 - DNA, 368 bp, Panicum virgatum
  misc_feature: Ceres CLONE 1909426
  misc_feature: Encodes the peptide sequence at SEQ ID NO. 32161
aaggaccgggcgcgcctgctctaccgtcgggcgctcgaggggcctctcaactgggccggccaccgccacctcttctaccaggatgcgtcggatctcagggacaagttcgaggcccaccgacctgtggataaactggacccaaccgctaggatcatctgggatgcggaggctcagtacaggaatttcgaccaccccgatccctacctcgttccatggccacgtggcggcactaaattcgcaagaaaccctcctccacctcaaggcattgacattgtctagaattatggcaaggaggactagaagacaaaaatcatgctggtggggacagaactcggcacacccggagatctaaatcacttcttgattga

SEQ ID NO: 32161 - protein, 92 aa, Panicum virgatum
  misc_feature: Ceres CLONE 1909426
  misc_feature (1)..(64): Pfam Name: Complex1_LYR Pfam Description: Complex 1 protein (LYR family)
KDRARLLYRRALEGPLNWAGHRHLFYQDASDLRDKFEAHRPVDKLDPTARIIWDAEAQYRNFDHPDPYLVPWPRGGTKFARNPPPPQGIDIV

SEQ ID NO: 32162 - DNA, 729 bp, Panicum virgatum
  misc_feature: Ceres CLONE 1909428
  misc_feature: Encodes the peptide sequence at SEQ ID NO. 32163
acctcaccctcccactctccctcactctactctttccatccagcgcgagaggcaggtcggcagcagagcgagagcgcgtgccagcccatggcgagcaccaacatggcgtcggccacctcgcggttcatgctggccgcgggcgtgcccgcggcgggcagcggccgcgtcggcttcgcgtcggtgcccggcaggccgcagggcaggaggctcgtggtgcgcgccgtggccaccaagcctaaggccgagaagccgccgccgatcgggcccaagaggggcgccaaggtcaagatcctgaggagggagtcctactggtacaacgggattggcaacgtcgtcacagttgatcaggaccccaacacccgctacccggtggtggtgcggttcaacaaggtgaactacgccggcgtatccaccaacaactacgccttggacgagatccaggaggtgaaatgagcagcgaggctggctggctggctgtgaaatgagggtcacaacatcttgtgtgtaatagcttaatttctgtaatcattatgtaactgcttgcttgcttcaccgtggacacaataatctcctgcacttaaaaacacggcgtctttgtgtgagcacaccgcgcggcgagcgaagaaagggggaagaagcagccaacgagctttttgcttttgggtttctcatccgagcagcggcggcggcgtcggcgaagagagaagagcgggggcggcatggctgagc

SEQ ID NO: 32163 - protein, 121 aa, Panicum virgatum
  misc_feature: Ceres CLONE 1909428
  misc_feature (60)..(121): Pfam Name: PSI_PsaE Pfam Description: Photosystem I reaction centre subunit IV / PsaE
MASTNMASATSRFMLAAGVPAAGSGRVGFASVPGRPQGRRLVVRAVATKPKAEKPPPIGPKRGAKVKILRRESYWYNGIGNVVTVDQDPNTRYPVVVRFNKVNYAGVSTNNYALDEIQEVK

SEQ ID NO: 32164 - DNA, 1355 bp, Panicum virgatum
  misc_feature: Ceres CLONE 1909438
  misc_feature: Encodes the peptide sequence at SEQ ID NO. 32165
gctatttacctcccctgccactaccactcccctccctggtcttggtctaccccaccagctagccgcgacgcgttcccgcggcagccggtcgccacgccatggccggcgacggcggggccgccgcggagagggtggcggcggccgtggaggcggcggcggcgggcggctgggagttccggaacgcgtaccggcgccagctcctggcgctgtcgcgccggattcggctcctcggtcccttcgcggaggagctccgggaggcgcgccggggccccacggacgcggggaaggagcgggagcgggagcgggcgctggcgccgctcgccgacgcgctggagaaggcgctcgacctgctccggctcggccgcgacgggagcaggatcttcctggtccttgagagggataatgtactgaagaagtttcaaggagtaattgctcagctagagcaagctttgtgtgattttccatacgataaattggatatatcagatgaagttagagagcaggttgagttagtgcatgcacagctcagaagagcaaaagaacgggcagacatgcctgatgatgagttctacaatgacgtactgtctctgtataacaagagctatgacccaagtgctgaactggatatccttgaaagattgtcagaaaagttacacctgatgaccatcactgatctcacacacgaatcgcttgctttgcatgagatggtggcatctggtggtggtcaggatccaggagaacacattgagaaaatgtcaatgctattgaagaagatgaaggactttgtgcaaactcaaaaccctgagatggggccgccaatagttaccaagctaatggattccaacggggagccaaggcctgtaaacattcctgatgagttccggtgtccaatttctcttgagctaatgaaagatcctgttattgttgctactggccagacatatgagcgggcatgcatcgagaagtggctagcttctgggcaccatacttgtccaaatactcagcagaggatgacaaacacaacactgacaccgaactatgttcttagaagtcttattgcccagtggtgcgaggccaacgggattgagccacccaaacgttcatcgcaacctaacaagcctacatcagcatgctcttcgagcgaacgtgctaacatcgatgctcttctgtcccaattatgctctcatgatcctgaggagcagaggtcagctgctgcagaactccggctcctagcaaagcggaatgcaaacaacaggatttgcattgctgaggctggtgccattcccttactactgagtctcttatcttcatctgacctgcggactcaagaacatgctgtgactgcacttctgaac

SEQ ID NO: 32165 - protein, 418 aa, Panicum virgatum
  misc_feature: Ceres CLONE 1909438
  misc_feature (256)..(330): Pfam Name: U-box Pfam Description: U-box domain
  misc_feature (382)..(418): Pfam Name: Arm Pfam Description: Armadillo/beta-catenin-like repeat
MAGDGGAAAERVAAAVEAAAAGGWEFRNAYRRQLLALSRRIRLLGPFAEELREARRGPTDAGKERERERALAPLADALEKALDLLRLGRDGSRIFLVLERDNVLKKFQGVIAQLEQALCDFPYDKLDISDEVREQVELVHAQLRRAKERADMPDDEFYNDVLSLYNKSYDPSAELDILERLSEKLHLMTITDLTHESLALHEMVASGGGQDPGEHIEKMSMLLKKMKDFVQTQNPEMGPPIVTKLMDSNGEPRPVNIPDEFRCPISLELMKDPVIVATGQTYERACIEKWLASGHHTCPNTQQRMTNTTLTPNYVLRSLIAQWCEANGIEPPKRSSQPNKPTSACSSSERANIDALLSQLCSHDPEEQRSAAAELRLLAKRNANNRICIAEAGAIPLLLSLLSSSDLRTQEHAVTALL

SEQ ID NO: 32166 - DNA, 687 bp, Panicum virgatum
  misc_feature: Ceres CLONE 1909438-R
cagttcctgttcttgtggagatgattggaagcgggtcaccaaggaatagagagaatgctgcagctgtgatgttacatctttgcagtggtgagcaacaacttgtgcatttggcccgtgcacaagagtgcagaatcatggtcccgctacgggagctggccctgaatggcacggagaggggaaagagaaaggcggtgctgctgcttgagcgaatgagcagattcctggttcagcaacaagaggaaaaggaagcccagctgctggcatccgcacaggccattcctcggatcgcagaacaggtccaagagaccgacatccctgaacagttggatagtccttcacctcaatatcccatggtcgcatgatgtcgatgaatatatttgcaacaatactgacaaaaggtgggccaagcagtatctgagtcacttggcttctggatccatgattcatatactgaacgagttttttaagctgtcagagtcacttttaattggtgattatcccagacgcttcttcccatgcttgggcgctgaagctcccatcgtgccacctgtttctgggtatgtaaattagcccagaatgttaagatgtgtacagtctagtaaagatgttgctccaaatgtcatgtagcttattactatgtacattttcactatgatactatataaaagagaaattatatcggcggac

SEQ ID NO: 32167 - DNA, 687 bp, Panicum virgatum
  misc_feature: Ceres CLONE 1909441
  misc_feature: Encodes the peptide sequence at SEQ ID NO. 32168
aaaaactgctccgttcctcctcaccaaccaaaccctctccaatggccgcgcccgtgtcgcagccgccggtggccgccagggcgtccacgcggctcctcccggagtccgcgcccgcctccctccgcttctccgtcggccgccgccgccgcgccgctcgcctagaggttaaggcatcaggaaatgtctttgggaaccacttccaggttgcaacctatggcgagtctcatggagggggtgttggttgtgttatcagtggttgcccacccagaattcctctcactgaggcggacatgcaagtagagctcgacagaagacgtccaggtcagagtagaataaccactccgagaaaggagactgatacatgcaaaattctatcagggacacatgaagggatgaccactggcacaccaattcatgtctttgtcccaaacacagatcaaagaggcggagattacagtgaaatggctaaggcatacagaccttcccatgcagatgcaacctatgacttcaagtatggtgttagagctgtgcagggaggtggaagatcatcagccagagaaaccattggcagggtggctgctggagctcttgcaaagaaaattctgaagctcaaatctggagtagagatcttggcatttgtttccaaagtgcatcaagttgtacttccagaagatgcagttgattttg

SEQ ID NO: 32168 - protein, 215 aa, Panicum virgatum
  misc_feature: Ceres CLONE 1909441
  misc_feature (53)..(215): Pfam Name: Chorismate_synt Pfam Description: Chorismate synthase
  misc_feature: SWISSPROT Homolog: EC 4.2.3.5 Chorismate synthase
MAAPVSQPPVAARASTRLLPESAPASLRFSVGRRRRAARLEVKASGNVFGNHFQVATYGESHGGGVGCVISGCPPRIPLTEADMQVELDRRRPGQSRITTPRKETDTCKILSGTHEGMTTGTPIHVFVPNTDQRGGDYSEMAKAYRPSHADATYDFKYGVRAVQGGGRSSARETIGRVAAGALAKKILKLKSGVEILAFVSKVHQVVLPEDAVDF

SEQ ID NO: 32169 - DNA, 698 bp, Panicum virgatum
  misc_feature: Ceres CLONE 1909443
  misc_feature: Encodes the peptide sequence at SEQ ID NO. 32170
ggacagctagcgcgatcgtcatccgcccccgcccccaggctcaactgctcgcggcgaggcaacacccgccccctcttcccctcctcctccgccgccacctcctcgctgacgcgcgcatacgtccacggcacgatcgggccgaccaatcgcgcgcggcggctctggtgggaatggatctcctcgaccagctctgggacgagacggtggccggcccgcgcccggactccggcctcggcaggctccgcaagtacgcctccttctcccactcgtcgtcgtcgtcctcgccggcgcccgcaatgacgcgcagcttcaccatcggcggcccgccatcgctgtccgtcgaccaccagtcgccgcgcggcgagtcgccctacagctcctccgtcccgtcctccccggccagcgcgccggactccccgttcgccgcaggttcgtgccagcctcacgggccgccgcgtctcggtctttcttcttggggggtggaaatcgtttcccttttaggatcgatccctgcggtactgtgcacgccacaattggggattggatctccgatgaaatgggagggggaaaacggatgatttttcccctttttgccgtttcattcatgcctcacaccttcttcagcgtgatgcagtcacagtctcacagatctgccactagtatagttggtaaaacacagcaagaatctggtcatgcat

SEQ ID NO: 32170 - protein, 135 aa, Panicum virgatum
  misc_feature: Ceres CLONE 1909443
  misc_feature (7)..(96): Pfam Name: Auxin_repressed Pfam Description: Dormancy/auxin associated protein
MDLLDQLWDETVAGPRPDSGLGRLRKYASFSHSSSSSSPAPAMTRSFTIGGPPSLSVDHQSPRGESPYSSSVPSSPASAPDSPFAAGSCQPHGPPRLGLSSWGVEIVSLLGSIPAVLCTPQLGIGSPMKWEGENG

SEQ ID NO: 32171 - DNA, 702 bp, Panicum virgatum
  misc_feature: Ceres CLONE 1909445
  misc_feature: Encodes the peptide sequence at SEQ ID NO. 32172
gcaacgcggcctctgccttctccgtcccccgtttccccttcttctccttccccgtctcgctccctcgagctcctcgctctccggcggcctctagaatctgctccggcttagcccagctagctagcagctcgagaccgtggaggcggagggcggcgacccgctggccgaggaggatcccaagatggggcgcggcaagatcgagatcaagcggatcgagaacgccaccaaccgccaagtcacctactccaagcgccgcaccgggatcatgaagaaggcgcgcgagctcaccgtgctctgcgacgcccaggtcgccatcatcatgttctcctccaccggcaagtaccacgagttctgcagccccggaaccgacatcaagacaatctttgaccgctatcagcaggccatcgggaccagcctatgggtcgagcagtatgagaatatgcagcgcacgctgagccatctcaaggacatcaatcgcaacctgcgcacagagattaggcaaaggatgggtgaagatctggacagtctggagttcgacgagctgcgcggtcttgagcaaaatgttgacaccgctctcaaggaggttcgccacaggaagtatcatgtgatcaccacgcagactgaaacctacaagaagaaggtgaagcattcttacgaggcgtacaagaacctgcagcacgagctgggcatgcgcgagggacc

SEQ ID NO: 32172 - protein, 173 aa, Panicum virgatum
  misc_feature: Ceres CLONE 1909445
  misc_feature (71)..(170): Pfam Name: K-box Pfam Description: K-box region
  misc_feature (9)..(59): Pfam Name: SRF-TF Pfam Description: SRF-type transcription factor (DNA-binding and dimerisation domain)
  misc_feature: The sequence is a functional homolog of SEQ ID NO 2 in US patent 7049489
  misc_feature: Useful for making plants with altered lignin content
  misc_feature: The sequence is a functional homolog of SEQ ID NO 1701 in the 10/412,699 US patent application
  misc_feature: The sequence is a functional homolog of SEQ ID NO 1967 in the 10/412,699 US patent application
  misc_feature: The sequence is a functional homolog of SEQ ID NO 1965 in the 10/412,699 US patent application
  misc_feature: The sequence is a functional homolog of SEQ ID NO 1963 in the 10/412,699 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
MGRGKIEIKRIENATNRQVTYSKRRTGIMKKARELTVLCDAQVAIIMFSSTGKYHEFCSPGTDIKTIFDRYQQAIGTSLWVEQYENMQRTLSHLKDINRNLRTEIRQRMGEDLDSLEFDELRGLEQNVDTALKEVRHRKYHVITTQTETYKKKVKHSYEAYKNLQHELGMREG

SEQ ID NO: 32173 - DNA, 751 bp, Panicum virgatum
  misc_feature: Ceres CLONE 1909477
  misc_feature: Encodes the peptide sequence at SEQ ID NO. 32174
aaaacggcagaagcatccctctcgtctcgtctccacgcacccccaaactactccgcaattccccaaccccgaaggcaaggaagcgacgccccctcgcgcacgagcacgacctgaccgcgccgtgccgtctcacggagcccggctgtctagaagcttcgtcgccgcccgcccgcccgcccgctcgcgccgtcgcacgccgccctagggttccgcgggtgggtgcggggggatcgccggagatggactggagcgcggtgacggcggaggacctggtggacgcgctgcgggaggtggactggtccacgccgccgcggcccgccccggagttcttctcccgcttcaccgtcccccgctcctactccaagtggaccagccgcctcaagtgcaacctctactactacaggacaaactatttcatcttgatcatgttcatccttgggatgggcttcctttggaaaccggttgcaatccttgcagcttttatgactggactcagcattgcatttctcaatgacagtttcgcagtcactttcaatgagaaagtcacaaggacagtgagacaattttcaccacatttagctgcaaagatgaggccaccaataacccctgttcttcgtggtcgaccaagctcaaagagatctattcatatttgtgggcgacctcgatgggtgtttgttctattcttttctgcagttagctgtatgctctggttgacctcatgcagtcttctcacagtcctctgggcacttct

SEQ ID NO: 32174 - protein, 170 aa, Panicum virgatum
  misc_feature: Ceres CLONE 1909477
  misc_feature (16)..(170): Pfam Name: PRA1 Pfam Description: PRA1 family protein
MDWSAVTAEDLVDALREVDWSTPPRPAPEFFSRFTVPRSYSKWTSRLKCNLYYYRTNYFILIMFILGMGFLWKPVAILAAFMTGLSIAFLNDSFAVTFNEKVTRTVRQFSPHLAAKMRPPITPVLRGRPSSKRSIHICGRPRWVFVLFFSAVSCMLWLTSCSLLTVLWAL

SEQ ID NO: 32175 - DNA, 647 bp, Panicum virgatum
  misc_feature: Ceres CLONE 1909481
  misc_feature: Encodes the peptide sequence at SEQ ID NO. 32176
aaatccttcttggtgcggccgccgcatttccctagccccttgcgccaccacacaaccacccggccgggagaccatcggcggcggagaagatggtgtcgtcgctcaaactccagaagcgccttgcatcgagcgtcctcaagtgcggcaagggcaaggtctggctcgaccccaatgaggtcagcgagatctccatggccaactcccgccagaacatccggaagttggtcaaggatggtttcatcatcaagaagcctcagaagatccactccaggtcccgtgcaaggagggcacatgaggccaagcagaagggacgtcactctggatatgataagcgcaggggtaccagggaggctaggctccccaccaagattctgtggatgcggaggatgcgtgttcttaagcgcctgctgcgcaagtaccgtgaagccaagaaaattgacaagcacatgtaccatgacatgtacgtgaaggttaagggtaacatgttcaaaaacaagagggtgctcatggagagtatccacaagtccaaggcttagaaggtcagagagaagacactttctgatcagtttgaggccaagcgtgccaagagcaaggcaagccgtgaaaggaagattgccaggagggaggagaggttggcccagggccca

SEQ ID NO: 32176 - protein, 148 aa, Panicum virgatum
  misc_feature: Ceres CLONE 1909481
  misc_feature (3)..(148): Pfam Name: Ribosomal_L19e Pfam Description: Ribosomal protein L19e
MVSSLKLQKRLASSVLKCGKGKVWLDPNEVSEISMANSRQNIRKLVKDGFIIKKPQKIHSRSRARRAHEAKQKGRHSGYDKRRGTREARLPTKILWMRRMRVLKRLLRKYREAKKIDKHMYHDMYVKVKGNMFKNKRVLMESIHKSKA

SEQ ID NO: 32177 - DNA, 675 bp, Panicum virgatum
  misc_feature: Ceres CLONE 1909502
  misc_feature: Encodes the peptide sequence at SEQ ID NO. 32178
aaccacaccgagctccactccgcgtctctccctctctctcgccatcgcaccgccgccgccgcgtcgtgatcgatcgagcctgcggtgcggtgagcgaggccggaaatgcagatggactcctacttctacgccggcttcttccacgacgaggccccgttgtaccagcacggcgccgtgccgccctccccggagctgcccttcggcctcattgcctcgccgggggagcccgagccgcccttcccggcgcctccggcgccgaggcccgccgcgttccaagactactccgtggccgggccggagctgctgccgccggccgtgggcgccggagagccacactactggagcgcgggagcgagcgtgcacatgcgggtggtcaacgcgctgggcgggatgggcggggacgctgtgcatgatcagacaatgggggaggagtggaaggaggagccgcagcggcagcagcagccggcgggcgccgccgtggagagcagccgcgggttccggcacatgatgcgggagcggcagcggcgtgagaagctgagccagagctacgccgacctctacgccatggtcgccgcccggtccaagggcgacaagaactccatcgtgcaatccgcagcgatctacatccacgagctcaagggcgcgcgggagcagctgctgcggcggaacgaggag

SEQ ID NO: 32178 - protein, 189 aa, Panicum virgatum
  misc_feature: Ceres CLONE 1909502
  misc_feature (132)..(178): Pfam Name: HLH Pfam Description: Helix-loop-helix DNA-binding domain
MQMDSYFYAGFFHDEAPLYQHGAVPPSPELPFGLIASPGEPEPPFPAPPAPRPAAFQDYSVAGPELLPPAVGAGEPHYWSAGASVHMRVVNALGGMGGDAVHDQTMGEEWKEEPQRQQQPAGAAVESSRGFRHMMRERQRREKLSQSYADLYAMVAARSKGDKNSIVQSAAIYIHELKGAREQLLRRNE

SEQ ID NO: 32179 - DNA, 1295 bp, Panicum virgatum
  misc_feature: Ceres CLONE 1909517
  misc_feature: Encodes the peptide sequence at SEQ ID NO. 32180
ccttttcttctccaccgcggcgacgggcctggtcaggtcgatctgtcttgccgccattgcggcgattcgcatcttcgtcctgccgggcgccgcgcgtatcctgcatcatcagggttgagcatatttgagagtggaagaaatcatgttcaggagaaagcatgcctatcatttcaactccagtgatgctgagcaaagacaagcaaagataaatgaattaaaatccgcatttgggcctttgtctgcccgcggtgagaagtactgcagtgaagcatggttgataagatatctagaagcccggaactggaatgttaccaagtcgaaaaaaatgctggaagaaagcctcaagtggagggtagcttataggccggaggatattcgctggcctgatgttgatgttgaagcggaaactggcaaaatgtacagggcaagttttcgagatagagagggaagaaccgttgtaattatgagacctacaaaggagaatacaacgtcccatgatgggcaaatccggtttcttgtatatgttttggagaatgcaatcctgagccttcctgaaggtcaagagaaaatggtatggctgatagacttcacaggatggacaatggcccatgccacgcctataaagactgctagagaatctacaagcatcctgcaaaattattaccctgagaggctgggtattgcatttctgtttaatcccccaaaagtatttgaagctttttataaggctatcaaatatttccttgacccgagatcaatcgagaagttgaacttcgtgtacctgaaggatgaggagagcatgaaggtcctgtacaggtgcattgatccggaggtccttccggtggacttcggagggaggaacaatgtggtgtataaccacgaggagtacaccaagttgatgctggaagatgacaacaaaacctcaagcttctgggcagatgacgcgaaacctgctaaccgtgtcgccaatgggacctttggttgccgatgtcaggcctcagtcgtcgctaattgctgctaaagccagttgaggagtatcagcctgttctgacgggagatattcgaatagctttaatggaagaaataggtaagttgaggtgctaatacaatgttcatagtgaagagaaaataaacgaagtaacaaaatagatattacttgttcatagtgctggaacgttttatctactatacactgagttgtaaccagaggatgttcttcatgggttattggatgccggaaggcccaaaagaaatggtgtacatggtaggaggctggaagtgcagcccagttactg

SEQ ID NO: 32180 - protein, 292 aa, Panicum virgatum
  misc_feature: Ceres CLONE 1909517
  misc_feature (91)..(264): Pfam Name: CRAL_TRIO Pfam Description: CRAL/TRIO domain
MFRRKHAYHFNSSDAEQRQAKINELKSAFGPLSARGEKYCSEAWLIRYLEARNWNVTKSKKMLEESLKWRVAYRPEDIRWPDVDVEAETGKMYRASFRDREGRTVVIMRPTKENTTSHDGQIRFLVYVLENAILSLPEGQEKMVWLIDFTGWTMAHATPIKTARESTSILQNYYPERLGIAFLFNPPKVFEAFYKAIKYFLDPRSIEKLNFVYLKDEESMKVLYRCIDPEVLPVDFGGRNNVVYNHEEYTKLMLEDDNKTSSFWADDAKPANRVANGTFGCRCQASVVANCC

SEQ ID NO: 32181 - DNA, 628 bp, Panicum virgatum
  misc_feature: Ceres CLONE 1909536
  misc_feature: Encodes the peptide sequence at SEQ ID NO. 32182
atcccccagcaaggcagcaacaaccccccctgccgcgcgcggcggatggcaacggccgcctccgcctcccccggcgcgctcggcgccaaaaccccagcgcgggggccgagcgcgagcgcgcgccacccggccccgaagccgaccccagcattcgcgaggccctccccgcgccgagcccccgcccccggcaggccccgcgccagccaacacctcggcggcgcgggcgcgggcgtggccagcagcagcagcgccgccgccaacggcagcgggctccacgtgccccccgcgatcgcgccgctcgccctgcccaagatggccggcgccatggggacccacaagaatgtcctgctcttctactgcaaggagatgcgggagctcgcgcagcaggtggccgcccggaacgatgatatcgagctgcgctccatctcctggaggacatttgctgatggattcccaaatttgttcatctcgaatgcccacagcattcgcggccggcatgttgcttttttagcatcatttagctcgcccagtgtcatatttgagcaactatctatcatatatgctctgccgaagttgtttatttcatcgttcactcttatactcccatttttcccggccgggacttctg

SEQ ID NO: 32182 - protein, 194 aa, Panicum virgatum
  misc_feature: Ceres CLONE 1909536
  misc_feature: SWISSPROT Homolog: EC 2.7.6.1 Ribose-phosphate diphosphokinase
MATAASASPGALGAKTPARGPSASARHPAPKPTPAFARPSPRRAPAPGRPRASQHLGGAGAGVASSSSAAANGSGLHVPPAIAPLALPKMAGAMGTHKNVLLFYCKEMRELAQQVAARNDDIELRSISWRTFADGFPNLFISNAHSIRGRHVAFLASFSSPSVIFEQLSIIYALPKLFISSFTLILPFFPAGTS

SEQ ID NO: 32183 - DNA, 313 bp, Panicum virgatum
  misc_feature: Ceres CLONE 1909543
  misc_feature: Encodes the peptide sequence at SEQ ID NO. 32184
gtctggctggctggcttggcatcggccatcggcacccggcaggcggcgggcggcagcagcgcaggatggccacccacgctgctctcgccgcgtcgcgcatccccacaggcacccggctgcacagcagggcggcgtccaggcagagggtggacttcgccgacttctccgggctgaggccgggatcatgctccgtcagcaccgccgccagggaggcgtcattctccgacgtgctcggtgcgcagctcgtcgccacggccaccacagaaaaaaaggcgagggcgcgcgctcacacaaagctcactgaggggaggaa

SEQ ID NO: 32184 - protein, 82 aa, Panicum virgatum
  misc_feature: Ceres CLONE 1909543
  misc_feature: SWISSPROT Homolog: EC 1.2.1.13 Glyceraldehyde-3-phosphate dehydrogenase (NADP(+)) (phosphorylating)
MATHAALAASRIPTGTRLHSRAASRQRVDFADFSGLRPGSCSVSTAAREASFSDVLGAQLVATATTEKKARARAHTKLTEGR

SEQ ID NO: 32185 - DNA, 694 bp, Panicum virgatum
  misc_feature: Ceres CLONE 1909545
  misc_feature: Encodes the peptide sequence at SEQ ID NO. 32186
aagtctgcgataacgaggatttcgagcagcgacacccgtccaatccccgaacgctgccaagcccctgccgcctgccgctgccggcgcggcggcgccccccacagatccgcacaaactctcggccggttcgcccgcgccgcccgtccgttccgcggcctcgcacggccccaaatcccacagctgcgcccccaaagccaccagccggccggccccgctacaaaagcaggcggctggctgcgcgacgagcagcagctgcctcagccactgcgctgcgcctcggtgaggagggcgcataggatagggatggcggcggcggtggagggcgtgcggcaccggacggtggaggcgaacggcgtccgcctgcacgtggcggaggcggggcccgaaggcggcggcgccgcccccgcggtgctgctgctgcacggcttcccggacctctggtacggctggcgccaccagatggccgccctggcggcgcggggctaccgcgccgtggcgcccgacctccgcggctacggcgactctgacgccccgcccgacgcgtccgcctacaccaccttccacgccgtcggggacctcgtcgcgctcatcgccgacctcggccagccccaggtttcgcggcggcagcggcaacccgttcgattcctggcacaccgaagctgcgaggcagcgactcgacgttgacttcctctta

SEQ ID NO: 32186 - protein, 126 aa, Panicum virgatum
  misc_feature: Ceres CLONE 1909545
  misc_feature: SWISSPROT Homolog: EC 3.3.2.10 Soluble epoxide hydrolase
MAAAVEGVRHRTVEANGVRLHVAEAGPEGGGAAPAVLLLHGFPDLWYGWRHQMAALAARGYRAVAPDLRGYGDSDAPPDASAYTTFHAVGDLVALIADLGQPQVSRRQRQPVRFLAHRSCEAATRR

SEQ ID NO: 32187 - DNA, 827 bp, Panicum virgatum
  misc_feature: Ceres CLONE 1909545-R
ttgcttgatcgatggtgtaattttgttgagaagtaccaacgtcacaacatatctgaggatacctggcagcagttgctagctttcagcaggtttgtaaatgaagacctggaaggttatgacccgcgaggtgcatggcctgttctgattgatgatttcgtggagcaaatgcacagaatttatcactccaccgactgcagcagtgctatggaatcacaatgtaccatttccagtacatttaaaggactggatcttctacctggatcaaagaggaaatgtcctcctcactttaggtccaatgaggaggatgtagagctttcagatagttttacacgctctgtccatcttacaccaataaagcgacttaaggaaagtcatggcactagttatggagtgggggaatcccacaaaggtacccatttctctgatagttcctcagactaccgtgaggatacaaatttgcacaacccaaggggctgtcttcagaactcgccttgtaatgttgaggatgccctgtcaaaagggttcgagggttgcatttcaatgaaatgctccttctgatatataaccaagaatgcataggttagtcattttgtggcagcccataaactgcatatattcccaacttcagtgccactatcatcctgtgtgtatttaatcaattttttcagaggtgatattattcttctgagctcgaatgatgctgttgtctcactcgtgaatcgtgatgatgtgcgattcacatatattttttaacatttttcctacattggatattaattactatatcggtgtgatgaaggcaattgcaactgagctttcttgacagc

SEQ ID NO: 32188 - DNA, 720 bp, Panicum virgatum
  misc_feature: Ceres CLONE 1909551
  misc_feature: Encodes the peptide sequence at SEQ ID NO. 32189
agtctcttcccaactccaaacaagcagcgaatcagcgatcgcaagcaccaaaaacatatggcgatggcgacggtgaagctgagctccccggccgcaggcttgctcgctggcggccgcacccgccgatccgcgcccgcccgccgcgccacggtgatccgcgccgccgccggctcctactccgacgagctcgtctccaccgcgaaatctgttgcttcccctgggcgtggtattctggcaattgatgagtcaaatgcaacatgcggaaagagattatcatccattggtttggataacacagaagctaaccgccaggcttacaggcagcttttactgacaactgctagccttggtgaatatatttctggtgctattctttttgaggagactctttatcaatcaactacagatggcaagaagtttgttgactgcttgaaggatcagaatatcatgcctggcatcaaggttgacaagggtttggttccattgcctggatccaacaatgaatcatggtgccaaggtcttgatggtttggcttcaaggtgtgctgagtactacaagcagggggcacgcttcgcaaagtggaggactgttgttagcatcccttgtggtccatctgcattagcagtcaaggaagcagcatggggacttgctcgatatgctgctattgctcaggacaatgggttagtgcctattgtggagccagagatccttcttgatgga

SEQ ID NO: 32189 - protein, 220 aa, Panicum virgatum
  misc_feature: Ceres CLONE 1909551
  misc_feature (43)..(220): Pfam Name: Glycolytic Pfam Description: Fructose-bisphosphate aldolase class-I
  misc_feature: SWISSPROT Homolog: EC 4.1.2.13 Fructose-bisphosphate aldolase
  misc_feature: Useful for making plants with modulated biomass
  misc_feature: Useful for making plants with modulated phosphate use efficiency
MAMATVKLSSPAAGLLAGGRTRRSAPARRATVIRAAAGSYSDELVSTAKSVASPGRGILAIDESNATCGKRLSSIGLDNTEANRQAYRQLLLTTASLGEYISGAILFEETLYQSTTDGKKFVDCLKDQNIMPGIKVDKGLVPLPGSNNESWCQGLDGLASRCAEYYKQGARFAKWRTVVSIPCGPSALAVKEAAWGLARYAAIAQDNGLVPIVEPEILLD

SEQ ID NO: 32190 - DNA, 726 bp, Panicum virgatum
  misc_feature: Ceres CLONE 1909580
  misc_feature: Encodes the peptide sequence at SEQ ID NO. 32191
atctccgtccccctccctctctctgcgaaccgcaaaatctcctccacctttccgtcccccacgcctcgtcactgtgccgcccgtgccctcccgtcccaccaataatccatccactcccacccccaccccgctgcggcggcgcctgttcctccggcggcggcgatgtgcggcggcgccatcctctccggcttcatccggccatccgggccggcggccaagaagcagcagcagcagctgctactgcagcaccagccccgccgggtcacggccgacttgctctggccgggggccggcaggaagggagcccccgtgggggatgacttcgaggccgacttccgcgagttcgtgcgcgggctcggcgagggcgacggcgccggtgacgtcggcgacgacgacgaggtcgtggaggtccccccgccggagccggcgatgttcgccttcgccgccgcggccaaggcggcggcccccgcagtcgatggtatgatgactccaaagactgctcaacatgatgaacctactgctacctcagcaaagcgcaaccggaagaatcagtacagggggatccgccagcgtccctggggtaaatgggcggctgagatccgagaccctagcaagggtgtccgtgtttggcttggaacttacaacacggctgaggaggccgcaagggcatatgatgctgaagctcgcaagattcgtggcaagaaagcaaaggtcaattttcctgat

SEQ ID NO: 32191 - protein, 187 aa, Panicum virgatum
  misc_feature: Ceres CLONE 1909580
  misc_feature (129)..(180): Pfam Name: AP2 Pfam Description: AP2 domain
  misc_feature: Useful for making plants with altered alkaloid content
MCGGAILSGFIRPSGPAAKKQQQQLLLQHQPRRVTADLLWPGAGRKGAPVGDDFEADFREFVRGLGEGDGAGDVGDDDEVVEVPPPEPAMFAFAAAAKAAAPAVDGMMTPKTAQHDEPTATSAKRNRKNQYRGIRQRPWGKWAAEIRDPSKGVRVWLGTYNTAEEAARAYDAEARKIRGKKAKVNFP

SEQ ID NO: 32192 - DNA, 1424 bp, Panicum virgatum
  misc_feature: Ceres CLONE 1909590
  misc_feature: Encodes the peptide sequence at SEQ ID NO. 32193
actcctccggctttcccctcctcgcttccaagccaaggcaaaaagcagcggcgagcccccgcgagaccgtacgcacccacccaccagtccactacccccgcgcgctataactgcagccccgcgggcgcgcgggcgccgccgacaccgccgcgggtcgagaagcccgtcaccagccatggcgaccggcggcgagacgaaggccccgggcgcggggtactaccagtaccccgcctcgtacggcggcggccgcgcggacgaggagcggcggtggtggccgtggctcgtgcccaccgtgctcgtcgcctgcatcgcggtcttcgccgccgagatgttcgtcaacgactgcccgcgccgcgggagcgcgctcggcggcggcgccgggtgcgtcgcgtcggggttcctccggcggttcgccttccagccgctccgggagaacccgctcctcgggccctcctccgccaccttggagaagatgggagctcttaactgggccaaagtagttcatgagcaccaaggatggcgcctcattagctgtatttggcttcatgctggcctagtccaccttgtagtcaacatgttaagcttgctattcattggaatccgacttgagcaacaatttgggtttgtgcgcattggggtcatctacttgatatcgggttttggcggcagtgtggtgtctgcactcttcttacagagtaactacatctctgttggtgcctctggggctttgtttggcctccttggatctatgctctcagagcttattatgaactggacaatctataccaacaaggcagcggcaatcataactctacttttcataattgcaattaatttggccattgggatattaccccatgctgataattttgcccacattggtggatttgcttctggatttcttcttggatttgtgttgttggctagacctcaatttggttggatggaacgcaacgagctaccccaaactaatcaacctccaaagtacaaattgtaccagtacgtcttgtgggttgctgcactcatattgctggtagttggatttgtgattatcctggtgatgctcttcaagggcaagaatgggaacgacagctgccactggtgccagtacctgaactgcgtaccaacatccagatggaagtgcaacacttgatggttcagttttccatcagctcctgtgcaaaatatatgcctctggtgggaaccatttttgtgcctgtgcgtttgtggatagcaagacctgtccgcactcctcgtgcctgagttctgtatggttatgtgaaggacaaatgtttctcaactgtaacctgagcttgtaactgtggatttcgccgcacttcttgtatcgatttcgccagcattagctgctgactgctggaactgtgtaaaaccattctgagcaatctgattgacagagattggtc

SEQ ID NO: 32193 - protein, 325 aa, Panicum virgatum
  misc_feature: Ceres CLONE 1909590
  misc_feature (108)..(253): Pfam Name: Rhomboid Pfam Description: Rhomboid family
  misc_feature: SWISSPROT Homolog: EC 3.4.21.105 Rhomboid protease
  misc_feature: Useful for making plants with altered cell wall content and/or composition
MATGGETKAPGAGYYQYPASYGGGRADEERRWWPWLVPTVLVACIAVFAAEMFVNDCPRRGSALGGGAGCVASGFLRRFAFQPLRENPLLGPSSATLEKMGALNWAKVVHEHQGWRLISCIWLHAGLVHLVVNMLSLLFIGIRLEQQFGFVRIGVIYLISGFGGSVVSALFLQSNYISVGASGALFGLLGSMLSELIMNWTIYTNKAAAIITLLFIIAINLAIGILPHADNFAHIGGFASGFLLGFVLLARPQFGWMERNELPQTNQPPKYKLYQYVLWVAALILLVVGFVIILVMLFKGKNGNDSCHWCQYLNCVPTSRWKCNT

SEQ ID NO: 32194 - DNA, 124 bp, Panicum virgatum
  misc_feature: Ceres CLONE 1909595
  misc_feature: Encodes the peptide sequence at SEQ ID NO. 32195
ccatccgtgtccttccgctacgtctgcgtgggcaacgaggtcgcccgcggcgcgtcgcagagcctggcccctgcaatgaaacacgtgcaccccgcgctggccgccgccgggctgggccacatct

SEQ ID NO: 32195 - protein, 41 aa, Panicum virgatum
  misc_feature: Ceres CLONE 1909595
  misc_feature: SWISSPROT Homolog: EC 3.2.1.39 Glucan endo-1,3-beta-D-glucosidase
  misc_feature: Useful for making plants with altered carbohydrate content
  misc_feature: Useful for making plants with altered cell wall content and/or composition
PSVSFRYVCVGNEVARGASQSLAPAMKHVHPALAAAGLGHI

SEQ ID NO: 32196 - DNA, 728 bp, Panicum virgatum
  misc_feature: Ceres CLONE 1909597
  misc_feature: Encodes the peptide sequence at SEQ ID NO. 32197
ccgtgtttaatcccaacaacgccccagatgaatcatccgccatatctaggaaccgtcacggcgtcgtatgacgccgttcacacccgcacatgcctgacactctgggccccacctgaactcgacgcctctttccctctcatctccctctcccacctcttgcttctcgcactcgcgttcgtgtcggctcgcaccggagatcgggggagggaggtggtggactggtggttgttgccccgtcggcggcgaggctcggggcctagggtccccgggctcggatccgcggcctggccgatgggatccgaaggcttcgtggccgcggcggccgcgtgcccggccgccgccgaggccttcgccaagtactacggtattgtgtcaggaggtacaaatgtgaaggcaagacaaggattggttgaactttcacaagctatagatggaatcaaaggaatgagagatgcaatatttgcagatgtcccaaatctgatgccatttattgatttggaggatacatgcctattcagttgcttctacgacttcgtcttcttcatctgtcgtgaaaaggggcaaaagagtatcaccattcagagagctgtagcagcatggaagattgttctaaatggaaggttccggttgcttgatcgatggtgtaattttgttgagaagtaccaacgtcacaacatatctgaggatacctggcagcagttgctagctttcagcaggtttgtaaatga

SEQ ID NO: 32197 - protein, 145 aa, Panicum virgatum
  misc_feature: Ceres CLONE 1909597
  misc_feature: Useful for making plants with modulated biomass
MGSEGFVAAAAACPAAAEAFAKYYGIVSGGTNVKARQGLVELSQAIDGIKGMRDAIFADVPNLMPFIDLEDTCLFSCFYDFVFFICREKGQKSITIQRAVAAWKIVLNGRFRLLDRWCNFVEKYQRHNISEDTWQQLLAFSRFVN

SEQ ID NO: 32198 - DNA, 639 bp, Panicum virgatum
  misc_feature: Ceres CLONE 1909598
  misc_feature: Encodes the peptide sequence at SEQ ID NO. 32199
ccaaatccatcgctggctctcgctctcgctctcgctctcgctccccgcctctgcgcctccgcctccgcctccgcctccgccaccgccaccgcctcgccgccacggcctccccaccccgtctgatctgctccgacgaccgcccgctcttcatgtagacacagcagtctggtcccgctcgcggtggaggatcagcttgccttggcgtcccgccgcccgtcgcgtcacggcgccgcaaaatgacagtggtgaaggtggagccggaacccgcgctggagctggcgtccgtggctgtcgctgaggcccgggcggaggagctctcgccgccgctgtcgtacggtgaggacgaggaggaggaggacgacaacgaggaggatgacgaggagaccgacagcgaggggtacggcggcggcggtgcgcccccgctgaagaaggggccctggacgccccaggaggacaagcgcctcaaggactacgtcgaggcgcacggcgaagggaactggaaccaggtgcagcggaacgccgggcttaaccgctgcggcaagagctgccgcctccgctgggccaaccacctcaggcccgacctcaagaaggggcctttcgacgccgaggaggttgataagattatcaaattccacatca

SEQ ID NO: 32199 - protein, 134 aa, Panicum virgatum
  misc_feature: Ceres CLONE 1909598
  misc_feature (65)..(112): Pfam Name: Myb_DNA-binding Pfam Description: Myb-like DNA-binding domain
  misc_feature: The sequence is a functional homolog of SEQ ID NO 1625 in the 10/412,699 US patent application
  misc_feature: The sequence is a functional homolog of SEQ ID NO 978 in the 10/666,642 US patent application
  misc_feature: The sequence is a functional homolog of SEQ ID NO 1626 in the 10/412,699 US patent application
  misc_feature: The sequence is a functional homolog of SEQ ID NO 979 in the 10/666,642 US patent application
  misc_feature: The sequence is a functional homolog of SEQ ID NO 200 in the 10/666,642 US patent application
  misc_feature: The sequence is a functional homolog of SEQ ID NO 830 in the 10/412,699 US patent application
  misc_feature: Useful for making plants with modulated nitrogen use efficiency
MTVVKVEPEPALELASVAVAEARAEELSPPLSYGEDEEEEDDNEEDDEETDSEGYGGGGAPPLKKGPWTPQEDKRLKDYVEAHGEGNWNQVQRNAGLNRCGKSCRLRWANHLRPDLKKGPFDAEEVDKIIKFHI

SEQ ID NO: 32200 - DNA, 731 bp, Panicum virgatum
  misc_feature: Ceres CLONE 1909603
  misc_feature: Encodes the peptide sequence at SEQ ID NO. 32201
atcttgacaggccaccgaaacaaaattctctctctaggcgggagagagagagagagcggtcgcagccgccggccatggcggaggcggcgggagcccaagccccggagcatggccccgaggaggcgcccctcgacgcgggcgccatcaggagcctgcctcccaattccgcctccaagctccgatccatggcgtctcacgatcaccaccaccaccactcctacgaccacgatcaccaccaccatcactcccacggggatggcggtggcaatgcagcggggggatcgtgggtcggggaggacggtcgcgtgtggcactcccacgacggcctcacgccgcactcccacgagcccatctactcccccggcgacttcaccaagcgcgcgccgccgctcgcctcgcgtgccttcaccgaccgcgccttcaccgtcggaattggcggccccgtcggcacggggaaaactgccctgatgttagcactgtgcagattcctacgtgataaatatagtcttgctgcggtcacaaacgacattttcacaaaagaagatggggaattcttagtcaagcatggagcactcccaaaagagcgcatacgtgcagtggaaactggagggtgccctcatgcagctatacgtgaagacatcagtataaatcttggtcctctagaggagctatcgaacttgtacaaagctgatttgctactctgtgaatctggaggagataacttggctgct

SEQ ID NO: 32201 - protein, 181 aa, Panicum virgatum
  misc_feature: Ceres CLONE 1909603
  misc_feature (79)..(181): Pfam Name: cobW Pfam Description: CobW/HypB/UreG, nucleotide-binding domain
MASHDHHHHHSYDHDHHHHHSHGDGGGNAAGGSWVGEDGRVWHSHDGLTPHSHEPIYSPGDFTKRAPPLASRAFTDRAFTVGIGGPVGTGKTALMLALCRFLRDKYSLAAVTNDIFTKEDGEFLVKHGALPKERIRAVETGGCPHAAIREDISINLGPLEELSNLYKADLLLCESGGDNLA

SEQ ID NO: 32202 - DNA, 598 bp, Panicum virgatum
  misc_feature: Ceres CLONE 1909606
  misc_feature: Encodes the peptide sequence at SEQ ID NO. 32203
gccgccgccgccgccgccgccgctgctgccaagcacatctcacccggcgcacaccgccgggcgagagcccacccccccttcccaccccaccatggcggaccgcggaggcgagagaggcggcgagcgcggcggcgagcgcggcggcttggggcgcgggttcgggcgccgcgggcgcggcgaccgcggcgggcgccggggcggtcggcgcggcgggcgccaggacgaggaggagaagtgggtgcccgtgactaagctcgggcgccttgtctaggagggcaggatctcgcggatggaggagatctccctcccctcgttccccatcagggagcaccagatcgtggacgccctcctcccggggctcgaggaggaggtcatgaagatcacggcggtgcagaagcagacgcgcgccgggcagcgctcgctcttcagggccttcgtcgtcgtcagcgagggcaatggtctcgtctggctcggggtcgagtgcgcgaaggaggtggccaccgccatccgcggcgccatcatcctcgccgagcactcggtcgtgcccgtcaggaggggctagtggaggatcatgatccgccagccgcacatcgtggta

SEQ ID NO: 32203 - protein, 90 aa, Panicum virgatum
  misc_feature: Ceres CLONE 1909606
  misc_feature (23)..(89): Pfam Name: Ribosomal_S5 Pfam Description: Ribosomal protein S5, N-terminal domain
MEEISLPSFPIREHQIVDALLPGLEEEVMKITAVQKQTRAGQRSLFRAFVVVSEGNGLVWLGVECAKEVATAIRGAIILAEHSVVPVRRG

SEQ ID NO: 32204 - DNA, 1668 bp, Panicum virgatum
  misc_feature: Ceres CLONE 1909634
  misc_feature: Encodes the peptide sequence at SEQ ID NO. 32205
agccgaaccaccgaagctatcatttctgccctgtacccctccggctcggttccaccctcgccgccatctcccacctctctccccccaagccctcacgctcccaccgaagcgccgccgctagggtttgctccgccagccgtgaaccctaaaccctactgctctgctccgttcctacagcgcaggccactactcagcaatctagctgctacgcttagctccccgcctcgatcgggagctagagtttcagtcgcccccaatctcgggtggtttcgggccggcggcgacgcggcatggcggggtacggggaggagaaccaggacggtatgaacgggtacgaggaggaggaggaggaagaggaagaggtggaggaggttgaggaggtctacgaggaagaggaggaggaaggggacggggaggcggacgacggggctgcggtggcggccgcggaagcggcggcggagcctgctgagatgagaagcgagggtggaggtcgaggcctagcggaggtcgttggggatgctgacgccggtggcgaggaagggagggatgcggattctgggggcggcgacgcctcggggaagattttcgtagggggtgtagcctgggagaccaccgaagaaacgttcactaagcattttcagaagtatggtgcaataactgattccgttatcatgaaggacaagcatacgaagatgcctcgtggatttggatttgtcacattttctgatccgtctatgattgatagggttctagaggatgaacatgtcatggatggaagaacggttgaagtcaaaaggactgttccaaaagaggagatgtcaacaaaagatggtcctaaaacaaaaaagatctttgtgggtggtatcccgccatctcttactgaagataaattgaaggagcacttctcctcatatgggaaggtggttgagcatcagattatgcttgaccatagcactgggcgatcacgaggctttggatttgtcacgtttgaaagtgaagatgctgttgaaagggttatgtcacatgggagaatgcacgatcttggagggaaacaggtcgaaataaagaaagctgagccaaagaaacctggcgggggtgattcaagctcaaatgggagatacagtcgtgggggtggtggtcaccgtgattcttaccatggtagtggcggcggcggcggcggcagctctgggagcagtggtggtggtggctatggatatggaggtggctaccgatcagctgcagcctattatggcagcacagcttatagtgcatatggcagaggatatggatacggcaatactgctggctatgggtctggttatggctcagtttatggtggttccatgtatggtggtccatatggtgcatacggggcatatggtggtgcctatggaggtggtgcatatggtgcaccaggaggctatggaggtgcaggaggatatggtggatacggtggggctggaggcatgggtggtggtggtggtggtagcactggcagtcggggctcgaggtaccacccttatggaaaatgatcatcgattcatagtggttttctaggatcagataataaagagtcctatataccttacctcatttgtgctaccgagacaatggaacattccattcacttcgcctgagtcagcggcatcagaccattttttttcctgg

SEQ ID NO: 32205 - protein, 413 aa, Panicum virgatum
  misc_feature: Ceres CLONE 1909634
  misc_feature (187)..(258): Pfam Name: RRM_1 Pfam Description: RNA recognition motif. (a.k.a. RRM, RBD, or RNP domain)
  misc_feature (98)..(167): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with altered alkaloid content
  misc_feature: Useful for making plants with altered lignin content
  misc_feature: Useful for making plants with altered terpenoid content
  misc_feature: Useful for making plants with modulated nitrogen use efficiency
  misc_feature: Useful for making plants with modulated phosphate use efficiency
MAGYGEENQDGMNGYEEEEEEEEEVEEVEEVYEEEEEEGDGEADDGAAVAAAEAAAEPAEMRSEGGGRGLAEVVGDADAGGEEGRDADSGGGDASGKIFVGGVAWETTEETFTKHFQKYGAITDSVIMKDKHTKMPRGFGFVTFSDPSMIDRVLEDEHVMDGRTVEVKRTVPKEEMSTKDGPKTKKIFVGGIPPSLTEDKLKEHFSSYGKVVEHQIMLDHSTGRSRGFGFVTFESEDAVERVMSHGRMHDLGGKQVEIKKAEPKKPGGGDSSSNGRYSRGGGGHRDSYHGSGGGGGGSSGSSGGGGYGYGGGYRSAAAYYGSTAYSAYGRGYGYGNTAGYGSGYGSVYGGSMYGGPYGAYGAYGGAYGGGAYGAPGGYGGAGGYGGYGGAGGMGGGGGGSTGSRGSRYHPYGK

SEQ ID NO: 32206 - DNA, 754 bp, Panicum virgatum
  misc_feature: Ceres CLONE 1909643
  misc_feature: Encodes the peptide sequence at SEQ ID NO. 32207
gatgctcgttgccgtccgtccaacccctctcgggcctctcggctccacctccaaactccctacaccaacgcccgccgccgccgccgccgcgacgcgacgcgtagatccaaacccccagcccacgccacctccgccgccgtcgaaccgacccgtccgcgcgaccgccccagtttcaggccccggcgttactcaagcaggaccgaggatggcggcgcgccgagggttgatggagcaggatctgagcaagctcgacgtcgccaggctgaaccctctgtcgccagaggtgatttcgcgccaggcgacgatcaacatcggtaccattggacacgtggcccatgggaagtctactgttgtcaaagcaatctcaggcgtgcagactgttcgtttcaagaatgaactggagcgcaatatcactataaagcttggttatgctaatgcaaaaatctataaatgtgaagatgatagatgcccacggccaatgtgctacaaggcttatggcagtggcaaagaagatagccctctctgtgatgttccagggtttgaaaactgtaggatgaagctcctgagacatgtttcatttgttgattgcccggggcatgacattctcatggctacaatgcttaatggagcagctatcatggacggagcactacttctgattgcagccaatgagagctgtccccaaccccagacatcagagcatcttgcagctgttgaaattatgcgtctttcacatattatcattctgcagaac

SEQ ID NO: 32207 - protein, 182 aa, Panicum virgatum
  misc_feature: Ceres CLONE 1909643
  misc_feature (31)..(182): Pfam Name: GTP_EFTU Pfam Description: Elongation factor Tu GTP binding domain
  misc_feature: SWISSPROT Homolog: EC 2.1.1.43 Histone-lysine N-methyltransferase
MAARRGLMEQDLSKLDVARLNPLSPEVISRQATINIGTIGHVAHGKSTVVKAISGVQTVRFKNELERNITIKLGYANAKIYKCEDDRCPRPMCYKAYGSGKEDSPLCDVPGFENCRMKLLRHVSFVDCPGHDILMATMLNGAAIMDGALLLIAANESCPQPQTSEHLAAVEIMRLSHIIILQ

SEQ ID NO: 32208 - DNA, 750 bp, Panicum virgatum
  misc_feature: Ceres CLONE 1909670
  misc_feature: Encodes the peptide sequence at SEQ ID NO. 32209
aaaacccacgcgaccgcgagagctctccgagagggagtccgagagcaccaccacgagagagacgaatcttccgaatctctcggcggcgatggcgctctccgaccgctcccgcgagtcgctcctcccgagcttcctctacgactcctcctcggcgcgctccttcgccgccaccccctcgcgcctctcagtccccgtccccgccccggccgcggctggagcgggtggcggcgcgcccttcacgatccaggcgcccaaggagaagatcgagctctactcgccggcgttctacgccgcctgcacggccggagggatcgccagctgcgggctcacccacatggccgtcaccccgctcgacctcgtcaagtgcaacatgcagatcgatccagcgaaatacaagagcatctcatctggatttggtgtcctgttaaaggagcaaggggctaggggcttcttcaggggatgggtgcctaccttgcttggttacagtgctcagggggcttgcaagtttggcttctatgagttcttcaagaagtactactcagatattgcagggcctgagtatgcccagaagtacaagactctaatctacctggcaggttctgcttctgctgaggtaattgccgatgtggctctctgcccctttgaagctgtgaaggtacgtgtgcagacacagcctggatttgctcgtgggttgagcgatgggctccccaaatttgtccgatctgagggtgctctcgggctctacagggg

SEQ ID NO: 32209 - protein, 220 aa, Panicum virgatum
  misc_feature: Ceres CLONE 1909670
  misc_feature (66)..(154): Pfam Name: Mito_carr Pfam Description: Mitochondrial carrier protein
MALSDRSRESLLPSFLYDSSSARSFAATPSRLSVPVPAPAAAGAGGGAPFTIQAPKEKIELYSPAFYAACTAGGIASCGLTHMAVTPLDLVKCNMQIDPAKYKSISSGFGVLLKEQGARGFFRGWVPTLLGYSAQGACKFGFYEFFKKYYSDIAGPEYAQKYKTLIYLAGSASAEVIADVALCPFEAVKVRVQTQPGFARGLSDGLPKFVRSEGALGLYR

SEQ ID NO: 32210 - DNA, 742 bp, Panicum virgatum
  misc_feature: Ceres CLONE 1909677
  misc_feature: Encodes the peptide sequence at SEQ ID NO. 32211
tcaaaacgttacgagttttattcgatttcgtgccccgtccgcttgacgaccgagccgcccgcccccgatttcctcctcccttccctgcctgcctgccggtgccgcggcgccggtagcatctcgcgcgcggaggcggcggcggcggacgcggttacaggctcggctctaccggagggcgcgctgcgggctccaaagctggtatgggcacgccggagttccccaacctggggaagcactgcagcgtcggcgactgcaaccagatcgacttcctccccttcacctgcgaccgctgcgaccacgtcttttgtcttcagcacagaagttatacaacacaccaatgtccaaatgcaaatatgaaggatgttaccgtcctcatctgcccactctgtgctcaaggagttcgcctcaatccaagcgaagacccaaatatcacctgggatactcatgttaacactgattgtgatccatcaaactaccagaaagtaacaaagaaacagaaatgccctgtgcctgggtgcagagagacactgacgttttccaacacgatcagatgcaaagactgcaccagagaacactgcctgaagcatagattcgggcctgatcacaaatgcccaggaccaagaacagtggattcgggcttcccctttgtaaatatgctaaggagaagtcagaaagcagagacacgtccgagcagcagcagtaagaatagttcttcctggtggagctccagccttgtgaatgc

SEQ ID NO: 32211 - protein, 180 aa, Panicum virgatum
  misc_feature: Ceres CLONE 1909677
  misc_feature (13)..(55): Pfam Name: zf-AN1 Pfam Description: AN1-like Zinc finger
MGTPEFPNLGKHCSVGDCNQIDFLPFTCDRCDHVFCLQHRSYTTHQCPNANMKDVTVLICPLCAQGVRLNPSEDPNITWDTHVNTDCDPSNYQKVTKKQKCPVPGCRETLTFSNTIRCKDCTREHCLKHRFGPDHKCPGPRTVDSGFPFVNMLRRSQKAETRPSSSSKNSSSWWSSSLVN

SEQ ID NO: 32212 - DNA, 694 bp, Panicum virgatum
  misc_feature: Ceres CLONE 1909684
  misc_feature: Encodes the peptide sequence at SEQ ID NO. 32213
gacgcacgcgtgcgcgggcggcctggcaagcgctagaaaggaaagccgaggcggcgcggcgcggcgagcgagcggcccaccaccgtcgactgcctagctccttggctttgccatttttgcttaattggtcggggagcggaggagggatccaggatggtgcgggggaagacggagatgaagcggatagagaacgcgacgagccggcaggtgaccttctccaagcgccgcaacgggctgctcaagaaggcgttcgagctctccgtgctctgcgacgccgaggtcggcctcatcgtcttctccccgcgcggcaagctctacgagttctccagcgcctccagcctccagaaaacaatcgaccgctataagtcatatacaagggaaaatctcagtaacaaggatacacgacaacaggatatacagcaagtcaaagcagatgccttaagcttggcaaatagacttgaagcccttgaaatgaccaagaggaagtttttgggtgaaaatttagaaggctgctctgttgaagaactgcatagtttggaggtcaaactggagaagagtctccacgtcatcagaggaaagaagacccaactgctggagcagcagatagccaagctgaaggagaaggtaatgcatcggcccggagtatcctgaaactactactccacacagtaaccgccttctgaatcctgactcc

SEQ ID NO: 32213 - protein, 165 aa, Panicum virgatum
  misc_feature: Ceres CLONE 1909684
  misc_feature (9)..(59): Pfam Name: SRF-TF Pfam Description: SRF-type transcription factor (DNA-binding and dimerisation domain)
  misc_feature (75)..(160): Pfam Name: K-box Pfam Description: K-box region
  misc_feature: The sequence is a functional homolog of SEQ ID NO 1368 in the 10/666,642 US patent application
  misc_feature: The sequence is a functional homolog of SEQ ID NO 422 in the 11/435,388 US patent application
  misc_feature: The sequence is a functional homolog of SEQ ID NO 1364 in the 10/666,642 US patent application
  misc_feature: The sequence is a functional homolog of SEQ ID NO 1728 in the 10/412,699 US patent application
  misc_feature: The sequence is a functional homolog of SEQ ID NO 122 in the 10/666,642 US patent application
  misc_feature: The sequence is a functional homolog of SEQ ID NO 406 in the 10/412,699 US patent application
  misc_feature: The sequence is a functional homolog of SEQ ID NO 919 in the 10/666,642 US patent application
  misc_feature: The sequence is a functional homolog of SEQ ID NO 164 in the 10/666,642 US patent application
  misc_feature: The sequence is a functional homolog of SEQ ID NO 642 in the 11/435,388 US patent application
  misc_feature: The sequence is a functional homolog of SEQ ID NO 1468 in the 10/666,642 US patent application
  misc_feature: The sequence is a functional homolog of SEQ ID NO 282 in the 10/666,642 US patent application
  misc_feature: The sequence is a functional homolog of SEQ ID NO 4 in US patent 7057087
  misc_feature: The sequence is a functional homolog of SEQ ID NO 203 in the 11/479,226 US patent application
  misc_feature: The sequence is a functional homolog of SEQ ID NO 40 in the 10/666,642 US patent application
  misc_feature: The sequence is a functional homolog of SEQ ID NO 730 in the 10/666,642 US patent application
  misc_feature: Useful for making plants with modulated biomass
  misc_feature: Useful for making plants with modulated flowering time
  misc_feature: The sequence is a functional homolog of SEQ ID NO 707 in the 10/666,642 US patent application
  misc_feature: The sequence is a functional homolog of SEQ ID NO 1362 in the 10/666,642 US patent application
  misc_feature: The sequence is a functional homolog of SEQ ID NO 199 in the 11/479,226 US patent application
  misc_feature: The sequence is a functional homolog of SEQ ID NO 34 in the 10/666,642 US patent application
  misc_feature: The sequence is a functional homolog of SEQ ID NO 58 in the 10/412,699 US patent application
  misc_feature: The sequence is a functional homolog of SEQ ID NO 30 in the 10/666,642 US patent application
  misc_feature: The sequence is a functional homolog of SEQ ID NO 1243 in the 11/479,226 US patent application
  misc_feature: The sequence is a functional homolog of SEQ ID NO 1420 in the 10/666,642 US patent application
  misc_feature: The sequence is a functional homolog of SEQ ID NO 1814 in the 10/412,699 US patent application
  misc_feature: The sequence is a functional homolog of SEQ ID NO 570 in the 10/412,699 US patent application
  misc_feature: The sequence is a functional homolog of SEQ ID NO 1460 in the 10/666,642 US patent application
  misc_feature: The sequence is a functional homolog of SEQ ID NO 938 in the 10/412,699 US patent application
  misc_feature: The sequence is a functional homolog of SEQ ID NO 1949 in the 10/412,699 US patent application
  misc_feature: Useful for making plants with altered lignin content
  misc_feature: The sequence is a functional homolog of SEQ ID NO 1967 in the 10/412,699 US patent application
  misc_feature: The sequence is a functional homolog of SEQ ID NO 1965 in the 10/412,699 US patent application
  misc_feature: The sequence is a functional homolog of SEQ ID NO 1963 in the 10/412,699 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
MVRGKTEMKRIENATSRQVTFSKRRNGLLKKAFELSVLCDAEVGLIVFSPRGKLYEFSSASSLQKTIDRYKSYTRENLSNKDTRQQDIQQVKADALSLANRLEALEMTKRKFLGENLEGCSVEELHSLEVKLEKSLHVIRGKKTQLLEQQIAKLKEKVMHRPGVS

SEQ ID NO: 32214 - DNA, 758 bp, Panicum virgatum
  misc_feature: Ceres CLONE 1909686
  misc_feature: Encodes the peptide sequence at SEQ ID NO. 32215
accattacagtacgcactccggctgacgcgccccgcactctctcacaaagctcaagcctttcgctcgctcgctcgctcgcggctacatctacaatggcgcgattccagctcgcggccctggccatggccatgctcttcgccgcgcgcgcctgccctgctgccggggccggccaccaccagcgcatgttctgcggcctcgacgacatctactgcgtcttcctcggccgcctcgacaacctcagcgccctcatccgccagtacggcctctgcaacaagtccaccaacgaggcgctgctcgtcatcgaggcctaccgcaccctgcgcgaccgcgggccctaccccgccgaccaggtcgtcaaggacctcgccggctcattcgccttcgtcgtcttcgacaacaagtccggcgccgtattcgcagccctgagcgccgacggcggcgtgcctctgttctggggcatcgcggcggacggctccgtggtcatctgcgaggaccgggagatcgtcaagcgcgggtgcggcaagtcgtacgcgcccttccccgtggggtgcatgttccacagcgagggcgggctcaagagcttcgagcaccccatgaacaggctcaaggcgttgccccgggtcgacagcgagggcgtcatgtgcggcgccaccttcaaggtcgacaccttcaccaagatcaactccatgccacgtgtcggcagcgccaccaactgggccgcctgggacgaccagccatctaggagtagatcatattt

SEQ ID NO: 32215 - protein, 221 aa, Panicum virgatum
  misc_feature: Ceres CLONE 1909686
  misc_feature: SWISSPROT Homolog: EC 6.3.5.4 Asparagine synthase (glutamine-hydrolyzing)
MARFQLAALAMAMLFAARACPAAGAGHHQRMFCGLDDIYCVFLGRLDNLSALIRQYGLCNKSTNEALLVIEAYRTLRDRGPYPADQVVKDLAGSFAFVVFDNKSGAVFAALSADGGVPLFWGIAADGSVVICEDREIVKRGCGKSYAPFPVGCMFHSEGGLKSFEHPMNRLKALPRVDSEGVMCGATFKVDTFTKINSMPRVGSATNWAAWDDQPSRSRSY

SEQ ID NO: 32216 - DNA, 973 bp, Panicum virgatum
  misc_feature: Ceres CLONE 1909691
  misc_feature: Encodes the peptide sequence at SEQ ID NO. 32217
aactcccggtagtggtcgtaccataagcccctccgcctctttcaccgactccagaaacctcgaagagcaagcgacgaaggcaagatacgcccacccaccggctccggcgatgcagcagcagatgcccatgcagtcggcgcccccggcgaccggcatcaccaccgagcagatccaaaagtatttggatgaaaataagcagcttattttggccatcctggaaaatcagaacttaggaaagttggctgaatgtgctcagtatcaagctcagcttcaaaagaatctcttgtacctggctgcgattgcagatgcccaaccccaaccaccacagaaccctgcaagtcgcccacagatgatgcaacctggcatggtaccaggtgcagggcattacatgtcccaagtaccaatgttcccgccaagaacaccattaaccccgcaacagatgcaagaacagcagcagcagcagcagcagcttcaacagcagcaagcacaggctcttgctttcccgggacagatggtcatgagacctaccattaatggcatgcagcctatgcaagccgaccctgctgccgccgccgccagcctacagcagtcagcacctggccctactgatgggcgaggaggcaagcaagatgcaactgctggggtgagcacagagccttctggcaccgagagccacaagagcacaaccgcagcagatcacgatgtgggcactgatgtcgcggagaaatcctaagccaagcgacgaaaccaaaggactcttgagtgataactagtagtccttactgtggtttagacgtgccctatccatccatgcagaacaaaaagtttagattggtgatgaatgatgtaatctgcccaagattgttaccgcgttcttacatttctgtagccattatggaataatttttaccagcctgttgtctagcgtattttactatgttttccagctaattagatggttaagagtggcttc

SEQ ID NO: 32217 - protein, 207 aa, Panicum virgatum
  misc_feature: Ceres CLONE 1909691
  misc_feature (14)..(76): Pfam Name: SSXT Pfam Description: SSXT protein (N-terminal region)
MQQQMPMQSAPPATGITTEQIQKYLDENKQLILAILENQNLGKLAECAQYQAQLQKNLLYLAAIADAQPQPPQNPASRPQMMQPGMVPGAGHYMSQVPMFPPRTPLTPQQMQEQQQQQQQLQQQQAQALAFPGQMVMRPTINGMQPMQADPAAAAASLQQSAPGPTDGRGGKQDATAGVSTEPSGTESHKSTTAADHDVGTDVAEKS

SEQ ID NO: 32218 - DNA, 204 bp, Panicum virgatum
  misc_feature: Ceres CLONE 1909699
  misc_feature: Encodes the peptide sequence at SEQ ID NO. 32219
cccaagcgaaagctcaagcaatcgaacaacagtcgcctaatccacactcaaatcaagcaccaaacagcctccagatcccccgatagagctcaccccccgcagcctctgcagcgagatggctcccgagattgccggcaagatgaccgccaaggccgccgccgccgccgcggggaagcccgcgaccagtgggtacgtgacgttcct

SEQ ID NO: 32219 - protein, 29 aa, Panicum virgatum
  misc_feature: Ceres CLONE 1909699
  misc_feature: Useful for making plants with altered carbohydrate content
MAPEIAGKMTAKAAAAAAGKPATSGYVTF

SEQ ID NO: 32220 - DNA, 1525 bp, Panicum virgatum
  misc_feature: Ceres CLONE 1909706
  misc_feature: Encodes the peptide sequence at SEQ ID NO. 32221
acatcgccatcggccatcgcgtcctgctgcccagcccagcatggcacgaccacgaccacgaccccctgctggtactcgtctcgccgctctcctcttcctctgcgcgctgtcggcctgccgcgccgacgcggccggctccggcggcagcaaccccacgagcgccgtggtgctgccggtgagcaaagacgcggccgccacgcagcagtacgtggcggggttccggcagcgcacgccgctggtgcccgtgcaggcggtgctggacctcgcgggcgccacgctctgggtggactgcgacgccgggtacgcgtcctccacctaccgccgcgtgccgtgcgggtccaagccctgccgcctctcgcgctccgccgcctgcgccaccacctgctcggggccgccgagcccgtcctgcctcaacgacacctgcgccgggttccccgggaacacggtcacgcacgtcagcacgggcggcaacatcatcaccgacgtgctggcgctgcccaccacgttccgcccggcgccgggcccgctcgccacggcgccggcgttcctcttcacctgcggctccacgttcctgacggagggcctcgcggcgggcgccgcggggatggcgtcgctcagccgcgcccgcttcgcgctgcccacgcagctcgccgccacgttccggttctcgcgcaggttcgcgctctgcctgccgccggcgggcgcggcgggcgccgtcgtcttcggcgacgcgccctacgcgttccagcccggcctcgtgctgtccaacgcgtcgctcatctacaccccgctcctcgtcaacccggtgagcacggcgggcgtgtccgccaagggcgacaagtcggacgagtacttcgtcggcgtgacgggcatcaaggtgaacggccgctccgtgccgctgaacgcgacgctgctggccatcgacaagaagggcgtgggcgggaccaagctcagcacggtggagccctacaccgtgctggagacctccatccacaaggccgtcaccgacgcgttcgcggccgagacggccatgatcccgcgcgccgcgcccgtggcacccttcaagctgtgctacgacgggagcaaggtcgggagcacgcgcgtgggccccgcggtgccgaccatcgagctgctgctggggagcgaggccgcgtcgtgggtggtgttcggggagaactcgatggtggccgccaagggcggcgcgctgtgcctcggcgtggtggacggcggcaagacgccgaggacgtcggtggtgatcggcgggcacatgatggaggacaacctggtggagttcgacctggaggcgtcgcggctcgggttcagttcgtcgctgctattccggcagacgaactgcaacaacttccgcctaggctagccgacaatgccagcagccgccacttgcgaaacgccattgcccggcctcaacgttgattgggttgtatgattgtgtctgtatgtccgtctgagaccagagaagatggtctcgggtttgggcagtcgctgtctgaataaattgttcatctcc

SEQ ID NO: 32221 - protein, 444 aa, Panicum virgatum
  misc_feature: Ceres CLONE 1909706
  misc_feature: SWISSPROT Homolog: EC 3.4.23.12 Nepenthesin
MARPRPRPPAGTRLAALLFLCALSACRADAAGSGGSNPTSAVVLPVSKDAAATQQYVAGFRQRTPLVPVQAVLDLAGATLWVDCDAGYASSTYRRVPCGSKPCRLSRSAACATTCSGPPSPSCLNDTCAGFPGNTVTHVSTGGNIITDVLALPTTFRPAPGPLATAPAFLFTCGSTFLTEGLAAGAAGMASLSRARFALPTQLAATFRFSRRFALCLPPAGAAGAVVFGDAPYAFQPGLVLSNASLIYTPLLVNPVSTAGVSAKGDKSDEYFVGVTGIKVNGRSVPLNATLLAIDKKGVGGTKLSTVEPYTVLETSIHKAVTDAFAAETAMIPRAAPVAPFKLCYDGSKVGSTRVGPAVPTIELLLGSEAASWVVFGENSMVAAKGGALCLGVVDGGKTPRTSVVIGGHMMEDNLVEFDLEASRLGFSSSLLFRQTNCNNFRLG

SEQ ID NO: 32222 - DNA, 1084 bp, Panicum virgatum
  misc_feature: Ceres CLONE 1909716
  misc_feature: Encodes the peptide sequence at SEQ ID NO. 32223
agacgcctccaatccgggtttccaaaccgtctcggagaagaagaggaagaggaacacctcacggcgaggtagccggcggcggagcagcagcgccttctcctttgacgggcaacccgcccactccttcggcgccgcgacccatctcctcccgtcgctcccccagcgcccgtcgctccccacgcggtcgggccgtgcgccgccctccacgctcccctgcgcacccgcagctcgagtctggctggtgcggcagcaccctcccttcccacggcttctccgttctttctctcggcctcggtcttcctttcctagcggcgacgacagagcgagttgcgctgcccgttgttcgtcgagcgacgggcgcttcgccggcgacggacatccgacagggcttgttcttggaggagggtttgctgaggaagccgcagccagttagccatgtcgtcatccgtgctgagggctgcggctgacagggccatccggaggcaggccctcacgctgacggatgccgcggcatccaggatcaagcaactcctcagcctcaggcagcggccgtacctgcggctcggcgtcaaagcccgaggctgcaatggcctctcatacacgctcaactattccaatgagaaggggaagtttgatgagctggtcgaggagaaaggggttaaagtgcttatcgaccccaaggcattaatgcatgttattggcaccaagatggactatgttgatgatccactgaagtccgagtttgtgttcataaacccaaattccaaaggggagtgtggctgcggtgaatcctttatgactacaagcagcaaagggtcctcatcatgatgcgttttgcattgtaaatgcataagcaaagtatcggaggcctcggctactgattttgttgggtctgttatgctgcaaccttgcaggacatgccacaagagtggttccctaatggacgcacctaacttacatgtacttctttgttcaccccagccatgttatatacatggagtgatttatccatgatctgtatattttgctggctcacgatatgatacctcgaaagtttatcaaatttttagtgccatgcttgtcc

SEQ ID NO: 32223 - protein, 130 aa, Panicum virgatum
  misc_feature: Ceres CLONE 1909716
  misc_feature (19)..(108): Pfam Name: Fe-S_biosyn Pfam Description: Iron-sulphur cluster biosynthesis
MSSSVLRAAADRAIRRQALTLTDAAASRIKQLLSLRQRPYLRLGVKARGCNGLSYTLNYSNEKGKFDELVEEKGVKVLIDPKALMHVIGTKMDYVDDPLKSEFVFINPNSKGECGCGESFMTTSSKGSSS

SEQ ID NO: 32224 - DNA, 505 bp, Panicum virgatum
  misc_feature: Ceres CLONE 1909717
  misc_feature: Encodes the peptide sequence at SEQ ID NO. 32225
ctcctcgctcccctccccacccacacaccccctccctcccgcatgtcaacggccctcccggcggactccgtccccgcccccagctcccgggcctagttacaaacccgcggtcggctccggatcgggcgcggcccgccgctctcgtcatgggcatttcccgtcgcgggtggctctgctcctcggggggggtgtggggaaggctgggtcctctccgcggcggcgggcggcgccgaaaggccaaggaaccgtgtgcttccgccgggtgttcagcttcggggactcgctcacggacaccggcaacttcctgctctccgtgccagaggacttcccggaccccgcgcggaacctcccctacggccagaccttcttcggccgcccatccggacgctactccgacggccgcaacctgctcgacttcttcgcggaagcatttgggattccattcgtgccgccgtaccttggcggtggggacttccaatatggtgcaaactttgcgggtgggcgg

SEQ ID NO: 32225 - protein, 167 aa, Panicum virgatum
  misc_feature: Ceres CLONE 1909717
  misc_feature: SWISSPROT Homolog: EC 3.2.1.51 Alpha-L-fucosidase
SSLPSPPTHPLPPACQRPSRRTPSPPPAPGPSYKPAVGSGSGAARRSRHGHFPSRVALLLGGGVGKAGSSPRRRAAPKGQGTVCFRRVFSFGDSLTDTGNFLLSVPEDFPDPARNLPYGQTFFGRPSGRYSDGRNLLDFFAEAFGIPFVPPYLGGGDFQYGANFAGG

SEQ ID NO: 32226 - DNA, 746 bp, Panicum virgatum
  misc_feature: Ceres CLONE 1909719
  misc_feature: Encodes the peptide sequence at SEQ ID NO. 32227
tcttccctgccacatagaatcgagctgccttgagcaccactgaaccattggcgttctccgcacagcaaagagagcagagcaagaagccgccggcgatggcttccgccgcgctgccggaggccgtcgagcccaagaagaagggcaacgtccggttcgccttcgcctgcgccatcctcgcctccatgacctccatcctcctcggctatgatatcggagtgatgagcggagcggggatgtacatcaagaaggacctccagatcagcgacgtgaagctggaggtcctgatgggcatcctcaacgtgtactcgctcatcggctccttcgccgcggggcggacgtccgactggatcggccgccgctacaccatcgtcttcgcggcggtcatcttcttcgcgggcgccttcctcatgggcttcgcggtcaactactggatgctcatgttcggccgcttcgtggccggcatcggcgtcggctacgcgctcatgatcgcgcccgtgtacacggccgaggtgtcccccgcgtcggcccgcggcttcctgacctccttcccggaggtgttcatcaacttcggtatcctcctcggctacgtgtccaactacgccttctcccgcctgccgctccgcctcggctggcgcgtcatgctcggcatcggcgcggcgccgtccgtcgtgcttgctctcatggtgctcggcatgcccgagtcgcccccgtggctcatcatgaagggccgcctcgcggatggccag

SEQ ID NO: 32227 - protein, 216 aa, Panicum virgatum
  misc_feature: Ceres CLONE 1909719
  misc_feature (24)..(214): Pfam Name: Sugar_tr Pfam Description: Sugar (and other) transporter
MASAALPEAVEPKKKGNVRFAFACAILASMTSILLGYDIGVMSGAGMYIKKDLQISDVKLEVLMGILNVYSLIGSFAAGRTSDWIGRRYTIVFAAVIFFAGAFLMGFAVNYWMLMFGRFVAGIGVGYALMIAPVYTAEVSPASARGFLTSFPEVFINFGILLGYVSNYAFSRLPLRLGWRVMLGIGAAPSVVLALMVLGMPESPPWLIMKGRLADG

SEQ ID NO: 32228 - DNA, 360 bp, Panicum virgatum
  misc_feature: Ceres CLONE 1909738
  misc_feature: Encodes the peptide sequence at SEQ ID NO. 32229
aagaagagcagcaccaaccagctcttctccagcacaaagccactccaaatcagccggccatcacccacgcctgcttctgatctccgatctctcaagtctcacggcttactagtgcttccgggttcgacccccccccccccccccgcacattagaaataaagtgcaagaacggccgcgtcgccaacggcgactctctgtgcgtggcgacgccgcgcgccgacccgctcaactgggggaaggcggcggaggagctcatgggcagccacctcgacgaggtgaagaggatggtggccgagtaccgccagccgctggtgaagatcgagggcgccagcctcccggatcgcgcaggtgggcgccgtg

SEQ ID NO: 32229 - protein, 35 aa, Panicum virgatum
  misc_feature: Ceres CLONE 1909738
  misc_feature: SWISSPROT Homolog: EC 4.3.1.5 Phenylalanine ammonia-lyase
  misc_feature: Useful for making plants with altered cell wall content and/or composition
  misc_feature: Useful for making plants with altered lignin content
MGSHLDEVKRMVAEYRQPLVKIEGASLPDRAGGRR

SEQ ID NO: 32230 - DNA, 734 bp, Panicum virgatum
  misc_feature: Ceres CLONE 1909768
  misc_feature: Encodes the peptide sequence at SEQ ID NO. 32231
acctacctgcctcacctcgccggcggcgacccatcagccgtcgtccgtccgtccctcactcgctgctgccgctgcatcgatcaggccagcatcaagcggatcaatcggagggagaagctatccagctcaacgacgacggagaagatcgaagaagaagaagatcagaaagggatccaccaaagatggggcgcggcaaggtgcagctgaagcggatagagaacaagataaaccggcaggtgaccttctccaagcgccgcaacggcctcctcaagaaggcgaacgagatctccgtcctctgcgacgccgaggtcgccgtcatcgtcttctccccaaaggggaagctttacgaatacgccaccgacgaccgcatggacaaaattcttgaacgttacgagtgctattcctatgctgaaaaggctctaatttcagctgaacctgagagtgaggtaaattggtgccacgaatacaggaaactgaaggccaaaattgggactatacaaaaatgccacaagcacctaatgggagaggatctagagtctctgaatctcaaagagctccaacaactagagcagcagctggagagctcactgaagcacatcagatcaagaaagagccaccttatggtcgagtccatttctgagctacagaagaaggagagatcactgcaggaggagaactaggctctacagaaggatcttgcggacaggcagaaggcggccgccagcaggcagcag

SEQ ID NO: 32231 - protein, 165 aa, Panicum virgatum
  misc_feature: Ceres CLONE 1909768
  misc_feature (75)..(165): Pfam Name: K-box Pfam Description: K-box region
  misc_feature (9)..(59): Pfam Name: SRF-TF Pfam Description: SRF-type transcription factor (DNA-binding and dimerisation domain)
  misc_feature: The sequence is a functional homolog of SEQ ID NO 6 in US patent 7279615
  misc_feature: Useful for making plants with modulated biomass
  misc_feature: Useful for making plants with modulated flowering time
  misc_feature: Useful for making plants with modulated phosphate use efficiency
  misc_feature: The sequence is a functional homolog of SEQ ID NO 2 in US patent 7273968
  misc_feature: Useful for making plants with altered alkaloid content
  misc_feature: The sequence is a functional homolog of SEQ ID NO 1360 in the 10/666,642 US patent application
  misc_feature: The sequence is a functional homolog of SEQ ID NO 22 in the 10/666,642 US patent application
  misc_feature: The sequence is a functional homolog of SEQ ID NO 730 in the 10/666,642 US patent application
  misc_feature: The sequence is a functional homolog of SEQ ID NO 46 in the 10/666,642 US patent application
  misc_feature: The sequence is a functional homolog of SEQ ID NO 4 in US patent 7057087
  misc_feature: The sequence is a functional homolog of SEQ ID NO 428 in the 10/666,642 US patent application
  misc_feature: The sequence is a functional homolog of SEQ ID NO 892 in the 11/435,388 US patent application
  misc_feature: The sequence is a functional homolog of SEQ ID NO 707 in the 10/666,642 US patent application
  misc_feature: The sequence is a functional homolog of SEQ ID NO 30 in the 10/666,642 US patent application
  misc_feature: The sequence is a functional homolog of SEQ ID NO 36 in the 10/666,642 US patent application
  misc_feature: The sequence is a functional homolog of SEQ ID NO 60 in the 10/412,699 US patent application
  misc_feature: The sequence is a functional homolog of SEQ ID NO 1362 in the 10/666,642 US patent application
  misc_feature: The sequence is a functional homolog of SEQ ID NO 199 in the 11/479,226 US patent application
  misc_feature: The sequence is a functional homolog of SEQ ID NO 34 in the 10/666,642 US patent application
  misc_feature: The sequence is a functional homolog of SEQ ID NO 58 in the 10/412,699 US patent application
  misc_feature: Useful for making plants with altered terpenoid content
  misc_feature: The sequence is a functional homolog of SEQ ID NO 1368 in the 10/666,642 US patent application
  misc_feature: The sequence is a functional homolog of SEQ ID NO 422 in the 11/435,388 US patent application
  misc_feature: The sequence is a functional homolog of SEQ ID NO 203 in the 11/479,226 US patent application
  misc_feature: The sequence is a functional homolog of SEQ ID NO 40 in the 10/666,642 US patent application
  misc_feature: Useful for biocontainment applications
  misc_feature: Useful for making plants with altered lignin content
  misc_feature: The sequence is a functional homolog of SEQ ID NO 1955 in the 10/412,699 US patent application
  misc_feature: The sequence is a functional homolog of SEQ ID NO 1949 in the 10/412,699 US patent application
  misc_feature: The sequence is a functional homolog of SEQ ID NO 1963 in the 10/412,699 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: The sequence is a functional homolog of SEQ ID NO 1965 in the 10/412,699 US patent application
  misc_feature: The sequence is a functional homolog of SEQ ID NO 1967 in the 10/412,699 US patent application
MGRGKVQLKRIENKINRQVTFSKRRNGLLKKANEISVLCDAEVAVIVFSPKGKLYEYATDDRMDKILERYECYSYAEKALISAEPESEVNWCHEYRKLKAKIGTIQKCHKHLMGEDLESLNLKELQQLEQQLESSLKHIRSRKSHLMVESISELQKKERSLQEEN

SEQ ID NO: 32232 - DNA, 714 bp, Panicum virgatum
  misc_feature: Ceres CLONE 1909770
  misc_feature: Encodes the peptide sequence at SEQ ID NO. 32233
gcgtctggcgtcgtcgccccgaccgtgctccgccactggaccgagccaccaaattccttcccatttcgaattagccaaaccggaggagattccccgtccacgcctcgccgaaccctagccccggcgatctcgcatggccacccacccgcgatctctccacgccctgctcggcggcggcgcagtcgccgacgtgctgctgtggcggcggaggaacgcctcggcggcggccgtggtgggcgccacggcggtctggttcgtcttcgagcgcgcgggctacagcctcccctcggtcctggccaacgccctgctcctcctcgtcgccatcctcttcttctgggccaagtccgcgtcgctgctcaacaggcctcttccacctcttcctaatctagaggtttcagatgtggttgttgagaaagctgcagatcgtgctcttgtatggatcaatagagtgcttgctgttggccaggatattgccatcaagagagataggaaaacttttataagggtgatattgatactgtgggtggtttcatatgttggaatgctcttcaacttccttacgctcatttacattggggtaatgctttctctgttggttccaccactgtatgagaagtaccaggatcatgttgatgaaaagctcggtgtagcgcacagtgtactatcaaggcacatagataccatcattaccagggcggggcaagccaagcagag

SEQ ID NO: 32233 - protein, 193 aa, Panicum virgatum
  misc_feature: Ceres CLONE 1909770
  misc_feature (17)..(192): Pfam Name: Reticulon Pfam Description: Reticulon
MATHPRSLHALLGGGAVADVLLWRRRNASAAAVVGATAVWFVFERAGYSLPSVLANALLLLVAILFFWAKSASLLNRPLPPLPNLEVSDVVVEKAADRALVWINRVLAVGQDIAIKRDRKTFIRVILILWVVSYVGMLFNFLTLIYIGVMLSLLVPPLYEKYQDHVDEKLGVAHSVLSRHIDTIITRAGQAKQ

SEQ ID NO: 32234 - DNA, 1027 bp, Panicum virgatum
  misc_feature: Ceres CLONE 1909792
  misc_feature: Encodes the peptide sequence at SEQ ID NO. 32235
cggtccgccccctcgcagccgccgtccgccgaatcgccggggtggggctttcgaggcgcgagcggaaggaagccatgtcgcggtggcgtgcggccgcctgccgcatctccgccgccgcatcatcccggaacgccacggcggagtcccgcgtcctctccagggcctgcgcgaaatctccgactgtgccgccgctgccgccgcctccgctccaaaccctctcgagaaccttctccaagtccgccgccgccgccaccaccgccaccgccacatcacgcggccctggcgcagccgccccagcttccgccgggccgcggcccgaggtcagactgaattctatgtttctgtccaagccctgttcattagcgttgccacctgactcccctcttagagcagtagatccacagtatgaaggcatcaagcgtttcatgctcacactgttgttgttctacagcaagcaaagcaaggccattagaggagcaaatgttgtttatgatcgaatcacttctcaagttgattctcctgctatttatgatgtttttcagttggagaaaacatttaaaacaacattttcattgcttgtcctccatatgtggcttgttctacgccgcttgaaggaagaagggaaggatggtgttaaatttggacagtacatctatgaaatgtacaaccacgatgtggagctcagagtttcaaaagctggggttaacttgctcttgacaaaatggatgaaagagctagagaaaatattctatggaaacattgtgaagtacgatgctgcgataagcccagaggctcgtcaggatgatcttgtaaacgtcatctggagaaatatttatgctgacgaaggttcagaggctatggatgcggctgctgcccctgctgtccaggcattggcaagatacacacgaagggaggcaacttgtctatcattgactgacaaagatgctatgttctctggaaacttcaagttcacaaccctgctgccaccaactcccagtcccagcccaaagaaacctgcacgatgaac

SEQ ID NO: 32235 - protein, 316 aa, Panicum virgatum
  misc_feature: Ceres CLONE 1909792
  misc_feature (153)..(307): Pfam Name: Ubiq_cyt_C_chap Pfam Description: Ubiquinol-cytochrome C chaperone
MSRWRAAACRISAAASSRNATAESRVLSRACAKSPTVPPLPPPPLQTLSRTFSKSAAAATTATATSRGPGAAAPASAGPRPEVRLNSMFLSKPCSLALPPDSPLRAVDPQYEGIKRFMLTLLLFYSKQSKAIRGANVVYDRITSQVDSPAIYDVFQLEKTFKTTFSLLVLHMWLVLRRLKEEGKDGVKFGQYIYEMYNHDVELRVSKAGVNLLLTKWMKELEKIFYGNIVKYDAAISPEARQDDLVNVIWRNIYADEGSEAMDAAAAPAVQALARYTRREATCLSLTDKDAMFSGNFKFTTLLPPTPSPSPKKPAR

SEQ ID NO: 32236 - DNA, 189 bp, Panicum virgatum
  misc_feature: Ceres CLONE 1909792-R
ccccccccccccccccccccttctttagcaatccttttccctggctgttttggacttgatcatcattccaatgggaggtgtagagaagtaaccctacagatgtgctatctaaatatgtactagtgatggctgccgtggttgcttggatgatctgggaaaataatgcaatcaggcttatctgaagttgtc

SEQ ID NO: 32237 - DNA, 1859 bp, Panicum virgatum
  misc_feature: Ceres CLONE 1909799
  misc_feature: Encodes the peptide sequence at SEQ ID NO. 32238
tttataaaccgcggctcgtgccattggcagcagacagactgcctttactcccgcccgtgtccctcgctgtctgcccgcgccgagccctcccctcggccgccggcctcaccccgcgccgctgttaatggaaacggcgcggcgtttccgttccgcccgctgccccctcccctcctcctctcgcgccgtctcgtcttccccgcgactgctcgcagctcctccgctcttctcctccgcctgcagatagagcgggtgcgtggttggcctggaagcgtacgtcacggtggtgatagtctcagcttgcggctatgctgaggtgcggggagacggtggccgaggaggaggaggacgacgagtacgccaagttggtccggtggatgaacccgccgagagttgtgatagacaatgactcgtgcgacaacgcaaccgtcatccgggttgatagggtcaagaagcatggcattttactggaagcagttcaagtccttgtcgatctcaaccttgtcatcaccaaggcgtacatttcttcggatggcaactggttcatggatgtgttcaatgtgaccgatcagcacgggagtaagcttcagaatagggaggtcattgaccatattcagaaatgcctggaatcagaagactacctcaagttgccggcgatcgggccgacggacggagctgagccaccagaagacgagtccacctctattgagctgaccggcaccgaccggcctggcctcctatccgaggtgtgcgccgtgctcgcctccctgagctgcaacatcgtcaaggccgaggtgtggacgcacaacaggcgcgcagccgcggtgatccagatcaccgacgaggcctccgggctcgccatccacgacgcagcccggctgtccaaggtgcaggagcttctctgcaacgtgatgcagggcgacggcgcgagcagccgcggcagcacgcgcacgggcgtgacattgggcacggcgcgcgcggagaggcgcctgcataaactgatgctcgacgacggcggcggtggtgaggaagctgtcggcggcgaggatcgccgcggcatggcgaggcccaaggccgcggccaaggtcgcggtgatggactgcgcgaagaggcggtacacggtggtgatcctgcggtacagggaccggccgaagctgctgttcgacacgctgtgcgcgctcacggacctgcagtacgtcgtgttccacggcaccgtcgacgccgagcggcggagcagggaggcctaccaagagtactacgtacggcacgtcgacggccacccggcgcgctccgacgccgagcggagccgcctcgtccgctgcctcgaggctgccgtcgagcggcgcgcgtccgacgtagggctggagctggagatgaggacggaggacagggtggggctcctgtcggaggtcacgcgcgtgttccgggagaacagcctctccatcatccgcgcggcgatcgcgaccagggacggcagggcggaggacacgttctacgtgtcggacgcgtacggcaaccccgtcgacggccggaccatggacgcggtgggcgggcagctcggggacgccgtgctgcgggtgaagcgccgcggcggcgacgcgccggcggctgagggcggcgccgtgtccgtcctgggcagcctgctcaagggctccttccaggggctcaggctgatcaggtcctactcgtaatccaaggattctgattagttacacgacccggcagggctttgtacatacaaatctgacgtaggttagggaataatgaagcagcagggcatggctcctgcattgtacatttgcacaggaagtcacatcattaccagcaccactgtgaattaacaatacaattctacaggtcag

SEQ ID NO: 32238 - protein, 460 aa, Panicum virgatum
  misc_feature: Ceres CLONE 1909799
  misc_feature (131)..(203): Pfam Name: ACT Pfam Description: ACT domain
  misc_feature (352)..(418): Pfam Name: ACT Pfam Description: ACT domain
  misc_feature: SWISSPROT Homolog: EC 2.7.7.59 [Protein-PII] uridylyltransferase
MLRCGETVAEEEEDDEYAKLVRWMNPPRVVIDNDSCDNATVIRVDRVKKHGILLEAVQVLVDLNLVITKAYISSDGNWFMDVFNVTDQHGSKLQNREVIDHIQKCLESEDYLKLPAIGPTDGAEPPEDESTSIELTGTDRPGLLSEVCAVLASLSCNIVKAEVWTHNRRAAAVIQITDEASGLAIHDAARLSKVQELLCNVMQGDGASSRGSTRTGVTLGTARAERRLHKLMLDDGGGGEEAVGGEDRRGMARPKAAAKVAVMDCAKRRYTVVILRYRDRPKLLFDTLCALTDLQYVVFHGTVDAERRSREAYQEYYVRHVDGHPARSDAERSRLVRCLEAAVERRASDVGLELEMRTEDRVGLLSEVTRVFRENSLSIIRAAIATRDGRAEDTFYVSDAYGNPVDGRTMDAVGGQLGDAVLRVKRRGGDAPAAEGGAVSVLGSLLKGSFQGLRLIRSYS

SEQ ID NO: 32239 - DNA, 506 bp, Panicum virgatum
  misc_feature: Ceres CLONE 1909824
  misc_feature: Encodes the peptide sequence at SEQ ID NO. 32240
cagctccgtaggcagcgagcgtctcccctctgccccccgcacgaagagagagcgagatcgccgtctctcttcgtcggtggtgcgggtgcccgccctccccgaacgagatctccctgccgttcctcgagatctggctacggatctcgctgtcatgatggagaagatctgctgcttcggtgctggctatgtcggtggcccggccgtggccgtcgttgccctcaagtgcccagactttgaggtggtcgtctttgacctctccgctccccgcattgaggcctggaacaatgacaccctccccatctccgagcctggtctcgatgatgttgtgaagcatggcatgggattgagcctcttcttcagcagtgatgttgagaagcacgtcgctgaagctgacatcatctttgtctcggtgaacacccccacctccactcgtggtcttggagctggtcaggctgccgacctcacctactgggagagcgctgctcgcatgatcgctgatgtctcca

SEQ ID NO: 32240 - protein, 117 aa, Panicum virgatum
  misc_feature: Ceres CLONE 1909824
  misc_feature (2)..(117): Pfam Name: UDPG_MGDP_dh_N Pfam Description: UDP-glucose/GDP-mannose dehydrogenase family, NAD binding domain
  misc_feature: SWISSPROT Homolog: EC 1.1.1.22 UDP-glucose 6-dehydrogenase
  misc_feature: Useful for making plants with altered carbohydrate content
  misc_feature: Useful for making plants with altered cell wall content and/or composition
MEKICCFGAGYVGGPAVAVVALKCPDFEVVVFDLSAPRIEAWNNDTLPISEPGLDDVVKHGMGLSLFFSSDVEKHVAEADIIFVSVNTPTSTRGLGAGQAADLTYWESAARMIADVS

SEQ ID NO: 32241 - DNA, 1224 bp, Panicum virgatum
  misc_feature: Ceres CLONE 1909842
  misc_feature: Encodes the peptide sequence at SEQ ID NO. 32242
cccccccgccacaccacacccacccacgccttccccataggccatctgcctccttcctcggcagatctgccgccgccgcccccagggcccgcgcccctccacgcccgcactaccgcaagccaccggccccgcccccaccgtcgacctagccctcgtcgcgacgacaccgcagctcatcggctccgtcgccgaggccatcggcggagaggactgcaccgccgacctccctgaggagctcctcgcctcatcttcggcctgcttgactttaatggggggcgatggcgtcttcctctcccgtccccgtcggccgcgagcggagcggcccagctgctgctgctactgctgctgcagagtcagagctgccctgaagcttctcgcctccccctcccacttccccttctcgtctgggctggaattccactccaccaccgccgcccgccgcccctctgctcgcaagcagcttgactgcttcagcacaagacccatctattcctttgaggatcgcatcgcatcggatcggatcggatttctcagatcagatcaacctcttccctctccggccgattctactccatcaagtccagtccagctgatatcacacccaatatggcggcaaatgtcggggaatcgacaagcggcaacagcagttgtgctaccttttgcaaagtacctgtaggaaatgctgacggtgaggatatctagcctcttatctgtgacaatggaactggaatggtcaaggctgggttggccggtgatgatgcaccaagggcttttttccctagcattgttggccgcccttgccgcactggtgtgatggtagggatggggcagaaggatgcatacgttggggacgactctagggactgcccccttcctcgacgtcggcttccactgctacgagaacggccgccccgacacgtccccaagtggcgctggcagctgacgtgctgcgatctccacaggtgggttggttctgatttgctgcttgttgcttctaagcaacttttttattacagacaggcattaatatgatgttagataggaaataatttgctattagttaggcaaagtactatctcaaaaaggggacaacaaggagggcagaaatgacggctgaattggtttgctattaacttttttttgtttgcgcattagcactttgtatagatatgagtttgtttgtgttgatcgtcatcgttgattaagtagattgtggcagcgatc

SEQ ID NO: 32242 - protein, 100 aa, Panicum virgatum
  misc_feature: Ceres CLONE 1909842
  misc_feature: SWISSPROT Homolog: EC 2.7.10.2 Non-specific protein-tyrosine kinase
MVKAGLAGDDAPRAFFPSIVGRPCRTGVMVGMGQKDAYVGDDSRDCPLPRRRLPLLRERPPRHVPKWRWQLTCCDLHRWVGSDLLLVASKQLFYYRQALI

SEQ ID NO: 32243 - DNA, 1285 bp, Panicum virgatum
  misc_feature: Ceres CLONE 1909850
  misc_feature: Encodes the peptide sequence at SEQ ID NO. 32244
ggattgggatccctcccgaagctagcttcgcaagcgggcgcgccgccgatgccagctcttgccactctccccctcccccgccgcccatccgactcccgacggcgcggccgcctgctccttttcctcatcgtccttgtcgccgtctccgccgccgcagccctcgcctacctctccttcccctccgccgcgctgacacctcccccggcagcgtcttccactgtgcgggccgatgccgattgctgcagaggtatccaggggctcgagctctggggtccggcggtcaagtggggctctaaccaccgcctgccctccgccgccgcctgctgcgcctcctgcaaggcgatgtgcccccacgccgaggacggcgcctgccgctgcaactcgtgggtcttctgcggggacgaacgcagatgcaaggacaggctcggggagtgctggctgaagaaacaaaaggacgtgatggctcctgctgttattgcaaggggggaggacgtcatgtggacttctggtctagtctttggaaaaggagagggaattttggggcttgaaacaaatcttgggacacttcatattcaattgctgcctggttgcgcaccgcgttctgtggactacttcatcgacctcttgggcttgcacagctgtgctgggtgcagattttatcgtgcggaaggacgcgggaatgtctgggatgcagaaggcaatcatgaaaaaaatgctgcatttggtcccccgtatgcattgcttcaagggacactggaagttgatggtgtgcctttcaacggtatagcaagagaagcatacccggcagtaaaaagagggtccattgcctgggttggatcagggcctgagttcctgatcagcttagcaaaccatgacgagtggaaggacacctacactgtgtttggccacgtgctgcctgaggacatggcgatagccgaggagatggcactgctgccagcgagcacggacgtgtggagcaatgtaacggtgaaggtgctgagagatcctgtctacttcaaggtgaagaggagcagccatgctagttttgtctaggtgagaggcatatttcattcatcaagtgtcggggcatggctccaattctgcctccaaaactctagctggaagctctggttggagttggagttggagctggctggatggggtgtttgcatggtgggtgcccctggctccagaagagtgtgttttgagcgtgcattgtcctattttttgcccctagttttattgagctgtaacatacccagttaacgtggaaccgcattctggc

SEQ ID NO: 32244 - protein, 334 aa, Panicum virgatum
  misc_feature: Ceres CLONE 1909850
  misc_feature: SWISSPROT Homolog: EC 5.2.1.8 Peptidylprolyl isomerase
MPALATLPLPRRPSDSRRRGRLLLFLIVLVAVSAAAALAYLSFPSAALTPPPAASSTVRADADCCRGIQGLELWGPAVKWGSNHRLPSAAACCASCKAMCPHAEDGACRCNSWVFCGDERRCKDRLGECWLKKQKDVMAPAVIARGEDVMWTSGLVFGKGEGILGLETNLGTLHIQLLPGCAPRSVDYFIDLLGLHSCAGCRFYRAEGRGNVWDAEGNHEKNAAFGPPYALLQGTLEVDGVPFNGIAREAYPAVKRGSIAWVGSGPEFLISLANHDEWKDTYTVFGHVLPEDMAIAEEMALLPASTDVWSNVTVKVLRDPVYFKVKRSSHASFV

SEQ ID NO: 32245 - DNA, 1382 bp, Panicum virgatum
  misc_feature: Ceres CLONE 1909855
  misc_feature: Encodes the peptide sequence at SEQ ID NO. 32246
tttctcgggcggcggcggccatggacaaggatgtgctgggcggcgtggacggcctctccctgatgctccagatccgtgacagtctgagaatgtacaattccctggtggagaggtgcttcagggactgcgtggacactttcctccgcaagactctgggcaagcaagaggagtcatgtgtccacggttgcgccgagaagttcatgaagcactccatgagggttggcatgaggttcgctgagattaaccagggcgtggccacacctgactaatcgtgtcaattttgttgcccctgccaagattctaaccgtggagattttgtcagcttcgatttgtggtcctaaaaaggttttagcacttcttgagatctgcacctcagttaggtttcctcttgaacaaactgctgggtatgaaaatgggtaaaattaccttgaaccaactcggtatccattcatgcttgagtaacttgctaactgctgagaagagtttgggttcatgtttcacacacttgaatcagcagatttttagccacttaagtgcataatatggttgctatagccagatattgtttggaatgttgcaagatctgtaaaggcaacttatttctttccctctcataaggcatctgccttctttgacagcaaaggatgctggaccatgcacatgagctcatcatgccatgaactgatgcacttggaattggaatttgtgatgcaaaagggggcatgatccagcacatgtattgtgttctggggtgctacatgtatcgaccatcggatcgcgccgtcaatggctcagatcaagctgccgaccccagttgccattggagaggaccgagaggttcacaatggtttggacgtgatcacctttggcatctcatggagcttggccatgggcaatttgggcaggttggcccgcggccaccgtgtgcccactacccgctgtgtgactgtacaagttggcgtgttgttttctcatgtggagccagcagggcggacagcggcatgatccatggcgaaggtgcagggcagatttccaatctctcatttggagctgcatggcatggcatggcgtgtcggtgactcggtgctgtggcactgtggcctgccctactgaatgaagctgctgcttgttctgatgtgtgtgtgatccagagttcacagttcagcatcgtcagtagattcagtagtcagtacttgtgctggcatttaagattggaacatgctgggtcatgatttgcccagtgtccttttgagcttgcatctttgagctctctgtacttttttggctcctcgatcaccagtttagttttggcatcaagattcacagttgtcataaactagaatcccattcccatggctgtaaagtgcagcttatcttgaggc

SEQ ID NO: 32246 - protein, 82 aa, Panicum virgatum
  misc_feature: Ceres CLONE 1909855
  misc_feature (9)..(74): Pfam Name: zf-Tim10_DDP Pfam Description: Tim10/DDP family zinc finger
MDKDVLGGVDGLSLMLQIRDSLRMYNSLVERCFRDCVDTFLRKTLGKQEESCVHGCAEKFMKHSMRVGMRFAEINQGVATPD

SEQ ID NO: 32247 - DNA, 1573 bp, Panicum virgatum
  misc_feature: Ceres CLONE 1909885
  misc_feature: Encodes the peptide sequence at SEQ ID NO. 32248
gttcttcctccgtcctcttctccctccctctgctctgcaaagcttccagaaacgagggggaggagccgggccgctccgaatgctctgatctccgctcggcgggttctcctccctcccctcctccatggcgcgcgtcctcccgctcagcatcgagccgggggagacggccagaggcaaagaggtggtgacagacacaccaaattcttcagctggggcatcatgcgcggcagttgatcattctgagcaaaacacaaaggatgatgagtatgcgaggctagttacacgagctcaacatgcaacatctgatctcagtgccacaattttacctgagcaaccaaagtcaagatctttcatttggtggatgaaagttctgcttggctgttttcttcttatattagtgggatacatctttgtgaaatggggagtcccctttgcctttgagaaggttctcttgccaatcatgcagtgggaagcaagtgcttttgggcgtccagtattggctgttgttcttgttgcatctttggccctctttccagttattctagtcccatctggaccttctatgtggttagcaggaatgatctttggttactgttggggtttcttaattataatggtcggaactactattggcatggtggtaccatattggattggctcattgttccgtgaacgtctacatgtatggttaacaaaatggcctcagcagatagcactaataaaacttgctggtgaagggaattggttccagcagtttcgagtggttgcgcttttcagaatctcaccattcccgtatacaatttttaactatgccgtcactgtcacagaaattaagttcaacccttatctatggggttcaattgctggaatggtaccagaggcattcatctacatctacagtggacggttaatccgtacattagctgacatgaagtatggcaactataaaatgaccccggtggagataacatacaacgtcatctccttcatcatcgccatcgtcctcacagtcgccttcacggtgtacgccaagagagctctaaatgaaataaagagttcagaaggtatctgtaaagaagttgtctccagccctgccggcccaggtgcaggaatgaaacaccatcaggagctggatgttgtatgagtgtatttcaccgagagagtagatacaatatcgactgagaggaggcaggtaggtcgtaggtgtagggttttacaccaatagagctaggtaggctacagcagcaggttaaatgaataacacgcacgcagctccagccgacggcctgacgtttactcgaatcatttcgtgtgctttattgtctgcacggccatacttgaattgagccgaaggtgcagtggtgctgagtgatgacccagcgatggtgtggcaggatgctgttgcctgttggcagtgtgttggtggcatgtagagtgtagtgtgtagatgcctcctgaagcacggccttgcagcgagcctaccactgcggttctgtggacattggaaacattgtgcacttgtaactccttgaacgaatagcactcgatgagtgtgtttctattgatatagcag

SEQ ID NO: 32248 - protein, 339 aa, Panicum virgatum
  misc_feature: Ceres CLONE 1909885
  misc_feature (141)..(262): Pfam Name: SNARE_assoc Pfam Description: SNARE associated Golgi protein
MARVLPLSIEPGETARGKEVVTDTPNSSAGASCAAVDHSEQNTKDDEYARLVTRAQHATSDLSATILPEQPKSRSFIWWMKVLLGCFLLILVGYIFVKWGVPFAFEKVLLPIMQWEASAFGRPVLAVVLVASLALFPVILVPSGPSMWLAGMIFGYCWGFLIIMVGTTIGMVVPYWIGSLFRERLHVWLTKWPQQIALIKLAGEGNWFQQFRVVALFRISPFPYTIFNYAVTVTEIKFNPYLWGSIAGMVPEAFIYIYSGRLIRTLADMKYGNYKMTPVEITYNVISFIIAIVLTVAFTVYAKRALNEIKSSEGICKEVVSSPAGPGAGMKHHQELDVV

SEQ ID NO: 32249 - DNA, 763 bp, Panicum virgatum
  misc_feature: Ceres CLONE 1909896
  misc_feature: Encodes the peptide sequence at SEQ ID NO. 32250
accgccgcggccgggaagcaagctcaaaccctaaccgccggcgacgccagcacgatggcccgctacgaccgcgcgatcaccgtcttctcccccgacggccacctcttccaggtcgagtacgccctcgaggccgtccgcaaggggaacgccgccgtcggcgtccgcggcaccgacaccgtcgtcctcggcgtcgagaagaagtccaccccaaagctccaggactccaggtccgtgcgcaagatcgccagcctcgacacccacatcgcgctggcgtgcgcggggctcaaggcggacgcgcgcgtgctcatcaaccgcgcgcgggtcgagtgccagagccaccggctcaccgtcgaggaccccgtcaccgtcgagtacatcacacgctacatcgccggcctgcagcagaagtacacgcagagtggtggagtgcgccccttcgggctctccactctcatcgtcggcttcgacccctacaccgacaagccggccctgtaccagaccgacccatccggtaccttttctgcctggaaggccaacgccacggggaggaactccaactccatgagggagttcctcgagaagaactacaaggagacctctggcaaggagactatcaagctcgccatccgtgcacttctagaggttgttgaaagtggtgggaagaacatcgaggttgcagtgatgacaaagaaggacggtctccgtgaacttgaggaggctgagattgatgaatacgttgctgagattgaggcagagaaggctg

SEQ ID NO: 32250 - protein, 236 aa, Panicum virgatum
  misc_feature: Ceres CLONE 1909896
  misc_feature (27)..(210): Pfam Name: Proteasome Pfam Description: Proteasome A-type and B-type
  misc_feature: SWISSPROT Homolog: EC 3.4.25.1 Proteasome endopeptidase complex
MARYDRAITVFSPDGHLFQVEYALEAVRKGNAAVGVRGTDTVVLGVEKKSTPKLQDSRSVRKIASLDTHIALACAGLKADARVLINRARVECQSHRLTVEDPVTVEYITRYIAGLQQKYTQSGGVRPFGLSTLIVGFDPYTDKPALYQTDPSGTFSAWKANATGRNSNSMREFLEKNYKETSGKETIKLAIRALLEVVESGGKNIEVAVMTKKDGLRELEEAEIDEYVAEIEAEKA

SEQ ID NO: 32251 - DNA, 1445 bp, Panicum virgatum
  misc_feature: Ceres CLONE 1909902
  misc_feature: Encodes the peptide sequence at SEQ ID NO. 32252
atggacactccgtgtctctctccctcacgtcactggaaccctatccggcggcggcggcggcggcggcggcagcaggagccagggagcggtggcggctggccgccgggcacgcaggctgcaagcggctttgtcttgctggtgggcaggcttggcgagcgcatggtgcgaggagggcacggggcaactaaccagcggccgccggcgggcggcgggtcggagccgaagccagccgcggctgccgcgcggggagacgagagcggagcgccggggcggcctgcagcagtgcggcactgcgacaccgggcaaaggcgcacggcgaccgcggcaccgcagcaggcagctcgcgcgcagcctctgctcaaaattggacaattctaagcttatggatttgccaggtccgagatggaagaaaggcaaggacggcaaggactttgccgctctcgcagcagccaatcccatgtccacgatacttgccaagctccaggcttctttgagagacgcacaagccgtggccgttttatcaggggatgccaaagatgcgattcttgcagttggagaagaccaagccgtgcttctgaaccgtgcggcccttggccgggctgtggaaaatgcggcagatgagaagctatggttccagctgggccccgaggagacgttcttcctttgccatgccctcaggtgcatcacagttcaatcggaggagaataagcagcagatgggtgaaggggagctgtgggatctcttgacctccacctcagagccattcccggagatgtacaaggcgtatcaacaccttagattgaagaattgggttgtaaagtcaggattgcagtacggtgcagattttgttgcttaccgtcaccatccagcacttgttcactcggagtttgcagtaatcgtagttccagaaggcaaaatatttggtgctcgatgtggccgcatgaaggtgtggcctgatctactctgcgcgcttcgagcttctggaagtgtggccaagacattacttattctaaccatcagcaccaacaactgcgaggtgagatcgtctgattgtttggaacagatgattgttcatgagaggatcatcaacagatggataccgcagcagtgccgtgagcaacaaaacaaaccgcgcagagaagaagcccacacggatgagcaaagacaaaaacagtgcagagaagaagcaattagggaagaacaagaggatacaagagagggtgtagtatttagctattggggtgtaatactaagctttacaattctctttctagcttacttgtctacaaactcaaactttgactgaagagcttaatatttatgtatgttcatgttggtaaacgtgaattctgtcctattgaatcctatgatgctacttcgtgagccttgttgaggtttctagatgtcctggctaataataccatcatatgactgcacttcactgc

SEQ ID NO: 32252 - protein, 307 aa, Panicum virgatum
  misc_feature: Ceres CLONE 1909902
  misc_feature (128)..(220): Pfam Name: tRNA_int_endo Pfam Description: tRNA intron endonuclease, catalytic C-terminal domain
  misc_feature: SWISSPROT Homolog: EC 3.1.27.9 tRNA-intron endonuclease
MDLPGPRWKKGKDGKDFAALAAANPMSTILAKLQASLRDAQAVAVLSGDAKDAILAVGEDQAVLLNRAALGRAVENAADEKLWFQLGPEETFFLCHALRCITVQSEENKQQMGEGELWDLLTSTSEPFPEMYKAYQHLRLKNWVVKSGLQYGADFVAYRHHPALVHSEFAVIVVPEGKIFGARCGRMKVWPDLLCALRASGSVAKTLLILTISTNNCEVRSSDCLEQMIVHERIINRWIPQQCREQQNKPRREEAHTDEQRQKQCREEAIREEQEDTREGVVFSYWGVILSFTILFLAYLSTNSNFD

SEQ ID NO: 32253 - DNA, 1247 bp, Panicum virgatum
  misc_feature: Ceres CLONE 1909904
  misc_feature: Encodes the peptide sequence at SEQ ID NO. 32254
aaactgccctcccctccgattctccggttcccttatcctctcccatggccgccagcctcgcgctccaactgcgcctcgcgccgtcgtcgtcggcgccgctgagcctccaccgccgccggcgcggagccggaatcctcacctgccgcgccacagccacgttccaccaactcgacgccgtcggtgagttctccgggggggggggggttgtgttgtgtgcggctcgagatctggctttgagttgcgggtgtgatgggacctcggccggcgcagcggtgagggaggaggaggcaaagttcaagtcctcggccaaggagggatgcaacctgctgccgttgaagcggtgcatcttctccgaccacctgacgccggtgctcgcataccggtgcctcgtcaaggaggacgaccgcgaggcgcccagcttcctcttcgagtccgtcgagcagggctccgagggcaccaatgtggggaggtacagtgtcgtaggggcgcagcccgccatggagatcgtggccaaggccaaccacgtgacggtgatggatcatgagatgaagtcgaggagggagcatttcgtgcctgatccgatgaatatccccaggagcattatggagcagtggagcccacatataaccgacggcctacctgatgcattttctggaggatgggttggattcttctcatatgatacagtgcgttatgttgaaacaaagaagcttccatttagtaaggcaccacatgatgataggaaccttcctgacattcatttaggcctctacaatgatgtcattgtgtttgaccatgttgagaagaaaacacatgttatacattgggtgagggtggactgctataattctgttgatgaagcatatgaagatggaacaaatcgactagaatctctgttatcaagattacattctcttaatatcccaacactttcttctggttctattaaacttaatgttgggcacttcggctcagcattacaaaaatcatcaatgtcatgtgaagaatataagcatgctgttgttcaagcaaaagaacatattctggctggtgatatttttcaagtagtcctaagccagcgttttgagagacggacattcgctgacccctttgagatctaccgtgcattgcgcattgtaaaatctagtccatatatggcctatctacaggcacgaaggtgtattcttgtggcatcaagtcctgaaaatctcactcgggtgcaaaagaagacaatcatcaatcgacca

SEQ ID NO: 32254 - protein, 400 aa, Panicum virgatum
  misc_feature: Ceres CLONE 1909904
  misc_feature (97)..(258): Pfam Name: Anth_synt_I_N Pfam Description: Anthranilate synthase component I, N terminal region
  misc_feature (318)..(398): Pfam Name: Chorismate_bind Pfam Description: chorismate binding enzyme
  misc_feature: SWISSPROT Homolog: EC 4.1.3.27 Anthranilate synthase
MAASLALQLRLAPSSSAPLSLHRRRRGAGILTCRATATFHQLDAVGEFSGGGGVVLCAARDLALSCGCDGTSAGAAVREEEAKFKSSAKEGCNLLPLKRCIFSDHLTPVLAYRCLVKEDDREAPSFLFESVEQGSEGTNVGRYSVVGAQPAMEIVAKANHVTVMDHEMKSRREHFVPDPMNIPRSIMEQWSPHITDGLPDAFSGGWVGFFSYDTVRYVETKKLPFSKAPHDDRNLPDIHLGLYNDVIVFDHVEKKTHVIHWVRVDCYNSVDEAYEDGTNRLESLLSRLHSLNIPTLSSGSIKLNVGHFGSALQKSSMSCEEYKHAVVQAKEHILAGDIFQVVLSQRFERRTFADPFEIYRALRIVKSSPYMAYLQARRCILVASSPENLTRVQKKTIINR

SEQ ID NO: 32255 - DNA, 602 bp, Panicum virgatum
  misc_feature: Ceres CLONE 1909904-R
  misc_feature: Encodes the peptide sequence at SEQ ID NO. 32256
tgaatattgaacgatattcacatgtcatgcacattagctcaacagtaactggggagctacgtgatgatcttacctgttgggacgcgcttcgtgcagcgttgcctgttggaacagttagtggcgctcctaaggtgagagcaatggagctgatcgacgagctggaagtgaatatgcgtgggccgtacagtggtggctttggagggatttcgttctgtggtgacatggacattgctcttgctcttcgcactatcgtcttccccaccggatctcggttcgacaccatgtactcatacactgatggaaacccgcgccaggagtgggtggctcatctccaggccggagctgggatagtggctgacagcaaaccagatgacgagcaccaggagtgcctcaacaaggcagctggcgctgcccgtgccattgaccttgccgaatctacatttctagacgagtagcctagtctccgtgtggcacatgtttgtttctaatttctatgtaaatgctgaccgtagcagaaaccttagcttcctggctatgaagctctaggattatgctgttctgaataaaactcttgtgtaataaagttataataaatgttaagc

SEQ ID NO: 32256 - protein, 150 aa, Panicum virgatum
  misc_feature: Ceres CLONE 1909904-R
  misc_feature (1)..(140): Pfam Name: Chorismate_bind Pfam Description: chorismate binding enzyme
  misc_feature: SWISSPROT Homolog: EC 4.1.3.27 Anthranilate synthase
NIERYSHVMHISSTVTGELRDDLTCWDALRAALPVGTVSGAPKVRAMELIDELEVNMRGPYSGGFGGISFCGDMDIALALRTIVFPTGSRFDTMYSYTDGNPRQEWVAHLQAGAGIVADSKPDDEHQECLNKAAGAARAIDLAESTFLDE

SEQ ID NO: 32257 - DNA, 707 bp, Panicum virgatum
  misc_feature: Ceres CLONE 1909917
  misc_feature: Encodes the peptide sequence at SEQ ID NO. 32258
accctgtccaacagcagcaggaggacgacgagggaaggagggacggggaggggcgaagaaaacccaggccaatcgcaccccgagctcacgccgatccacctcccgcattgcctccaagcctctcgattcggccggacccgtgccaccccgcccgccggagggctcgatctgggcccagatcggcctgcatttgcaggctccggttccggcggtgagggatggggaacgtggacggcgagtacggcgagttccatgcagccaatcggcgtgctgaggtgatagattggcttggtgggttgctgccggagttcgacttgccattggattcttcagatgaggagctgcgggagtacctcatcgacggtaccgcgctatgctacattgcggagaagctcatgcctgatgttcaggagggaatgtggggtggtaatgcatcagaccagaggtcgaatgtgaagaaattcctctctgttgtcgcggagatggggctaccaggattcagcgtcaaggatctggaggagggatcggtgtcttctgtagtggagtgtctcttggcactaaaggataatgtgactacgggatcaagtcaaaacatttcaaacaatgttaagacaccccttagaaggagactggaacttcgagaatccgatgggcctataaattcggttgtgatgccagggaaaagatctcccatggaggagagacag

SEQ ID NO: 32258 - protein, 162 aa, Panicum virgatum
  misc_feature: Ceres CLONE 1909917
  misc_feature (15)..(119): Pfam Name: CH Pfam Description: Calponin homology (CH) domain
MGNVDGEYGEFHAANRRAEVIDWLGGLLPEFDLPLDSSDEELREYLIDGTALCYIAEKLMPDVQEGMWGGNASDQRSNVKKFLSVVAEMGLPGFSVKDLEEGSVSSVVECLLALKDNVTTGSSQNISNNVKTPLRRRLELRESDGPINSVVMPGKRSPMEER

SEQ ID NO: 32259 - DNA, 692 bp, Panicum virgatum
  misc_feature: Ceres CLONE 1909919
  misc_feature: Encodes the peptide sequence at SEQ ID NO. 32260
acacacggctctctccccgccccgcgcgcgcacccgtggtcgcctcgccgcgcgctctgctcggacgcggacgggcgggcgggagcgtctcccgggagtccaccggccttccgctgccccggcgagcggcgtcctcggctcctcgccaccgccgcgaggaccagcttcccaccggcacgggggaaaggaaggaaccaccaaaccggcggcggcgacgcgcgtccggatggattccgggtcggagcagcagcacggctgcgagcattacaggcgcgggtgtcgggtcgtggcgccctgctgcggcgaggtcttcggctgccgccattgccacaacgacgccaagaactcgctcgaggtcgacccgcgcgaccggcacgagatccctcgtcacgaaataaacaaggtgatctgcacacactgctccaaagaacaggatgtgcaacagaattgttctaactgtggtgcctgcatgggggaatacttctgtgaaatatgcaaattctttgacgatgatttatcaaagggccaataccactgtgatggatgtggcatatgcagaactggtggtgcagataacttctttcactgcgacaaatgcgggtgttgctacagcaacgtcttgaaggattctcaccgctgcgtggaaagagcaatgcatcacaactgccctgtctgctttgagtatctgttcg

SEQ ID NO: 32260 - protein, 155 aa, Panicum virgatum
  misc_feature: Ceres CLONE 1909919
  misc_feature (11)..(94): Pfam Name: zf-CHY Pfam Description: CHY zinc finger
MDSGSEQQHGCEHYRRGCRVVAPCCGEVFGCRHCHNDAKNSLEVDPRDRHEIPRHEINKVICTHCSKEQDVQQNCSNCGACMGEYFCEICKFFDDDLSKGQYHCDGCGICRTGGADNFFHCDKCGCCYSNVLKDSHRCVERAMHHNCPVCFEYLF

SEQ ID NO: 32261 - DNA, 724 bp, Panicum virgatum
  misc_feature: Ceres CLONE 1909923
  misc_feature: Encodes the peptide sequence at SEQ ID NO. 32262
acggagcgaagcgaagcgcggcgcggggcagtgcagtgcagcgcgacccctcctcggaacagccgcggagcagagccgcgcgcgcgtgcgtgtgcttgcccccaccccacacgccacacccctcgtctctccagccatggcggcccgccgcgggtgcttccccctggtcgccgtgctgctcgcgctgctctgccgcgccgaggcggcggtgagggagctcaaggtcgggtactacgccgagacgtgcccggaggccgagggggtcgtccgggaggtcatggcgcgggcgcgcgcccgcgaggcccgcagcgtcgcctccgtcatgcgcctccagttccacgactgcttcgtcaacgggtgcgacgggtcggtgctgatggacgccacgcccacgatgatcggcgagaaggacgccctgtccaacatcaactccctgcgctcgttcgaggtcgtcgacgagatcaaggaggcgctggaggagcgctgccccggcgtcgtctcctgcgccgacatcgtcgtcatggccgcccgcgacgccgtcttcctgaccggtgggcccacctgggaggtgcggctcgggcgcgaggacagcctgacggcgagccaggaggactcgtacagcatcatgccgagcccgcgcgccaacgccagcgcgctcatccgcctcttcgccgggctcaacctcagcgtcaccaacctcgtcgcgctcctcggctcccactcc

SEQ ID NO: 32262 - protein, 195 aa, Panicum virgatum
  misc_feature: Ceres CLONE 1909923
  misc_feature (44)..(195): Pfam Name: peroxidase Pfam Description: Peroxidase
  misc_feature: SWISSPROT Homolog: EC 1.11.1.7 Peroxidase
  misc_feature: Useful for making plants with altered cell wall content and/or composition
  misc_feature: Useful for making plants with altered carbohydrate content
MAARRGCFPLVAVLLALLCRAEAAVRELKVGYYAETCPEAEGVVREVMARARAREARSVASVMRLQFHDCFVNGCDGSVLMDATPTMIGEKDALSNINSLRSFEVVDEIKEALEERCPGVVSCADIVVMAARDAVFLTGGPTWEVRLGREDSLTASQEDSYSIMPSPRANASALIRLFAGLNLSVTNLVALLGSH

SEQ ID NO: 32263 - DNA, 1274 bp, Panicum virgatum
  misc_feature: Ceres CLONE 1909952
  misc_feature: Encodes the peptide sequence at SEQ ID NO. 32264
acagcaaacgcgaagccagggcagcgagccagatctcgcctgcccgccgcggccgtgacagccaccgtcaccagatcggacgaggcgccggagctccaggagtccaccgcggagcaggagtggcagcagatcccgagagcaggagcagtgggtagccgccaaggcaagaaggaggcggcgaggatgctgccgacgaccgcgtccaaggggcgcgggcccgcccgctccgccccgccgctcttcggcccctacctccgccgcatcgtcaagtggcaacaaatggatattgaatacacattttggcaaatggttcatctctgtacttcaccaaaagtagtctatcagcacaccaaatatcacaagcaaacaaagaaccagtgggctcgggatgatcctgcatttgttgtcatcctgattcttttcctcgtgttcgcaacatcagcttactgtgcagcgtatggagagagtgcctcacatgctgctctaacaatcacttcggttgtgttcttccatttcttgtttgctgggatagttttggccacactttgctggtttcttacaaattcttacttgagagaggaacctaacagccatgttgttgagcaacgtgtggagtggctctatgcatttgatgttcactgtaactcgttctttcctgcatttgtcatcctatatgtgcttcaatattttctgtcacctctgttggtcgcgcatggcttctttccagcacttttatcgaatctactctttgtggtggcaatttcttattatcactacctgaactttctaggatatgatgttcttccatttttggacagaacaacattctttctgtacccgattggtcttgtcatcatcctatctccacttatgatactaatagggttcaatccgacaagatactttctaagcttgtacttcggctaaggctgacagctatattgctgagtacaagaaaaatatggtgacagaactaatggcagatttggacacatactttctgaagtagtagcagtttagatctcttgtgtgaactgggggtgagcgaggttcagaaaagctcggagcattctttggatgtatcagctgcctgcggcaggccagcatagaagagaagagccttttgattgatatctatatccctttttggtgtcaacttgttcataatatgagctgttttctttggtttgggccagtgaccagtgtataattctagtgggaattacagtgttgtactatcacattggcagcatgattgcacgtatcacgctttg

SEQ ID NO: 32264 - protein, 247 aa, Panicum virgatum
  misc_feature: Ceres CLONE 1909952
  misc_feature (17)..(247): Pfam Name: UNC-50 Pfam Description: UNC-50 family
MLPTTASKGRGPARSAPPLFGPYLRRIVKWQQMDIEYTFWQMVHLCTSPKVVYQHTKYHKQTKNQWARDDPAFVVILILFLVFATSAYCAAYGESASHAALTITSVVFFHFLFAGIVLATLCWFLTNSYLREEPNSHVVEQRVEWLYAFDVHCNSFFPAFVILYVLQYFLSPLLVAHGFFPALLSNLLFVVAISYYHYLNFLGYDVLPFLDRTTFFLYPIGLVIILSPLMILIGFNPTRYFLSLYFG

SEQ ID NO: 32265 - DNA, 1157 bp, Panicum virgatum
  misc_feature: Ceres CLONE 1909953
  misc_feature: Encodes the peptide sequence at SEQ ID NO. 32266
ctcgccctcccctccctcctctctcgaccttcttcgttcggcgacgacaggggagtggcgccgccagttcttcgtcgggcgcttcccggcggccaagagaatctcggtggttttagctgaactcgcgtcccctgctatgcacccagttcagtctcattgcaccctttcactgcaactccggcaagcgtacttatcccaaggaacgcagctgtgaggaattccatcaattttgccgagttggggagagctggaaggtccagtggaaaccttgctatgaattccatacagaatcctgcccgtgggtcagaaacgttcggaactgaggatttcactgtgggggataaggatgccgtggtcattgtcgaccatgggtcacggcgccaagaatccaatctcatgctaaatgactttgtcgatatgttcagggcacgaactggttataagatcgttgagcctgctcatatggagctggctgagcctactattaaggatgcttttggaaaatgtgtgcaacaaggggcatcccgtgttattgttagtccatatttcctttcccctggacgacactggaaacaagatatccctgctttagcagcagaagcatccaaggagctctcaaatataccctacatcatcactgcccctcttggattgcatgagcttatggtggatatcatgaatgaccgcatcaagtactgcctgcaacacgttgcaggtgatgtcgatgagtgtaaagtatgtgctggaactggaaagtgccgcctctactcctgatggtgattacctgggaggctgggaggccacagttctctttatgagtatatgactgtccatactgcatcttgtaatctgaatagctgtcagtggcatttcaatgccagctttttttttctctgttttaccatttagaaggtctgggccaatatttttttctcttgtaagagatctgacgagtgtatatccaggtcccttatgtcccgttcaaccaaaattaccattgtaagggcatgtacaatggttagacggctgccgtctgtgtgtgtctagaatactgcacgcgacagagtagataacctgtacaatggtgtgtctttgtggttgtctgctagttatttaatacatgactaggcacatgaaacatgataatcaaacatgtg

SEQ ID NO: 32266 - protein, 166 aa, Panicum virgatum
  misc_feature: Ceres CLONE 1909953
  misc_feature (32)..(137): Pfam Name: CbiX Pfam Description: CbiX
  misc_feature: SWISSPROT Homolog: EC 4.99.1.3 Sirohydrochlorin cobaltochelatase
MNSIQNPARGSETFGTEDFTVGDKDAVVIVDHGSRRQESNLMLNDFVDMFRARTGYKIVEPAHMELAEPTIKDAFGKCVQQGASRVIVSPYFLSPGRHWKQDIPALAAEASKELSNIPYIITAPLGLHELMVDIMNDRIKYCLQHVAGDVDECKVCAGTGKCRLYS

SEQ ID NO: 32267 - DNA, 721 bp, Panicum virgatum
  misc_feature: Ceres CLONE 1909967
  misc_feature: Encodes the peptide sequence at SEQ ID NO. 32268
agtcccagagaagctgccactgccaccagcactcgagcagcgagagctatcggccatggggagcgtgctggaggaggtcgccctgggcttcggcggcctggcgggggacctgagggaggtgtacgagagcggcaggacccgggacctggagtggcgccgctcgcagctccggggcctcctcaggctgctcgaggacaaggaggagggcatcttcgacgtgctccgcgcggacctcggcaagcaccgcgccgagtccttccgagacgaggctcacgcgccgctggttgccttcccggcgaccgcgctggtggtgccggagccgctcggggtcgtgctcatcttctcctgctggaacctcccaataggcctggccctggagccgctctccggagccttggcggccggcaacgccgtggtggtgaagccgtccgagctcgcgccgtgcacctccgcgttcctggcggcgaacatcccaaagtacctggaccccaaggccgtgaaggtcgtcgagggcggcgcggacgtcggggacaggctcatggagcacagatgggacaaggtcctcttcaccggcagcagccgtgtcgggcgcctcatcatgaccaaggccgccaagcacctgaccccggtggcgctcgagctcggctccaagtgcccgtgcatcgtcgaccggctcgatagcagcagggacagcccagtagctgtgaaccgcataattggg

SEQ ID NO: 32268 - protein, 221 aa, Panicum virgatum
  misc_feature: Ceres CLONE 1909967
  misc_feature (5)..(221): Pfam Name: Aldedh Pfam Description: Aldehyde dehydrogenase family
  misc_feature: SWISSPROT Homolog: EC 1.2.1.3 Aldehyde dehydrogenase (NAD(+))
MGSVLEEVALGFGGLAGDLREVYESGRTRDLEWRRSQLRGLLRLLEDKEEGIFDVLRADLGKHRAESFRDEAHAPLVAFPATALVVPEPLGVVLIFSCWNLPIGLALEPLSGALAAGNAVVVKPSELAPCTSAFLAANIPKYLDPKAVKVVEGGADVGDRLMEHRWDKVLFTGSSRVGRLIMTKAAKHLTPVALELGSKCPCIVDRLDSSRDSPVAVNRII

SEQ ID NO: 32269 - DNA, 1286 bp, Panicum virgatum
  misc_feature: Ceres CLONE 1909974
  misc_feature: Encodes the peptide sequence at SEQ ID NO. 32270
ggctgtcggcagtgctcccgtggctagagggaaagcctcaagctgtcgtctcgtctgtcgtcaacgttccacagccacaagccgaagcggcggccggtggttccgcgcttggacgtcgccgcagcaacaccaccagacagactcgttgccagttgccatggagggccttgctgctcctgcatcctgaactaatcgatctgatctccccagattccttcatctctgaagctttcgtcgtcaatggcggcgcgcggcggcgcgctctgcttctcatcctcgtccgccgccgccgtcacgtgcagcaggaacagcaggagggcgggtggctgcaggccgcgtttcttggttgtcagctgcgacgccaggctgcccctggccgcgaagctactgggtcctcccacgaccttcaacgcggcgaagctcaaggtggagttcgccggggaggaactgctgtggggcaagaagcaggctttccccagagcctacaccctgacccactgcgacctgacggccaacctaacgctcgccgtgaccgggcccatgaccagcgagcagctgcggagctggcagtcgacgctgcagcgggacgacgtggtggccgagtggaaggaggcggccgccggcgccggggagatgacgctgcacgtgcattgcttcgtcagcggcgccaacctcctgcaggagctggcggcggggttcagatactacgtcttctccaaggagctgccgctggtcctcaaggctgtggttcacggcgacgcggcgctcttctcggagcggccggagctgatggaggccaaggtgtgggtgcacttccactccagctcccgcaagtacaaccggatggagtgttgggggcctctcagggaggccaccaagaggaacctgctggatggaaggctggacgaactgcagagcgcaatcaccaggagcaggaggcgacgcaagtgggcgagcccagagacgatcttcaacgccctggtggcacttctgctttgacaatgctactggatgctgatactggcatgtgcattcttcaattcctaccacataaaaaagaatcggtggttggttgatctccagcactgcactgcactgctctgctctgctctgcttgacaccccagttgccatttgcaacccttcttcaggtcaggactggtgattgcttggcttgctgctccagtccagtagtatttgtcaacatcaagtttcgcaagcgaatcctgtagtaatgtacaataccaagaaattcagcaatggaagcaatataatgattcatcattc

SEQ ID NO: 32270 - protein, 252 aa, Panicum virgatum
  misc_feature: Ceres CLONE 1909974
  misc_feature: Useful for making plants with modulated time to senescence
  misc_feature: Useful for making plants with modulated abscission
MAARGGALCFSSSSAAAVTCSRNSRRAGGCRPRFLVVSCDARLPLAAKLLGPPTTFNAAKLKVEFAGEELLWGKKQAFPRAYTLTHCDLTANLTLAVTGPMTSEQLRSWQSTLQRDDVVAEWKEAAAGAGEMTLHVHCFVSGANLLQELAAGFRYYVFSKELPLVLKAVVHGDAALFSERPELMEAKVWVHFHSSSRKYNRMECWGPLREATKRNLLDGRLDELQSAITRSRRRRKWASPETIFNALVALLL

SEQ ID NO: 32271 - DNA, 1191 bp, Panicum virgatum
  misc_feature: Ceres CLONE 1909980
  misc_feature: Encodes the peptide sequence at SEQ ID NO. 32272
accaagcacacaagttcagacactactccaaggagcgagctaccaagtgcagcagcagtgtgttcagtgttcctacactttggcactcggtgctctctagtctctacgagccgatgacgggacagacggagattccggtgatcgacctcgccggcctcaccgccggcggcgaggagaggtcgcgcaccatggcgcgcctccacgaggcctgcagggactggggcttcttctgggtggactgggaggccacctacttcatccagcaccgcccccggaacaccaccgccgacttcccggagatctcgccgccggccagggcggcgctggacgcgtacgtcgcccaggtggtgtccctcgcggagcgcctggccgagtgcgtgggcctcaacctgggcctccccgccggccacgtcgccgccgcattcgcgccgccgttcgtgggcaccaagttcgccatgtacccgccctgcccgcgcccgggccgcgtgtggggcctgcgcgcgcacaccgacgccggcggcatcatcctgctcctccaggacgacgccgtgggcgggctcgagttcctccggggcggagccgagtgggtccccgtggggcccaccaggggcgcccgcctcttcgtcaacatcggggaccaggtcgaggtcgtcagcggcggggcctaccggagcgtcgtgcaccgcgtcgcggcggggagcgaggggcggcggctgtccgtggccacgttctacaaccccgggcccgacgccgtggtggcgccggcggtgaggggggacgacgacgcggcggcggcggcctcctacccggggccctacaggttcggggactacctcgagtactaccagggcaccaagttcggcgacaaggacgccaggttccaggccgtcaagaagctgctcggttgagccaccaggcagagcttggagatcccgcgtttcgattcttggcgctgttgcttgttgatgattgatgatccatggcttgcgttggggttgcattgcgtgtttgctttagcaaatctttttacgtgatggttagtaattattaattgtacgcattcggcggttgactaatggtgccgcatgctttcggtcgacgtgctgtggctggtggctggtgctaatctgttgtgagagaaaagtattgctggctggttggcggctgctggctgatgatggtttggtgtcg

SEQ ID NO: 32272 - protein, 264 aa, Panicum virgatum
  misc_feature: Ceres CLONE 1909980
  misc_feature (107)..(209): Pfam Name: 2OG-FeII_Oxy Pfam Description: 2OG-Fe(II) oxygenase superfamily
  misc_feature (29)..(262): SWISSPROT Homolog: EC 1.14.17.4 Aminocyclopropanecarboxylate oxidase
  misc_feature (1)..(40): SWISSPROT Homolog: EC 1.21.3.1 Isopenicillin-N synthase
MTGQTEIPVIDLAGLTAGGEERSRTMARLHEACRDWGFFWVDWEATYFIQHRPRNTTADFPEISPPARAALDAYVAQVVSLAERLAECVGLNLGLPAGHVAAAFAPPFVGTKFAMYPPCPRPGRVWGLRAHTDAGGIILLLQDDAVGGLEFLRGGAEWVPVGPTRGARLFVNIGDQVEVVSGGAYRSVVHRVAAGSEGRRLSVATFYNPGPDAVVAPAVRGDDDAAAAASYPGPYRFGDYLEYYQGTKFGDKDARFQAVKKLLG

SEQ ID NO: 32273 - DNA, 726 bp, Panicum virgatum
  misc_feature: Ceres CLONE 1909985
  misc_feature: Encodes the peptide sequence at SEQ ID NO. 32274
agaagacaagcaaaacaaccaagatggccaggccgtcgccgtcgccgtcgctgctcgtcctcgcggccgtcgccgccgccgccgcctgcctcgcgcagcccggcgcggcggccctgaaggtggactactacgcgagcacctgccccaacgtggaggccatcgtgcgtggcgtggtgcagcagaagatacaggccaccatccggaccaccggttccaccatccgcctcttcttccatgactgcttcgtcgagggttgcgacgggtcggtgctgatcgagtcgacgccgggcaaccaggccgagaaggacgcctccgacaacaagtccctggcgttcgagggcttcgacacggtgcggagcgccaaggccgccgtcgaggccgcctgccccggcaccgtctcctgcgccgacgtgctcgccctcgccacccgtgacgccatcgccatgagtggcgggcccttcttcccaatggagctgggcaggctggacgggctgagctccacggccagcagcgtgccggggcagctgccggagccgaaccagaccatggaccagctgctcgcggtgttcaaggcccacgggctcaacatgtcggacctcgtggcgctctcggcggcgcacagcgtggggctggcgcactgcagcaagttctcggaccggctgtacaaccaccggccggggcagccgacggacccgacgctgagccccaggtacgcgcggttcctgg

SEQ ID NO: 32274 - protein, 234 aa, Panicum virgatum
  misc_feature: Ceres CLONE 1909985
  misc_feature (47)..(234): Pfam Name: peroxidase Pfam Description: Peroxidase
  misc_feature: SWISSPROT Homolog: EC 1.11.1.7 Peroxidase
  misc_feature: Useful for making plants with altered carbohydrate content
  misc_feature: Useful for making plants with altered cell wall content and/or composition
MARPSPSPSLLVLAAVAAAAACLAQPGAAALKVDYYASTCPNVEAIVRGVVQQKIQATIRTTGSTIRLFFHDCFVEGCDGSVLIESTPGNQAEKDASDNKSLAFEGFDTVRSAKAAVEAACPGTVSCADVLALATRDAIAMSGGPFFPMELGRLDGLSSTASSVPGQLPEPNQTMDQLLAVFKAHGLNMSDLVALSAAHSVGLAHCSKFSDRLYNHRPGQPTDPTLSPRYARFL

SEQ ID NO: 32275 - DNA, 230 bp, Panicum virgatum
  misc_feature: Ceres CLONE 1909986
  misc_feature: Encodes the peptide sequence at SEQ ID NO. 32276
gaagagagggttctaagagctcaagactcaggcttactcataagaaggcggacatgcgccagacgctaaaggccggccaatgcctcatgtacatggggttcgcctgtcgcgagtccctgtgctgcccctcggtgacactgggcctgcagcccggagagggcttcaccatctgcaacatcgccgctatgatcccgctgtaataaaacaacaaataagcgagcatcggcgac

SEQ ID NO: 32276 - protein, 65 aa, Panicum virgatum
  misc_feature: Ceres CLONE 1909986
  misc_feature: SWISSPROT Homolog: EC 4.2.1.1 Carbonate dehydratase
REGSKSSRLRLTHKKADMRQTLKAGQCLMYMGFACRESLCCPSVTLGLQPGEGFTICNIAAMIPL

SEQ ID NO: 32277 - DNA, 1739 bp, Panicum virgatum
  misc_feature: Ceres CLONE 1910009
  misc_feature: Encodes the peptide sequence at SEQ ID NO. 32278
tgacttgccccctccttcccctcccctccgctcccaattttttttgcggcgggagaggagagagacacacacagcgcgtagaaaccggcggcggcgggcggtagcggcgatgaggatcgaggaggtgcagtcgacgtcgaagaagcagcgcatcgccacccacacccacatcaagggcctcggcctcgacgccaatgggttggcgcttgcgatggcgtcggggttcgtggggcaggtgggggcgcgggaggcgtgcggcctgatagtcgacatgatacgccagaagaagatggctggccgcgcgctgctccttgcgggcccgcccgccacgggaaagacggcgctcgcgctcggcgtctcccaggagctcggcagcaaggtccctttctgccctatggtaggatcggaagtgtactccacagaggtcaagaaaactgaggtgctgatggaaaattttcgtagagctataggtctgcgtataaaggaaaacaaagaggtttatgaaggagaggttactgaactttccccggaagaggctgagagtacaacaggtggatacgcaaaaagcattagccatgtaatcataggtctaaagactgttaaagggactaagcaactgaaattagatccttcaatttatgatgctttaatcaaagaaaaggtggccgtgggtgatgttatatacattgaagcaaatagtggtgctgtgaaaagagttggtagatgtgattcttttgctacagaatatgatcttgaagctgaggagtatgttccaatccccaaaggcgaagtccataagaaaaaggaaatagtacaggatgtcacacttcatgacctggatgctgcaaatgctcagccacaaggaggtcaagatattttatcacttatgggccaaatgatgaagccgcggaagactgaaatcaccgacaaactacgccaagaaattaataaggtggtaaacagatatatcgatgaaggaattgcagagcttgtgcctggtgttttgttcattgatgaggtccacatgttggacattgaatgcttttcttatctgaatcgtgcactggagagcccattatcaccgattgtgatacttgctacgaataggggaatatgtaatgtgagaggtactgatatgacaagtccacatggtataccagttgaccttctagataggctggtgattattcgaacagaaacatatggccctactgagatgatccagatactagctatccgagcacaagtggaagagattgatattgatgaagagagtcttgcttatttaggagagatcggacaacagacttctttgagacatgctattcagctgctgtcacctgccagtgtggttgcaaagactaatggaagagagaagatctgcaaggctgatcttgaggaagttagcggactctatttggacgccaaatcgtctgctcgtctgctccaggagcaacaagaaagatacatcacttagatttctcatgttgtagatgtcctcgaacgtagttgtcgactttagtcttgtacactgcatcggtctggttcacaggtgcagagtcttcgagagcacatttgagggataatgatttttgtactggctgctttggacttcgtagtctccagcgaagactcgattccggcatattgcttgtttacatactgttggcagattagattggtgcaagaattgtcgtgtatttttacccttgctaacaatgcccagattccgtgtgctc

SEQ ID NO: 32278 - protein, 455 aa, Panicum virgatum
  misc_feature: Ceres CLONE 1910009
  misc_feature (117)..(439): Pfam Name: TIP49 Pfam Description: TIP49 C-terminus
MRIEEVQSTSKKQRIATHTHIKGLGLDANGLALAMASGFVGQVGAREACGLIVDMIRQKKMAGRALLLAGPPATGKTALALGVSQELGSKVPFCPMVGSEVYSTEVKKTEVLMENFRRAIGLRIKENKEVYEGEVTELSPEEAESTTGGYAKSISHVIIGLKTVKGTKQLKLDPSIYDALIKEKVAVGDVIYIEANSGAVKRVGRCDSFATEYDLEAEEYVPIPKGEVHKKKEIVQDVTLHDLDAANAQPQGGQDILSLMGQMMKPRKTEITDKLRQEINKVVNRYIDEGIAELVPGVLFIDEVHMLDIECFSYLNRALESPLSPIVILATNRGICNVRGTDMTSPHGIPVDLLDRLVIIRTETYGPTEMIQILAIRAQVEEIDIDEESLAYLGEIGQQTSLRHAIQLLSPASVVAKTNGREKICKADLEEVSGLYLDAKSSARLLQEQQERYIT

SEQ ID NO: 32279 - DNA, 1111 bp, Panicum virgatum
  misc_feature: Ceres CLONE 1910010
  misc_feature: Encodes the peptide sequence at SEQ ID NO. 32280
cacgctcggcggcaagggcgccgccctatcgccggccgccgtctacgcgctttccctcggcctcgcgtcacccgccatcgacgcctccgctctgaagtcgctctccacccgcgccccctcgccgcaggagacccccgcctccctcggcgccgccctggcagccctggcgccggccgagtcgcgcgctgcggcggcggtgctgctgaacaagctcctcctcaccgcgtccgactccgcctccgcgctcatcaccgccgccacggccacccgcctcgcggagtcgctcgacgtcgccgcggcgctgccgctgggatcccgggacgaggccgcggtggcggcggcctccgcacccgtggccgtcgcgcttgcggccctgatcgactcctgcgccgcgccgctagcccgcgtggccgacgccgtcgccgcgctgtcctgcgaggccgcgcgcggggacgccgcggcattcgacgttcctgcctccggcgacgggctctccgccaaggacgaggccgacgtggcagccgacatcatgatgctcgtcttcggctccaagctcgtcggcagcgccggaggcgcccccgccccagctgccgccacgttcgccaaggtgcccaccgtgaacgggatcttccgcgaggcggtgcgtgcgctgcacgcgagggtgcggatcgagctcaacgccccggtgaagctggggaagagggatgccggcgaaacaggtgcaggaaaggaggaggcattggtggtgctggccacgcagctcgcgagagcagtgcaggcattgtgcaagctgagcatttctcgggcaaggctctgcgcagagagcattgctgatgccgaccttcgagaaaagcttaccaatggcgtcagcattgatgatttgaaggggatgcttgacagggctttgattgattcagatgcagtgtcagtcctgaaaggggtgtacaaccacttgctcaagttcagggacttccttgcgtgggaggcagctgtggccatggcggtgattgaaggggacagttcaattgagaagccccaagctggtgttgagaatgaagtgggcagttcagctgagaagccacaggctggtggtgagaaagggaagggcgac

SEQ ID NO: 32280 - protein, 369 aa, Panicum virgatum
  misc_feature: Ceres CLONE 1910010
  misc_feature: SWISSPROT Homolog: EC 6.1.1.21 Histidine--tRNA ligase
TLGGKGAALSPAAVYALSLGLASPAIDASALKSLSTRAPSPQETPASLGAALAALAPAESRAAAAVLLNKLLLTASDSASALITAATATRLAESLDVAAALPLGSRDEAAVAAASAPVAVALAALIDSCAAPLARVADAVAALSCEAARGDAAAFDVPASGDGLSAKDEADVAADIMMLVFGSKLVGSAGGAPAPAAATFAKVPTVNGIFREAVRALHARVRIELNAPVKLGKRDAGETGAGKEEALVVLATQLARAVQALCKLSISRARLCAESIADADLREKLTNGVSIDDLKGMLDRALIDSDAVSVLKGVYNHLLKFRDFLAWEAAVAMAVIEGDSSIEKPQAGVENEVGSSAEKPQAGGEKGKG

SEQ ID NO: 32281 - DNA, 1793 bp, Panicum virgatum
  misc_feature: Ceres CLONE 1910015
  misc_feature: Encodes the peptide sequence at SEQ ID NO. 32282
gagagatgccgcgccgcgacagcgacggccgcgcacagacaacgctacctcgccgtcgcagcggagacggggggtcgcgcgagttgtgataggcagcggcacacgccgccacaggcctcggctcgccgccaccggcagtagaaaacaagccggcagcagcgcccggccgcccgcctgaggcggggaaaaaacgggccaccgccgccaccacctccgctcgcggctagcctagcctcctccgactccacaacaatataagctagctagccctctccggtgaacgccatcggcgaagttacggacgcgcggtggccgccatggatgcctccaggtagcttaaccatagctttgctagctgggaggacgacggcaacggcgacaagagctacctactagctcgagtctcttctccgtccattcctgacctaggaagcagctagccagctcgccgcggcgtttcttgggtgtagatgacggttggtagcggcgtcgacatggaggccggcggcggcgcggcggcgggcgggtcctccgacggcgaggcgcggtgcggcgggcggttcgtggaggagtggtgctgcgcctgcgcggggctcctcgccgggcccaacccgatgatggcgcggtacctgtacrcgctcatcttcctcgtcaccaacctcctcgcctggaccctccgcgactacggcaactccgccctcgacgagctccagcgtctcaaggtctgccagggcgcgcgctactgcctgggagccgaaggcgtgctgcggatcatcctcggctgctttctcttcttcttcgtgatgttcctgtccaccgtgaacacgaggaaggtgcatgagtgccggaactcgtggcactcggagtggtggccggccaaggtcgtcctctggctgggcctcacggccgtcaccttcctcgcgccgtcgacgctcgtccagctctacggaaaggtcgcacatttcagagcaggggcgttcctggtgatccagctcatcagcgtgaccaggttcatcatgtggctcaacgactgctgccagtcggagaccacccggaagaaatgccacctgcagattcaggttgtgtccatcgtcacctacgtcgggtcgctgctggggatcgtgctcatgtacgtgtggtacgcgccgagccgggcctgcaagctcaacatcctcttcatcaccgtcacyctggtgctcgtgcagctcatgaccttcgtctccatgagctccaaggtaaaggcagggtatctggcgccggggctgatggggatctacgtcgtgttcctgtgctggtcggcaatcagaagtgagcctcacacggagatctgcaacaagaaggcagcagttgcaacgagtgcggactgggtgaacatcgcgagctttgtgatcgcggtcatagtcatcgtggcggcgaccttctcgaccggaatcgactccaagtgcctccagttcaagaagtcggacggggagtcggaggaggacgacatcccctacgggttcggcttcttccacctggtgttcgccatgggcgccatgtacttcgccatgatcttcgtcggctggaacgcgcaccagacaatggagaagtggacgatcgacgtcgggtgggcgagcacgtgggtgcgcatcggcaacgagtggctagcggtgatcgtgtacagcgaatgcttgcttgcaattgcagtatggatgatgatcgcgcccatcatctggaagacacggcaggtgggatcatcggcggagacatgaactgatgaacaatcaaccactaatgtgacatcagaaagcacc

SEQ ID NO: 32282 - protein, 426 aa, Panicum virgatum
  misc_feature: Ceres CLONE 1910015
  misc_feature (36)..(420): Pfam Name: Serinc Pfam Description: Serine incorporator (Serinc)
  misc_feature (56)..(56): Xaa is any aa, unknown, or other
MTVGSGVDMEAGGGAAAGGSSDGEARCGGRFVEEWCCACAGLLAGPNPMMARYLYXLIFLVTNLLAWTLRDYGNSALDELQRLKVCQGARYCLGAEGVLRIILGCFLFFFVMFLSTVNTRKVHECRNSWHSEWWPAKVVLWLGLTAVTFLAPSTLVQLYGKVAHFRAGAFLVIQLISVTRFIMWLNDCCQSETTRKKCHLQIQVVSIVTYVGSLLGIVLMYVWYAPSRACKLNILFITVTLVLVQLMTFVSMSSKVKAGYLAPGLMGIYVVFLCWSAIRSEPHTEICNKKAAVATSADWVNIASFVIAVIVIVAATFSTGIDSKCLQFKKSDGESEEDDIPYGFGFFHLVFAMGAMYFAMIFVGWNAHQTMEKWTIDVGWASTWVRIGNEWLAVIVYSECLLAIAVWMMIAPIIWKTRQVGSSAET

SEQ ID NO: 32283 - DNA, 713 bp, Panicum virgatum
  misc_feature: Ceres CLONE 1910024
  misc_feature: Encodes the peptide sequence at SEQ ID NO. 32284
acgaagcttgtggagctggtgtgccgtgtgcagcgccggcttgtttggctcggcgcactggtggttgaaggcttgggaggaccggagaagtagagtgtggtctcgccatggagcagcagaagggaggagcggtttctgcgccggcgaccgccgccgccaacgggaccggggagctgatcgggtacgtcgacgtgcacgtgcggagcgcgcgggacatccagaacatctgcatctaccacaagcaggatgtgtacgcgcgggtgtcgctgccgggggacggcgcgccggtggcgtccacgcaggtggtcaacggcggcggccgcaacccggtgtttgaccagtcgctgcgcctcggcgtgcgcgcgggggacgtcgacgctgcgctccgctgcgaggtctggatgctcagccgggtcaagaactaccttcaggaccagctgctggggtttgcgctcgtgccgctcccggaggtcgtcgccgccgacggcggcacgctcgcccgggagttcccgctcaccaccagcgacctcttccagacgccctcggggttcctgcagctcgagctgtcctacatcggggtcgtcccggaggtcgtgcccatctcgccgacgcccaagccggcgctggccgacccggaggaggagccggagactaacgccggcgccggcgcggggagcgggaaggaatacgagaagatcgagttccccgacctg

SEQ ID NO: 32284 - protein, 201 aa, Panicum virgatum
  misc_feature: Ceres CLONE 1910024
  misc_feature (27)..(116): Pfam Name: C2 Pfam Description: C2 domain
  misc_feature: Useful for making plants with modulated biomass
MEQQKGGAVSAPATAAANGTGELIGYVDVHVRSARDIQNICIYHKQDVYARVSLPGDGAPVASTQVVNGGGRNPVFDQSLRLGVRAGDVDAALRCEVWMLSRVKNYLQDQLLGFALVPLPEVVAADGGTLAREFPLTTSDLFQTPSGFLQLELSYIGVVPEVVPISPTPKPALADPEEEPETNAGAGAGSGKEYEKIEFPD

SEQ ID NO: 32285 - DNA, 698 bp, Panicum virgatum
  misc_feature: Ceres CLONE 1910025
  misc_feature: Encodes the peptide sequence at SEQ ID NO. 32286
gtcgccacggaaacagctcacgggcagcgaggatttatctcccggctgccagccagccgccgttcgaaaccggacacacgaggaggggggagacgcggtctcgtctggagcctgggatcgagagcgcccgatccatcatccatccatcaggctgtttgggggattgattgctcgagttcgagtaggagcaggaggaggaagatggcaatggtgttggcggcggcggcggtggggagcgggcgcagggacgcggaggcggagctcaacctgccgccggggttccggttccaccccaccgacgaggagctcgtggtgcactacctctgccggaaggtggcgcggcagcagctgcccgtgcccatcatcgccgaggtcgacctctacaagttcgatccctgggatctcccagagaaggcgctgttcggccgcaaggagtggtacttcttcacgccgcggggccgcaagtaccccaacggctcgcgccccaaccgcgccgccgggagggggtactggaaggccaccggcgccgacaagcccatcacgcccaagggctgcgccagggcggcgggcatcaagaaggcgctggtgttctactccggcaaggcgccccggggcgtcaagaccgactggatcatgcacgagtaccgcctcgccgacgcggaccgcgccccgggcaagaaggggtcccagaagttgga

SEQ ID NO: 32286 - protein, 165 aa, Panicum virgatum
  misc_feature: Ceres CLONE 1910025
  misc_feature (23)..(151): Pfam Name: NAM Pfam Description: No apical meristem (NAM) protein
  misc_feature: The sequence is a functional homolog of SEQ ID NO 853 in the 10/374,780 US patent application
  misc_feature: The sequence is a functional homolog of SEQ ID NO 891 in the 10/374,780 US patent application
  misc_feature: The sequence is a functional homolog of SEQ ID NO 104 in the 10/225,068 US patent application
  misc_feature: The sequence is a functional homolog of SEQ ID NO 2014 in the 10/374,780 US patent application
  misc_feature: The sequence is a functional homolog of SEQ ID NO 22 in the 10/286,264 US patent application
  misc_feature: The sequence is a functional homolog of SEQ ID NO 314 in the 10/412,699 US patent application
  misc_feature: The sequence is a functional homolog of SEQ ID NO 734 in the 11/479,226 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 890 in the 10/374,780 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: Useful for making plants with altered terpenoid content
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: Useful for making plants with modulated water use efficiency
  misc_feature: The sequence is a functional homolog of SEQ ID NO 1157 in the 11/479,226 US patent application
  misc_feature: The sequence is a functional homolog of SEQ ID NO 1416 in the 10/666,642 US patent application
  misc_feature: The sequence is a functional homolog of SEQ ID NO 30 in the 10/286,264 US patent application
  misc_feature: The sequence is a functional homolog of SEQ ID NO 430 in the 11/435,388 US patent application
  misc_feature: The sequence is a functional homolog of SEQ ID NO 518 in the 10/412,699 US patent application
  misc_feature: The sequence is a functional homolog of SEQ ID NO 854 in the 10/374,780 US patent application
  misc_feature: The sequence is a functional homolog of SEQ ID NO 2110 in the 10/374,780 US patent application
  misc_feature: The sequence is a functional homolog of SEQ ID NO 304 in the 10/225,066 US patent application
  misc_feature: The sequence is a functional homolog of SEQ ID NO 954 in the 11/435,388 US patent application
  misc_feature: Useful for making plants with altered cell wall content and/or composition
  misc_feature: Useful for making plants with altered lignin content
  misc_feature: Useful for making plants with modulated light quality response
  misc_feature: The sequence is a functional homolog of SEQ ID NO 851 in the 10/374,780 US patent application
  misc_feature: Useful for making plants with modulated oxidative stress sensitivity
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: Useful for making plants with altered alkaloid content
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: The sequence is a functional homolog of SEQ ID NO 1012 in the 11/435,388 US patent application
  misc_feature: The sequence is a functional homolog of SEQ ID NO 1064 in the 10/225,066 US patent application
  misc_feature: The sequence is a functional homolog of SEQ ID NO 2838 in the 10/374,780 US patent application
  misc_feature: The sequence is a functional homolog of SEQ ID NO 682 in the 11/435,388 US patent application
  misc_feature: The sequence is a functional homolog of SEQ ID NO 612 in the 11/435,388 US patent application
  misc_feature: The sequence is a functional homolog of SEQ ID NO 320 in the 10/374,780 US patent application
  misc_feature: The sequence is a functional homolog of SEQ ID NO 850 in the 10/225,066 US patent application
  misc_feature: The sequence is a functional homolog of SEQ ID NO 2592 in the 10/374,780 US patent application
  misc_feature: The sequence is a functional homolog of SEQ ID NO 288 in the 10/225,066 US patent application
  misc_feature: The sequence is a functional homolog of SEQ ID NO 2472 in the 10/374,780 US patent application
  misc_feature: The sequence is a functional homolog of SEQ ID NO 520 in the 11/435,388 US patent application
  misc_feature: The sequence is a functional homolog of SEQ ID NO 974 in the 10/225,066 US patent application
  misc_feature: The sequence is a functional homolog of SEQ ID NO 2776 in the 10/374,780 US patent application
  misc_feature: The sequence is a functional homolog of SEQ ID NO 416 in the 10/225,066 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 2418 in the 10/374,780 US patent application
  misc_feature: The sequence is a functional homolog of SEQ ID NO 554 in the 10/225,066 US patent application
  misc_feature: The sequence is a functional homolog of SEQ ID NO 68 in the 10/286,264 US patent application
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: The sequence is a functional homolog of SEQ ID NO 476 in the 10/666,642 US patent application
  misc_feature: The sequence is a functional homolog of SEQ ID NO 2 in US patent 7230164
  misc_feature: The sequence is a functional homolog of SEQ ID NO 6 in US patent 7230160
  misc_feature: The sequence is a functional homolog of SEQ ID NO 116 in the 10/225,066 US patent application
  misc_feature: The sequence is a functional homolog of SEQ ID NO 2476 in the 10/374,780 US patent application
  misc_feature: The sequence is a functional homolog of SEQ ID NO 88 in the 11/375,241 US patent application
  misc_feature: The sequence is a functional homolog of SEQ ID NO 852 in the 10/374,780 US patent application
  misc_feature: The sequence is a functional homolog of SEQ ID NO 328 in the 10/374,780 US patent application
  misc_feature: The sequence is a functional homolog of SEQ ID NO 852 in the 10/225,066 US patent application
  misc_feature: Useful for making plants with modulated light quality sensitivity
  misc_feature: The sequence is a functional homolog of SEQ ID NO 492 in the 11/435,388 US patent application
  misc_feature: The sequence is a functional homolog of SEQ ID NO 741 in the 11/479,226 US patent application
  misc_feature: The sequence is a functional homolog of SEQ ID NO 326 in the 10/412,699 US patent application
  misc_feature: The sequence is a functional homolog of SEQ ID NO 760 in the 11/479,226 US patent application
  misc_feature: The sequence is a functional homolog of SEQ ID NO 2840 in the 10/374,780 US patent application
  misc_feature: The sequence is a functional homolog of SEQ ID NO 450 in the 10/225,066 US patent application
  misc_feature: Useful for making plants with modulated nitrogen use efficiency
  misc_feature: Useful for making plants with altered carbohydrate content
  misc_feature: The sequence is a functional homolog of SEQ ID NO 1729 in the 11/479,226 US patent application
  misc_feature: The sequence is a functional homolog of SEQ ID NO 106 in the 10/225,068 US patent application
  misc_feature: The sequence is a functional homolog of SEQ ID NO 2348 in the 10/374,780 US patent application
  misc_feature: The sequence is a functional homolog of SEQ ID NO 340 in the 10/412,699 US patent application
  misc_feature: The sequence is a functional homolog of SEQ ID NO 778 in the 11/479,226 US patent application
  misc_feature: The sequence is a functional homolog of SEQ ID NO 2590 in the 10/374,780 US patent application
  misc_feature: The sequence is a functional homolog of SEQ ID NO 286 in the 10/225,066 US patent application
  misc_feature: Useful for making plants with modulated biomass
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: Useful for biocontainment applications
  misc_feature: The sequence is a functional homolog of SEQ ID NO 2168 in the 10/374,780 US patent application
  misc_feature: The sequence is a functional homolog of SEQ ID NO 370 in the 10/666,642 US patent application
  misc_feature: The sequence is a functional homolog of SEQ ID NO 1196 in the 10/412,699 US patent application
  misc_feature: The sequence is a functional homolog of SEQ ID NO 865 in the 10/374,780 US patent application
  misc_feature: The sequence is a functional homolog of SEQ ID NO 2416 in the 10/374,780 US patent application
  misc_feature: The sequence is a functional homolog of SEQ ID NO 914 in the 10/225,066 US patent application
  misc_feature: The sequence is a functional homolog of SEQ ID NO 310 in the 10/666,642 US patent application
  misc_feature: The sequence is a functional homolog of SEQ ID NO 1270 in the 10/374,780 US patent application
  misc_feature: The sequence is a functional homolog of SEQ ID NO 1423 in the 10/412,699 US patent application
  misc_feature: The sequence is a functional homolog of SEQ ID NO 898 in the 10/666,642 US patent application
  misc_feature: The sequence is a functional homolog of SEQ ID NO 2470 in the 10/374,780 US patent application
  misc_feature: The sequence is a functional homolog of SEQ ID NO 798 in the 10/225,066 US patent application
  misc_feature: The sequence is a functional homolog of SEQ ID NO 162 in the 10/225,068 US patent application
  misc_feature: The sequence is a functional homolog of SEQ ID NO 2414 in the 10/374,780 US patent application
  misc_feature: The sequence is a functional homolog of SEQ ID NO 428 in the 11/435,388 US patent application
  misc_feature: The sequence is a functional homolog of SEQ ID NO 508 in the 10/412,699 US patent application
  misc_feature: The sequence is a functional homolog of SEQ ID NO 728 in the 10/225,066 US patent application
  misc_feature: The sequence is a functional homolog of SEQ ID NO 344 in the 10/666,642 US patent application
  misc_feature: The sequence is a functional homolog of SEQ ID NO 240 in the 10/225,068 US patent application
  misc_feature: The sequence is a functional homolog of SEQ ID NO 368 in the 10/374,780 US patent application
  misc_feature: The sequence is a functional homolog of SEQ ID NO 160 in the 10/666,642 US patent application
  misc_feature: The sequence is a functional homolog of SEQ ID NO 634 in the 10/412,699 US patent application
  misc_feature: The sequence is a functional homolog of SEQ ID NO 638 in the 11/435,388 US patent application
  misc_feature: The sequence is a functional homolog of SEQ ID NO 194 in the 10/374,780 US patent application
  misc_feature: The sequence is a functional homolog of SEQ ID NO 898 in the 10/225,066 US patent application
  misc_feature: The sequence is a functional homolog of SEQ ID NO 1365 in the 11/479,226 US patent application
  misc_feature: The sequence is a functional homolog of SEQ ID NO 2474 in the 10/374,780 US patent application
  misc_feature: The sequence is a functional homolog of SEQ ID NO 744 in the 10/225,066 US patent application
  misc_feature: The sequence is a functional homolog of SEQ ID NO 1198 in the 10/412,699 US patent application
  misc_feature: The sequence is a functional homolog of SEQ ID NO 867 in the 10/374,780 US patent application
  misc_feature: The sequence is a functional homolog of SEQ ID NO 1816 in the 11/479,226 US patent application
  misc_feature: The sequence is a functional homolog of SEQ ID NO 2112 in the 10/374,780 US patent application
  misc_feature: The sequence is a functional homolog of SEQ ID NO 745 in the 11/479,226 US patent application
  misc_feature: The sequence is a functional homolog of SEQ ID NO 854 in the 11/435,388 US patent application
  misc_feature: The sequence is a functional homolog of SEQ ID NO 142 in the 10/286,264 US patent application
  misc_feature: The sequence is a functional homolog of SEQ ID NO 324 in the 10/412,699 US patent application
  misc_feature: The sequence is a functional homolog of SEQ ID NO 756 in the 11/479,226 US patent application
  misc_feature: The sequence is a functional homolog of SEQ ID NO 1452 in the 10/666,642 US patent application
  misc_feature: The sequence is a functional homolog of SEQ ID NO 158 in the 10/225,066 US patent application
  misc_feature: The sequence is a functional homolog of SEQ ID NO 226 in the 10/666,642 US patent application
  misc_feature: The sequence is a functional homolog of SEQ ID NO 242 in the 10/714,887 US patent application
  misc_feature: The sequence is a functional homolog of SEQ ID NO 242 in the 11/435,388 US patent application
  misc_feature: The sequence is a functional homolog of SEQ ID NO 280 in the 10/374,780 US patent application
  misc_feature: The sequence is a functional homolog of SEQ ID NO 68 in the 10/225,068 US patent application
  misc_feature: The sequence is a functional homolog of SEQ ID NO 108 in the 10/666,642 US patent application
  misc_feature: The sequence is a functional homolog of SEQ ID NO 332 in the 10/412,699 US patent application
  misc_feature: The sequence is a functional homolog of SEQ ID NO 886 in the 10/412,699 US patent application
  misc_feature: The sequence is a functional homolog of SEQ ID NO 582 in the 10/666,642 US patent application
MAMVLAAAAVGSGRRDAEAELNLPPGFRFHPTDEELVVHYLCRKVARQQLPVPIIAEVDLYKFDPWDLPEKALFGRKEWYFFTPRGRKYPNGSRPNRAAGRGYWKATGADKPITPKGCARAAGIKKALVFYSGKAPRGVKTDWIMHEYRLADADRAPGKKGSQKL

SEQ ID NO: 32287 - DNA, 647 bp, Panicum virgatum
  misc_feature: Ceres CLONE 1910025-R
  misc_feature: Encodes the peptide sequence at SEQ ID NO. 32288
tcccagaagttggacgagtgggtgctgtgccggctgtacaacaagaagaacaactgggagaacgtgaaggtggaggagctggaggcggcggcggcgcaccaccaccaccggcagggcgcgggggaggtcatggacgcgctcgacgactccatgtccgacagcttccagacgcacgactcggacatcgacaacgcctctcgcatgcagaacagcttcgggaacatggcgcagcagggggtgccggccatgcggaacggcctcggcaccgtgacggtgaaggaggacaacgactggttcaccggcctgaacctggatgagctgcaggcgccttacagcatggcgcagatggtgaatcctatcccggtccaccagacgatgaatctggcagctgggcaaggccatggctacttgcagtcgatgagctcgccgtcgatgaagatgtggcagacaatcttgccaccattctgagagttgacatggaaagggaaagacgtgtgctcttgtaaataatggggcaataggagtggctagacaggacttagaaacaacaaactgaaagtttggagggtataattctgcataactgttgctgtagtcttgtaatgtttattcgttcgttagatctatctatgcatttgttaaccagc

SEQ ID NO: 32288 - protein, 155 aa, Panicum virgatum
  misc_feature: Ceres CLONE 1910025-R
  misc_feature: The sequence is a functional homolog of SEQ ID NO 853 in the 10/374,780 US patent application
SQKLDEWVLCRLYNKKNNWENVKVEELEAAAAHHHHRQGAGEVMDALDDSMSDSFQTHDSDIDNASRMQNSFGNMAQQGVPAMRNGLGTVTVKEDNDWFTGLNLDELQAPYSMAQMVNPIPVHQTMNLAAGQGHGYLQSMSSPSMKMWQTILPPF

SEQ ID NO: 32289 - DNA, 552 bp, Panicum virgatum
  misc_feature: Ceres CLONE 1910028
  misc_feature: Encodes the peptide sequence at SEQ ID NO. 32290
ataaaagataagctcagctcagctcgcatgcaagaggtggagatgcggagcccacgaggaggagggcgcgcccatgatcacgtccacctgatcccgggcgtccccgactacctcgcgggaaaatgcttggcgacggtgccatacgcgacctgctgattccggaggcgagtgagcagcgccgggggaagatgcacaaccacaacttcctcggcctcaacgtccaggtccgcgccaactgggtggagggcgtcaacggcggcaagatgatccccatctggcccatcgtcaactccaccctcaagctcaggaacttccgctccgacttcgactacctcgcacaaaacgtctacaaggaggatggtggcctttatgatgaagattacgttcagaagaggattgacctggcggatagtgtggaacagagtggggaaaaactctccggcacgttgcacactagtggccgcgacgacatgtctatccttgccatgcagcggctctacgatcaccagcctaacggcccggcgacgccggtggacatgtccgtggactact

SEQ ID NO: 32290 - protein, 143 aa, Panicum virgatum
  misc_feature: Ceres CLONE 1910028
  misc_feature: SWISSPROT Homolog: EC 1.5.3.11 Polyamine oxidase
MLGDGAIRDLLIPEASEQRRGKMHNHNFLGLNVQVRANWVEGVNGGKMIPIWPIVNSTLKLRNFRSDFDYLAQNVYKEDGGLYDEDYVQKRIDLADSVEQSGEKLSGTLHTSGRDDMSILAMQRLYDHQPNGPATPVDMSVDY

SEQ ID NO: 32291 - DNA, 1565 bp, Panicum virgatum
  misc_feature: Ceres CLONE 1910042
  misc_feature: Encodes the peptide sequence at SEQ ID NO. 32292
agtccacccgtgaccgtgaggtgagctcgtctcgcctcgactgagcagcacagctcaaagtctgcaggcgatatcggctatcctctcctccactcgacccaagccagcaagcgcccggctgcctccccatggctgccgcccacctcctcgccgcctccacctcgtcctcctccaccgccgccttccgcccccctctccgcctccgctctccggcgcacactcctcatctccgcctcaaccgcactgggaggcgcccgttcccggtggtccgcgcggccgagaccgacgctaaagacgccaagcccaaggcaccggagaaggcgccggcggcgggcgggtccagcttcaaccagctgctcggcatcaagggcgccaagcaggagaccgacatttggaagatacgtcttcaacttactaaaccagtaacgtggcctccgcttgtctggggagttctctgtggagcagctgcctctggaaatttccattggacggttgaagatgttgcaaaatctattgtatgcatgataatgtctggtccatgccttacaggatacacgcagacaattaatgactggtatgatcgagacattgatgcaatcaacgagccttatcgccctattccatcaggtgctatatcagaaaatgaggtaattactcagatctgggtgctattgttagcagggcttggattgggtgctttgttagacgtgtgggcagggcacgattttcctattgttttttatcttgctgtgggtggttccttactatcctacatatattcagcaccacctctcaagctcaagcagaatggatggattgggaactttgctctcggtgcgagttacattagcttgccctggtgggctggtcaggcgttgttcggaactcttactcctgatattgttgttctgacaactttgtacagcatagcagggctagggattgctattgtaaacgactttaagagcattgagggggatagagctctggggcttcagtcacttcctgttgcttttgggatggaaactgcaaaatggatatgcgttggagcaattgacatcactcaattatctgttgcaggctacctattgagcactggcaagctatattatgccctggcgctgcttggactaacaattcctcagttccagtacttcctgaaggaccctgttaagtatgatgttaaatatcaggcaagcgcgcagccgttcttcgtactgggcctgctggtgacggccctggcaaccagccactgatgaaagcatccaaccagtagacttattcaggtgtgatgagataaggtttcagcgcccgtgtagtcgcattttgtaagctccttgtgagcagggtggggtcaggggggaaaaaaatcaattttgtgaggttcaggtgatgcagcagccacgctggtgatagatggaaagattagagatattccctgctgttgtagtaggttcagtagatacacgttattaagacgcttgagactattgtgcaaattgtccgcggctcaaccgcctgctgttctgtaatgcttccaataaacagtttctggctttctgcat

SEQ ID NO: 32292 - protein, 375 aa, Panicum virgatum
  misc_feature: Ceres CLONE 1910042
  misc_feature (102)..(371): Pfam Name: UbiA Pfam Description: UbiA prenyltransferase family
  misc_feature: SWISSPROT Homolog: EC 2.5.1.62 Chlorophyll synthase
MAAAHLLAASTSSSSTAAFRPPLRLRSPAHTPHLRLNRTGRRPFPVVRAAETDAKDAKPKAPEKAPAAGGSSFNQLLGIKGAKQETDIWKIRLQLTKPVTWPPLVWGVLCGAAASGNFHWTVEDVAKSIVCMIMSGPCLTGYTQTINDWYDRDIDAINEPYRPIPSGAISENEVITQIWVLLLAGLGLGALLDVWAGHDFPIVFYLAVGGSLLSYIYSAPPLKLKQNGWIGNFALGASYISLPWWAGQALFGTLTPDIVVLTTLYSIAGLGIAIVNDFKSIEGDRALGLQSLPVAFGMETAKWICVGAIDITQLSVAGYLLSTGKLYYALALLGLTIPQFQYFLKDPVKYDVKYQASAQPFFVLGLLVTALATSH

SEQ ID NO: 32293 - DNA, 1556 bp, Panicum virgatum
  misc_feature: Ceres CLONE 1910052
  misc_feature: Encodes the peptide sequence at SEQ ID NO. 32294
gtaaaaaaaacccacaaaaaatacttgctgggcacaaaaaaaaagttccttttttattttcctcgtcctcttcgtctcaactcgccgcccactgcgcccctccccctcctccccctcggcccctccaatccctccgatccaatccccccaaaccctaggcaatccgccaccagagtgccaaggtcgtcccccctcctcacccgcggcggcgcggcacatggcccacggcggcggcgggagggcgaaggtgacgccgaacctcgcggtggacggcgagggcacgcggacgctcaacctcaccgtgctgcagcgcctcgaccccgccgtcgaggacatcctcatcaccgccgcccacgtcacgctctacgacttcgacaccgacgtcaaccagtggagccggaaggatgtcgaggggtcgctcttcgtcgtcaagaggaatgcccaacccagattccagttcattgtcatgaatcgccggaacacagataatctagttgaagatctcttgggagatttcgaataccaactccaagttccttatataatgtaccgcaattctgcacaagaagttattggaatttggttttacaactcccaggagtgtcaagaagttgcaaatctttttagcaggatactgaatgcattctcgaaggtgcctccaaagccaaagattccctccgttcaaagtgaatttgaagagcttgaagcagcacctgcgttggttgaaggtcctctggaaccgcaaacatcaaatatcatatcaactaccacccacgttcaagaggaccccttatctgcattcttcagtgcagctgtgaacgctggtggcaccacctctgtagctattgcaggacagccaaatcaatcttttggtgctattcctttgtcacatgcacctactagtacaattacatcgcaatcaccgggcttgcatcatttgcttccttcacagacctcatcagtttctggcatacctgctgatgttcatggtggcactggtcctatagtgaggtccacaagccttgtaaatccatcacatttctcaccattgacatcagcgcagacagcaatggtgcgcagtaattctgcagcaccaactgctccacctcaacaccctcgtactgctcagcatccgcaaagtgctcccttgcttcagccttttccattacctacagcttcaccttctccaccgtatgggactccattgcttcaaccatttccaccaccaaatccatcgccgtctcttgcatcagctccagtctacaacccagcactgtccagagacaaagttagagatgcattactgagacttgtggagaatgatgaatttatcgatttggtttaccgggagatcgtgaacagacaataatgaattttgaatgaacagccctctcaatcaggctggttgtgtttggactcttgctatcggttgggagcttgtaattcaagttatgacgtaaattcattagtgaagtccatcggtgggcgaagtttgtattttgtactttcaacatatctgtaaatgcttatgaaatctatcccctcggtggcaggtc

SEQ ID NO: 32294 - protein, 383 aa, Panicum virgatum
  misc_feature: Ceres CLONE 1910052
  misc_feature (18)..(140): Pfam Name: DCP1 Pfam Description: Dcp1-like decapping family
MAHGGGGRAKVTPNLAVDGEGTRTLNLTVLQRLDPAVEDILITAAHVTLYDFDTDVNQWSRKDVEGSLFVVKRNAQPRFQFIVMNRRNTDNLVEDLLGDFEYQLQVPYIMYRNSAQEVIGIWFYNSQECQEVANLFSRILNAFSKVPPKPKIPSVQSEFEELEAAPALVEGPLEPQTSNIISTTTHVQEDPLSAFFSAAVNAGGTTSVAIAGQPNQSFGAIPLSHAPTSTITSQSPGLHHLLPSQTSSVSGIPADVHGGTGPIVRSTSLVNPSHFSPLTSAQTAMVRSNSAAPTAPPQHPRTAQHPQSAPLLQPFPLPTASPSPPYGTPLLQPFPPPNPSPSLASAPVYNPALSRDKVRDALLRLVENDEFIDLVYREIVNRQ

SEQ ID NO: 32295 - DNA, 736 bp, Panicum virgatum
  misc_feature: Ceres CLONE 1910055
  misc_feature: Encodes the peptide sequence at SEQ ID NO. 32296
atcgcggcacaaagcccatcgcatcccctccgccccgcccctcgcccattcccttccgcctcccgccccgcgccgccgctcgccggagcccgcgcctccgcccgcgctgcgccactgtagatatctgaatggctgccgcaaggggcattaaccagcttctgaggagaactctccagaaccagtcatctggttcatcgctgctttcttcgtttcggggaaagcatgaagagtcctctgctggactgagagcattggctcttcttggagttggtgcctccggtcttttgagttttgctacaatagcatctgcagatgaagctgagcatggcttggcagccccagattacccctggccacatgctggcatcatgagctcttatgatcatgcatcaattcggcgtggacaccaagtttacacacaagtttgtgcctcttgtcactccatgtccttgatttcgtaccgtgatttggttggggtagcctatactgaagaggaaacaaaggcaatggctgctgagattgaggtagttgatggtcctaatgatgagggtgaaatgttcacccgccctggtaaactgagtgaccgcttcccacagccctatgcaaatgagcaagcagccagatttgcaaacggtggtgcataccctccggacctcagtcttatcacaaaggcgaggcacaatggtcagaactatgtttttgctctccctactgggtatcgtgagccacctgctgg

SEQ ID NO: 32296 - protein, 202 aa, Panicum virgatum
  misc_feature: Ceres CLONE 1910055
  misc_feature (69)..(202): Pfam Name: Cytochrom_C1 Pfam Description: Cytochrome C1 family
  misc_feature: Useful for biocontainment applications
  misc_feature: Useful for making plants with modulated biomass
MAAARGINQLLRRTLQNQSSGSSLLSSFRGKHEESSAGLRALALLGVGASGLLSFATIASADEAEHGLAAPDYPWPHAGIMSSYDHASIRRGHQVYTQVCASCHSMSLISYRDLVGVAYTEEETKAMAAEIEVVDGPNDEGEMFTRPGKLSDRFPQPYANEQAARFANGGAYPPDLSLITKARHNGQNYVFALPTGYREPPA

SEQ ID NO: 32297 - DNA, 1692 bp, Panicum virgatum
  misc_feature: Ceres CLONE 1910067
  misc_feature: Encodes the peptide sequence at SEQ ID NO. 32298
gagggcgacctagggttccccgattcaaattggcggtgcgcggcggccagcggccagcccctgctggatccgggcatccggcaacggcgactcgggcgacgcctcggcggaaggagccagggagggcggagaggaggagcgagccgccggctggcaagggaggcgcggccgcgcggaggagatccggcgggcggcggcgggtggctggttcgcaggcgcggcttgcggcggcgcccctcggccggtctctggctcactgccacattggagtggagcaggatctgaggagcggcaggcaagcagccaacgccccgcagcgagccggcaggcaacgcaagagccatgtgacccccaccaaaaagacatcaggtgctctgcgtttgctccagagccatgtgaaccccaactaagggatatcctgcaatgtgcatctctctgaccatcgaaacagagagcttcatgtcttcctagtactagcaacaaaagagatatagctagtaagatggcatccatgatcgcctcgtccacggtggttacacttggtgcgctgatcttcctcctccttgtctcgtatggcttatgcactaggatcgtcaacttcaatgcctccgacatcaccgcagacccctactgggtgcctgccagggccacttggtatggtgcgccaaccggcgctggcccctacgacaatggtggagcttgcgggttcaagaacgtgaacctgcctcctttctcggccatgacgtcgtgcggcaaccagcccctgttcaaggatggcaagggttgtggctcgtgctaccagataagatgcctcaaccaccctgtgtgctccggaaacccagagacggtggcgatcaccgacatgaactactacccggtcgccaagtaccactttgacctcagcggcacagcctttggggccttggcacagcccggacgcaatgacgagctccgccatgccggcatcattgacatccagttcaggagggtgccctgcatctaccccgggctgacggtgaccttccacatcgagcacggctcaaaccctgtctacttggcagtgcttgtcgagtttgaagacggtgacggcgatgtggtccaggtggacctcatggaggccaattccaggtggtggacgccgatgcgggaatcatggggatccatctggaggcttgactccaaccaccggctcacagggcccttctctctgcgcatcaccaacgagtctggccagaagctggtggcttaccaagtcatccccgccaattgggcacccaacacctactaccgctccaacatccagtatcaggctacgagctctggtgctggactgggtatgagctctggtgctggactggatattagctctgctactgggctggttattagctctgctgctagactggacacgaaaattctcagcatcattggcttgatttgtttggtattgttttgttttgtttgcatgggattgaggaaccttagctgattagctagcaggtgacagtgacatgtcgggtgccctatgctgtagatggtgttgtgtgtcttgagatttgacaactgggaggtaatcctgtcccggagagagttggagaggcgcccccgacgcgtctgacctgtcggaggcattgtcgcttgtataaagaatgaactcgcgaatggaatgaatgagtagaacaaatgtatggt

SEQ ID NO: 32298 - protein, 328 aa, Panicum virgatum
  misc_feature: Ceres CLONE 1910067
  misc_feature (172)..(253): Pfam Name: Pollen_allerg_1 Pfam Description: Pollen allergen
  misc_feature (81)..(160): Pfam Name: DPBB_1 Pfam Description: Rare lipoprotein A (RlpA)-like double-psi beta-barrel
  misc_feature: Useful for making plants with altered carbohydrate content
MASMIASSTVVTLGALIFLLLVSYGLCTRIVNFNASDITADPYWVPARATWYGAPTGAGPYDNGGACGFKNVNLPPFSAMTSCGNQPLFKDGKGCGSCYQIRCLNHPVCSGNPETVAITDMNYYPVAKYHFDLSGTAFGALAQPGRNDELRHAGIIDIQFRRVPCIYPGLTVTFHIEHGSNPVYLAVLVEFEDGDGDVVQVDLMEANSRWWTPMRESWGSIWRLDSNHRLTGPFSLRITNESGQKLVAYQVIPANWAPNTYYRSNIQYQATSSGAGLGMSSGAGLDISSATGLVISSAARLDTKILSIIGLICLVLFCFVCMGLRNLS

SEQ ID NO: 32299 - DNA, 2595 bp, Panicum virgatum
  misc_feature: Ceres CLONE 1910071
  misc_feature: Encodes the peptide sequence at SEQ ID NO. 32300
aaacgaagccctccaaggaaggcgttgcagatcggcagaacaggagggagaccgtacggcggcgcggggggagggagagcgtacgtcccaccggcacgaggccgcgttacagggtgtgcagtacgcacgggcccttttctggtgcgcgccctcaatgcgctcttgataacccccggctccccctcgatccgcttctgcttcggttgctggccgcctacctggagcggcaggaggggtgggagctggcatttgatccggttttccgtccgccgcaatccctggaaggattcttgagaagccctgtttgtgactgcctgattctccaacaagctctgcgaaatctaggatccatttctctgtacttggcaagctctgggcccttttagattacccgtctgatacacaagttgctgcaagaattcgactgcaaatggaccaaggaactgcagcggcgattcctggtttaagcacttctgttggtgtttcgggtgacagattccttttctcctcaaagttcaacatgtggtttctatgcttccagacttccaaagttggaatctgatctcttgtgacagtgcttcttggcttccttattttccgttatggaggagcagaactcatggcttaggaggaccaagttctcacacactatctacacaagagtggatcctcgaagggtacctattgctcctccggttggcaaggatgtggtggtacctttcgctccgcttagcaaggatgttgagcggaaattgcagaaatttgtgagtatggggaagtccatgtcgatgcctgttgatcgggatgccgaagatacagggactgcactcaagcactgtgctagcttgcctctggtccgatcctcgcttcagcttgatagggacaaggccaataaaccgaagaaggcgagtttggagattccttccagccctccaatgaactcagagaattgcaggggcctgagagcaaggagcctggtcaagagcccaagttcgatgatgctcctcagctacttgaacaaagctccctcgaaccaaggctctagtccgcaaaaggcttatggacctcagcacaaacagagatcgaagtccccccttccttgtactgcaccttctgaagtgttcagggaagcaaagtctagcagccagaggtttgcgagcccccctccacagcgaagaggatctgaaaagagtatatatggaaaatcatttgctaggcaggtgtcttatatgggtcagagtcctgatttgtgctcaactccaatggtatctggtaagcacaagtctcaaaaggataattcttgggcaaggaaatacagcggtggaaggagggttagtgcagttaaccctgctattgatcggagggcccagatggttagaatgaatcaggcggtgcaaacgacagtcgattggacacttgatccctccaagctgctcgttgggcacaggtttgctagcggggcatatagtcggctgtacagggggttgtatgacgataaaccagttgcaattaaatttatccgacaacctgatgatgacgacaatgggaagatggctgctaaacttgagaagcagtataacagtgagataaattcactatctcacctttaccacaagaatgtgatcaagcttgtggtggcctataaatgcccaccagttttttatattattaccgagttccttccgggaggctccttaaggtcatacctgaatagcacagagaaccaccccatccctgtggagaatatcatatccattgctcttgatgttgcctgtggtttggagtacatacactctcaagggattgttcaccgcgacattaagcctgagaacattctctttgacgagaacttttgtgtgaagattgctgattttggtatcgcctgtgaggagactttctgtgatgttctagtggaggatgagggcacttacaggtggatggctcctgagatgatcaagcaaaaggcatacaaccgaaaggttgatgtctacagctttgggttgctcctgtgggaaatggtgtctggaagaattccttacgagaacctgacccctttccaggtggcttatgctgtcgccaataggaacttgaggccaacaattcctccagaatgcccatcagctctcagatccctgattgagcagtgctgcgcgttgcagcctgacaagaggcctgatttctggcagattgtgaaagtcttggaacagttccgttccattctctcgcagggtggctgccttgacatagcgaagagtggcacctgccaggatcccaagaagcgtctcctgcactggattcagaaactgaaaccagcgcagagcagctgagtactcaagcacttgtagcatctttgcagccatagttttatctggttgggtatgctcagtagcttagcataaacccttagtacctttttgcgcttgggaaagaaggatccttgattcaaggaacctgggttctaggatgcttgcaggtgtttatccctgcgagtatagattctacagtagctgtatatggttgtgccttgcgcactctgtctcgcctcttgttaaatttacctgcaagttatggtgatgatactatagcatcttgtct

SEQ ID NO: 32300 - protein, 574 aa, Panicum virgatum
  misc_feature: Ceres CLONE 1910071
  misc_feature (277)..(533): Pfam Name: Pkinase Pfam Description: Protein kinase domain
  misc_feature: SWISSPROT Homolog: EC 2.7.11.1 Non-specific serine/threonine protein kinase
MEEQNSWLRRTKFSHTIYTRVDPRRVPIAPPVGKDVVVPFAPLSKDVERKLQKFVSMGKSMSMPVDRDAEDTGTALKHCASLPLVRSSLQLDRDKANKPKKASLEIPSSPPMNSENCRGLRARSLVKSPSSMMLLSYLNKAPSNQGSSPQKAYGPQHKQRSKSPLPCTAPSEVFREAKSSSQRFASPPPQRRGSEKSIYGKSFARQVSYMGQSPDLCSTPMVSGKHKSQKDNSWARKYSGGRRVSAVNPAIDRRAQMVRMNQAVQTTVDWTLDPSKLLVGHRFASGAYSRLYRGLYDDKPVAIKFIRQPDDDDNGKMAAKLEKQYNSEINSLSHLYHKNVIKLVVAYKCPPVFYIITEFLPGGSLRSYLNSTENHPIPVENIISIALDVACGLEYIHSQGIVHRDIKPENILFDENFCVKIADFGIACEETFCDVLVEDEGTYRWMAPEMIKQKAYNRKVDVYSFGLLLWEMVSGRIPYENLTPFQVAYAVANRNLRPTIPPECPSALRSLIEQCCALQPDKRPDFWQIVKVLEQFRSILSQGGCLDIAKSGTCQDPKKRLLHWIQKLKPAQSS

SEQ ID NO: 32301 - DNA, 749 bp, Panicum virgatum
  misc_feature: Ceres CLONE 1910072
  misc_feature: Encodes the peptide sequence at SEQ ID NO. 32302
atcagctcatcagctcttgatctctagctagctagagagataagcttcctctcttcctctcggtcgagggagtgatcctctctcactctcaccaggagctcagctcgggtagctcaaggaggccagaagaagaaatggcgtcgctgtcgatgaccagcagctcggtgcgggcgcagtggacgaagaagcagaacaagctcttcgagcaggcgttggccgtgtacgacaaggacacccccgaccggtggcacaacatcgcccgcgccgtcggcggcaagtcagccgaggaggtcaggcgctactacgagatgctggaggaggatgtcaagcacatcgagtccggcaaggtgcccctccccgcctaccgctgccccggcggcgccggcgccggcgccctcggctacgaggccgacaggatgaagcatctgaagatctaggcgaacttcagaggatggtcaagaagaggctgcgcaggcacacgtgtatatatgattgggatagcatgcatgtccatgctactcctacgcaagtggtctggaagaagcaagaagaatcagatgagatgcatgcatgtcataattaattaattaattaattaataattagtatggggatgatcgagtagtatcctagcctgtcacgcgagatcgaccgacccatcgatctcccagcatgtgtccttcgtacccacgcgcgtatgtgtattatatcctagctgcatctgtgtaccataccaatcagaaacatga

SEQ ID NO: 32302 - protein, 100 aa, Panicum virgatum
  misc_feature: Ceres CLONE 1910072
  misc_feature (12)..(61): Pfam Name: Myb_DNA-binding Pfam Description: Myb-like DNA-binding domain
  misc_feature: SWISSPROT Homolog: EC 3.3.1.1 Adenosylhomocysteinase
  misc_feature: Useful for making plants with altered lignin content
  misc_feature: Useful for making plants with modulated low light sensitivity
  misc_feature: The sequence is a functional homolog of SEQ ID NO 1973 in the 11/479,226 US patent application
  misc_feature: The sequence is a functional homolog of SEQ ID NO 880 in the 11/435,388 US patent application
  misc_feature: The sequence is a functional homolog of SEQ ID NO 2720 in the 10/374,780 US patent application
  misc_feature: The sequence is a functional homolog of SEQ ID NO 360 in the 10/225,066 US patent application
  misc_feature: The sequence is a functional homolog of SEQ ID NO 876 in the 11/435,388 US patent application
  misc_feature: Useful for making plants with modulated nitrogen use efficiency
  misc_feature: The sequence is a functional homolog of SEQ ID NO 976 in the 11/435,388 US patent application
  misc_feature: The sequence is a functional homolog of SEQ ID NO 510 in the 10/666,642 US patent application
  misc_feature: Useful for making plants with modulated flowering time
  misc_feature: The sequence is a functional homolog of SEQ ID NO 1404 in the 11/479,226 US patent application
  misc_feature: The sequence is a functional homolog of SEQ ID NO 662 in the 10/412,699 US patent application
  misc_feature: The sequence is a functional homolog of SEQ ID NO 944 in the 11/435,388 US patent application
MASLSMTSSSVRAQWTKKQNKLFEQALAVYDKDTPDRWHNIARAVGGKSAEEVRRYYEMLEEDVKHIESGKVPLPAYRCPGGAGAGALGYEADRMKHLKI

SEQ ID NO: 32303 - DNA, 1094 bp, Panicum virgatum
  misc_feature: Ceres CLONE 1910094
  misc_feature: Encodes the peptide sequence at SEQ ID NO. 32304
accactccccacctgccctcgtccgccgcctccaaaccctagcccgcgcgctcgcgtcctcgtctccccaggccatggcgtcggccccggccccggcccccaagaaggtgctggtccccatcgcgaacgggacggagccgatggaagcggtcatcaccatcgacgtgctccggcgcgcgggggccgacgtcgccgtcgcatccgtcgagccggcctccgcgaccgtcgcggcggcgtggggcgtcaagctcgccgcggacgcgctcctcgccgacatcgccgacgccgaattcgacctcatctctctccccggagggatgcctggggcttccaattttagatactgcaaacttttggagaatgtggttagaaaacatgtagagaagggcaagctttatgctgcgatatgtgctgcaccagctgtggctctaggaacttggggtttgctcaatggcttaaaggcaacatgtcatccttcgttcatggataaacttccttcagaggtgcatgctgtggaatcaagggtgcagattgatgggaagtgtgttaccagccgtgggccaggaacagccatggagtattctattgttttggttgagcaactatatgggaaggaaaaggctgaagaagttgctgggccgatggttatgcgccctcagcatggtgtggaattctctacgaaagagctgaattcaactagttggaatgttggtgaaacacctagtattcttgtaccaattgctaatgggacagaggagatggaggcaactatgatcattgacattctgtgcagggcgaaagcaaatgttgtggttgcctcgttggaagacaagttggaggttgttgcatcccggaaagtgaagatggttgctgatgtgatgttagacgatgctcttaagcagcaatatgatctcattctgctacctggtggtcttggtggtgctgaagcctatgcaaaatctgataaactgatgggtctgattcagaagcaagctgaggcaaacaaattgtatggcgctatatgtgcatctcctgcaatcgctcttgaaacacatggcctcctaaaggaaagaaagctacatcatatcctgctt

SEQ ID NO: 32304 - protein, 339 aa, Panicum virgatum
  misc_feature: Ceres CLONE 1910094
  misc_feature (38)..(178): Pfam Name: DJ-1_PfpI Pfam Description: DJ-1/PfpI family
  misc_feature (244)..(339): Pfam Name: DJ-1_PfpI Pfam Description: DJ-1/PfpI family
MASAPAPAPKKVLVPIANGTEPMEAVITIDVLRRAGADVAVASVEPASATVAAAWGVKLAADALLADIADAEFDLISLPGGMPGASNFRYCKLLENVVRKHVEKGKLYAAICAAPAVALGTWGLLNGLKATCHPSFMDKLPSEVHAVESRVQIDGKCVTSRGPGTAMEYSIVLVEQLYGKEKAEEVAGPMVMRPQHGVEFSTKELNSTSWNVGETPSILVPIANGTEEMEATMIIDILCRAKANVVVASLEDKLEVVASRKVKMVADVMLDDALKQQYDLILLPGGLGGAEAYAKSDKLMGLIQKQAEANKLYGAICASPAIALETHGLLKERKLHHIL

SEQ ID NO: 32305 - DNA, 316 bp, Panicum virgatum
  misc_feature: Ceres CLONE 1910094-R
cgacggcaacctgatcacaagccaaggtccaggcacttctatggaattctctcttgccatagtggagaaactctttggccgggagaaggcccgtgagcttgccaaaaccatggttttcgtttgagttcagcaacttcagttggtatgtattaggtccctggagtaccaactttttgtgaatgtgaggcatgctatgttttccccttgtgtcgaatgtactctaaggccctttttagcaacaataacatgacaccttgtaatgagtttaatatgcaaataaagttgatgcgaacatgcatatagatgtttcctgatc

SEQ ID NO: 32306 - DNA, 692 bp, Panicum virgatum
  misc_feature: Ceres CLONE 1910119
  misc_feature: Encodes the peptide sequence at SEQ ID NO. 32307
attcctatctcccgtcccctctctctctctctctctctcgcgtctagcctttctttgctggcggtgacgactgggcgagcgccgccatcctacgcccaggtcttcgtcgggccagccccggcgatgagcatccacttccactagtgtcctatactggatccgccccgcagcagggtatctgcccctgacctcagacgccctgatggcagggctggaggagttgaagaagaagctacaacccttgctgttcgatgacccggacagaggtgccgccagtaacagggtgccctttccggaagatacttgcgattcctacgtagtttctgatagcggaactgttaatttacttagtagatccttgggtgagtacaacatcaatgagcatggatttcataaacgaagtgccaggcaagtcgagtcagattctgatgagaaggcataccgttgcgcctctcatgagatgcacatatttggtgccattggtaatggtgcaagtagtgttgtggagagagctatatttattccagttcatcgtattttggccttgaagaagataaacatatacgagaaggagaagaggcaacagattctcaatgagatgagaacattatgcgaagcatgttgttatcctggtttagttgagttccagggtgcattttacatgcctgattctggacaaataagcattgctc

SEQ ID NO: 32307 - protein, 163 aa, Panicum virgatum
  misc_feature: Ceres CLONE 1910119
  misc_feature: SWISSPROT Homolog: EC 2.7.12.2 Mitogen-activated protein kinase kinase
MAGLEELKKKLQPLLFDDPDRGAASNRVPFPEDTCDSYVVSDSGTVNLLSRSLGEYNINEHGFHKRSARQVESDSDEKAYRCASHEMHIFGAIGNGASSVVERAIFIPVHRILALKKINIYEKEKRQQILNEMRTLCEACCYPGLVEFQGAFYMPDSGQISIA

SEQ ID NO: 32308 - DNA, 475 bp, Panicum virgatum
  misc_feature: Ceres CLONE 1910132
  misc_feature: Encodes the peptide sequence at SEQ ID NO. 32309
gtctcattccgcatcgactcctctccctcttcgccttcctcctccttccccgactctgctcctgccgtcgacggccatggattgcctctccgacctctctctttttcatcctctcgacacaccacggagaagatcatcactcagaaattgtgaatcttcggatctggcatggatctcacgagcttggtcgagaccctctccggcccggtgactgattccttcaagctgcccaagtggaactacaacggcaccactcccggacgggccccctgcgatgacaccgaggtcgtcctgtacccgaaggatatctttcaggattcgttcaagactgtctttatcattctcatcatgtactattgctgcacccaatctggcaagcctattcttacctaatacaggcacagcgcccccgttatcttagacggatctgaggttgccgctgacgatccctgttatggtattgagcaagattact

SEQ ID NO: 32309 - protein, 74 aa, Panicum virgatum
  misc_feature: Ceres CLONE 1910132
  misc_feature: SWISSPROT Homolog: EC 6.3.1.2 Glutamate--ammonia ligase
MDLTSLVETLSGPVTDSFKLPKWNYNGTTPGRAPCDDTEVVLYPKDIFQDSFKTVFIILIMYYCCTQSGKPILT

SEQ ID NO: 32310 - DNA, 633 bp, Panicum virgatum
  misc_feature: Ceres CLONE 1910146
  misc_feature: Encodes the peptide sequence at SEQ ID NO. 32311
ctgccggttaccacattaactcacccagcaccaccaatcgaccttcctctagagaccaacttgcgttgatcatatcgagcaccgccactactagctactacatctagcccccccatccgccggccgccatggccaagaagaacctcctcctcctcgcgcacaagctcctctccgccatgctctccctcctcttccacaacgggcgaaacaatagcaacaaacaccagcctcgcctctccaaggctgccgccacccctccaccagacggccgcggcggcccctctcccccgccggtggtgcaccgcggcggccgccgcccgccggggcccggccaggcacgcacaccacgctcgtcgtcgacgacgactccgtgctgctgccctccgacgagaacgtcatcctctacttcgagcacccggcgctgaagatgcgcctgttcatgagcttcctcgtgcgcatggacaccgagcacaactggcgcgactacctccgcctccactgccacccgctcgagcagttcgtccccgactggccggccaatccgccgtccttcagggagatcgtgagcgcctactgccgagaggtccgggggctcgggttccggctgtacgcggccatctccgcgagcctggg

SEQ ID NO: 32311 - protein, 68 aa, Panicum virgatum
  misc_feature: Ceres CLONE 1910146
  misc_feature: SWISSPROT Homolog: EC 1.14.11.11 Hyoscyamine (6S)-dioxygenase
  misc_feature: Useful for making plants with modulated oxidative stress sensitivity
MRLFMSFLVRMDTEHNWRDYLRLHCHPLEQFVPDWPANPPSFREIVSAYCREVRGLGFRLYAAISASL

SEQ ID NO: 32312 - DNA, 1842 bp, Panicum virgatum
  misc_feature: Ceres CLONE 1910170
  misc_feature: Encodes the peptide sequence at SEQ ID NO. 32313
ctgtcaattccgacgccatcgtcgctgtacgcgaacgactgttccgttctagaagtctccccctctcctggcagcagcatgtcgtcgccattaatcaaagcaaactagctatccgaggcagaagagagggaggaggaaggcacaggggaatctcctatctggaaaaggccatttggatccctgggctcgagatagaaaaaaggaaacgaggtctgatttcttccaacgcggcggcagcgcatccgtcctctctctccccgtcctcctccctccgaacaacccgccgcccccctcccaccctcgttattagtttttttagttgcctcattcggcagcctcgcattcggccatctgatctctctctctcccttcccttcctctgctgctggggaggcggaggagaggaaagaggcgaagggcgcaccaggaaggaggacctggaggagggacaccgggagcaatcctcttgctggcggagttctctcccctccttcttgctccgatttcgggtgcaataaatccagcgctgtcggcggctaccggcagccatgtcgcccttctaccttgctcgcagtgcttccaagttagtgaggaggatcacctcggaggtatcggtcgagctcaagatcctctctgagaaatggcgccttcttctcgcaggcctcgttttccagtacattcatggtttggccgctcgaggggtacattatttgcaccagccagggcctaccctccaagatctaggcttcatgattcttccggaacttggaaaagaaaggggttacatcagtgagacgttgtttacgttcatattcctctcctttgtattgtggacatttcatcctttcatgcttcataccaagcgcttctacactgttctgatctggcgcagggtgcttgccttcttatgcgcttctcaatttctacggataataacgttctattccacgcagcttccaggacccaattatcattgtcgcgagggctcaccactggccagattaccaccaccccagaatgcagcagaggttcttctgattaatttcccacgaggagtgatatatggctgtggtgacttgatattttcatcccacatgatttttactctagtctttgtcataacataccagaagtatggaagcataaggtttgttaagatgattgcctggtgcatagctattgctcaaagtcttcttattatttcatctcgcaagcattacagtgttgatgttgttgttgcatggtataccgtgaatttggttgttttctttgtggataagaagcttacagaacttcccgatcgatcagcaggatctgcaccaatactgcctgtgagtgtgaaggacaaagataccaagttgaaagaagagaacacgagattgctgaatggtaactctggggattcagctgatcggagaccacgaacacagatgaatgcaaagctcattgagaatgaaagccatgttgataatgaaaatgtgaagacatgacgaatgctaatggaatgattttgttagttaaatgttccattgaactaaggaatatgggatgcaacgtgctttggtgcctagcttcttgatcacttcatgacatagctatgaaggaagttgttttagacctcacgatcctaggcaaaacgagttttgttcgtaaaactgtttgtgtttatctcagctgtctcattgtgacccacagttttttcttgttcctttcttttttgttttccagattggaattcggattgtctatacaaattgtgtatggttagcacagccctgagattaattgcaagtgtaaccacctggacaatatgagattatcttggtttagtacctacttccg

SEQ ID NO: 32313 - protein, 313 aa, Panicum virgatum
  misc_feature: Ceres CLONE 1910170
  misc_feature: SWISSPROT Homolog: EC 2.7.8.27 Sphingomyelin synthase
MSPFYLARSASKLVRRITSEVSVELKILSEKWRLLLAGLVFQYIHGLAARGVHYLHQPGPTLQDLGFMILPELGKERGYISETLFTFIFLSFVLWTFHPFMLHTKRFYTVLIWRRVLAFLCASQFLRIITFYSTQLPGPNYHCREGSPLARLPPPQNAAEVLLINFPRGVIYGCGDLIFSSHMIFTLVFVITYQKYGSIRFVKMIAWCIAIAQSLLIISSRKHYSVDVVVAWYTVNLVVFFVDKKLTELPDRSAGSAPILPVSVKDKDTKLKEENTRLLNGNSGDSADRRPRTQMNAKLIENESHVDNENVKT

SEQ ID NO: 32314 - DNA, 2437 bp, Panicum virgatum
  misc_feature: Ceres CLONE 1910174
  misc_feature: Encodes the peptide sequence at SEQ ID NO. 32315
gcctgctttgaactcgtcgtgcgcgtctgttaggataccacatggcgtagcagcctaccaagaaacagagccttcttctccgcactgcctctccttgcctcacggattgagatcagttgccggggcatggtggatgatcgctgtgtgtggctagctgccaagacggcacctctccggcttcaagcgcctccggctctcccccgttcactctggccttccccgcgccaccgccgcctcgcagcttgagcgaggagcatgcgagtttgccctcttccgtcttccccgtcgtcgtcctcgcgatcgccgcgtcgctgctgcggagggcgtctcccgtagataacggctaagtgctgttcctgattccgtccttgaacgccagcacacgtgcgcaacaagggatggccaagatgagctgcttccccactctgctcgccgccggcaggaagaagaagaagagccacaagatcgccgccgccaagatggtcagcggaaacgagtgccccaaggtgaagccggtcgagttcatcgatgccccagttgctcccggcgccggggaattcgagaataaggtcgccgccgccgcggacatggttcccgtggcttcccacgaacgaggtgatcaattcgtcgccgccaaggcgccggctaaggggggcgatctgtcagatttcgaattcgacttccacgcgcccagcaagccagacggcgacggcgcggagaagcgagccaccgacacggcagcgggcgacgcggaggcggcgccggcggacccgtcgcccaagctgaagcggtcctgctccaacatcgagaccaagcggcccggcccacgcgaagcgccggagatgccggcgcggtcgcgctcctacggcgatctggggaacctgatcggtggcctcgccctggacgcgtcggcaactccgcacggcgcgccggaggcgagcccggcatcggtcaagacgtcgcgcacggccgaccgcgtcatgctcaagaagcggtcgtccagccaggtgctgccgtcgcgcagccggaagctctggtggcggctcttcctctggagccaccgcaacctgcaccggccggggtcggcgcgcccggccgcggcgtgctctccgggtcgccacggaggatacacctcggacacgctcgaggagggcccggccgcagaccgcaagaagaagaaggtcatggttgacgactcgccgtcgccgccgccgttcgcctcgaaccagtgggtcgccttctgcgccgagaactccctccacgaccgcgtcagcgcctgggtgtgcagcatcgagaacgagcctccgttccacatcgccgaagaggacgaaaactacgacggagaggacaacacggatgacgactgcgatgagcacggcgagtgcgcggcacgcccgcgccccgtcgagctcggggggtcatcttcggggaagaaccacggcaagtccaagcgctgcgcggcggccgacgaggtcgtccaggccaacaccatcgtgcagtccctgaacgccttctcgtcggtggcgcacatatctgggatggggctcaaggtcatgccaatgatcgcgccgttctcgagcctccgagccgtcaacctctccagcaacttcatcgttcatatctccccaggatcgctgccgaagggcctgcactcgctcgatctatcgaggaataagattgcaaacatcgaggggctccgggagctgacgaagctgcgcgtgctgaatctcagctacaaccggatttcgcgcatcgggcacgggctgtcgaactgcacggcgatccgggagctgtacctggcgggtaacaagatcagcgacgtggagggcctccaccggctgctgaagctggcggtgctggacctgagcttcaacaagatcacgacgaccaaggcgctgggccagctggtggccaactaccactccctcctggcgctcaacctggtgggcaacccggtgcaggccaacgtcggcgacgacgcgctgcgccgggccgtgacgggcctcctccctagcctggcctacctgaacaagcagcccgtgaagccgcagcgcagcgcgcgggaggcggccacggacagcgtcgcgcgcgccgcgctcggcgggtcgggctccggcagccggagcctgcggaagaggccgtcgcggcggctcacccagagcccccggtcgtcgtcgctgacgaggggccgcagcggcggcggggacggcagcgtgaggagcaggtccaagggaaggcaccacggctgaggcaggacgaggatcggaggagctgatgaaacgaaaatgaattgctgcgtgtgacgttttgtgcatgcctgcctgcccggatttcgcagagctgcgatgggactattgatgtgaattactacgggcttgatgatggattgtttgtagatgcaaaagtgcgatttaagatgatgatgccagcgttgcgc

SEQ ID NO: 32315 - protein, 616 aa, Panicum virgatum
  misc_feature: Ceres CLONE 1910174
  misc_feature: SWISSPROT Homolog: EC 4.6.1.1 Adenylate cyclase
MAKMSCFPTLLAAGRKKKKSHKIAAAKMVSGNECPKVKPVEFIDAPVAPGAGEFENKVAAAADMVPVASHERGDQFVAAKAPAKGGDLSDFEFDFHAPSKPDGDGAEKRATDTAAGDAEAAPADPSPKLKRSCSNIETKRPGPREAPEMPARSRSYGDLGNLIGGLALDASATPHGAPEASPASVKTSRTADRVMLKKRSSSQVLPSRSRKLWWRLFLWSHRNLHRPGSARPAAACSPGRHGGYTSDTLEEGPAADRKKKKVMVDDSPSPPPFASNQWVAFCAENSLHDRVSAWVCSIENEPPFHIAEEDENYDGEDNTDDDCDEHGECAARPRPVELGGSSSGKNHGKSKRCAAADEVVQANTIVQSLNAFSSVAHISGMGLKVMPMIAPFSSLRAVNLSSNFIVHISPGSLPKGLHSLDLSRNKIANIEGLRELTKLRVLNLSYNRISRIGHGLSNCTAIRELYLAGNKISDVEGLHRLLKLAVLDLSFNKITTTKALGQLVANYHSLLALNLVGNPVQANVGDDALRRAVTGLLPSLAYLNKQPVKPQRSAREAATDSVARAALGGSGSGSRSLRKRPSRRLTQSPRSSSLTRGRSGGGDGSVRSRSKGRHHG

SEQ ID NO: 32316 - DNA, 226 bp, Panicum virgatum
  misc_feature: Ceres CLONE 1910186
  misc_feature: Encodes the peptide sequence at SEQ ID NO. 32317
acctgtaccacactaccctactctaggcccgacggctagccgatcttaccgtgcgttccgcagtacgccagaccacccactcacacacaccccccatgggggggcgtcgaatcgccggggcggtggcgttcctggcgctggcggcggcggttccagcggcgctggcgggcgagccgggccgcgcagcggcgccaatcgggccccccaacgtgaccgcgatgctgga

SEQ ID NO: 32317 - protein, 43 aa, Panicum virgatum
  misc_feature: Ceres CLONE 1910186
  misc_feature: Useful for making plants with altered carbohydrate content
MGGRRIAGAVAFLALAAAVPAALAGEPGRAAAPIGPPNVTAML

SEQ ID NO: 32318 - DNA, 1403 bp, Panicum virgatum
  misc_feature: Ceres CLONE 1910189
  misc_feature: Encodes the peptide sequence at SEQ ID NO. 32319
tctctctctctggcccctactcccccaagctgatcacaccgcatcgcatctctctctcgctcgtttcgctcgcagaacccccgcctccgccgcggctccggcgccgcatccatatccaggagcagtcagtcccttccccgcgcggggcggtggaggtgtagagaacatctttggggtgcacatgactatatgagttgccaggagcccaggaaacagtatcaggcatgcgaagttaagccactgcaattctaaagacggcttggttatttctcagatgtaatttggtgatgctggggcttgtttagtcatcttggtttgaagataccagccatgggtcatctgaattatggagtctctcttcctctactgctccgtctacaacttttgctgccactacttcttccttttgctatggcagatatagcctctgagaagcaagcactccttgattttgcctctgcagtctaccgtggcaacaagctcaattggagtccaaatatcccactgtgctcatggcatggtgtcacatgctcaccagatcgatcacatatatgggcccttagggtaccaggggctggtttgattggtacaattccagctaatactcttggcaggcttgtgtccctccaagttttaagcctgaggtctaatcgtttgagtggaagtcttccattggatgttgccttacttccttctttacaagccatatttcttcagcacaacgaactgttgggagacttgccttcatttttctctccaagcctcaataccctcgatctctcttacaactcctttacaggacaaataccatcaggtttgcaaaatcttacccaattatctatcctgaatttagcaggaaattccttgtccgggccaatccctgacctcaaacttccaagcctaagacagctaaatctgagcaacaatgaactaaatggttcaattcctccctttctccaaatattctcaaatagctccttcttagggaaccctggattgtgtgggccacctctagctgaatgctcctttctatcttcaccgacaccgtcacaagtgcctttgcttccatcatcgccacatcgtgagaagaaggcaggcaatggcttgataattgccgctgttgttgggggctttgttatatttctgctagctgctgtgatgttcactacgtgcttttcaaagaggaaggagaagaaagatgaggtgggttacaacagtaaggtgactgatggtgccaggattgagaagcgcaaagatgtcagtagtggtgtccaaatggctcataagaacaagctggtattcttggatggatgcagttacaactttgacttggaggatttactgagggcttctgctgaagttcttggcaaaaggagttatggaactgcctacaaagctatact

SEQ ID NO: 32319 - protein, 357 aa, Panicum virgatum
  misc_feature: Ceres CLONE 1910189
  misc_feature (31)..(68): Pfam Name: LRRNT_2 Pfam Description: Leucine rich repeat N-terminal domain
  misc_feature: SWISSPROT Homolog: EC 2.7.11.1 Non-specific serine/threonine protein kinase
MGHLNYGVSLPLLLRLQLLLPLLLPFAMADIASEKQALLDFASAVYRGNKLNWSPNIPLCSWHGVTCSPDRSHIWALRVPGAGLIGTIPANTLGRLVSLQVLSLRSNRLSGSLPLDVALLPSLQAIFLQHNELLGDLPSFFSPSLNTLDLSYNSFTGQIPSGLQNLTQLSILNLAGNSLSGPIPDLKLPSLRQLNLSNNELNGSIPPFLQIFSNSSFLGNPGLCGPPLAECSFLSSPTPSQVPLLPSSPHREKKAGNGLIIAAVVGGFVIFLLAAVMFTTCFSKRKEKKDEVGYNSKVTDGARIEKRKDVSSGVQMAHKNKLVFLDGCSYNFDLEDLLRASAEVLGKRSYGTAYKAI

SEQ ID NO: 32320 - DNA, 799 bp, Panicum virgatum
  misc_feature: Ceres CLONE 1910189-R
  misc_feature: Encodes the peptide sequence at SEQ ID NO. 32321
gaactgcacgtggaatcgagcacatccatgcagaaggtggctccaagttcgcccatggcaatatcaagtcagccaatgtcctgctcgatcaaggccacaacccatatgtctcagactatggtcttagtgctttgatgagccttccaatcaacacctcccgggttgttgctggttaccgagctccggagacctttgaatccaggaaattcacacacaagtctgacgtgtacagctttggcgtccttctcatggagatgctaaccggcaaagcctctctccagtcacaggggcaggatgacgtcgttgatctaccaagatgggtgcattctgtggtccgtgaggagtggaccgccgaagtatttgatgtccagctgatgaaatatccgaacatagaggatgagctggtccagatgctccatattgccatggcgtgcacgtcgtggttgccagaccgacgcccaacaatggcagatgtggttcggatgatggaggagctaggccagtctgcttccgagagctgcactccctccaatggcaatcccagggagaccaatcctccatcggtgtgaatttcagtctataatttgtgtgattctgatccgaaattggtgaatccatgacatcgatgatatcctctattggctttatgtggtcctgaagcttacacattagaaccacaccggctgtatgatacggcgttgtatcgttacagttgtaatgttattccctgttcatgttaaagttgttattccctgttcatgttaaagttgttaactgggagatgttaacatttcttcct

SEQ ID NO: 32321 - protein, 188 aa, Panicum virgatum
  misc_feature: Ceres CLONE 1910189-R
  misc_feature (1)..(162): Pfam Name: Pkinase_Tyr Pfam Description: Protein tyrosine kinase
  misc_feature: SWISSPROT Homolog: EC 2.7.11.1 Non-specific serine/threonine protein kinase
TARGIEHIHAEGGSKFAHGNIKSANVLLDQGHNPYVSDYGLSALMSLPINTSRVVAGYRAPETFESRKFTHKSDVYSFGVLLMEMLTGKASLQSQGQDDVVDLPRWVHSVVREEWTAEVFDVQLMKYPNIEDELVQMLHIAMACTSWLPDRRPTMADVVRMMEELGQSASESCTPSNGNPRETNPPSV

SEQ ID NO: 32322 - DNA, 334 bp, Panicum virgatum
  misc_feature: Ceres CLONE 1910219
  misc_feature: Encodes the peptide sequence at SEQ ID NO. 32323
aagaaggatgaagaggaccagcccgccggcgggtactcggaggccgtggccgccgaggtggtggccgccggcgacagcgagtactacagggaccacaaggaggacaacgagcaccagcaccagccgcacctcggtgaggccggcgccatcgccgccggcgccttcgcgctctacgagaagcacgaggcgaagaaggactcggagctcgctcacctactcaagatcacggatgagatcgccgccacggcggccgtcggcgccggcggctacgccttccacgagcaccacgagaagaagaaggagcactaggacgccgaggaggtcagcggcgaga

SEQ ID NO: 32323 - protein, 102 aa, Panicum virgatum
  misc_feature: Ceres CLONE 1910219
  misc_feature (29)..(102): Pfam Name: ABA_WDS Pfam Description: ABA/WDS induced protein
KKDEEDQPAGGYSEAVAAEVVAAGDSEYYRDHKEDNEHQHQPHLGEAGAIAAGAFALYEKHEAKKDSELAHLLKITDEIAATAAVGAGGYAFHEHHEKKKEH

SEQ ID NO: 32324 - DNA, 1608 bp, Panicum virgatum
  misc_feature: Ceres CLONE 1910253
  misc_feature: Encodes the peptide sequence at SEQ ID NO. 32325
aatcctccccatcccgaccgaccgcggtagcaaagcagcaattgacgccgccccacctcctccgcgcccgcctcgccccgccgccgccgcgcccgatcgcaagcctccacctcgccctccgcttgctgccggtcttaaatccaccttctgcgcgaggaatcggcggcggcgtcgccgtcgctgcccgccatggaggcgtacaagctctgggtgcgcaggaaccgggacctcgtctactccctcgagtccctcgccaacgggctcacttggatactacctgagcgctttgccaactcagagatcgcgccagaagcagtatattcgctattgggtattgtgagttctgtcaaccagcacataattgatgcgcccaccgaaaaccactcatttgcctcaaaggagcaatctatcccatggggtcttgttgtctctgtactaaaggatgtagaggcagttgttgaggttgctgctcagcactttgttggtgatgatcgcaagtggagcttccttgctgttacagaagcagtgaaagcaggtgtcaggttagccgctttccgggagagtggatacaagatgctcttacaaggaggggaggtggcaaatgaagaagaggtgaccgttcttgaagataattatggagtaaatggtaatggagttccagtcatctatccaatgaatgggcattcccaaaatggtcacaaagctgtgaccaatggtctcgatggaaaaaatgaatttgtatctaagagtcttgagagaagagcagtagctgctttgaacaagtttggtgagaatgcaaagatgatgtctgatcctatgtggctgaggaggctccaacctgcgcccgagccaactgtctcagttgttgagaagccaactttggcaagtatttggtctgctaaagggggtactgggtgcttatttgtcttaggggaggttgttcacatattcaggccacttgtttatgtacttctgatcagaaagtttggaatcagatcatggaccccctggttagtgtcgctagctgtggaactgacaagtcttggcctccattcacatgcaactgatctaaatcatagaggagggaaagtgcatcatctctccacagctgagagggatgagttgaaaaggagaaagatgatgtgggccctttatgtgatgagggatcctttctttgctggttataccaagcgtcatctccagaaggctgaacaggtgctgaatccggtgccattgattggtttccttacaggtaaacttgtagagctactggaaggggttcagacaagatatacatacacgtcaggttcatagagatggcttagttcatggtttggaggaccttcatgctacacgagttggttgatgggttatgttatactggccgagaacttgtgcccagacctgtagtaccgcttccttggcagatgtggcattgttgtcttacgacttatgaggctgttaagctgcggcctaaactttcatccatggtgggagatgagaactaagtatctgagtatagaattctaatgcgaatgtaatgctaagaaccggcacgtgcctctgcaacgcatcatgcacgatttactggaaaagaatcttgattat

SEQ ID NO: 32325 - protein, 374 aa, Panicum virgatum
  misc_feature: Ceres CLONE 1910253
  misc_feature (1)..(367): Pfam Name: Pex16 Pfam Description: Peroxisomal membrane protein (Pex16)
MEAYKLWVRRNRDLVYSLESLANGLTWILPERFANSEIAPEAVYSLLGIVSSVNQHIIDAPTENHSFASKEQSIPWGLVVSVLKDVEAVVEVAAQHFVGDDRKWSFLAVTEAVKAGVRLAAFRESGYKMLLQGGEVANEEEVTVLEDNYGVNGNGVPVIYPMNGHSQNGHKAVTNGLDGKNEFVSKSLERRAVAALNKFGENAKMMSDPMWLRRLQPAPEPTVSVVEKPTLASIWSAKGGTGCLFVLGEVVHIFRPLVYVLLIRKFGIRSWTPWLVSLAVELTSLGLHSHATDLNHRGGKVHHLSTAERDELKRRKMMWALYVMRDPFFAGYTKRHLQKAEQVLNPVPLIGFLTGKLVELLEGVQTRYTYTSGS

SEQ ID NO: 32326 - DNA, 581 bp, Panicum virgatum
  misc_feature: Ceres CLONE 1910268
  misc_feature: Encodes the peptide sequence at SEQ ID NO. 32327
atccttttacacgatcgagacattccatcggttcgatcgatcactctttgtgaacctgatccactcggccctctgctgcgcatccctatctagctcgctcgctcggtcatgaacgtggaagctatgctatcagtcttgagcaataacagtaacacgatggcctctgctaccctgctcaagtcctccttccttccccacaaatccgaatggggcgccagcgcgcaggtcgccgcgcccagccccgtcaccgtgtccatggtctccgtccccgccaccggctacgcccatgatctcgccaataccgccaacaccgtggagtccccggggctgcgcatcctgaccatggactactctaacgcaacgtgcagaaagcggctggcgtccatctggctgaacaacacggaggcaaacccgcaagcctaccggacactgctagtgaccgcctctgggctccgacagtacatctcgtgcgccatcatcttcgacgacactctgtaccagtcggccgtgcactggcgcaagatctctgacatcctatcctagccgggcatcctgccctggatcagtgtctacaagggcct

SEQ ID NO: 32327 - protein, 144 aa, Panicum virgatum
  misc_feature: Ceres CLONE 1910268
  misc_feature: SWISSPROT Homolog: EC 4.1.2.13 Fructose-bisphosphate aldolase
MNVEAMLSVLSNNSNTMASATLLKSSFLPHKSEWGASAQVAAPSPVTVSMVSVPATGYAHDLANTANTVESPGLRILTMDYSNATCRKRLASIWLNNTEANPQAYRTLLVTASGLRQYISCAIIFDDTLYQSAVHWRKISDILS

SEQ ID NO: 32328 - DNA, 744 bp, Panicum virgatum
  misc_feature: Ceres CLONE 1910270
  misc_feature: Encodes the peptide sequence at SEQ ID NO. 32329
attcgcttgcctttcctcgcggctgcccgtcaccgctgacgctcgcctccacctccacctccgcccccgtcaccactaactccccgccggcgcgtataaagattcgccgcccgcgccgcgaagctcaccgcatcgccgcgcggaaaccctcccgaatcgtcgccatggcagccgccgcaccggcaaactccgtcaaggaagtgctcccgtttcccctgaccgccgcctccgagcccccgcccctcttcgacggcacaaccaggttgtatgttgcctaccattgcccgtacgcgcagcgcgcttggattgccaggaactacaagggtttacacgacaagatcaagatagttgcaatcgatcttgctgacaggccagcatggtacaaggagaaggtttatcccgagaacaaggtgccttccctagagcacaacaaccaggttaaaggggagagcttggatttggtcaagtacattgatagcaatttcgaaggcccatcattgcttcctgatgatcctacaaagaagcagttcgctgaggagctgcttgcttttaccgatgcttttaacaaagcactgtactcatctataatctctaaggaagatgtgtccgaggaaactgttgctgctctggataaaatagaagaggccctggggaaatttaacgatggaccattcttcctcggtcagttcagtctggtggacatagcatatgtgccatttatcgaaaggtttcagatattttttg

SEQ ID NO: 32329 - protein, 193 aa, Panicum virgatum
  misc_feature: Ceres CLONE 1910270
  misc_feature: SWISSPROT Homolog: EC 2.5.1.18 Glutathione transferase
MAAAAPANSVKEVLPFPLTAASEPPPLFDGTTRLYVAYHCPYAQRAWIARNYKGLHDKIKIVAIDLADRPAWYKEKVYPENKVPSLEHNNQVKGESLDLVKYIDSNFEGPSLLPDDPTKKQFAEELLAFTDAFNKALYSSIISKEDVSEETVAALDKIEEALGKFNDGPFFLGQFSLVDIAYVPFIERFQIFF

SEQ ID NO: 32330 - DNA, 652 bp, Panicum virgatum
  misc_feature: Ceres CLONE 1910301-R
  misc_feature: Encodes the peptide sequence at SEQ ID NO. 32331
cagcgtttggcagagagtgatctcaatcgttctggcacaccacctgccaagaaggaggctgtagctgcattgccatctgtgaacatcaaggaagtgttgggttgttcagtctgtcttgaggattttgagatgggagcagaagcaaagcagatgccctgtcagcataaattccactctcagtgcatccttccatggctggagcttcacagttcttgcccaatctgtcgatttcagttgcctactgaggagacgaagaacccatgtgaatcagccagcagtgccggggccatgaacggcaatggagacaatgttgctgcaagcagtagtgatacagaaagtactacccgtaatggagacaaccattcagatagtcctatcttctctgctttgagcgcactcttctctgatccatcctcatcatctgatgatgaaagtgctccacactcttctgagacctgaagacaccgctggatgcaggcttgcagtacggtgaaggtgatctgaaatgtgagactggcatctttatattgtagtttctgactttctgtacatatctctgaattggcgcccccagaagacaagatattctatcctcttttctgaaaactatgtggcttgtaacgtgctagtgcttgctatgtttacttatcct

SEQ ID NO: 32331 - protein, 152 aa, Panicum virgatum
  misc_feature: Ceres CLONE 1910301-R
  misc_feature (35)..(75): Pfam Name: zf-C3HC4 Pfam Description: Zinc finger, C3HC4 type (RING finger)
  misc_feature: SWISSPROT Homolog: EC 6.3.2.19 Ubiquitin--protein ligase
  misc_feature: The sequence is a functional homolog of SEQ ID NO 1722 in the 11/479,226 US patent application
QRLAESDLNRSGTPPAKKEAVAALPSVNIKEVLGCSVCLEDFEMGAEAKQMPCQHKFHSQCILPWLELHSSCPICRFQLPTEETKNPCESASSAGAMNGNGDNVAASSSDTESTTRNGDNHSDSPIFSALSALFSDPSSSSDDESAPHSSET

SEQ ID NO: 32332 - DNA, 1441 bp, Panicum virgatum
  misc_feature: Ceres CLONE 1910301
aggtctccgtcttgtcactcccaactgctcctcgacgccgggcgcgccgcgcagggaggaatcatggcctgaagcgaaatcccgcgccgcgacgctgcgaggtaatggttccgtcctcctccccgcttcaaatttcggattcccgagctgttgtttcgcctgatcccttccatttagtttggtcgcttttggaagcgctagggtttagatgaggccgctgtgtagatccgtgctcttgcttgctttgattcggttctggcgtgagattctgcggcgttagagaagtgctcgtggagtaggatgggttttggttgcttggatccagcggcagggcccccggtttcgctgaaacctggggaactggggtgtgcactttgcttgatctgtgtttctgtactaggtttcgtgctcctgaatgaaggcatatgtgctttagttgcggatgctcgtgtagaaagtttcctagaaatatcctgcctttattgcctgttcagcgggattagacttgcaactggtttccctttcttttggtagatctgttagtaccttaatctttgcgtacgtgttttcgttctagtaaaagttaagtacagatgctcatggggaaatttgtttcggggtgacaaggataactttctcaggccagggaaggaagacatctccttgacgcgatagagcttttgatggttgctataagtattcaggggtgaattaggactgcaagatactactgaagcgaaacagatagtgtcaacagagtttgtttcaagatggatgaaggccaggaagttaggtattggtgccacatgtgtgaggaggtgatcgatcctatgccggaaatgaagtgccctagctgtgagggtgggtttgtggaagagatggactctgaaggctttgaaccagctacaaacacgaggtctgatcgctccctctctgctttggctccgctgctttttggtatgctggggggttcgtcgcgcagatcaagactcaggagggaggccatggaggatgttgatgctgatgaggatgaggatgaggatgattcagaccgtgagctcgaactattcaattggaggcggcgaaggaggacgccctcagcatcacttgtcaggctgattcaaactatacgtgatgacatgaggggcttggatgacactgacagtgatacagagagagatatggagagagaaagaagggagagacaggctgtggagaggaggatggagaggcagagggcagagaggcaggctgtggagaggagggcagagaggcagagggcaatggagagactgagcaatcgtgggagagagaggacagaaagcctaatactgatcaactccaacaatgaggccatcattctccaaggaacgtttggacgcgatgacaatcaagaggaatcaagcaacacaagttctggtgtatcagctgcggattactt

SEQ ID NO: 32333 - DNA, 721 bp, Panicum virgatum
  misc_feature: Ceres CLONE 1910310
  misc_feature: Encodes the peptide sequence at SEQ ID NO. 32334
cttccatccactcgtccagagcaagcgagctcagctagcttcctagctcagcagcagcagcattccagcagctccggctagctcggccactcgctcccgatcggtcgacgcataggtagattgtcgtcagacaatccaacagagagaagatcgagtaggaagatccaaactttttttggtaggaactagctaacaacaactaacagagatcagaagagaaaagcaaggctcggctcggcagataattaatacataatggagaagatgaacatggtggcgagcaggaagcccggcgactggagctgccggtcgtgccagtacgtcaacttctgcaagcgcgaggcgtgccagcgctgcggcgaggccaagctgggcggcgagcggacggactacgccgcgctgggcggcgactgggacgtcaagcccggcgactggtactgctgccgctgcggcgtccacaactacgcctcccgcggcagctgcttcaagtgctccgcctccaagaacgaggccgccgccgccgtcgcccagggctgggggttcaccgtcgccggccaggccgggatgatgcccggcgactggatctgcccaaggtgacggacgcctcgatcgatcttattagcttggtcgtcttaaacattctttctaatccctgctgctgctcagccagaatgcagcttatctgcatgcatgatgcatgcagcagcactagcttgcagtt

SEQ ID NO: 32334 - protein, 113 aa, Panicum virgatum
  misc_feature: Ceres CLONE 1910310
  misc_feature (11)..(40): Pfam Name: zf-RanBP Pfam Description: Zn-finger in Ran binding protein and others
MEKMNMVASRKPGDWSCRSCQYVNFCKREACQRCGEAKLGGERTDYAALGGDWDVKPGDWYCCRCGVHNYASRGSCFKCSASKNEAAAAVAQGWGFTVAGQAGMMPGDWICPR

SEQ ID NO: 32335 - DNA, 1435 bp, Panicum virgatum
  misc_feature: Ceres CLONE 1910314
  misc_feature: Encodes the peptide sequence at SEQ ID NO. 32336
aagaacaagaggaaggccacaagggagccaaaaaggccagagagagagagagagagagagagagagagcgtccctccacttgccgtctccctctcccgcttcgcgctcttcgtcatcttcctcttcctccgcttgggggctgggctctccactccagggttcggttcagattcagattggggcgccgccgcagtcctaccgtgctgctctccctcaccacgacgaggatggggcaggacggccaccagatccgccgccacaagctcatcatcgacacggatcccggcatcgatgatagcatggcaatcctaatggcgttcagagaaccaagcgtggaaatcattgggttgacgaccatatttggcaacgttagcacggagggtgcaacacggaatgcgctgttgctgtgtgagagagcagggcattctgaagttccactagcagagggaagccctgagcccctaaagggaggaaaaccccgtattgctgattttgttcatgggtcagatggcattgggaatctgtttgttcctgaacccactactaggaaggttgaggaaagtgctgctgagttcttggtcaataaggtctctgagtttcctggagaggtctctgtactcgctttggggcccctgacaaatgtagcattggctgtcaaaaaagacccttcctttgcaagcaaggtgaagaaaatagttgtactaggtggagctttctttgcggcaggaaatgtcaaccctgcagccgaagcaaatatccatggagatccagaagcagctgacatagtttttacctcaggagcagatattgttgtggttggcattaacataacgactcaagcctgctttacagatgaggatctgttggagctaagaaactcgaaagggaagcatgcacagttcttgtctgatatgtgcaagttctacagggattggcatgccaagtctgatggtttccacggaattttccttcatgatcctgtgagcttcatggctctagttcgtcctgagtacttcacgttcaagaagggtgtggtgagagtggagacccagggcatttgcactggccacactttgatggatcagggattgaaaaagtggaattcagagaatccatggtcaggctataaaccgatttcagtcgcatggaccgtcgatgtgccaaaggttattagctttataaagaagctgctcatggcaccatgagaaactgcaagcatttaacaatttcttcgctttctaatgtccaagaaaatttgtcaagtacagagccttctatcccagctgcctagtaactagttcctggacagtaggaagctttcttcagtgtcctgagaagcataggaagcttccttgtgataggttatgcaagtaaattctgcataggacagcattgttccacattgtttcacatatttgtaccaatatattcgagt

SEQ ID NO: 32336 - protein, 325 aa, Panicum virgatum
  misc_feature: Ceres CLONE 1910314
  misc_feature (10)..(319): Pfam Name: IU_nuc_hydro Pfam Description: Inosine-uridine preferring nucleoside hydrolase
  misc_feature: SWISSPROT Homolog: EC 3.2.2.8 Ribosylpyrimidine nucleosidase
MGQDGHQIRRHKLIIDTDPGIDDSMAILMAFREPSVEIIGLTTIFGNVSTEGATRNALLLCERAGHSEVPLAEGSPEPLKGGKPRIADFVHGSDGIGNLFVPEPTTRKVEESAAEFLVNKVSEFPGEVSVLALGPLTNVALAVKKDPSFASKVKKIVVLGGAFFAAGNVNPAAEANIHGDPEAADIVFTSGADIVVVGINITTQACFTDEDLLELRNSKGKHAQFLSDMCKFYRDWHAKSDGFHGIFLHDPVSFMALVRPEYFTFKKGVVRVETQGICTGHTLMDQGLKKWNSENPWSGYKPISVAWTVDVPKVISFIKKLLMAP

SEQ ID NO: 32337 - DNA, 520 bp, Panicum virgatum
  misc_feature: Ceres CLONE 1910340
  misc_feature: Encodes the peptide sequence at SEQ ID NO. 32338
aacaggcggtgactcctctcctctcctctggtcagaggatcgaaagacgggaacagcctgctcctccctgactactccatcttccttcccgcaaggcctggtcgaccggttggctggttccttatccggcggaggttgttgctctaggctatcgcatcgtcttccgcagctcgcgccggtcgattgaaccatggacaacccaccgcccccaacgaatgccgcggccggtgctcctcattcgtccccttcgccgacgcggcggctgccagacttccagcagtcggcgcggctcaagtacgtgaagctggggtaccactacctcatctcccacgggatgtacctgctgctcacaccgctgatggtgttcgtggtcttgcacctctccacgctctccccgcgcgacgcgccctagctgtggacgcacctccgcctcaacctcctctccgtgctcgcctgctccgcgctcctcgtcttcctcaccactgcctacttcctcacacgaccgcggaccatgtaccta

SEQ ID NO: 32338 - protein, 73 aa, Panicum virgatum
  misc_feature: Ceres CLONE 1910340
  misc_feature: SWISSPROT Homolog: EC 2.3.1.119 Icosanoyl-CoA synthase
MDNPPPPTNAAAGAPHSSPSPTRRLPDFQQSARLKYVKLGYHYLISHGMYLLLTPLMVFVVLHLSTLSPRDAP

SEQ ID NO: 32339 - DNA, 603 bp, Panicum virgatum
  misc_feature: Ceres CLONE 1910388-R
  misc_feature: Encodes the peptide sequence at SEQ ID NO. 32340
cgagggcggaggccgcggagctgcacgacgcggtggtggccaggaagcagacgctgcacggcgacgtcgcgcgcatagtcggctcgaggagcaagccgcagctgaaggcgacgttcgagcggttcaggcaggagcacggcagggccatcgacgacgtcctcgaggaacgccgcggcgaccagctcgcggcggtgctcaagaccgcggtgtggtgcttggcatgccccgagaagcatttcgcagaggtgatccggatctccattgttgggctcggcaccgacgaggagtcgctgacgagggccatcgtctcgcgcgccgaggtcgacatgaagaaggtgaaggaggagtacaagacgaggtaccgcaagacggtcaccagcgacgtcaacggcgacacgtccggctactacaatggcatcttgctcaccctagtggggcctgagtaaaatggccatggatgatggatctctgtaggttggagggcagattgatacgtagctgttcttgttttggatatgattgcacaacgtgaaactgtcatgtggcgtgtgttcttgtagtgatgcaaaactgctgagtgaaatggtgatatttgtgatgatc

SEQ ID NO: 32340 - protein, 147 aa, Panicum virgatum
  misc_feature: Ceres CLONE 1910388-R
  misc_feature (78)..(143): Pfam Name: Annexin Pfam Description: Annexin
  misc_feature (3)..(67): Pfam Name: Annexin Pfam Description: Annexin
RAEAAELHDAVVARKQTLHGDVARIVGSRSKPQLKATFERFRQEHGRAIDDVLEERRGDQLAAVLKTAVWCLACPEKHFAEVIRISIVGLGTDEESLTRAIVSRAEVDMKKVKEEYKTRYRKTVTSDVNGDTSGYYNGILLTLVGPE

SEQ ID NO: 32341 - DNA, 1394 bp, Panicum virgatum
  misc_feature: Ceres CLONE 1910388
actacaagtacttgcttatagttgttgggctctgctagctctcgcgtcgctctcggtggcgactcgggggacgccccgcgccgccgcccaccaccccacccgtgctgcctccggcggcggcccgcggccgagccgaagccggttatgctcctcccccttcctctctcttccctcccacctctctccccccggccttcaacctcgctcgtcggcgctccaccgccggtcgccgggccggatccggcgccctcctcaccggatccaaggtcccctgggccggattcgtcttcgcccctgtttcccggccggctggcgtgctgtgccccgggggttcggttggacaggggcgcgcggccgtcgccggcgctccctccggtcgcgccgcccttcctgtctggccctgctccggtctcgcggtggcttgccgtgcctcgggtggccgggggccgtcaccgccggtactctccccggggtgggttgccgggcctcgagtggccgggggcccgtcgccgccgttactcgccccgaggtgggctgccaggagcgtgcgccgcctccgggagggcgctcgtacgtcctcgtgggggctggggctggtgctcttgccctgggtcgctgggcgccggtgctccctccgcctggttcttggtggcgtctgggcggttggcttcgcccccgctggctgccctgtcttggtggcctaccatggcggggaccggggtgccagccggaggactcttcggttccatggtgactttggggagggatttgggtggaggcgaaagccttacgtccgctctcgggccaatgacggcgacactctcgggcgccgctaaccttgttgaaggcgtcatctttcccccttccctcctctccggtgagctctccgggtgaaaaccttgactatggtggtcgggcggcgacggcgcctttggcgtcgctccctcccttgaggcgtcgtcttggaagctttggtggtggtcgtcgcttgctctcttcggagagtttccgcttttgcgcctatcttcgctcggttgcatctactttgttcgggctgcgtcggtcgtcgtctggcagatgctttgctgcctctctcttcgcggcggatgctttgccgtcgtttgctctggcggttgctttgtcgccgctgtcgtgttggtcgggaaccacctcggacggatgctttgccgccgtggtttgctggttggatggatgctttgccacctttgttgtgctgtcgatctttgcagccttaacgttgtaggtttcttaagcaggttcatttgtggctaggtctgtaggttcgggtgagtctcatcctccgttgttcttgctgttcatgtttgttgtgtggttgtccgccacttgctgagtggtgtttgtttctgcctcaa

SEQ ID NO: 32342 - DNA, 682 bp, Panicum virgatum
  misc_feature: Ceres CLONE 1910393
  misc_feature: Encodes the peptide sequence at SEQ ID NO. 32343
gcggaggagaaaaggccttccggctgcggacgcaaacggaccggccacgcgcccccctgcgatccgcgagacgcttccctccaaatccccctcaggcaggaccgcgcggggccgtggcggagcgcctcgccgcctccctcctccgctcggccgcctcctcggcggctgcgcgcggcgtcgcggtcggggccgcgggcgccccgtgcttcccttgccgggggggcgggagaggggggtcgagtggacgatcatctgacgctgggcgcggcggcgggccgggcgccgctgcgggtggcggtgctggtgagcggtggggtggacagcagcgtcgcgctccgcctcctccacgccgccggccaccgctgcaccgcgttctaccttaagatttggttccaggaagatttcaggaacttttggtccgagtgcccgtgggacgaggatttaaagtatgcacaagctgtttgtgacaagattgatgtacaattggaggtggtccatctgtccgatgagtactggaaccatgtggtatctcacatcatcaatgagtatcgctgcggccgcacaccatatcctgatgttctttgcaatacaagagtaaagcttggggctttcttagaagctattgaagatctgggatttgactacatagcttcgggacattatgcatatgtagtccatcctt

SEQ ID NO: 32343 - protein, 227 aa, Panicum virgatum
  misc_feature: Ceres CLONE 1910393
  misc_feature (96)..(227): Pfam Name: tRNA_Me_trans Pfam Description: tRNA methyl transferase
  misc_feature: SWISSPROT Homolog: EC 2.1.1.61 tRNA (5-methylaminomethyl-2-thiouridylate)-methyltransferase
AEEKRPSGCGRKRTGHAPPCDPRDASLQIPLRQDRAGPWRSASPPPSSARPPPRRLRAASRSGPRAPRASLAGGAGEGGRVDDHLTLGAAAGRAPLRVAVLVSGGVDSSVALRLLHAAGHRCTAFYLKIWFQEDFRNFWSECPWDEDLKYAQAVCDKIDVQLEVVHLSDEYWNHVVSHIINEYRCGRTPYPDVLCNTRVKLGAFLEAIEDLGFDYIASGHYAYVVHP

SEQ ID NO: 32344 - DNA, 681 bp, Panicum virgatum
  misc_feature: Ceres CLONE 1910395
  misc_feature: Encodes the peptide sequence at SEQ ID NO. 32345
gtcccattcggtcagtgcagtgatagctcccgctagcagctcgccgcagctcagggcggctcgcacccagatcccaatgcgcgccgccgcgccgctctaggccgagagaagctgaggtgagaccgagacgcccgggggtcgcgcgccggaataccgagatcgacgtgcagccatgacggccctcgccgcggtggcgctcgtcgccgccgccgcgccggtggtagaggcggttggagaggaggaccgggcgaggctgcgggcggtggcggggcgggcgccgctgggggtgggggagctggtgagcggggggggggagagcaacgacgcgctccgcctccgccacgccgacggccaccgctgctccgtgttctaccttatcatttggttcgaggaagatttaacgaactttgggtccgagtgccggtgggaggaggatttagagtgtgcactggctgtttgtgacaagattgaggtgctgttgaaggtggtccatctgtccaaggagtactggaaccatgtggtaactcacataatcaatgagtatcggtgcggccgcacaccacgtcctgatgttcattgcaatacaagaatagagattggggctttcttagaaactattgaggatctggaatttgactacatagcttcaggacattgtgcgtatgtgctggatcattctgt

SEQ ID NO: 32345 - protein, 169 aa, Panicum virgatum
  misc_feature: Ceres CLONE 1910395
  misc_feature: SWISSPROT Homolog: EC 2.1.1.61 tRNA (5-methylaminomethyl-2-thiouridylate)-methyltransferase
MTALAAVALVAAAAPVVEAVGEEDRARLRAVAGRAPLGVGELVSGGGESNDALRLRHADGHRCSVFYLIIWFEEDLTNFGSECRWEEDLECALAVCDKIEVLLKVVHLSKEYWNHVVTHIINEYRCGRTPRPDVHCNTRIEIGAFLETIEDLEFDYIASGHCAYVLDHS

SEQ ID NO: 32346 - DNA, 2207 bp, Panicum virgatum
  misc_feature: Ceres CLONE 1910400
  misc_feature: Encodes the peptide sequence at SEQ ID NO. 32347
aggagatagagcatggagcacgcggcgcagaacctcgcaagcaatgttgggcagctgctggccgcggagtatcggcagctccgcggcgtcggcggcgagatcgccgagctgcgcgacgacttggccaccatgaacgccctcctccggatgcagtcggaggccgaggacggggccgttgaccacttcgtccgggagtggatgaagcagctgcgcgagctcgcctacgactcagaggactgcatcgacctgtacctgctccgcatcaagtgccgcccgggcgaaggcgtgcgcgccagggcgaggcgcctgctcgcgacgttcttccctcgccgcagcctcgccggcgagatcagagcgctccgcgcccgcgccctcgccatcagcgagcgccacgcgcgctacggcgtcagccgcgacgcgctcatgcgccgctcccctctcttacctgccccccagatgctgacgtcgacggcctccgccgccgccgcacctaatcagcacgcgctgagccgtgccaacgagcagcctgagcacagccgggtcgtcggcatcgaggaccaggtcgacacgctggccggccggctgagtccggccgtcgagggagagcgctatctgaaggtgttttccgtcgtggggttcgggggcgtcggcaagaccacgctggccctggaggtgtgccggcggctggagccggagttcccgtgccaggccttcgtttcggtgtctcaggcgttcgagccgagcagggacctcaagccgctgctcaggcgtgtgctggagcagatcgtcaagaccaaagcagagaacgagaaaggtatcaaggaagaggggtcgcttggtgacatcgacggcttggatgctgatctgctggcccgaaaactcgcgcacaaagtcaaggacatgaggtacctcattgtactggatgatgtatggaccgtacgaacatgggagtcaatccaatcggttttaccagagaacaattgcaacagcagaataattgtgaccactaggatggagacagtggccaaagtatgcagtccagccagtattgttaagggtcatttcatccattatatggaacctctcaagctcgaagattccaaaaagttgtttctgagcagagcatttggctctgtggatgcctcttatcccacggagttcaacgatgtaatggacaatatcttaagaaaatgcggtggactgccactggccatagttagcattgccagcgttttggcaggctacaagtcatccggcagtatagacaagtgggaaaccatatgcaaatcaatagtttctcagatggagagcaaccctaccttggaggggatcaggcagattgtcacagtcagtttcaaccacttacctcatgagctcaagggttgcatgatgtaccttagcattttccctgaggattacgagatcagtaaggaccgactcttgtgcagatggatcaccgagggattggtcttggagaagcaggggttgacacagatggaggttgcagaatcctacttggacgagctactgagtaggaacatgatcaaagccaaccgtttggacgagcacaagagggatcaatcgtaccaggtgcatgacctgcttctcgagatcatggtgtccaagtctttagaggctaactttgttagcctgaaaggagggcggtacgacgggatgtcgtacgacaggatccgtcgcctctccatacatgacagcgccgatgttggtgcatactcaacttccaaggtaaaggtaacagttgatcaccgaggcaccgaagaggtgaacctgcagcatgttcgatcactgagtatgttccagctccaagggcacaagctccttgaccaactaggcgacttcgccttgctgagggtgcttgacctggaaggttgcgagggggtaaccaacaagcatgtgaggtacgcttgtcagttgcacctactcaggttcctgagcatgaagaatacaaatatcagcgtggtgcctcctcaaattgggaatctggagcacctacagacgctcgatgtacggacaacccttcttgatcacctgcctgaaactgtcacaaagctggaaagactcgagcgcctcaagttctccaagaggggcttggatatcaagtgggtgttgccccggggcctcagcaagatgaaggcgcttcgcgatgtgggtttagtacgtctcggaaatgactcccaagtcgcccg

SEQ ID NO: 32347 - protein, 731 aa, Panicum virgatum
  misc_feature: Ceres CLONE 1910400
  misc_feature (161)..(491): Pfam Name: NB-ARC Pfam Description: NB-ARC domain
MEHAAQNLASNVGQLLAAEYRQLRGVGGEIAELRDDLATMNALLRMQSEAEDGAVDHFVREWMKQLRELAYDSEDCIDLYLLRIKCRPGEGVRARARRLLATFFPRRSLAGEIRALRARALAISERHARYGVSRDALMRRSPLLPAPQMLTSTASAAAAPNQHALSRANEQPEHSRVVGIEDQVDTLAGRLSPAVEGERYLKVFSVVGFGGVGKTTLALEVCRRLEPEFPCQAFVSVSQAFEPSRDLKPLLRRVLEQIVKTKAENEKGIKEEGSLGDIDGLDADLLARKLAHKVKDMRYLIVLDDVWTVRTWESIQSVLPENNCNSRIIVTTRMETVAKVCSPASIVKGHFIHYMEPLKLEDSKKLFLSRAFGSVDASYPTEFNDVMDNILRKCGGLPLAIVSIASVLAGYKSSGSIDKWETICKSIVSQMESNPTLEGIRQIVTVSFNHLPHELKGCMMYLSIFPEDYEISKDRLLCRWITEGLVLEKQGLTQMEVAESYLDELLSRNMIKANRLDEHKRDQSYQVHDLLLEIMVSKSLEANFVSLKGGRYDGMSYDRIRRLSIHDSADVGAYSTSKVKVTVDHRGTEEVNLQHVRSLSMFQLQGHKLLDQLGDFALLRVLDLEGCEGVTNKHVRYACQLHLLRFLSMKNTNISVVPPQIGNLEHLQTLDVRTTLLDHLPETVTKLERLERLKFSKRGLDIKWVLPRGLSKMKALRDVGLVRLGNDSQVA

SEQ ID NO: 32348 - DNA, 2201 bp, Panicum virgatum
  misc_feature: Ceres CLONE 1910411
  misc_feature: Encodes the peptide sequence at SEQ ID NO. 32349
cccaatccagccgagcaccgcaatcgcagggcaccgggggcgattaaaaaaggcagccctcccccgcaaaggtaaaaacaaacaaccaccaccgcatcgcggcaggcaaggcatcgctcgccagccaccgagcggaggaggggggacgccaggggggaagcaaaagcttcgataaaaaggagaggaggagacgaggcgtgccgtccgaacccaagcaacttccccccaccacccccctcccctcccctcccatgcccgcatcgagatcttaagcgggacagcgagaggagaggcgacgcgggcgcgggcgacccccgatccgtcctcgccgccgccgccgccgaccgaccgaccgggggaggaggaggggaggggaggacggacgccatggaggccgactccgggaagctcttcgtcggcggaatctcctgggagacggacgaggaccgcctccgcgagtacttcggccgcttcggggaggtcaccgaggctgtcatcatgcgggaccgcaacaccggccgcgcccgcggcttcggcttcgtcgtctttgctgactccgccatcgccgagcgagttaccatggataagcatatgatcgacgggcgcatggtggaagccaagaaggctgttcccagggacgaccagagtatcgcaagcaagaacaatggcagcagcatagggtcacctggaccaggacgtactagaaagatctttgtgggaggcctggcatcaaatgttaccgaggttgaattcagaaggtactttgagcaattcggtgtgataaccgacgtggtcgtgatgtacgaccacaacacgcagaggcctaggggatttggtttcatcacctatgactcagaagatgcagtggataaggctctgcacaagaacttccatgagctgaatggtaaaatggttgaggtcaagagggctgtcccaaaggagcagtctcctggaccaattgcacattcgcctgcaggagggcagaactatgctatgagcagagttcataacatcctgaatggcttcaaccagggttacaacccgaaccctattggtggttatggcatgagggtcgatggaaggtacggtctccttacaggtgcacggaatgggttctcttcgtttggtccaggttttggaatgggcatgaatattgaaggtggaatgagtggaaattttggtgcaggctctggtttcatcaatagctccaatgggaggcaaataggttcttactacaatggtagttcaaacagattaggtagtcctattgggtatgttggccttaatgacgattcaggatcaatactgagttcaatgtcaagaaatgtatggagtaatggaaatctgaactacacgggcaatcctacaaacatgaatgctttttgtccacctggaagtggtgggggcattcctggtgatggtattagttggggaggccttacttctgctcatgggatgggcaacatttcaagccttggttcgggaaaccttggccgtggaactggagataacaactttggcttgccttctggcaactatgtgaggagcaattcaactggtaccattggcgagccattttctgcatcagccaatgcatatgaatcgaacaatccaggtgcatatggcagcagctctatttatggtgacacaacctggaggttcacctcatctgaggtagacatgcctccttttggtcatgatcttggaaatgtcgatccggatatcaaatcagaaatatcagcaggttatatgggcaactatactgttaataataatcagacaagcagaggtatcacttcctagggagagtactattatattcatatatgacttgggataggtgaaacacccactactatatcaggctttcaggtgcatgactgtgaattggtgatgtcagattaatatatgggttagttgcttgtttctaggtaaccagaggtgtggtttacgaacaccaaaaatgctagaggagcggatacaaacattttgtgaagctttcagattttagtttaatttctacgtgtattaggtctttgttttttgaatgagatgtgcagtgttgattgcggcacatacttagaagtgttccaacataagctggaaatctgtcatacggaaggataaacttgtataccaaaggaatgctgtattatctttgcccatttatggctacattagctcgcttgttttaattctcg

SEQ ID NO: 32349 - protein, 471 aa, Panicum virgatum
  misc_feature: Ceres CLONE 1910411
  misc_feature (108)..(178): Pfam Name: RRM_1 Pfam Description: RNA recognition motif. (a.k.a. RRM, RBD, or RNP domain)
  misc_feature (8)..(77): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MEADSGKLFVGGISWETDEDRLREYFGRFGEVTEAVIMRDRNTGRARGFGFVVFADSAIAERVTMDKHMIDGRMVEAKKAVPRDDQSIASKNNGSSIGSPGPGRTRKIFVGGLASNVTEVEFRRYFEQFGVITDVVVMYDHNTQRPRGFGFITYDSEDAVDKALHKNFHELNGKMVEVKRAVPKEQSPGPIAHSPAGGQNYAMSRVHNILNGFNQGYNPNPIGGYGMRVDGRYGLLTGARNGFSSFGPGFGMGMNIEGGMSGNFGAGSGFINSSNGRQIGSYYNGSSNRLGSPIGYVGLNDDSGSILSSMSRNVWSNGNLNYTGNPTNMNAFCPPGSGGGIPGDGISWGGLTSAHGMGNISSLGSGNLGRGTGDNNFGLPSGNYVRSNSTGTIGEPFSASANAYESNNPGAYGSSSIYGDTTWRFTSSEVDMPPFGHDLGNVDPDIKSEISAGYMGNYTVNNNQTSRGITS

SEQ ID NO: 32350 - DNA, 2260 bp, Panicum virgatum
  misc_feature: Ceres CLONE 1910427
  misc_feature: Encodes the peptide sequence at SEQ ID NO. 32351
gcacccgtctcgcctctgatcccatccttcttcctcgactccgtcggccaccgccaccgctcgccggcggcgccggccatccgagctcggaaaggtcccgcctttcctgctaagatcccaccttgctttatcgagccaactaacctcgcctgctccgtactagctagctagttgattggtggggcgttcttgattcgtgaagcgaccgtacagtaggatcgtgctcgcgccgcctgagggttgcgtgcaggatggtcgtcaaagattgggagtgaggaagcagctcaacgcagtcgtggaggctaaatgtaccgcaagaacgactcggcactctcctgcttctacctcttcctcctctggttcttcttcttgaaatagaccagcccggcccagcgagagcaactcgactgcgattgagatcgatcgctgtctcgttgtttggtccgtgtgaggctgaggtgattctttcctggttgtttgctccggcaagaatcgcaaggtgcttcgagaaggagggaggagatggagctggatctgaacgtggccgaggtggcgccggagaagacggcggcgatggccacgagcgactccggctcatcggagtcgtcggtgctgaacacggaggcgtccggcggcggggccgcgccggcggaggagggctccagctcgacgcccccgccgcccgccgtgctcgagttcagcatcctcaggagcgagagtgacgcggccggcgccgacgacgacgacgacgccacgccgtcgccaccgcaccaccaccaccagcagcagccgcagctcatcacccgggagctctttccggccgccgcgggcccgccgcgcccgctgccgcagcattgggccgaccttggcttcttccgcgccgagccgccgcgcccgcagcctgacatcaggatcctgccgcacccacacgccacgccgccggcgccgccgcccgtgcagccacaggcggccaagaagagccgccgcggcccgcgttcccgcagctcgcagtaccgcggcgtcaccttctaccgccgcaccggccgctgggagtcccatatctgggattgcggcaagcaagtgtacttaggtggatttgacactgcccatgctgctgcaagggcgtacgatcgagcggcgatcaagttccgcggcgtcgacgcggacataaacttcaatctcagtgactacgaagacgacatgacgcagatgaagagcctgtccaaggaggagttcgtgcacgtcctgcgacggcagagcacggggttctcgcggggcagctccaagtacagaggcgtcaccctgcacaagtgcggccgctgggaggcgcgcatggggcagttcctcggcaagaaggcttatgacaaggccgcgatcaaatgcaatggtagagaggccgtgacgaacttcgagcctagcacatatgacggggagctgctgtccgaagttggaactgaagcgggtgctgatgttgatctgaacttgagcatatctcaaccggcatctcagagtccgaaaagagataagaactccctcggtctgcaactccaccatggatcctttgagggctccgaattgaaaagaacaaaggttgatactccccatgagctggccggccgccctcatcggtttcctgttatgactgagcatccaccgatctggcctgcccaatctcaccccttctttacaaataatgagagtgcatcaagagatcttaacaggaggccatcagagggggggacagggggtggtgttcccagctgggcatggaaggtgacagcccctcctcccaccctgccattgccgctcttctcgtcgtcgtcgtcgtccgctgcagcatcatcaggattctccaataccgccacgacagctgcccttgccaccccatcgtatgcctccctccggttcgacccgccgtcgtcgagccatcaccgctgaaaatcaagaagccacgctgtaaatttgccgggaagctggcattttccccctctgggcgttgcaactttttcggttttgcgccggggtggtttcttgtagtggattggattggtaactgcattttcataccgcccaagtgaaatggttctctctttacacatacttcaacatccttagctctgggagttgctgctgctggagattgactaacttcaacatctgagattgatctatacattgtgtagagaatcatttctgaactattaacatacagatcagtataggtatcataagccatgtcctctacttgtggacaaagttc

SEQ ID NO: 32351 - protein, 471 aa, Panicum virgatum
  misc_feature: Ceres CLONE 1910427
  misc_feature (162)..(212): Pfam Name: AP2 Pfam Description: AP2 domain
  misc_feature: Useful for making plants with altered alkaloid content
  misc_feature: Useful for making plants with modulated nitrogen use efficiency
  misc_feature: Useful for making plants with modulated seed size
  misc_feature: The sequence is a functional homolog of SEQ ID NO 1785 in the 11/479,226 US patent application
  misc_feature: Useful for making plants with modulated flowering time
MELDLNVAEVAPEKTAAMATSDSGSSESSVLNTEASGGGAAPAEEGSSSTPPPPAVLEFSILRSESDAAGADDDDDATPSPPHHHHQQQPQLITRELFPAAAGPPRPLPQHWADLGFFRAEPPRPQPDIRILPHPHATPPAPPPVQPQAAKKSRRGPRSRSSQYRGVTFYRRTGRWESHIWDCGKQVYLGGFDTAHAAARAYDRAAIKFRGVDADINFNLSDYEDDMTQMKSLSKEEFVHVLRRQSTGFSRGSSKYRGVTLHKCGRWEARMGQFLGKKAYDKAAIKCNGREAVTNFEPSTYDGELLSEVGTEAGADVDLNLSISQPASQSPKRDKNSLGLQLHHGSFEGSELKRTKVDTPHELAGRPHRFPVMTEHPPIWPAQSHPFFTNNESASRDLNRRPSEGGTGGGVPSWAWKVTAPPPTLPLPLFSSSSSSAAASSGFSNTATTAALATPSYASLRFDPPSSSHHR

SEQ ID NO: 32352 - DNA, 302 bp, Panicum virgatum
  misc_feature: Ceres CLONE 1910430
  misc_feature: Encodes the peptide sequence at SEQ ID NO. 32353
cggccctttttatcgcccgatctcacacatttctggaaagaagagagagagagagaggaagcgccctgccaaaggaagaaaccgcggcgagaggaggagagggaggaggaacggcggagggcgagcaagatgagagagatcatcagcatccacatcggccaggccgggatccaggttggcaacgcctgctgggagctctattgcctcgagcacggcatcgagcccgatggcaccatgcccagtgatacctcggttggcgtcgcacatgatgccttccacaccttcttcagcgagaccggttc

SEQ ID NO: 32353 - protein, 57 aa, Panicum virgatum
  misc_feature: Ceres CLONE 1910430
  misc_feature: Useful for making plants with altered cell wall content and/or composition
MREIISIHIGQAGIQVGNACWELYCLEHGIEPDGTMPSDTSVGVAHDAFHTFFSETG

SEQ ID NO: 32354 - DNA, 1237 bp, Panicum virgatum
  misc_feature: Ceres CLONE 1910450
  misc_feature: Encodes the peptide sequence at SEQ ID NO. 32355
aggggcaccagcagcaacagccaacagcaaaggctactggaattttttggttgggaaatctcggaggaggaggagctcatggcatggatcgtccgtcctgctgtctgattcgattccgctagctgttccttccgccccactccaataagccctccagctccatccgattcgactcgattcccctcccctgcctcctcgtccatggatgaacggatcaccaccggcggcggggcatgctccgtcggagaatttgcgtgggacgtggtgctctggcgccggggccgcgccgacgccagcgcctgcctgctggcggccaccgccgcctcctggctgctcttctacggcccgggccgcggctacaccgcgctctccctcgcctccgacgtgctcctcctcctcctcaccgtgctcttcctctgggccaaggccgcgcgcctcctcaacaggccggcgccccccgtcccggcgatgcgcgtctcgcagcgggccgtggacgaggcggcggccctgctgcgcgccgccctcgacgccgtctgctccggcttccatgacatcgccacgggcagggactcgctcctcttcggccgggtcttcctctgcctgtgggccctctccatcgtcggcagcctcaccgatttccccaccttctgctacgcgagcatcgtggctgttctgacgctcccagcactgtaccagaaataccaagaatgtgtggacacatacatgaggtttgcctacatgaacctgcgcatgtacgagatggtgtacgagaggttctccatgaaatgcttcatcagggtcagggattgcgtcatggaggtcctcaaggatccatgaccagcttccaccgccattgcatcgcttgcttccacagggattggatttgattttgatttgaattcttctgtatagttttctttgattgagcatagtatatccctatcagcacaggagtggaaaatatagaaggaaatgagtagttctgattggttctgatgattgtttgtttgtttgctccgggtggtgtgcttttatctttgatcttcagctgctgctgctgttcagcttggagcagtctagggtgatgcgaacaaatggctgcagctgttccagtttgatgctcagcgcagccacgatcgcatgtagttttgtgtgcgcgcctgttatcgcccaggctgctttcatgtagctgttgagtttgtacagaaagacaaaactcactgtaaacattttgcag

SEQ ID NO: 32355 - protein, 211 aa, Panicum virgatum
  misc_feature: Ceres CLONE 1910450
  misc_feature (18)..(210): Pfam Name: Reticulon Pfam Description: Reticulon
MDERITTGGGACSVGEFAWDVVLWRRGRADASACLLAATAASWLLFYGPGRGYTALSLASDVLLLLLTVLFLWAKAARLLNRPAPPVPAMRVSQRAVDEAAALLRAALDAVCSGFHDIATGRDSLLFGRVFLCLWALSIVGSLTDFPTFCYASIVAVLTLPALYQKYQECVDTYMRFAYMNLRMYEMVYERFSMKCFIRVRDCVMEVLKDP

SEQ ID NO: 32356 - DNA, 636 bp, Panicum virgatum
  misc_feature: Ceres CLONE 1910454
  misc_feature: Encodes the peptide sequence at SEQ ID NO. 32357
aaagaggacgcgagcccaccccaccccaccgcaccccacccacccgagatccatagccggtggcgacttccatgccgctgccatcgcgtcgccactgctgtccccttgggcctaaggctacccctgcgggatcttggcgccaggcgaggacgaagatgacggattgcttctcttcccccatctgggaggctggtttctgcttccgtgacacgtgttggtagctttactgcattccttaccgtttctctcctgagggccctctgtccagagattatactgtgggacattattatgatgccttctcctgcttcttctcctcgactggctctggtaagtatgtgcctcctgccatcttcgttgatcttgaaccctctgtgatctatgacgcgcgcactggcatgtaccgtcagcttttccaccctgagcagctcatcagtggcgaggatgatgctgcctacaacttcgcccgtggccactatacaattggcaaggagattgttgacttgtgccttgaccgcatctccgatcttgctgacaactgcactggacttcaagggttgctggtcttcaacgctgttggtggtggcgctggttctggccttggttcactcctcctcgagcgcctatctgtggact

SEQ ID NO: 32357 - protein, 79 aa, Panicum virgatum
  misc_feature: Ceres CLONE 1910454
  misc_feature: Useful for making plants with altered cell wall content and/or composition
MYRQLFHPEQLISGEDDAAYNFARGHYTIGKEIVDLCLDRISDLADNCTGLQGLLVFNAVGGGAGSGLGSLLLERLSVD

SEQ ID NO: 32358 - DNA, 349 bp, Panicum virgatum
  misc_feature: Ceres CLONE 1910461
  misc_feature: Encodes the peptide sequence at SEQ ID NO. 32359
aattgtaaagcatttctctcattgctcatgtcctttgattccctccacgcgtgctgctgaacttgcccttctcaccaacattttctacctccaaaatcgatggtggcctccactggtctcctgatccaggtcggctggaatcctccatctacttactgcaaaatctaatactcaagggtaatcgagtacaactgccttgcaatgagggcggacacgcagcttcaatcgcaggtgtaccagctcacccccacccgcaccaggtgtgatttagttgtggtggccaatggaaagaaggaaaagatagcctctggtttgctgaacgcgttcatcactaatcttcacgttgcac

SEQ ID NO: 32359 - protein, 49 aa, Panicum virgatum
  misc_feature: Ceres CLONE 1910461
  misc_feature: Useful for making plants with altered cell wall content and/or composition
MRADTQLQSQVYQLTPTRTRCDLVVVANGKKEKIASGLLNAFITNLHVA

SEQ ID NO: 32360 - DNA, 430 bp, Panicum virgatum
  misc_feature: Ceres CLONE 1910471
  misc_feature: Encodes the peptide sequence at SEQ ID NO. 32361
atttttttccgcgcttgctcgctcccgccacacccaccccccaatgttcctcgcttctccacactccgggctctctgatgcttcctgatttgggtgggagcgcacgaaaggagcttgcatcgctggcgtccgtttccggggctgtctgcggtgtgcagatgccgtgcttgatcgggttggatgcgcccgccggccgccgatcggtcgcggcgcccaaggcccggaacgccaggcggggcgtcctccgctcccggtccgtctcccgctcccgctccgtctcccgccgcgggccgcgttgcgcgcctgccttcgctctcgccaacgccgcaccgattgccgcgacgaaaagggtgttccccttcggcacgggaacgaccaagggatggacgcctttgagcgatttgctggctagtgagggcgcgaacctggc

SEQ ID NO: 32361 - protein, 117 aa, Panicum virgatum
  misc_feature: Ceres CLONE 1910471
  misc_feature: SWISSPROT Homolog: EC 2.7.9.1 Pyruvate, phosphate dikinase
MLPDLGGSARKELASLASVSGAVCGVQMPCLIGLDAPAGRRSVAAPKARNARRGVLRSRSVSRSRSVSRRGPRCAPAFALANAAPIAATKRVFPFGTGTTKGWTPLSDLLASEGANL

SEQ ID NO: 32362 - DNA, 727 bp, Panicum virgatum
  misc_feature: Ceres CLONE 1910480
  misc_feature: Encodes the peptide sequence at SEQ ID NO. 32363
ccttccatccactcgtccagagcaagcgagctcagctagcttcctagctcagcagcagcagcattccagcagctccggctagctcggccactcgctcccgatcggtcgacgcataggtagattgtcgtcagacaatccaacagagagaagatcgagtaggaagatccaaactttttttggtaggaactagctaacaacaactaacagagatcagaagagaaaagcaaggctcggctcggcagataattaatacataatggagaagatgaacatggtggcgagcaggaagcccggcgactggagctgccggtcgtgccagtacgtcaacttctgcaagcgcgaggcgtgccagcgctgcggcgaggccaagctgggcggcgagcggacggactacgccgcgctgggcggcgactgggacgtcaagcccggcgactggtactgctgccgctgcggcgtccacaactacgcctcccgcggcagctgcttcaagtgctccgcctccaagaacgaggccgccgccgccgtcgcccagggctgggggttcaccgtcgccggccaggccgggatgatgcccggcgactggatctgcccaagactgggttgcaacgtgcagaactacgccaaccgaaccgagtgcttcagggtgcatatgcccagatcatactacggtaagcgcactagcggcactcccttgtgatcctgtcaataatacaactgatgacgacat

SEQ ID NO: 32363 - protein, 146 aa, Panicum virgatum
  misc_feature: Ceres CLONE 1910480
  misc_feature (11)..(40): Pfam Name: zf-RanBP Pfam Description: Zn-finger in Ran binding protein and others
MEKMNMVASRKPGDWSCRSCQYVNFCKREACQRCGEAKLGGERTDYAALGGDWDVKPGDWYCCRCGVHNYASRGSCFKCSASKNEAAAAVAQGWGFTVAGQAGMMPGDWICPRLGCNVQNYANRTECFRVHMPRSYYGKRTSGTPL

SEQ ID NO: 32364 - DNA, 557 bp, Panicum virgatum
  misc_feature: Ceres CLONE 1910504
  misc_feature: Encodes the peptide sequence at SEQ ID NO. 32365
ctcccaattccttcgcttctcgatttcacagcagccatttgcagccgagctgaatcgtctggcttcaaatcatcctcccctctctctctctctctctctctctctctctctctcgcagactcccttgttggttggttggttttccccacccatccgacaggaagagaggcatagatctgaggcctggagggcatccctcccgaccagtagcttctgatcttcgctggcccgcagctcgaggatcgccgcaccctaccggactacaacatccacaaggagtccaccctccacctggtgctccgcctgcgtggtggtatgcagatctttgtgaagaccctcactggcaagaccatcaccttggaggtggagtcttccgacaccatcgacaatgtgaaggcgaagatccaggacaaggagggcatccccccggaccagcatcgtctgatcttcgccggcaagcaactggaggatggccgcaccctggcggactacaacatccagagggagtccaccctccacttggtactccgtctgcgtggtggtatgcagatctttgt

SEQ ID NO: 32365 - protein, 80 aa, Panicum virgatum
  misc_feature: Ceres CLONE 1910504
  misc_feature (6)..(74): Pfam Name: ubiquitin Pfam Description: Ubiquitin family
  misc_feature: Useful for making plants with modulated nitrogen use efficiency
  misc_feature: Useful for making plants with modulated cold sensitivity
  misc_feature: Useful for making plants with modulated flowering time
MQIFVKTLTGKTITLEVESSDTIDNVKAKIQDKEGIPPDQHRLIFAGKQLEDGRTLADYNIQRESTLHLVLRLRGGMQIF

SEQ ID NO: 32366 - DNA, 726 bp, Panicum virgatum
  misc_feature: Ceres CLONE 1910529
  misc_feature: Encodes the peptide sequence at SEQ ID NO. 32367
agatctcgaccagcagtgtcagtcgccggcgagcggtaagggcggacggaccaccgtacgcgatgccgccgcccctccaaactctaaccacttccaccctctttctcctcgtcctgctcaccgcttccgccgtttcctgttcttccttgccgccggaggacggcatccgggttgcctctgccgagaaaaggatcgacctcaccagtcccattgtcaaagtctatctaacattgaaggtcgagaatgctccagctgcctctgatgcctcccaagttcttctcgccttcacacccacagaggctcaacatcttgctattgtcaaggccacaagagcagaggggaagcgcaagaagaagacatatgtgcccctctcggttgaagcctctgatctcgcctccactgccctgaatggtgctcgcctctactctattctgctgggcgctcctctgaaacctggcgagacaaccactcttgaagtgttatacgtgctgacacacactttagagccctttcctgctgagattagccagtcagagtccgagctggtttacttccgtgacagtgcggtgcttctctcgccttaccatgttctggagcaggttacttacatcaaaacaccaagcaataggattgagttcttcacaacggtcgatccaaccagtcgtgctggtactgaattgaaatatggcacatataaaaaacaggtgccaaactcatattttgcca

SEQ ID NO: 32367 - protein, 221 aa, Panicum virgatum
  misc_feature: Ceres CLONE 1910529
  misc_feature (34)..(221): Pfam Name: Ribophorin_I Pfam Description: Ribophorin I
  misc_feature: SWISSPROT Homolog: EC 2.4.1.119 Dolichyl-diphosphooligosaccharide--protein glycotransferase
MPPPLQTLTTSTLFLLVLLTASAVSCSSLPPEDGIRVASAEKRIDLTSPIVKVYLTLKVENAPAASDASQVLLAFTPTEAQHLAIVKATRAEGKRKKKTYVPLSVEASDLASTALNGARLYSILLGAPLKPGETTTLEVLYVLTHTLEPFPAEISQSESELVYFRDSAVLLSPYHVLEQVTYIKTPSNRIEFFTTVDPTSRAGTELKYGTYKKQVPNSYFA

SEQ ID NO: 32368 - DNA, 738 bp, Panicum virgatum
  misc_feature: Ceres CLONE 1910533
  misc_feature: Encodes the peptide sequence at SEQ ID NO. 32369
gacactcttgccaccactccctgtcagaccatctgtcagtgtgtggcctcactccccgatccttcgccaggccacaggcaccccgtgagctccgccgctcggcgcctgcctccctcgtccttcctcactgcaggagcaatggcgatggccgccatggcctccccgtcgtccatgaccatgatccccgcgcgccaccacggcgccgcgccatccccgtcaacctccggcgactcctcggtccgccgccaccgcgcgcagccgggccacgtccggcgcggccgcgggacgtccgtctcaacggccgcggcgcggcggcggccgttcctcttcaccccgcgcgccgtgtccgactccaagagctctcagacctgcctcgaccccgacgccagcacgagtgttcttgggatcattcttggaggtggtgcgaggaccatattgtaccccctgacaaagaagcgtgccaagcctgcagtgccattgggtgccaactacatgctgattgatatccctgacagcaattgtctcaacagcaacatctcaaagatctatgtgctgacacagttcaactctgcttctctcaatcatcacctctcaagagcctatggaagcaacattggaagttacaagaatgatcgatttgttgaagtgttggctgcccagcagagtccagataatcccaactggttccaaggtacagcagatgctgtaaagcagtacttgtgactatttgaggagcat

SEQ ID NO: 32369 - protein, 194 aa, Panicum virgatum
  misc_feature: Ceres CLONE 1910533
  misc_feature: SWISSPROT Homolog: EC 2.7.7.27 Glucose-1-phosphate adenylyltransferase
MAMAAMASPSSMTMIPARHHGAAPSPSTSGDSSVRRHRAQPGHVRRGRGTSVSTAAARRRPFLFTPRAVSDSKSSQTCLDPDASTSVLGIILGGGARTILYPLTKKRAKPAVPLGANYMLIDIPDSNCLNSNISKIYVLTQFNSASLNHHLSRAYGSNIGSYKNDRFVEVLAAQQSPDNPNWFQGTADAVKQYL

SEQ ID NO: 32370 - DNA, 724 bp, Panicum virgatum
  misc_feature: Ceres CLONE 1910539
  misc_feature: Encodes the peptide sequence at SEQ ID NO. 32371
gttttacccatcggcagcttcgtcttccctcgtccactgcgacggcgaaggacgccgggcgcgcgccacccgcgatgtacgggcttccttcggccgcgccggccccgctaccgtctcactccgcctgctcggcttcttcctccgttcctcgggcgagggcggcgtcggcgtactgctgcgccagtctgaagcaggcgcgtccttccgccgtcgctgcggccatagcggggcgcgcggccgcgccgctcttggctgcggcactcctcctcgcagctgcgccccctggcgaaccttctgccccctctccagcatttgcacaaccaatttcggaaggcgcagcgttgttccggaaggtctgcatcggctgccataacatgggaggaaacatactacagcccggagccactcttttcctgaaggatctcgagagaaatggagtcaccacagaggaggaattgtataacatcacatactacgggaaggggaggatgccgggctttggagagaaatgcactccaagaggacagtgcaccttccgtccccggctgtctgaagatgacatcaagctcctagcttcgtttgtcaagtcacaagccgaagacgggtggccaaagatcgaagatataaagcttctgttgcattgccgaatcttgacgagcttttggaagcactccaactcatgagttgcatccttgtgggtatggaatggaggcagacaaaatat

SEQ ID NO: 32371 - protein, 202 aa, Panicum virgatum
  misc_feature: Ceres CLONE 1910539
  misc_feature (84)..(174): Pfam Name: Cytochrom_C Pfam Description: Cytochrome c
MYGLPSAAPAPLPSHSACSASSSVPRARAASAYCCASLKQARPSAVAAAIAGRAAAPLLAAALLLAAAPPGEPSAPSPAFAQPISEGAALFRKVCIGCHNMGGNILQPGATLFLKDLERNGVTTEEELYNITYYGKGRMPGFGEKCTPRGQCTFRPRLSEDDIKLLASFVKSQAEDGWPKIEDIKLLLHCRILTSFWKHSNS

SEQ ID NO: 32372 - DNA, 964 bp, Panicum virgatum
  misc_feature: Ceres CLONE 1910543
  misc_feature: Encodes the peptide sequence at SEQ ID NO. 32373
cgaacctagcacggccgccgccgccccgcttcctcccaatggcgtccctcttcaaggacccgagcaagctgtcggcgtacagggaccggcggttcccggggacgcaggaggagtacgaggcggcgctgcaggcgtcgacgacggtgtacatcgggaacatgtccttctacaccacggaggagcaggcctacgagctcttctcccgcgccggcgagatcaagaagatcatcatggggctcgaaaagaactccaagaccccctgcggcttctgcttcgtactgtactactccagggaggatgctgaagatgctgtcaaatatattagcggaacaatgcttgacgatcgtccaatccgcgttgatttcgattggggctttgaagaaggcaggcagtggggccgtggacggagtggcggtcaagtcagagacgagtaccgtacagattatgatccaggaagaggtggttatggtaagatggttcagaaggagctagaagcacaaagagaattagttgactatggtggatcatttcaaccaaatgcaccacctccattgtcagatgagagaggtgaacgcaagagaggatatggagactcgtacaggaatgacagaggagattaccaacggaaacgctaccggaatgatgaacggtctgcggccgaggggtccaggagagctgactcagatcaagcggagaagaatcctaggttccgagagaaaggcgactctgatgaggaagaagacgactatgacaagaggcgccgtcgctgaacctgtgtaacaattgttgcttgcatgcagttattctgatgcccggttactgcagaagaatccacaaaatgcagcattatctgtttcaccttgctgtacaacagactatgacttatccttgttgggccggtcctctgtctcgtgcccgtcatctgttaatcagcatttgcatgggatgatgctgatttgagtac

SEQ ID NO: 32373 - protein, 243 aa, Panicum virgatum
  misc_feature: Ceres CLONE 1910543
  misc_feature (36)..(107): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with modulated water use efficiency
MASLFKDPSKLSAYRDRRFPGTQEEYEAALQASTTVYIGNMSFYTTEEQAYELFSRAGEIKKIIMGLEKNSKTPCGFCFVLYYSREDAEDAVKYISGTMLDDRPIRVDFDWGFEEGRQWGRGRSGGQVRDEYRTDYDPGRGGYGKMVQKELEAQRELVDYGGSFQPNAPPPLSDERGERKRGYGDSYRNDRGDYQRKRYRNDERSAAEGSRRADSDQAEKNPRFREKGDSDEEEDDYDKRRRR

SEQ ID NO: 32374 - DNA, 605 bp, Panicum virgatum
  misc_feature: Ceres CLONE 1910551
  misc_feature: Encodes the peptide sequence at SEQ ID NO. 32375
gcccagcccagctcccgctgcccagccctgccaagccaagcccgtcggccaccgcacatcccggggaacccaatcccatcgcgaacgcagaagatcccgtgccagcgggctgcggcggcggcggtggcgacggtggtggactggacggactactagtagccataacccgtatccaatagcccgtccattccatccagccagagccagacctcccacccgcatcctcctccgcgccggcggcaatgggccggctcgtgctctcggagtgctgcagcctcgtgccgctgagcatgcgcgccgtggggcgtgccgttgccgctttcgcccacagcacctaatctccgggaaggaggatgcggctaacaactttgcccgtggccactacactgttgggaaggagattgtcgatctgtgcctcgaccgagtgcgcaagctagcagacagttgcactgggctgcagggatttttggtgttcaatgctgttggtggtggtactggctctggacttggttcactgctgttggagcgcctctcagttgattatggcaagaagtccaagctcggcttcaccatttatccttccccgcaggtgtcaacagctgttg

SEQ ID NO: 32375 - protein, 201 aa, Panicum virgatum
  misc_feature: Ceres CLONE 1910551
  misc_feature (72)..(200): Pfam Name: Tubulin Pfam Description: Tubulin/FtsZ family, GTPase domain
PSPAPAAQPCQAKPVGHRTSRGTQSHRERRRSRASGLRRRRWRRWWTGRTTSSHNPYPIARPFHPARARPPTRILLRAGGNGPARALGVLQPRAAEHARRGACRCRFRPQHLISGKEDAANNFARGHYTVGKEIVDLCLDRVRKLADSCTGLQGFLVFNAVGGGTGSGLGSLLLERLSVDYGKKSKLGFTIYPSPQVSTAV

SEQ ID NO: 32376 - DNA, 1767 bp, Panicum virgatum
  misc_feature: Ceres CLONE 1910564
  misc_feature: Encodes the peptide sequence at SEQ ID NO. 32377
atgctacagcacactgcacactcactgcatatacaggagagagagagagataaattgctccatagcaaatccaaaagttgagcctgagtagtagagtaccacgcctcgccgcaggcaggcatcttgtcttgttgctctttccttgatccgtccatggcgcttttgcagccgcagggctcccctcccctccagccatagcgttttagtgcatgaatgctccttctgcacctccctcatcaccatagcttgcagcatcagcatcagcctacctcgcgagtattagatcaacagtgcagtgaaactgtccaatgcggcagtgccagccaccaccaccggcactcatcacctccatcagattcagacctgcagctttgcctcgcattaatcaaggttttatttgcaagatggatcatagcttcagcgacatgatcttgagcgagaccgcgtggagcggcggcggcgacggagggtcggtcttgctgccgccgccggaggtgggcggtgttggtggcgttggcgttggcgtcgaggggggcaacatgtcggtgctggagaggctagttctcgacgaggccctggcggcggcgatcctggagctgcagggcatccaggcgcccgccgcctgcgccggcaaggcgccggcggccggtggtggcgtggtcggggaggccgtcgccttccccgcgatggcgacgccaacgcccgcctacgcggacgttgacgcggatgtcctccagcgacagcagcatcgccatcgccatcagggcgcgatggggatggcaccggactacgacctcacaccagcaacagccgctgtcgcggtaactactgcgccggctgccttcatcacaggcgccgcagcggcggttgacagcggcggcctcgtcgttgacgcgccggtcttctccggccacgagaccggcgcgccgggggccgcgacagcaacggcggcggcggccgtgacggcgacgacgacgagccagcggtgcgaagaaggaaaaggaggcggcggccggaggcaacgccggcccaccaggaagcggaaagccgccgccgagccgtcctccgtgccggcgcaggagagcaccctgtgcagcctcctggcgtccaccacggcgggcgagggcggcggcatccagatcgccttcagcacgagcgctcaggctcccgccggcggcgccaagagggcgatgcgccccgtctccctcggctccgacgacgccggcgagcggccgcgccggcgcaacgtgcgcatctcctccgacccgcagacggtggcggcgcggcagcggcgggagcgcatcagcgagcgcctccgcgtgctgcagaagctcgtcccgggcggcgccaagatggacaccgcctccatgctggacgaggccgccaactacctccgcttcctcaagtctcaggtccgggagctgcaaaccctagaccgccggaactacgccagcaacgtgaacaacgccatagcggcgccgcctccaccatggccgggtcactgagctacaacgatggcaacggtgtgccatgcgctggccttcaatttcattctcggcagcagccgaaaccctacgaggaggagggggaggtgccgatcgagctagcagctgatttagtcacttagttggatgatgcatgatagatttgtaacactcatgcatgttgctgttaatactttttatgtctgtccaatgtgcgtgcatgagaccatcttatgatgtattcatcattgttaattcaaatactagggagatgatgatgatg

SEQ ID NO: 32377 - protein, 366 aa, Panicum virgatum
  misc_feature: Ceres CLONE 1910564
  misc_feature (287)..(334): Pfam Name: HLH Pfam Description: Helix-loop-helix DNA-binding domain
  misc_feature: The sequence is a functional homolog of SEQ ID NO 1939 in the 10/374,780 US patent application
  misc_feature: The sequence is a functional homolog of SEQ ID NO 1938 in the 10/374,780 US patent application
MDHSFSDMILSETAWSGGGDGGSVLLPPPEVGGVGGVGVGVEGGNMSVLERLVLDEALAAAILELQGIQAPAACAGKAPAAGGGVVGEAVAFPAMATPTPAYADVDADVLQRQQHRHRHQGAMGMAPDYDLTPATAAVAVTTAPAAFITGAAAAVDSGGLVVDAPVFSGHETGAPGAATATAAAAVTATTTSQRCEEGKGGGGRRQRRPTRKRKAAAEPSSVPAQESTLCSLLASTTAGEGGGIQIAFSTSAQAPAGGAKRAMRPVSLGSDDAGERPRRRNVRISSDPQTVAARQRRERISERLRVLQKLVPGGAKMDTASMLDEAANYLRFLKSQVRELQTLDRRNYASNVNNAIAAPPPPWPGH

SEQ ID NO: 32378 - DNA, 713 bp, Panicum virgatum
  misc_feature: Ceres CLONE 1910585
  misc_feature: Encodes the peptide sequence at SEQ ID NO. 32379
tcccggccatatcctccgatcctccgccgacgatcgagagcccagagagctgcttgctatagtaatactaccaccaccaccgtcgtgccgcagcaatatatataatggcctgcggcggcggccactccgccgcctcggcggcgctcctgctgctggtggcggtggtggcctcctccgcccgctgcggccgcgccgcgccggcgggggcgctggtgacgcgcgtgccggggttcgggggcgcccgtctgccgtcgaagcactacgccgggtacgtgacggtggacgaggcgcacgggcggcgcctcttctactacctggtggagtcggagcgcgacccggccggggaccccctcgtgctctggctcaacggcggcccgggctgctccagcttcgacggcttcgtctacgagcacggaccattcaactttgagtcaggagggtcagctggaagcttgccaaagcttcatctaaacccatatagctggtccaaggtgtctagtgttttatacttggactcccctgctggtgttgggctgtcatactcgaagaatgtttcagattatgaaactggcgatcttaagactgctgctgattcacatacttttcttctgaagtggtttcagctctaccctgagttcctgaaaaatccattttacataactggagaatcgtatgccgggggtttatgttcctaccctttcacatgaagttgt

SEQ ID NO: 32379 - protein, 200 aa, Panicum virgatum
  misc_feature: Ceres CLONE 1910585
  misc_feature (41)..(200): Pfam Name: Peptidase_S10 Pfam Description: Serine carboxypeptidase
  misc_feature: SWISSPROT Homolog: EC 3.4.16.5 Carboxypeptidase C
MACGGGHSAASAALLLLVAVVASSARCGRAAPAGALVTRVPGFGGARLPSKHYAGYVTVDEAHGRRLFYYLVESERDPAGDPLVLWLNGGPGCSSFDGFVYEHGPFNFESGGSAGSLPKLHLNPYSWSKVSSVLYLDSPAGVGLSYSKNVSDYETGDLKTAADSHTFLLKWFQLYPEFLKNPFYITGESYAGGLCSYPFT

SEQ ID NO: 32380 - DNA, 1513 bp, Panicum virgatum
  misc_feature: Ceres CLONE 1910616
  misc_feature: Encodes the peptide sequence at SEQ ID NO. 32381
acagatacacctatatccatctcatcgtctcctctcctcgccccagccagccctccacacctccaagtccccacctcctcacccgtcgtcgccagcctccaaccccgccgtccgccgaccgcgccggagatgctgggcgtcgcgcggaggcggcttgtcggatccggatgcgtgctcggccagctggcgcaggccctccgcccggcggccgccgcgaggacctactccgccgccgccaaggagataactgtgcgggaagcattgaattccgcactagatgaagaaatgtctgcggatccttctgttttcttgatgggagaagaggttggggagtatcaaggtgcatacaagatatccaagggactgctcgacaagtatggccctgatagggttcttgatacaccaatcactgaggctggctttactggcattggtgttggtgctgcttaccatggtcttcgacctatagtagagttcatgacatttaacttttcaatgcaggcaattgatcatatcattaattcagctgccaagtcgaactacatgtcagctggtcagatatctgttcctattgtcttcagaggtccaaatggagctgctgctggagttggtgctcaacactcgcagtgctatgcggcttggtatgcacatgttcctggattgaaagttctagcaccatattctgcagaagacgctcgaggtttgctgaaagcagcaatcagggatccagatcctgttgttttcctggaaaatgaacttctttatggtgaatcatttcctgtttctgatgaggtactcgattctagcttctgccttccaattggcaaggctaagatagagagacaaggaaaagatgttacaatcattgcattctccaagatggttgggtatgcccttcaggctgcagatatactagccaaggagggtatcagtgccgaggtaatcaatcttcgttcaattagaccgctggatagagctgctattaatgcatctgtgaggaaaaccaacagattagtaacagtagaagaaggcttcccacaacacgggattggagctgaaatatgcatggctgttgtcgaggacagctttgagtatcttgatgcgccagttgagaggattgctggagctgatgtgcccgtgccttacgctgccaatctagagaggatggctgttccacaggttgaggacattgttcgagcggcgaagcgggcttgctacagagcagtaccaatggcggcaacagcctaattcacagacccaatcgtttctcaatcttccatttcgtagtttgtgtcgagaaagatgtgttgcataatggtatgagtgcccactaccgctccaactcaactagcgtgagctgattttgtagagcaaccaaagaggtgtgtccagttcagttctctccgacgccgcagcagccggatggctgcctgactctgcttcactttacggttctcaactcgggttcgcgagccatgcagggatatacatgaggggggattgtgtcaataac

SEQ ID NO: 32381 - protein, 372 aa, Panicum virgatum
  misc_feature: Ceres CLONE 1910616
  misc_feature (37)..(215): Pfam Name: Transket_pyr Pfam Description: Transketolase, pyrimidine binding domain
  misc_feature (232)..(354): Pfam Name: Transketolase_C Pfam Description: Transketolase, C-terminal domain
  misc_feature: SWISSPROT Homolog: EC 1.2.4.1 Pyruvate dehydrogenase (acetyl-transferring)
MLGVARRRLVGSGCVLGQLAQALRPAAAARTYSAAAKEITVREALNSALDEEMSADPSVFLMGEEVGEYQGAYKISKGLLDKYGPDRVLDTPITEAGFTGIGVGAAYHGLRPIVEFMTFNFSMQAIDHIINSAAKSNYMSAGQISVPIVFRGPNGAAAGVGAQHSQCYAAWYAHVPGLKVLAPYSAEDARGLLKAAIRDPDPVVFLENELLYGESFPVSDEVLDSSFCLPIGKAKIERQGKDVTIIAFSKMVGYALQAADILAKEGISAEVINLRSIRPLDRAAINASVRKTNRLVTVEEGFPQHGIGAEICMAVVEDSFEYLDAPVERIAGADVPVPYAANLERMAVPQVEDIVRAAKRACYRAVPMAATA

SEQ ID NO: 32382 - DNA, 1322 bp, Panicum virgatum
  misc_feature: Ceres CLONE 1910620
  misc_feature: Encodes the peptide sequence at SEQ ID NO. 32383
aagacccgctcgccgccgctccaccaccattcccccaaccaggcaccagtccacactctccgccgcgccgcgacgcgagcgagcgaccgaccgggctccctgtcctccgctcccctcccggcgcgcgcgctggtccgggcgcgcctgggctgggctggtctcgtctggctctcggttgatgcagcagcggggcctcgcccacaaccgccgctcccgcagcttctcccgctcccgcctcgccgtcgagggcgcctgaacgcacgaaccccccacgcggtgctcaccccaacaaaaagaaaaaccaaagctttctaactagagaacgaaagagaacagagaaaacaccgtcgagatggacgccggccgcgcccccgtgatggccgtcgcgaatgggatcggtgaggtagagcggaaggtgcagaagagctactgggaggagcactccaaggacctcaccgtcgagtccatgatgctcgactcccgcgccgccgacctcgacaaggaggagcgcccagagatcctgtcgttgcttccatcttacaaagggaaatcagttcttgagcttggtgctggaataggacgctttactggagacctggcaaaagaagctggccacgttctagcactggattttattgaaagtgtgattaagaagaatgaaagcataaatggacacaacaagaacataactttcatgtgtgctgatgtaacatctcccgacttgaaaattgaagacaactcctttgatctgatattttcaaactggctattaatgtacctttcagatgaggaggttgagaagcttgtggcgaaaatggtaaaatggttaaaggtaggtgaccatatattctttagataatcatgttttcaccaatctggagattcgaaaaggaaagtgaacccaacacactacagagaaccaaggttttatactaagctctggtgttacaacttcaagagtttcatcaccaagtttccagtctagataactatgtccatgaaactcccactgaccttaaacgcctgattgtttggttggacatggagtttaggtggattttacattgccaaagagaaaaaggagcaccactagtcgctgacgaccgtatcattccgaggcagaaatgctccacgctcgtgcctgtatcttgcaattgcaaggttgtaagaactgcgcgaggggcatgtcctcttgtctgaaaacgatcccatttcttcgcttccacaagatttgcggaccatttcttctttctttctctgttttgttgattattgaacttctgtaatttcttttcctattaatatataactagtggagatac

SEQ ID NO: 32383 - protein, 168 aa, Panicum virgatum
  misc_feature: Ceres CLONE 1910620
  misc_feature (69)..(167): Pfam Name: Methyltransf_11 Pfam Description: Methyltransferase domain
  misc_feature: SWISSPROT Homolog: EC 2.1.1.103 Phosphoethanolamine N-methyltransferase
  misc_feature: The sequence is a functional homolog of SEQ ID NO 40 in US patent 7151202
MDAGRAPVMAVANGIGEVERKVQKSYWEEHSKDLTVESMMLDSRAADLDKEERPEILSLLPSYKGKSVLELGAGIGRFTGDLAKEAGHVLALDFIESVIKKNESINGHNKNITFMCADVTSPDLKIEDNSFDLIFSNWLLMYLSDEEVEKLVAKMVKWLKVGDHIFFR

SEQ ID NO: 32384 - DNA, 702 bp, Panicum virgatum
  misc_feature: Ceres CLONE 1910625
  misc_feature: Encodes the peptide sequence at SEQ ID NO. 32385
aaaccgaagcggcggcagcagcaatggcggcctccatgatctcgtcgtcagctctggcggcaccggccagggcccagggcctgccgtccctcggccgccgcgcgtcctccttcgccgtcgtctgcggcaccggcaagaagatcaagaccgacaagcccttcgggattggaggtggcctcaccgtcgaccacgatgcctccgggaggaaggtcaagggcaagggcgtgtaccagttcgtcgacaagtacggcgccaacgtcgacggatacagcccaatctacaaagaggaggactagtctcccaccggtgacgtctacgtcggtggaaccactggacttctgatctgggccgtcaccctcgccgggctccttggcggcggcgccctccttgtttacaacaccagcgccctcgccagctaagaacactattcatgcatagtccatgcaagcgcttgtggttcatgtaagatcagctcgggtgtctgtcgtctgtaatctagcctgcagctttgatgcgcaatataatgcttggttcatgtaacaatgctactacggccctccatacttttgggacagttattatattaataaggtaaggatggcgcgctatgcgcgcctgtagcaaaaggtttgatctaaaattataataaaaatatattattactcccaccacagtccgcagcagcagctagcgaccggtctc

SEQ ID NO: 32385 - protein, 90 aa, Panicum virgatum
  misc_feature: Ceres CLONE 1910625
  misc_feature (35)..(90): Pfam Name: PsbR Pfam Description: Photosystem II 10 kDa polypeptide PsbR
MAASMISSSALAAPARAQGLPSLGRRASSFAVVCGTGKKIKTDKPFGIGGGLTVDHDASGRKVKGKGVYQFVDKYGANVDGYSPIYKEED

SEQ ID NO: 32386 - DNA, 676 bp, Panicum virgatum
  misc_feature: Ceres CLONE 1910636
  misc_feature: Encodes the peptide sequence at SEQ ID NO. 32387
aatccattccccaattcagcagcagcagcagcagcagcagcagcacgaggcgcctctgcgaattccgacagcgagagcgggaagaggaaactcgaaacccggcgagcggcatggccaccggcgaggagcacgtggcggcggcggcggcggcggtcgaggagacgccggagaagaaggaggccggcgtaaccgagctccccgcgccctccggctggacgaagaagcttgccccaattagaggtggaaagtttgaggttatttttgtttccccaactggtgaggagatcaagaccaagagacagctgacccagtacctgaaagctcatcctggaggccctgcatcttcggagttcgattggggaaccagtgatactcctagacgatcaccacgcataagcgagaaagtcaaggcaactgagagcccagaaggtgagaagacccctaaacgtggaagatcaagctctaagaggggcaaaaaggagaaaaaagaagatgcagatgcagtggatgccaatgaaactgtaggccgtggcactttgaaaggcattgatgtggagatgaaggatgctgaaaacgccatagaagagaagaaagaggaggtccccagtgcagatattgacgagaagactgaaggagttgaagagaagaaagaggaggcccctggtgcagatgccac

SEQ ID NO: 32387 - protein, 188 aa, Panicum virgatum
  misc_feature: Ceres CLONE 1910636
  misc_feature (21)..(91): Pfam Name: MBD Pfam Description: Methyl-CpG binding domain
  misc_feature: Useful for making plants with modulated drought sensitivity
MATGEEHVAAAAAAVEETPEKKEAGVTELPAPSGWTKKLAPIRGGKFEVIFVSPTGEEIKTKRQLTQYLKAHPGGPASSEFDWGTSDTPRRSPRISEKVKATESPEGEKTPKRGRSSSKRGKKEKKEDADAVDANETVGRGTLKGIDVEMKDAENAIEEKKEEVPSADIDEKTEGVEEKKEEAPGADA

SEQ ID NO: 32388 - DNA, 1399 bp, Panicum virgatum
  misc_feature: Ceres CLONE 1910638
  misc_feature: Encodes the peptide sequence at SEQ ID NO. 32389
gagcggccgagccccagcgggcggcggcggggcttgctgcggggcttaagggcgggccgtcgcggcaatccccggcccggcggtactcgcggaggctggctccggcaagagaaagggaggggaggcgtggaggctaggagcgggaaggacaggggagcggctggcctcgtctcctctcgggtcgtcgtcgtcgccgccaccaccaccaccaccggcggcggcggataggctgcgacttgcgatggcaatggaggggcgggccctggattccgcgttccacgagttcagagtagactacgagctaaccaagcaactcgccgtcggcgtcgccgtccactccgatgccttctccgccggtggccacatgtggagggtacagctctacccgcgcgggatcagtgagtcggacaatggccagtatctctccatcttctttgagcttctgaacagatccatgaccacaagagtcaactgtatcttcgaggccttcttgatggacaaggctggacggccgcgttccatagctcgaatgaggtcggagtccgacgaaggctatgggtggagtcggttcatttcagtggctgatctggaggaaaatcatgtgaacgaggaaatcatccgccttgtatgcggcatcgcggtggtatctgacagttctattccagtgccgccttcagacattaggaaacatctgggcacgctgctgggtaacaccgacgggacagatgtctcattcatcgttcatggccagactttccatgcacaccgcgcagtgcttgccgcccgctcaccggtcttcagggcagagctccttggatccatggctgaggctacaatgtcatccatcaccctgcaagggatagctccagaaacattcaaactcatgcttcaattcatctacacagataccttgcctgaggatgatgagcttggtgacatagaaatgagaatgaagatgcttgcacgaattcttgttgcagctgaccggtatgcattaggccggttgaagcttctttgtgccaagaggttgtgggataatatgacagctggtatggttgcaacgaccttatctttggctgatatgcataactgcccagaattgaagaagaagtgccttgactacatagtggcaggcgagcatcgcggtcgtgtcttcttaaccaaaggttacattgaatttgctgtgaagtacccacaccttcttgctgagctgcgacagaagcttggggcatgatacaatcccatcccatatggaccatatatgtagtttagcgatcaagcagcgtagctttagtatggtgttcagctattttggtgactgtagtctgaaatatactttaagcatttgaagtcgtgaactcactttctcatactattgaactaagttcctgctagtgac

SEQ ID NO: 32389 - protein, 330 aa, Panicum virgatum
  misc_feature: Ceres CLONE 1910638
  misc_feature (151)..(267): Pfam Name: BTB Pfam Description: BTB/POZ domain
MAMEGRALDSAFHEFRVDYELTKQLAVGVAVHSDAFSAGGHMWRVQLYPRGISESDNGQYLSIFFELLNRSMTTRVNCIFEAFLMDKAGRPRSIARMRSESDEGYGWSRFISVADLEENHVNEEIIRLVCGIAVVSDSSIPVPPSDIRKHLGTLLGNTDGTDVSFIVHGQTFHAHRAVLAARSPVFRAELLGSMAEATMSSITLQGIAPETFKLMLQFIYTDTLPEDDELGDIEMRMKMLARILVAADRYALGRLKLLCAKRLWDNMTAGMVATTLSLADMHNCPELKKKCLDYIVAGEHRGRVFLTKGYIEFAVKYPHLLAELRQKLGA

SEQ ID NO: 32390 - DNA, 445 bp, Panicum virgatum
  misc_feature: Ceres CLONE 1910667
  misc_feature: Encodes the peptide sequence at SEQ ID NO. 32391
atcccgcccgcatctagctagcacggcgttccccgctcctgcggaagagccatccagatagcctcgttcgcttgcctcctcggccgccatggcgtccgccgagcgccaccactccatcgacgcgcatgtccggcagctggcccccggacaggtctccgaggatgacgagctcgtccagtacgatgtcctcctcatggaccgcttcctctacatcatcaagaacctccacggccccgccatcctcgaactcgtcccgcactgctacgagttggtggccgagtacgagggcaagcgcgacgccccgaagctcacggagctcgggtccaggctcgcggcgctggcccccgacgacgccatcctcctcgcgagcaccatccagcacaggccttcaccccccccaccttggcgaagaagttcgagatggccaaccccccctcccaaaaaa

SEQ ID NO: 32391 - protein, 118 aa, Panicum virgatum
  misc_feature: Ceres CLONE 1910667
  misc_feature: SWISSPROT Homolog: EC 4.1.1.31 Phosphoenolpyruvate carboxylase
MASAERHHSIDAHVRQLAPGQVSEDDELVQYDVLLMDRFLYIIKNLHGPAILELVPHCYELVAEYEGKRDAPKLTELGSRLAALAPDDAILLASTIQHRPSPPPPWRRSSRWPTPPPK

SEQ ID NO: 32392 - DNA, 1806 bp, Panicum virgatum
  misc_feature: Ceres CLONE 1910678
  misc_feature: Encodes the peptide sequence at SEQ ID NO. 32393
gagaatttcagtacacctcttaggattgacacgaggcttatcgaacgatcgagcctctccatttcatgtgtataaattttaaagatgctgcattcatcatcactgcccgcaaagtcctgagatcgaaagaaatctcgacaccagcacgacatgacggtgatcgcagacctccccagcagcgcgccgccgtcctccgacgtcgagaccgcggccgccgccgacgccggcgcggccttcgtgctcgagtccaaggggacgtggtggcacgcggggttccacatgacgacggcgaccgtgggccccgcgctgctgacgctgccgtacgcgctccggggcctcgggtggcggctcggcgtcgcggcgctcacggcgctcgccgccgtcaccttctactgctacctcctcgtgtccagggtgctcgaccgctgcgaggccgccggccgccgccacatccgcttccgcgagctcgccgccgacgtcctcggatcccagtgggcgtcctacctggtcctggtcgtgcaaaccgccatcaacgccggggttaccattgggagcatcctgctcgccgccgactgcctgcagataatatacctgcacgccgcgccacatgggcacctgaagctctaccatttcgtcatcgtcgtcgccgtggtggtggcgctcctgtcacagatgccgtcgctgcactcgctgcggtacatcaacttgggctcgctcgtcgtcagcgtcggctacaccacgcttgtgtcggctgcttgcatttgtgcaggttcgtcgagtaaggctccaacgaaagattactctttgagcccatccaattccgcgaggaccttcaacgcgttcctctccatctccatcctcgcctccgttttcggcaacagcattctgcctgaaatccaggccacgctggcgccgccggcgtcggggaagatggccaaggcgctggtgctgtgctactccgtgctgtcgctcacgttctacttcccggccatcaccggctactgggcgttcggcaaccaggtgcgctccaacgtgctcaagagcctcatgccagacacgggcccctggctcgccccggagtggctgctcatcctcgccgccgtcctcgtcctcctccagctcatcgccatcgccctggtgtactcgcaggtggcgtacgagatcatcgagaccaagtcggcggacgtggcgcgcgggcggttctcgaggcggaacctggcgccacgggtggcgctgcggacggcgtacgtcgccgggtgcgcgctcgcggcggcgatgctgcccttcttcggcgagatcatcgccgtggtgggcgccgtcgggtacatcccgctcgacgtcgtgatccccgtcgtcatgtacaacatggccccgcgcggcggcggcgggcgccggtcgcaggcggcctacgcggccaacgtcgccatcatggtggtcttcgtcggcctcggggtgataggcgccgtggcgtcggtgcggaagctcgccatcaacgccgaccggttcaagctcttcagcaatgggatctcttagcaggccatgtatttgtatatggccctagaccccggcccatctgtggatcgtgtggaatttcggcctctctcagaaataggagcacaattagctgattagcttaatttatttgtgaagtgaggagatttctacttttaattatgtgccaattaataaatatgagagtttgaatttataattttgttgggtagcgaagctttagtttgggttgcccgtaggttccgtatggtacatgttgtaataatgcatagtatatattttgggtactctatc

SEQ ID NO: 32393 - protein, 460 aa, Panicum virgatum
  misc_feature: Ceres CLONE 1910678
  misc_feature (33)..(443): Pfam Name: Aa_trans Pfam Description: Transmembrane amino acid transporter protein
MTVIADLPSSAPPSSDVETAAAADAGAAFVLESKGTWWHAGFHMTTATVGPALLTLPYALRGLGWRLGVAALTALAAVTFYCYLLVSRVLDRCEAAGRRHIRFRELAADVLGSQWASYLVLVVQTAINAGVTIGSILLAADCLQIIYLHAAPHGHLKLYHFVIVVAVVVALLSQMPSLHSLRYINLGSLVVSVGYTTLVSAACICAGSSSKAPTKDYSLSPSNSARTFNAFLSISILASVFGNSILPEIQATLAPPASGKMAKALVLCYSVLSLTFYFPAITGYWAFGNQVRSNVLKSLMPDTGPWLAPEWLLILAAVLVLLQLIAIALVYSQVAYEIIETKSADVARGRFSRRNLAPRVALRTAYVAGCALAAAMLPFFGEIIAVVGAVGYIPLDVVIPVVMYNMAPRGGGGRRSQAAYAANVAIMVVFVGLGVIGAVASVRKLAINADRFKLFSNGIS

SEQ ID NO: 32394 - DNA, 735 bp, Panicum virgatum
  misc_feature: Ceres CLONE 1910695
  misc_feature: Encodes the peptide sequence at SEQ ID NO. 32395
gttctcccaccaccaccaccatccctcctcgaggcagaggaagggggaggaaaacctccaagccgccgcgtcgcgggcgcccacaccactcctccctcctgccctcgcctcgccatggccgccgcgctcctcctggcggtcctcctcccgctcgtggccaccccgtcccgcgccgccgcgccggcaagtgcgccctccaccgccgcgttccagctccacggcgacgtctaccccacaggccactactatgtcactatgaacattgggaacccggcgaagccctacttcctggacgtggacaccggcagcgacctcacatggcttcagtgcgacgcaccctgccagagctgcaacaaggtgccgcacccattgtatcggcctgcacagaacaggcttataccgtgtgcagattctctttgcactgcactccacagtggactgggttcaaacaagaagtgcccttcaccaaaacaatgtgactaccaaatcaagtacacagacagcgcatcatctcaaggtgtgcttatcaatgacaacttctcgctgcccctcaagtcctccaacattcgtcccagcctgacctttgggtataacacttgagtgagtaatatatttcttgatagtgttgctggattcagttgttcatatggttgcttttgtttgcaaaaaaagctgtgggtatgatcagcaagttggaaaaaatggtgcgggtgcagcagtgacagacggcttact

SEQ ID NO: 32395 - protein, 161 aa, Panicum virgatum
  misc_feature: Ceres CLONE 1910695
  misc_feature: SWISSPROT Homolog: EC 3.4.23.12 Nepenthesin
MAAALLLAVLLPLVATPSRAAAPASAPSTAAFQLHGDVYPTGHYYVTMNIGNPAKPYFLDVDTGSDLTWLQCDAPCQSCNKVPHPLYRPAQNRLIPCADSLCTALHSGLGSNKKCPSPKQCDYQIKYTDSASSQGVLINDNFSLPLKSSNIRPSLTFGYNT

SEQ ID NO: 32396 - DNA, 509 bp, Panicum virgatum
  misc_feature: Ceres CLONE 1910701
  misc_feature: Encodes the peptide sequence at SEQ ID NO. 32397
gtgaccccgcaccgcccgggtttaaatgcccccgcgacgcgccgcaactgaagccgcacagcaagcacccaccgacgccagcctattgctttcaaccgcccgccatggcgcccgacgcgtcctccccgacgccgcacgttgccgtggtagcgttccctttcagctcccacgcggcggtgctgctagccttcgcgcgcgcgctggccgccgctgctgcgcccgcgggggccacactctcgttcctctccaccgcgggctccatcgcgcagctccgccgggcggtcggcgccgagctcccgggaaacctgcgcttcgtggaggtgccggacggcgccgggccgcccgcggtgaagggcgcctcgccggtgccgatgccgcggtagatggatctgttcgtggccgccgcagaggggggagggctgaagggacccctgcactcgtcgcgtccttcgctgtgcacggcttcggtgagcagggagtccgatcctctgctcgatggaacacatcct

SEQ ID NO: 32397 - protein, 92 aa, Panicum virgatum
  misc_feature: Ceres CLONE 1910701
  misc_feature: SWISSPROT Homolog: EC 2.4.1.115 Anthocyanidin 3-O-glucosyltransferase
  misc_feature: Useful for making plants with altered carbohydrate content
  misc_feature: Useful for making plants with modulated flowering time
MAPDASSPTPHVAVVAFPFSSHAAVLLAFARALAAAAAPAGATLSFLSTAGSIAQLRRAVGAELPGNLRFVEVPDGAGPPAVKGASPVPMPR

SEQ ID NO: 32398 - DNA, 700 bp, Panicum virgatum
  misc_feature: Ceres CLONE 1910703
  misc_feature: Encodes the peptide sequence at SEQ ID NO. 32399
agcctagccgcctccccaacctcctcaccgaggagagagagagagaggacagaggagagagagagagaggaggttccatttccgcgtcgtctccgcccgcagccccaccctccacatggccgcgctgccgggtggggcccacgctgccggcgccgcggacccgatgcaggtggaccagccgcgccccgccgccgccgccgcagccgcagcagcaaccgcccccgcggacgccaagcatgccagttctatgattgaagggggtgatccagtcactggtcacataatctcaacaacgattggaggcaagaatggagagcctaaaaggactatcagctacatggccgagagagttgtgggaactggatcattcggaatcgtcttccaggctaaatgtctggagactggtgagactgttgccattaagaaggttttacaggacaagcggtacaagaatagggagctgcaaatcatgcgatccatggatcactgcaatgtcgtctccttgaagcattgcttcttctctaccacaagcagggatgaacttttccttaacttggtgatggagtttgttcctgagtcactgtatcgtgtattgaagcattacagcaatatgaaccagaggatgccgcttatatatgtcaagttatacacctaccagatatttcggggtttagcctatattcacactgtacctggcgtt

SEQ ID NO: 32399 - protein, 194 aa, Panicum virgatum
  misc_feature: Ceres CLONE 1910703
  misc_feature: SWISSPROT Homolog: EC 2.7.11.1 Non-specific serine/threonine protein kinase
  misc_feature: Useful for making plants with modulated biomass
  misc_feature: Useful for making plants with modulated water use efficiency
MAALPGGAHAAGAADPMQVDQPRPAAAAAAAAATAPADAKHASSMIEGGDPVTGHIISTTIGGKNGEPKRTISYMAERVVGTGSFGIVFQAKCLETGETVAIKKVLQDKRYKNRELQIMRSMDHCNVVSLKHCFFSTTSRDELFLNLVMEFVPESLYRVLKHYSNMNQRMPLIYVKLYTYQIFRGLAYIHTVPG

SEQ ID NO: 32400 - DNA, 621 bp, Panicum virgatum
  misc_feature: Ceres CLONE 1910710
  misc_feature: Encodes the peptide sequence at SEQ ID NO. 32401
ctctcctcccccaccctgcctgctccgctccgcgcccatctcatctcatccctccatccgaggctagggggtgagtggtgggctggtggcttgcggctcccctccctccacttcgtcaactgaaacggtcacgctaccacaccaccggtgcaggcaggagtaactgcactgacacagtcacactgcgcacgcttcttgctagttgcagccgcagccgctaccccgtcactgcattgcctcgaggcgcagcaatggcgctgccaagatccgtggccgtccttgtggtcgtgctcctggtcttgtggagagagggggaggcgtccaccttcacgttcgtcaaccggtgcgcggacacggtgtggccgggcatcctgtccaacgccggcagcccgcggctggagcccacggggttcgagctcccgccgggcgccgcgcgcgcggtgcccgcgccgtcgggctggtccggccgcatgtgggcgcgcacgggctgctcgcaggacggcgccacggggcggctcgtctgcgccactggcgactgcggctccggcgccgccgagtgcgcgggcgcgggtgccgcaccgccggcgacgctggccgagttcacgctggacggcagcggcg

SEQ ID NO: 32401 - protein, 123 aa, Panicum virgatum
  misc_feature: Ceres CLONE 1910710
  misc_feature (30)..(123): Pfam Name: Thaumatin Pfam Description: Thaumatin family
MALPRSVAVLVVVLLVLWREGEASTFTFVNRCADTVWPGILSNAGSPRLEPTGFELPPGAARAVPAPSGWSGRMWARTGCSQDGATGRLVCATGDCGSGAAECAGAGAAPPATLAEFTLDGSG

SEQ ID NO: 32402 - DNA, 371 bp, Panicum virgatum
  misc_feature: Ceres CLONE 1910715
  misc_feature: Encodes the peptide sequence at SEQ ID NO. 32403
agatcttatgaagaaacttgtgacaaccattccattagggagactaggcgaaccagaggaagttgcagggttagtcgagttcttggcccttaatcctgcggccaactatatcaccggacaggtgcttaccattgacggagggatggtaatgtgaggtatgagtgagcttgatagacttcgacttagtctataatggtgttgtacgctcctgtgcatgaggcgatttttggactacaaattttagggctgtctcttgttttgtagtactctcgtgttttgtagtacccaccaatgtgtcatgactcatgatgtattttggattataaatcggcgtgttgaagttgaaatatatgtctttggtgtcatgactc

SEQ ID NO: 32403 - protein, 50 aa, Panicum virgatum
  misc_feature: Ceres CLONE 1910715
  misc_feature: SWISSPROT Homolog: EC 1.1.1.100 3-oxoacyl-[acyl-carrier-protein] reductase
DLMKKLVTTIPLGRLGEPEEVAGLVEFLALNPAANYITGQVLTIDGGMVM

SEQ ID NO: 32404 - DNA, 339 bp, Panicum virgatum
  misc_feature: Ceres CLONE 1910718
  misc_feature: Encodes the peptide sequence at SEQ ID NO. 32405
aattttcctcgctgcgtttgtttacttctatccagcagagcgcagcaggatggtgtactcgctccggctggtccccttgccggttgtcgccgcctcgtgcctgctccgccactacctcccgctgctcctcggcggcctccccaagggcagcttcggctggcccctcatcagcgagaccatcggcttcgtctccgcgcacccgtcaaacacggccggcggtttccccaaagagcaggtctccaggtacgggacgttgttcaagtccctcctcttcggctcgcttgcggtggtctcctgcacacgaggagctcaagcacttcgtgctgcacatctaggagc

SEQ ID NO: 32405 - protein, 96 aa, Panicum virgatum
  misc_feature: Ceres CLONE 1910718
  misc_feature: SWISSPROT Homolog: EC 1.14.13.77 Taxane 13-alpha-hydroxylase
MVYSLRLVPLPVVAASCLLRHYLPLLLGGLPKGSFGWPLISETIGFVSAHPSNTAGGFPKEQVSRYGTLFKSLLFGSLAVVSCTRGAQALRAAHLG

SEQ ID NO: 32406 - DNA, 712 bp, Panicum virgatum
  misc_feature: Ceres CLONE 1910728
  misc_feature: Encodes the peptide sequence at SEQ ID NO. 32407
gcgctggccggcatcaaccccgtcaacatcgagcgtcttcaggtaacccgtcgccgtcacgacgcccggacacgccgccagcgtgcgcggccgttgctcacctgtcgatcgcgtccccccctccgcaggcgttcccgccggtgagcaagctggaccctgccctgtacggcccgccggagtcggccctcaccgaggagcacatcgccgggcagctggacggcatgtcggtgcggcaggcggtggaggacagccggctgtacatgctggactaccacgacatcttcctgccgttcctggaccggatcaacgcgcaggacgggcgcaaggcctacggcacgcgcacgctcttcttcctgacggccgcgggcacgctcaagcccatcgccatcgagctcagcctgccgcccatgaccgacggctgcaagcgcgcaaagcgcgtgttcacgccgcccgccgacgccaccagcaactggctctggcagctcgccaaggcgcacgtctgctccaacgacgccggcgtccaccagctcatcaaccactggtacgtgtcagtcctggctagaggcgtctctgcatttctttccattggcaggtgatgcagaggaactcaaactgcacttccgtgcaggctgcggacgcacgcgtgcgtggagccattcatcatcgcggcgcaccggcagctgagcgcgatgcaccccatcttcaagctgct

SEQ ID NO: 32407 - protein, 197 aa, Panicum virgatum
  misc_feature: Ceres CLONE 1910728
  misc_feature: SWISSPROT Homolog: EC 1.13.11.12 Lipoxygenase
AGRHQPRQHRASSGNPSPSRRPDTPPACAAVAHLSIASPPPQAFPPVSKLDPALYGPPESALTEEHIAGQLDGMSVRQAVEDSRLYMLDYHDIFLPFLDRINAQDGRKAYGTRTLFFLTAAGTLKPIAIELSLPPMTDGCKRAKRVFTPPADATSNWLWQLAKAHVCSNDAGVHQLINHWYVSVLARGVSAFLSIGR

SEQ ID NO: 32408 - DNA, 964 bp, Panicum virgatum
  misc_feature: Ceres CLONE 1910732
  misc_feature: Encodes the peptide sequence at SEQ ID NO. 32409
cctatctgcagatccccccaccgactccgtcccctccccctccccctcctcctccattaatggccgccaccaagaaccctccaacccccacctgacctccctcccgactcgcctccgtcgccgtccgttccccacgccctctgcctgtacgttcttggtcggcctaaaggaggaagggaagggtgggggtggagccaaccggtgggggccaggccatcgatgctgagctcggcatcctcggcgggggcggggataggggtggggggagggggagggtacccgccgccgcagcgcggggcggcggtgttcaccgcggcgcagtgggcggagctggagcagcaggcgctcgtatacaagtacctcatggccggcgtccccgtcccgcccgatctcctactccccgtccgccccagcccccactccgccgccaccttctccttcgccaaccccggcgccgccgcgtcacccttctaccatcaccaccacccgtccctgagttactacgcgtactatgggaagaagctggacccggagccgtggcggtgccgccgcaccgacggcaagaagtggcggtgctccaaggaggcgcaccccgactccaagtactgcgagcgccacatgcaccgtggccgcaaccgttcaagaaagcctgtggaatccaagaccgcctcgcctgcgcatccgtcgcagccccagttgtccaccgtgacaacgacgacccgagagacagcgccccttgactccctcaccgtggggggtaaaactcatggcctgtctctcggtggggctggctcatcacagcttcacgtcgatgcttcgaatgctcattatcgttatggcagcaagtaccctcttggagctaaagctgatgctggcgaactgagcttcttctccggagcatcaggaaactccaggggcttcactattgattctccaacagaaaactcgtggaactccctgccct

SEQ ID NO: 32409 - protein, 248 aa, Panicum virgatum
  misc_feature: Ceres CLONE 1910732
  misc_feature (103)..(148): Pfam Name: WRC Pfam Description: WRC
  misc_feature (28)..(64): Pfam Name: QLQ Pfam Description: QLQ
MLSSASSAGAGIGVGGGGGYPPPQRGAAVFTAAQWAELEQQALVYKYLMAGVPVPPDLLLPVRPSPHSAATFSFANPGAAASPFYHHHHPSLSYYAYYGKKLDPEPWRCRRTDGKKWRCSKEAHPDSKYCERHMHRGRNRSRKPVESKTASPAHPSQPQLSTVTTTTRETAPLDSLTVGGKTHGLSLGGAGSSQLHVDASNAHYRYGSKYPLGAKADAGELSFFSGASGNSRGFTIDSPTENSWNSLP

SEQ ID NO: 32410 - DNA, 724 bp, Panicum virgatum
  misc_feature: Ceres CLONE 1910732-R
catttacactgtcaaagagtagagattctggtctcctgcctggtacctactcctattcccaactggagccgccacaggagcttggccaggtcaccatcgcctccctgtcccaggagcaggagcgccactctttcagcagcggagctggtgggttgctaggaaatgtgaagcaggagaaccagccgttgaggcccttcttcgatgagtggcctgggacgcgggattcatggtcggagatggacgacgcaaggcccaataggacctctttctcaacgactcagctctcaatctccatcccaatgcccagatgcgattgagaagctcgtgccacctcaaggtggggttgtgtgacgtgcatcaggcattgtattcgccgttagcgggtcggagattgatgggccatggcgtgcctgcgcttgccctagctatttctttcactgtaacgcactaagaactctttgtaagagcaggatcccctatggatcaatggagcccatagaactccaacctgttttctaaggtattaccacgctttgtattgtatccggacccaggaccgtcagttgtcgattgcagtagatgatgcaggtgtttgtgtgctttcccgcttgtgcaatctgatggcgaatctgatcttgtagcatctggttctggtgcccatccagtagtcaactgtcctcaagctagcagcagcagatttttaggctgttcggctggtctggtc

SEQ ID NO: 32411 - DNA, 721 bp, Panicum virgatum
  misc_feature: Ceres CLONE 1910755
  misc_feature: Encodes the peptide sequence at SEQ ID NO. 32412
agacggcgacctaaaaaagccgacgccgccgcacgccgcacgccgcacgcgcatccgcatccgcctccgcacgccgccgccatggccgaggagaccgacactaggcccacgtccgccggctcccggggccgccccgcaccggacgacaacgacagggaggagggcgagatcactgacgactcctccgctcccgccccgccgctccaccccgccacgcacccgctcgagcactcctggaccttctggttcgacaacccgcagggaaagtccaagcaggccgcatgggggagctccatccgacccatccacaccttctccaccgtcgaggacttctggggcctttacaataatattcaccaccctagcaagttgattgtgggagcggacttccattgcttcaagaacaagattgaaccaaaatgggaagaccctatttgtgctaatggcggtaaatggaccatcaactgtggcagaggaaaatctgacacaatgtggctgcacactctactggcaatgattggcgaacaatttgattatggtgatgaaatttgtggagcagtcgttagcgtgcgtggtaagcaggaaagaatagctatctggaccaaaaatgctgctaatgaagctgcccaggtaagcatcgggaagcagtggaaggaacttctggactacaaggactccattggattcatcgtccatgacgatgcaaagaagatggacaaag

SEQ ID NO: 32412 - protein, 213 aa, Panicum virgatum
  misc_feature: Ceres CLONE 1910755
  misc_feature (1)..(212): Pfam Name: IF4E Pfam Description: Eukaryotic initiation factor 4E
MAEETDTRPTSAGSRGRPAPDDNDREEGEITDDSSAPAPPLHPATHPLEHSWTFWFDNPQGKSKQAAWGSSIRPIHTFSTVEDFWGLYNNIHHPSKLIVGADFHCFKNKIEPKWEDPICANGGKWTINCGRGKSDTMWLHTLLAMIGEQFDYGDEICGAVVSVRGKQERIAIWTKNAANEAAQVSIGKQWKELLDYKDSIGFIVHDDAKKMDK

SEQ ID NO: 32413 - DNA, 659 bp, Panicum virgatum
  misc_feature: Ceres CLONE 1910760
  misc_feature: Encodes the peptide sequence at SEQ ID NO. 32414
actctcccttgcatcaccaacaagaaggctaacgcacaccaacccaagaacaaggaggggagagaaggaaggaaaaaaaaaaggaattttgatcgcccagagtgtggtagtagaatagcaatttgatctctccttgttcgaggtcagtgcgcgaggcaataatggtggccgtggaggctgcggcggcggcggtggagggcccgatccgggcggaggccgaggtggaggtgaagggcgatgccccggccgtgggggaggaggaggagaaggagtacaagagcgacatgaggaagctggaggagctcatgtccaagctcaacccctgcgcgcaggagttcgtgccgtcgtcgcgccgcgccacggcgccggcggtgaagccggcggggggaggcgtgctctccgccgacgcgccggtgttcgtgtccgctgccgagtactacggcgctgccggcgggcacctgcaggtggccggtggcggcgctgccggcggtgggagcagggactccagcagcgacggatccagcaacggcagcggccaccctctgaatcgccggagaaggaacagcttcaaccaggggaggcggaggatggggggccgaccccgacgggctgatagggaggatagtgtgcggcgaaccgtctatgtctctgacattgat

SEQ ID NO: 32414 - protein, 165 aa, Panicum virgatum
  misc_feature: Ceres CLONE 1910760
  misc_feature (47)..(64): Pfam Name: PAM2 Pfam Description: Ataxin-2 C-terminal region
MVAVEAAAAAVEGPIRAEAEVEVKGDAPAVGEEEEKEYKSDMRKLEELMSKLNPCAQEFVPSSRRATAPAVKPAGGGVLSADAPVFVSAAEYYGAAGGHLQVAGGGAAGGGSRDSSSDGSSNGSGHPLNRRRRNSFNQGRRRMGGRPRRADREDSVRRTVYVSDI

SEQ ID NO: 32415 - DNA, 1932 bp, Panicum virgatum
  misc_feature: Ceres CLONE 1910764
  misc_feature: Encodes the peptide sequence at SEQ ID NO. 32416
gtaacatctcagccccatttccacagccccccgcgggcgcctcagccagagagggggcgcgggcgcggcagcttcacatcgcggccgaggccgcgcgcgcgttataagcagcaccgcgccgcgctcgctgatcgcgcgccggccagcagcagcagtagcggagaggaggcgagccgcgggccatcatcccttgctcgccgcgggctccagcgacgctccgcagctggcaggatcctccggtgggccgtccgacgacggcagaatgtcttcggacccgctgctcggcggcgacggcggcggggagcccgcgcgggcgccgtcgtggctggggcgcgtggtggacacggaggaggcgcgcgcgcagctgcggttcgcggtgccgatggtgctgaccagcatggcctactacggcatcccgctggtgtcggtgatgttctcgggccacctcggcgacgtccacctcgccggtgctacgctcggcaactcctgggccaccgtcaccgggtacgccttcgtgacgggcctgagcggcgccctggagacgctgtgcgggcaggcgtacggcgcgcggctgtaccggatgctgggcctgtacctgcagtcgtcgctcgtcatgtcggccgccgtctccgcgctgtggtgcttcacggagcccgtgctggtgttcctccggcaggacccggaggtgtccagcgccgcggcgtccttcgtccggtttcagatcccgggcctcttcgccttctccttcctgcagtgcctgctccggtacctgcagacgcagtccgtcgtggcgccgctcgtggcctgctccgtggcgcccttcgcgctccacgtcgcgctggcgcacctgctggtgaacgtgctcgggctgggcgtcgcgggggcctccgccgccgtgtccgccacgttctgggtctcctgcctcatgctgctcgcctacgtgacgcgctccaaggccttcgccgagacgtggacggggttctccgtcgaggcgttcaagtacgtgttgccgacggtcaagctcgccacgccgtccgccgtcatggtctgcttggagtactgggcgttcgagctcttggtcctcatcgccggcttgctccccaattcgacggtgagcacgtcgctgatcgccatgtgcgctagcacggaggcgatcgcgtacatgatcacgttcgggttcagcgccgccgtcagcacgcgggtgtcgaacgagatcggcgccgggaacgtggctcgtgcgaagaacgcggtgtcggtgacgctgaagctgtccgtgttcctggccgtctccttcgtggcgctgctggcgttggggcacacccagtgggcgcggctcttcagcgggagcgccaccatcgtgtcggagttcgcggccatcgcgccgctgatggcggtgtccatcgtgctggactcggcgcagggggtgctgtccagggtggccaggggctgcggctggcagcacctggcggcggtcaccaacctggtggccttctacttcgtgggcatgccgctggccgtgctcctcgccttcaagctggacctccgcgccaggggcctctgggcggggctcatctgcgggctcgcgtgccaggccgccgccctgctcgtcgtcaccgcgcgcaccaggtggtccgacctcgccgacgccatgcgggagcagaaggccaactacgtcgcctagcaagacacccgtattacttacttgctcacggcttactagttactaccactactactttaaaaaaaaagttactaccactactgtactagtgctaatgacgaaaatggacgagcagttgtgcatcgaaagcacactagcgagccttttttttttggtggcgacggcatgtactttagggggttttgtaagaggttctggagagcggagattatcatcaggatttgaccctgttgacagtcaaaattggcacc

SEQ ID NO: 32416 - protein, 472 aa, Panicum virgatum
  misc_feature: Ceres CLONE 1910764
  misc_feature (257)..(420): Pfam Name: MatE Pfam Description: MatE
  misc_feature (40)..(196): Pfam Name: MatE Pfam Description: MatE
MSSDPLLGGDGGGEPARAPSWLGRVVDTEEARAQLRFAVPMVLTSMAYYGIPLVSVMFSGHLGDVHLAGATLGNSWATVTGYAFVTGLSGALETLCGQAYGARLYRMLGLYLQSSLVMSAAVSALWCFTEPVLVFLRQDPEVSSAAASFVRFQIPGLFAFSFLQCLLRYLQTQSVVAPLVACSVAPFALHVALAHLLVNVLGLGVAGASAAVSATFWVSCLMLLAYVTRSKAFAETWTGFSVEAFKYVLPTVKLATPSAVMVCLEYWAFELLVLIAGLLPNSTVSTSLIAMCASTEAIAYMITFGFSAAVSTRVSNEIGAGNVARAKNAVSVTLKLSVFLAVSFVALLALGHTQWARLFSGSATIVSEFAAIAPLMAVSIVLDSAQGVLSRVARGCGWQHLAAVTNLVAFYFVGMPLAVLLAFKLDLRARGLWAGLICGLACQAAALLVVTARTRWSDLADAMREQKANYVA

SEQ ID NO: 32417 - DNA, 744 bp, Panicum virgatum
  misc_feature: Ceres CLONE 1910786
  misc_feature: Encodes the peptide sequence at SEQ ID NO. 32418
aagcgcacaggcgaaacggcagaagcatccctcgtctccacgcaccccaaactactccgcaagcgacgccccctagagcacgagcacacgacctgaccgcaccgtgccgtctcacggagcccgcccgtctggaagcttcgtcgccgcccgcccgcccgcccgcccgcgccgtcgcacgccgccctagggttccgccggcgcggggggttcgccggagatggactggagcgcggtgacggcggaggacctggtggacgcgctgcgggaggtggactggtccacgccgccgcggcccgtcccggagttcttctcccgcttcaccgtcccccgctcctactccaagtggaccagccgcctcaagtgcaacctctactactacaggacaaactatttcatcttgatcatgttcatccttgggatgggcttcctttggaaaccggttgcaatccttgcagcttttatgactggactcagcattgcatttctcaatgacagtttcgcggtcactttcaatgagaaagtcacaaggacagtgagacaattttcaccacatttagctgcaaagatgaggccaccaataacccctgttctccgtggtcgaccaagctcaaagagatctattcatatttgtgggcgacctcgatgggtgtttgttctattcttttctgcagttagctgtatactctggttgacctcatgcagtcttctcacagtcctctgggcacttctcattgctctatttgc

SEQ ID NO: 32418 - protein, 175 aa, Panicum virgatum
  misc_feature: Ceres CLONE 1910786
  misc_feature (16)..(173): Pfam Name: PRA1 Pfam Description: PRA1 family protein
MDWSAVTAEDLVDALREVDWSTPPRPVPEFFSRFTVPRSYSKWTSRLKCNLYYYRTNYFILIMFILGMGFLWKPVAILAAFMTGLSIAFLNDSFAVTFNEKVTRTVRQFSPHLAAKMRPPITPVLRGRPSSKRSIHICGRPRWVFVLFFSAVSCILWLTSCSLLTVLWALLIALF

SEQ ID NO: 32419 - DNA, 975 bp, Panicum virgatum
  misc_feature: Ceres CLONE 1910788
  misc_feature: Encodes the peptide sequence at SEQ ID NO. 32420
aacaagaaccccgacgcaccatctcgcagcaaagctgtagcattcggagcaaaggctccttctttgttcaagctcgtctacactacagaccggccacagagtaatcaatcgtcgatggctgatcagaggaacgcgatggtgcggccgctcctgcgtcgggtgctctcgttccgggagccgctcctgctcatcccgtacctgctcaccttcctcggcgccgcggcgtcggcgttcgtgcggagccattcctcgctgctgcacgcgctcgcgaggtcgctcgtcccgtccaagtgcgcgtacagcgcctcgccggttagcggcgacctgcccgtcgccgccgccgaggcggaaaaggaggaggcggcggcggaggacgccgcgctgagcaaggaggaggtggaggcgatcatgggcgcgatcggcctcgcggcggccggccggggggagggcctcgcgcccgccatggaccgggacgaggtggcccggctgttcgacgccgaggagccgagcttcgcggaggtgcggagcgccttcgcggtgttcgacggcgaccgcgacgggttcatcggcgcggccgacctgcagggcgccctagcgaggctcggcgtgcgggaggatgccgcagcgtgccgcgccatgatcgccgcggccggcggcggcagggacggccggatgaccctgttccagttcgtcagcttcctcgagaacggcttgtgttgagatcgagccggaggaactgactgaccatttacttcattttttcccctttcttttcgtcggctcagctcgtggcaggagatgtgagagtagtgacagagtgtgtgtcctcggagagacgaacggtgttggttcttgcgtgtgtttttttcctcctgccatgagatgggggtggatggactactgtgcagcgattaacgcactaattcccaagctaaggaaacagcagatcaatggaactaatttgccccgttgcag

SEQ ID NO: 32420 - protein, 201 aa, Panicum virgatum
  misc_feature: Ceres CLONE 1910788
  misc_feature (135)..(163): Pfam Name: efhand Pfam Description: EF hand
MADQRNAMVRPLLRRVLSFREPLLLIPYLLTFLGAAASAFVRSHSSLLHALARSLVPSKCAYSASPVSGDLPVAAAEAEKEEAAAEDAALSKEEVEAIMGAIGLAAAGRGEGLAPAMDRDEVARLFDAEEPSFAEVRSAFAVFDGDRDGFIGAADLQGALARLGVREDAAACRAMIAAAGGGRDGRMTLFQFVSFLENGLC

SEQ ID NO: 32421 - DNA, 584 bp, Panicum virgatum
  misc_feature: Ceres CLONE 1910801
  misc_feature: Encodes the peptide sequence at SEQ ID NO. 32422
attctgagctgctgtagcgacccgaacaggcctccccccctccccagttcgccgcgggcgggtggagtcgggctggaccacccgccttttaacggagacgaccccaactatccatcccgcgacgatggcgcacggcgtcagctgcgcccgcaccggcgaccagcacgactacttccgcgcggtgcagctcggggacctcgacgccctggccgcgctcctcgccgccgacacctccctcgctcgccgcgccaccctctacgaccgcctctccgcgctccacatcgccgccgccaatggacgtctcgaggtgctgtccatgatcttggatcacggggtgccgccggacgtggtgaatcggcacaagcagactccgctgatgctcgcggcgatgcacggcaagattgactgcgtgatcaggctcctccagaccgacgccaatatcttgatgttcgattctgtgcacgggcggagctgtctgcaccacgctgcctacttcagacatgtggactgcctgcatgccatcctctcagcggcgcagacgacgccggtggccgactcatggggtttcgcccggttcgtcaacg

SEQ ID NO: 32422 - protein, 153 aa, Panicum virgatum
  misc_feature: Ceres CLONE 1910801
  misc_feature (46)..(78): Pfam Name: Ank Pfam Description: Ankyrin repeat
  misc_feature (79)..(111): Pfam Name: Ank Pfam Description: Ankyrin repeat
  misc_feature: SWISSPROT Homolog: EC 2.7.11.1 Non-specific serine/threonine protein kinase
MAHGVSCARTGDQHDYFRAVQLGDLDALAALLAADTSLARRATLYDRLSALHIAAANGRLEVLSMILDHGVPPDVVNRHKQTPLMLAAMHGKIDCVIRLLQTDANILMFDSVHGRSCLHHAAYFRHVDCLHAILSAAQTTPVADSWGFARFVN

SEQ ID NO: 32423 - DNA, 738 bp, Panicum virgatum
  misc_feature: Ceres CLONE 1910821
  misc_feature: Encodes the peptide sequence at SEQ ID NO. 32424
atccagctcatacttccagttcaaacatcgtcttcagttccaggcaaggcggagcagcaaggcgatcacgatcagaaaggctgccgttttgtgttctccggcacggcagaggtggacagttaagtgcaccatgtgctattcagagcagccggcgaaactcgccatgcccatgcttatactattgccattgctgctgctgtcctatggagttggaaacgttcactgctcaacggttcatgatagcagcatcgatctgcaggcactgctcgacttcaagcacggcatcaccagcgatccgaatggagccttgaacaattggaccacgaggtcccacttctgtcactggaatggtgtcaattgcaccttggagcaaccacggcgcatcagggggctccaactgacaagccaaagtttgtcaggccaaatcagctcatctcttggcaaccttactttccttcgttaccttgacctctcctataataactttgttggtcccttacctcatctcggccgcctccaacaactgcatattctttatttatacaacaacagtttgtctgggataattcctgatgcacttacaaactgctccaacttgaccgccatagatttatcttcaaacttgctagtgggttcaattcctcagaaattaggtctactatccaatctagtatatctcaacttgatgtcaaatcaaattcatggaagcattcctagtgaactggggcaataaaagtt

SEQ ID NO: 32424 - protein, 200 aa, Panicum virgatum
  misc_feature: Ceres CLONE 1910821
  misc_feature (38)..(78): Pfam Name: LRRNT_2 Pfam Description: Leucine rich repeat N-terminal domain
  misc_feature: SWISSPROT Homolog: EC 2.7.11.1 Non-specific serine/threonine protein kinase
MCYSEQPAKLAMPMLILLPLLLLSYGVGNVHCSTVHDSSIDLQALLDFKHGITSDPNGALNNWTTRSHFCHWNGVNCTLEQPRRIRGLQLTSQSLSGQISSSLGNLTFLRYLDLSYNNFVGPLPHLGRLQQLHILYLYNNSLSGIIPDALTNCSNLTAIDLSSNLLVGSIPQKLGLLSNLVYLNLMSNQIHGSIPSELGQ

SEQ ID NO: 32425 - DNA, 1639 bp, Panicum virgatum
  misc_feature: Ceres CLONE 1910828
  misc_feature: Encodes the peptide sequence at SEQ ID NO. 32426
atatccgtggagagaagttgccctaactttgtgccccgagcctcaggccccgcgcgcctccttacggcagcatccgctcctttcccctccgacccgccgccggcaccccctccgcgcccgccggtgaagtcctgccgctcctccgcgcgcattctctctcccccgcctcatcatctaccagaggcggccagctcggtggggattgcgcgatggatggatacggagaggcggccacggcggccatggaggtggaggccgaggccagtccgtgcgcggggctcttctctcctgagacgtcggattccccatctcgaaaccctgatggaagcgtgacctcgaggcggctcgccctcaagaacagaatccagaccaatttcggagatgattatgtcttccaaattgcttcttgccaggagatctcaacactcgcagtttccttgtcatcaaatgcgctgaagttttattctccagcaactggacaatatctggggaaatgtaaaggacatgaaggaactattcatgaaatctccttctcagttccatcatcaccacaagtaatctgttcttgttcttctgatggaactgtcagagcgtgggatacaagaaactttaagcagatctctctgctaagaggaggcgcatcgcaagaaatgtttaccttctcctttggtggatcaagtggtaacctacttgctgctggctctaatgcccaggttctattgtgggattggagaaattcaaaacaagttgcatgcttagaggaaagccacatggctgatgtgacacaagtcaaatttgcaccaaatcaacagagcaaactcatttctgcagcagtggatggattagtatgtgtttttgacactgatggcgacattgatgaggacaatcatctgctatctgttatgaatgcagaaacatctgttgccaaagtgggattttttgggaatatgtatcagaagctttggtgtttgacccatattgagacattgagcgtttgggactggaatgacgggtctagagagttgaatatagaagatgctcgctccttggccactgataagtggaaccttgaccatgttgactaccttgttgactgtcattactctctgcctgatgaacggctatggttgattgccggcacaagtgcagggactctaggttacttccctgtaagaaatgatcctgccggagcaattggtcccgccgaagctatccttgaaggaggccatacaggggttgttaggaccgtgtaccctgccgcaggaacccatggcagccttgggcaaaataggggcatctttggatggacaggaggtgaggatggccgtctctgctgctggcgatccgacgaaattgcagagacaaacaagtcttggatctcgagttcattagtctcaaagctgcaaaagaaaaccaaaagccgacatcagccatactagccgccaagaacaaatctgtgtaacatttgccgttgaaaagagcaagccctgtgtgtgtgctgtgtgagcatgcttatcttcatgcttaaagttctaggtcatgatcaacatatttggtatatccccgtagaacattgtaactgttctttttttacactaatggttgagaatgctaccgtagttcacggggactagttatc

SEQ ID NO: 32426 - protein, 409 aa, Panicum virgatum
  misc_feature: Ceres CLONE 1910828
  misc_feature (90)..(130): Pfam Name: WD40 Pfam Description: WD domain, G-beta repeat
MDGYGEAATAAMEVEAEASPCAGLFSPETSDSPSRNPDGSVTSRRLALKNRIQTNFGDDYVFQIASCQEISTLAVSLSSNALKFYSPATGQYLGKCKGHEGTIHEISFSVPSSPQVICSCSSDGTVRAWDTRNFKQISLLRGGASQEMFTFSFGGSSGNLLAAGSNAQVLLWDWRNSKQVACLEESHMADVTQVKFAPNQQSKLISAAVDGLVCVFDTDGDIDEDNHLLSVMNAETSVAKVGFFGNMYQKLWCLTHIETLSVWDWNDGSRELNIEDARSLATDKWNLDHVDYLVDCHYSLPDERLWLIAGTSAGTLGYFPVRNDPAGAIGPAEAILEGGHTGVVRTVYPAAGTHGSLGQNRGIFGWTGGEDGRLCCWRSDEIAETNKSWISSSLVSKLQKKTKSRHQPY

SEQ ID NO: 32427 - DNA, 1679 bp, Panicum virgatum
  misc_feature: Ceres CLONE 1910831
  misc_feature: Encodes the peptide sequence at SEQ ID NO. 32428
atctccgtctccactctaccctcgcctcctccctccccgcgccgccacccccctcgaaaccctaaccctagccgcctcccgggaggcgggtaggagagctcgcggcgccggccatggcggagcacgacctcacggcgctgctggcggcgcagatggaccgccacctggtgttcccgctgctggaattcctgcaggagcggcagttctactcggagccggagatcctcgaggccaagatccgcctcctcagcggcaccaacatggtcgactacgccatggacatccacaagtcgctccacggcaccgacgacgtgcccgaggacatggtccgccgccgcgccgaggtcgtctccaggctcaggtcgctcgaggaggccgcggcgccgctcgtcaccttcctccagaacccgcagctcgtgcaggagctcaggcccgacaagcagtacaacatccacatgctccaggaccgataccagattggtccagatcagattgaagctctgtatcagtatgccaaatttcaatttgagtgtggtaactactcaggggctgctgactacttgtaccagtatcgtgctttgtgcacaaacagtgagaggagtgtgagtgccctttggggaaagctggcagcagaaatcctgatgcagaactgggatgtagctttggaagaactcaaccgcttgaaggaaataattgattcaaagaacttctcatcacctctgaatcagctccagaacaggatatggctgatgcattgggctctcttcatcttcttcaaccatgaaaatggtagaaatgggatcattgatctgttcttccaagacaggtacttgaacgctattcagacaaatgcacaccatcttctgagatacctagctactgcagttgttgtgaacaaaaggagaaggaatatgcttaaagagcttattaaagtcattcagcaggagcaacatagctacaaggaccccataactgaatttctggaatgcttatatgtcaactatgattttgatggtgctcaacagaaactcatggagtgtgagcaggttattttgaatgatcctttcctgggaaagcgcattgaagaaggaaatttcgtcactgtccctttgagagatgagttccttgaaaatgctcgtctgtttattttcgaaacttactgccgtattcatcggtgcattgatatcggcatgcttgcgcagaagctgaacatgagctacgatgaggcagagttgtggataatgaacttggttaggaactcaaaactggatgccaggatcgattcagtgtctggaacccttatcatgacaaccaatcatgtcaatgtgcatgagcagattatcgagagcttgaagggccttaacatgcggacatacatgctagcaaagaacatcgtggagccagctcaagcagcacagcaggcagctcggtgaggttagcggaatccacagttttgaggtgcccagtgttagttacagtagagacagctgtaaactctcggagctctattgtcaggaagtgacttcgtcatcagtatttgaacacctggggtgttggtttgccgtttgctacagcttatgctgacatttttagtattttgtactcagaatttcataacatgtgatctccttctctatgtattactgaaatgaatgatgcaatcagattcatgtttcggc

SEQ ID NO: 32428 - protein, 439 aa, Panicum virgatum
  misc_feature: Ceres CLONE 1910831
  misc_feature (284)..(400): Pfam Name: PCI Pfam Description: PCI domain
MAEHDLTALLAAQMDRHLVFPLLEFLQERQFYSEPEILEAKIRLLSGTNMVDYAMDIHKSLHGTDDVPEDMVRRRAEVVSRLRSLEEAAAPLVTFLQNPQLVQELRPDKQYNIHMLQDRYQIGPDQIEALYQYAKFQFECGNYSGAADYLYQYRALCTNSERSVSALWGKLAAEILMQNWDVALEELNRLKEIIDSKNFSSPLNQLQNRIWLMHWALFIFFNHENGRNGIIDLFFQDRYLNAIQTNAHHLLRYLATAVVVNKRRRNMLKELIKVIQQEQHSYKDPITEFLECLYVNYDFDGAQQKLMECEQVILNDPFLGKRIEEGNFVTVPLRDEFLENARLFIFETYCRIHRCIDIGMLAQKLNMSYDEAELWIMNLVRNSKLDARIDSVSGTLIMTTNHVNVHEQIIESLKGLNMRTYMLAKNIVEPAQAAQQAAR

SEQ ID NO: 32429 - DNA, 1489 bp, Panicum virgatum
  misc_feature: Ceres CLONE 1910833
  misc_feature: Encodes the peptide sequence at SEQ ID NO. 32430
atacccgacctcttatccgctcagctactgacctccgctcctccagctccaggttcctccagctccgggcggcgcttgccgcccccggcggcagcgcctcctcctccacttgcccgctcccccggccccgattcctcccggctgcaagactgtagatcgatacatctagcaccaggtgcggcctctgctcgtcctttgctgtggcaagggtggagcggcggaatcgatccccgcatcgcggaagagctcgcagcctcttatccactccacctctgtccagtgaccgccgccgccttctatctgggtggaagaaacatgtcaagaatggcgcctccgtcctctcccctatccatgaagcccccgacgctgcccttctcccctcccaagaagccggcgccgatgccggtgtacaaggacctgcatttcaaccgcgacctctccgctaccaagaagctccaggccggggtggacctggtggcgcggttggtgggggtcaccctggggcccaaggggaggaacgtggtgcttggcaacaagtatggccctcccaagattgtcaacgatggggagaccgtccttaaggagatcgaattggaggatccattagaaaatcttggagtgaagctggtcaggcaggctggtgcaaggaccaatgatattgcaggaaatggttgtaccacttccataatccttgctcgaggcctgattgctgaaggaatgaaggttcttgcagctggaatcaacccagttcaggttgcacgtggtattgagaagactgctgccgctttggtgtctgaactcagaattgaagaccatgaacttgcacatgtggctgcagttagcgcaggaaatgattatgctgttggaaatatgatttctgatgcttttcaaagagtaggtagaaaaggaatggtgagaattgaaaatggaagaggcaccgaaaacagtctggatgttgttgaaggaatgcaatttgaatgtggttacctctcgccctactttgttactgatcgtgcaaatatgacggtggagttcacagactgtaagattctattggttgacaagaaaattactgatgctagtgaaattataaggatactggatagtgctgtcaaagaaaattatccattattaatagttgctgaggatgtggaagaaacagcaatggctgatttgataaaaaacaagctgaaagggacaattaaggttgcagcagttaaggccttctcttttggggagcaaaagactcaatgcttggaagatgttgcagtcatgacgggaggtacagtagtgagggatgacatggcatattcattggaaaaggcaggaaaagaggttctgggttctgcttctaaggtggttatcaggaaagattcaacactaattgttactgatggaagcactcgtcatgcagttgagaaaagagttgctatgataaaaggacaaattgagaactcaaaggaaaggtacaacaagaaaatattgggtg

SEQ ID NO: 32430 - protein, 388 aa, Panicum virgatum
  misc_feature: Ceres CLONE 1910833
  misc_feature (51)..(386): Pfam Name: Cpn60_TCP1 Pfam Description: TCP-1/cpn60 chaperonin family
MAPPSSPLSMKPPTLPFSPPKKPAPMPVYKDLHFNRDLSATKKLQAGVDLVARLVGVTLGPKGRNVVLGNKYGPPKIVNDGETVLKEIELEDPLENLGVKLVRQAGARTNDIAGNGCTTSIILARGLIAEGMKVLAAGINPVQVARGIEKTAAALVSELRIEDHELAHVAAVSAGNDYAVGNMISDAFQRVGRKGMVRIENGRGTENSLDVVEGMQFECGYLSPYFVTDRANMTVEFTDCKILLVDKKITDASEIIRILDSAVKENYPLLIVAEDVEETAMADLIKNKLKGTIKVAAVKAFSFGEQKTQCLEDVAVMTGGTVVRDDMAYSLEKAGKEVLGSASKVVIRKDSTLIVTDGSTRHAVEKRVAMIKGQIENSKERYNKKILG

SEQ ID NO: 32431 - DNA, 717 bp, Panicum virgatum
  misc_feature: Ceres CLONE 1910833-R
gtggatgtagcctactaagattatcaaagaagattgacgcaaccaaggaatcatcattggataatatagagcaaaagattggtgctgacatcttcaagcaagccttgagttaccctacctcactgatagcaaacaatgcggggatgaatggtaattttgtcgttgaaaaggtgttattgaatgacaacacaaattatggttacaatgctgccacgaaccgctatgaggacttgatggctgctggaatactggatccatcagaggttgtgagatgttgcattgagcatgctgctgtggttgcaaagtcttttctcacttctgatgtggtgattgttgaggcaaaagaaagcaaacccattcgaataaggcccccaatgccacctgggagcttgatccccccaatacctgcctcagtttcaggtattcgagtgtagcaagcttcatttccacagattgacctcaatatgacaaaaactacatggacgaaattcttttgcaaaaaatgcatgtaatagagaagagaatgctggaaatttcaattgatattcttatctcctcccacactctgtggatatgtttatcttctttgggggaggctagctatgtaaatagctgagtcggtttagattgttcacataagttgcattgtacgaccagagttgctactcattttgtaaatatttctagcaaattcctcaaatacttatgtatatttat

SEQ ID NO: 32432 - DNA, 748 bp, Panicum virgatum
  misc_feature: Ceres CLONE 1910836
  misc_feature: Encodes the peptide sequence at SEQ ID NO. 32433
actcccccgccgcctctcgtctcgtgagtagctgcggagcaggcaccaaacccccgcgcgcgcagcgcggcggcggcaatggcgcccacggcctgcctccggctcccctttctcccggctcgagccccggcccgctccgccaacccggccgccgcctacccatccccccgcctcccctccctgaaatgcagcgccgccaacagccacagctccggcttcagccccaactccacctccatctctccgatctcgccgccgcgggcgacgctggcggacggcgttgagtcggtggacgccaacgggctgcgccgcccgcccgcgcctgtctccggcctcaccgtccccggcgcccgcgatccccactggctgcctcggccgctcactagtgcggacgtcatggatgtgaatgggaaggggctcaaggttgcttaccagggttgccctggggcgtacagcgaggcagcagcaaaaaaggcatacccgaattgtgagactgtgccctgcgagcactttgatactgcatttcaggctgttcaaaactgggtggctgatagggctgtactgccacttgagaattcattgggaggtagcattcatcggaactatgaccttttgcttcggcatagtttgcacattgttggagaagttcgccttgcagtgcgtcattgcttgttagccaatcctggcgtgaagattgaaaacctgaaaagtgctatgagtcatccccaggctcttgcgcaatgtgagc

SEQ ID NO: 32433 - protein, 117 aa, Panicum virgatum
  misc_feature: Ceres CLONE 1910836
  misc_feature (10)..(117): Pfam Name: PDT Pfam Description: Prephenate dehydratase
  misc_feature: SWISSPROT Homolog: EC 4.2.1.51 Prephenate dehydratase
  misc_feature: Useful for making plants with altered lignin content
MDVNGKGLKVAYQGCPGAYSEAAAKKAYPNCETVPCEHFDTAFQAVQNWVADRAVLPLENSLGGSIHRNYDLLLRHSLHIVGEVRLAVRHCLLANPGVKIENLKSAMSHPQALAQCE

SEQ ID NO: 32434 - DNA, 650 bp, Panicum virgatum
  misc_feature: Ceres CLONE 1910843
  misc_feature: Encodes the peptide sequence at SEQ ID NO. 32435
acgggcatctcgccccccctccccggctctccccccccccccccccgaaacttcgtggcaaaacctccgccatttcccttccgttccggcctcttccctccccacccgacccggacctcccctctcctaccaatccccccgcccccccctccgcatcttgtcgcgcgggtacctgcagcgactgacggcgagcaatggagaacgccaccccacggcagggggtcctgccgcggcacctcatccccgcggccgcggcgtcgggcccctccccgcccgccatctccgcgagcgcgtgctcggcgggggacagcgcggcgtaccaccggacggcggccttcaccgacaacgtcgtcatcgtcgctgcatacaggacggcgatttgcaaggccaagagagggggtttcaaggatacgttcgctgaggacctattggttcctgtcttcaaggctttattggataaaacaaagctgaaccctagcgaagttggggacattgttgtccgtactgtcttagcacctggctcccagagggcaatcgaatgcagaatggcagcattctatgctggtattcctgacactgttcctctgaagactgtaaacaggcaatgctcttctggccttcacgcagttgcagatgttgctggctgctat

SEQ ID NO: 32435 - protein, 151 aa, Panicum virgatum
  misc_feature: Ceres CLONE 1910843
  misc_feature (49)..(151): Pfam Name: Thiolase_N Pfam Description: Thiolase, N-terminal domain
  misc_feature: SWISSPROT Homolog: EC 2.3.1.16 Acetyl-CoA C-acyltransferase
MENATPRQGVLPRHLIPAAAASGPSPPAISASACSAGDSAAYHRTAAFTDNVVIVAAYRTAICKAKRGGFKDTFAEDLLVPVFKALLDKTKLNPSEVGDIVVRTVLAPGSQRAIECRMAAFYAGIPDTVPLKTVNRQCSSGLHAVADVAGC

SEQ ID NO: 32436 - DNA, 1719 bp, Panicum virgatum
  misc_feature: Ceres CLONE 1910845
  misc_feature: Encodes the peptide sequence at SEQ ID NO. 32437
aacggagaactaacgccgtttctatacccggcggcgtagttggacattctggctcttcttcccctgtcgcaagtaaacagcagatctcgccgcccccgtcctccgccgcatccgcgattccgaccatggagggcgacagtaccaacctcgatgcggcgatagagtcactcctgaatgtcgagaagcagatgagactggccggcgatgtcgctgccacgcggaaggccgtcatcgacatcgtcgagctttgctacaaggccggtgcgtggaagacgctcaatgaccagatcgttctcctctccaagaggagaggccagctcaagcaggccattaccgccatggttcagaaagcaatggagtacattgatttgacgccagacatggacacacgcattgagctaatcaaaacattgagcagtgtctctgctggcaagatatatgtcgagatagagcgagcaagacttatcaaaagacttgcgaaaatcaaagaggagcaggggaagattgatgaggctgctgatttgatgcaagaagttgctgttgaaacatttggctctatggcaaagacagaaaaaattgctttcattctcgagcaggtccggctgtgtctggatcgtcaagattatgtccgagcacaaattttatccaggaaaatcagtactagagtatttgatgcagatccatctaaggaaaaaaagaaaccgaaaggtgacagtattgttcaggatgctcctgcagaaataccttccctcctagaattgaaacgcatctactacgaactgatgattcgatattactctcacaacaatgattatttggagatctgccgttgctacaaggcaatctatgatattccagctataaaagaggatccagcaaagtggataccgattcttaggaagatatgttggtacctagtgttggcacctcatgatcctatgcaatcgagccttctcaatgctactctagaggataaaaacctttctgagatcccaaatttcagattattgctgaagcagctggttaccatggaggtaatccagtggacaagtttatgggatttcttcaaagctgaatttgaggatgagaaaaatctccctggaggagctttgggtgacaaagctgcagcagatttgaagctgaggataattgaacataatatcttggttgtctccaagtattattcaaggattaccctcaataggcttgcagatctcctttgcctaagtttgcaggaggcagagaagcatctttcagacatggtgaattcaaaatctctggttgcaaagatcgacaggccaatgggagttgtgagcttcggtacagctcaagacagcaatggggtactcaactcctgggccacaaacctcgagaaacttcttgaccttgtcgagaagagttgccatcaaatccacaaggagacaatgatccacaaggccgtgttgaaagcttagatttggctcgtggctctaggttcccttcataggctccctttgaggagaggtgccaccccgcttcataggctccctttgaggagaggtgccaccccgagaacgatgaatactactcactgtcctccaaatttcttaactcgtgtatcttgctgaatattgtttgaattcctagacctcaatcagacatctgctcttgaaaactagaactagcttcttattgaatttggagaagaaaagaacgaccctttgcagaggtttttatttc

SEQ ID NO: 32437 - protein, 442 aa, Panicum virgatum
  misc_feature: Ceres CLONE 1910845
  misc_feature (290)..(400): Pfam Name: PCI Pfam Description: PCI domain
MEGDSTNLDAAIESLLNVEKQMRLAGDVAATRKAVIDIVELCYKAGAWKTLNDQIVLLSKRRGQLKQAITAMVQKAMEYIDLTPDMDTRIELIKTLSSVSAGKIYVEIERARLIKRLAKIKEEQGKIDEAADLMQEVAVETFGSMAKTEKIAFILEQVRLCLDRQDYVRAQILSRKISTRVFDADPSKEKKKPKGDSIVQDAPAEIPSLLELKRIYYELMIRYYSHNNDYLEICRCYKAIYDIPAIKEDPAKWIPILRKICWYLVLAPHDPMQSSLLNATLEDKNLSEIPNFRLLLKQLVTMEVIQWTSLWDFFKAEFEDEKNLPGGALGDKAAADLKLRIIEHNILVVSKYYSRITLNRLADLLCLSLQEAEKHLSDMVNSKSLVAKIDRPMGVVSFGTAQDSNGVLNSWATNLEKLLDLVEKSCHQIHKETMIHKAVLKA

SEQ ID NO: 32438 - DNA, 715 bp, Panicum virgatum
  misc_feature: Ceres CLONE 1910858
  misc_feature: Encodes the peptide sequence at SEQ ID NO. 32439
aaaaggcccaatcgtcctacccgacaatggaggcgctcgtggtgcggtggcttggtgaccccacggtggcccccggcgaggagtcctcccctttcgccggcgtcttcgggggccacccggtgccggagctctcatcgccgacggccgtccgggtgcgcgtcgcggcgaccagcctcaacttcgccacgttcctccaagtgcagggcaagtaccaggagcggcctccgctgccgttcgtgcccggctccgactacgccggcgtcatcgacgctgtcgggcctggggtccgaggcctacaccccggcgaccgcgtctgctccttcgcaggtctcgggtccttcgccgacttcatcgtcgccgaggagaagcagctatttttagtgcctgatggatgcgatctggtcgctgctggggctttacctgttgcatttggcacatcacatttggcccttgttcatagagctcagctgaaggccggccaggtgctacttgttcttggtgctgctggtggtgtcggggtatctgctgtgcaaataggaaaagtttgtggtgctgtcgttattgctgttgctagggggattgagaaattgcaatatctcaagtccataggagctgatcatgtaattgactcaagcaaggataatgttgtaggaagtgccaagtccttcttaaaggctagaggcctgagaggtgctgatgttttatatgatcctgt

SEQ ID NO: 32439 - protein, 229 aa, Panicum virgatum
  misc_feature: Ceres CLONE 1910858
  misc_feature (38)..(119): Pfam Name: ADH_N Pfam Description: Alcohol dehydrogenase GroES-like domain
  misc_feature: SWISSPROT Homolog: EC 2.3.1.94 Erythronolide synthase
MEALVVRWLGDPTVAPGEESSPFAGVFGGHPVPELSSPTAVRVRVAATSLNFATFLQVQGKYQERPPLPFVPGSDYAGVIDAVGPGVRGLHPGDRVCSFAGLGSFADFIVAEEKQLFLVPDGCDLVAAGALPVAFGTSHLALVHRAQLKAGQVLLVLGAAGGVGVSAVQIGKVCGAVVIAVARGIEKLQYLKSIGADHVIDSSKDNVVGSAKSFLKARGLRGADVLYDP

SEQ ID NO: 32440 - DNA, 756 bp, Panicum virgatum
  misc_feature: Ceres CLONE 1910874
  misc_feature: Encodes the peptide sequence at SEQ ID NO. 32441
ctccctccctctccttctacctcttcctctttcccttccgtttttctaagagggagagagacagagagggggcacatgctccgattgctagcttcagttcgatccgtgtagctctgctagctcctttcacccgcctttcagaattcattatcatcatccgatcgatcggtcgtcggtggtgcagaagaagccggagagtcaggtaggctactgtccaagctaagaagagacactagccgcagtagtcacgcggccaccacacagctagctgcgtgacttggactggcagtcgcagtgtgaccggccggtagctcgctgcttgttgcttctcgatctctaccactacatactccagctgctaacgcagcagcaggtggtgccgtgaccaatccaatcgtcaactcgtcagctagctagctgagatcgatcatcgatacatggcggctgctcacctgttcggactcggcgacgcgcagacgatgcagccgccgctgccgcagcaggcagcgcctcctcctccggcggccgcgccggcgctcaagaagaagaggaaccagcccggtaacccaaatcccgacgcggaggtgatcgctctgtccccgaagacgctgctggcgacgaaccggttcgtgtgcgaggtgtgcaacaaggggttccagcgggagcagaacctgcagctgcaccggcgcgggcacaacctgccgtggaagctcaagcagaagaaccccaaggagacgcggcggcggggtgtacctg

SEQ ID NO: 32441 - protein, 106 aa, Panicum virgatum
  misc_feature: Ceres CLONE 1910874
  misc_feature (64)..(86): Pfam Name: zf-C2H2 Pfam Description: Zinc finger, C2H2 type
  misc_feature: Useful for making plants with altered lignin content
  misc_feature: The sequence is a functional homolog of SEQ ID NO 1086 in the 10/666,642 US patent application
  misc_feature: The sequence is a functional homolog of SEQ ID NO 312 in the 10/666,642 US patent application
  misc_feature: The sequence is a functional homolog of SEQ ID NO 1719 in the 11/479,226 US patent application
  misc_feature: The sequence is a functional homolog of SEQ ID NO 650 in the 10/666,642 US patent application
  misc_feature: The sequence is a functional homolog of SEQ ID NO 960 in the 11/435,388 US patent application
MAAAHLFGLGDAQTMQPPLPQQAAPPPPAAAPALKKKRNQPGNPNPDAEVIALSPKTLLATNRFVCEVCNKGFQREQNLQLHRRGHNLPWKLKQKNPKETRRRGVP

SEQ ID NO: 32442 - DNA, 785 bp, Panicum virgatum
  misc_feature: Ceres CLONE 1910879-R
  misc_feature: Encodes the peptide sequence at SEQ ID NO. 32443
atgcatacacactgaaggttgacgagaagagcgatgtctatagctttggcgttgtgcttcttgagctggtgactggaaggaagcctgtaggtgagtttggcgatggtgttgacattgtccaatgggcgaagatgatgacagactcaagcaaagaacaagtgatgaagatcctggacccaaggctctcaactgttccactgcacgaggtcatgcatgtctcctacgttgcattactttgcacggaggagcagagtgtgcagcgcccaacaatgagggaagttgtgcagatcctgagtgagcttccaaagccatctactaagcaaggagaggaggtatcaaatgcatgtgatggccctgcatccaatcctctacctccagctccagctgggtctaatgaagcaacaacaggcgaagccagagatcgtcaacagcagcaaacaagcactccgtcgtcaccgcctccagatctcataagcatctgatctgagtaacgcaaaactgaaaatgttatcattccttggaaattcgctccattctcgcaagcttaggtcgtaatttaggatgcagtaaatttggcctcctttgctgtacatattcaagtttgttggtggtgccccagtttccagtttgacaatgtgtttgctttgctggtgcaatgtaggagtctgtagcgcgtcaagtcaccttaatagagcttttgatctcctttgtccaatattccaatgtaggcactaaagtataaagtgctctctctatcgaatttaacatcagaatctttgctgtgg

SEQ ID NO: 32443 - protein, 159 aa, Panicum virgatum
  misc_feature: Ceres CLONE 1910879-R
  misc_feature: SWISSPROT Homolog: EC 2.7.11.1 Non-specific serine/threonine protein kinase
AYTLKVDEKSDVYSFGVVLLELVTGRKPVGEFGDGVDIVQWAKMMTDSSKEQVMKILDPRLSTVPLHEVMHVSYVALLCTEEQSVQRPTMREVVQILSELPKPSTKQGEEVSNACDGPASNPLPPAPAGSNEATTGEARDRQQQQTSTPSSPPPDLISI

SEQ ID NO: 32444 - DNA, 500 bp, Panicum virgatum
  misc_feature: Ceres CLONE 1910879
aaacccacacgaagcacacacctctctgccgtccgcactctcctcgccgagcgggtggtgcgagcctccccgcctgaccgcctatcccctcttcccccctcatctccgccgccgcacccgagaggaagcgaagcccaatgcgcctcctcccgctgctcctgctcctggccctcgccgcgggcgcggccggcgcggcgggcggcggcgcggacgcggacgcgggcgcggccggcgccgccggcggctccccggacgcggacgctcgcgcgcagcgcgcggccatcgccgcactctcccacttccccggcactgtcgcgtggcgccacgcctcctctgtccgcgaccgatgtgggggagaaggggtctcgtctgaatgttactgcgacatggggagtgtcctgatcttcagaattgaacttgtcagagctgatctttccgcgctgactctgactcgcgcacctggaccaccctctatatctgacatcctgctctgtgcaact

SEQ ID NO: 32445 - DNA, 748 bp, Panicum virgatum
  misc_feature: Ceres CLONE 1910907
  misc_feature: Encodes the peptide sequence at SEQ ID NO. 32446
acccgccgccgccgcccgccgtcgccgctctcgctcgcaccgtcgcatcgccgcaggattcgcaaagatggcggtgccgctgctgacgcagaagatcgtgaagaagcgggtgaagcagttcaagaggccccacctcgaccgctacaagtgcctcaagccaagctggcgcaggcctaagggtattgactcccgcgtcaggcggaagtttaagggatgcaccttgatgcccaacattggatacggctctgacaaaaagaccaggcactaccttcccaacaagttcaagaagttcgttgtacacaatgtctctgagcttgagctgcttatgatgcacaacaggacgtactgtgctgagattgcccacaacgtctccacccgcaagcgcaaggagattgtcgagcgcgctgcgcagctggacatcgtggtcaccaacaagcttgccaggctccgcagccaggaggacgagtgaaatgttcagtagttgcagttgcagttgcagttgcagttgcgttagagcagtactgagattgaagatacctttccagtttccaccatttgtatgcttgtgttagacttgttctgtaaacgaaattttgctatgagtgaatggcgaaccccatctagttttgacctgaaaaaaaaaaaaaaaaaactcaaacgccactcctccctctcctctcgtctcggcctcgggatcagcgggatcggagcagcagcaatggcgatggcgtcgtcgagcgggctccgg

SEQ ID NO: 32446 - protein, 133 aa, Panicum virgatum
  misc_feature: Ceres CLONE 1910907
  misc_feature (14)..(123): Pfam Name: Ribosomal_L32e Pfam Description: Ribosomal protein L32
MAVPLLTQKIVKKRVKQFKRPHLDRYKCLKPSWRRPKGIDSRVRRKFKGCTLMPNIGYGSDKKTRHYLPNKFKKFVVHNVSELELLMMHNRTYCAEIAHNVSTRKRKEIVERAAQLDIVVTNKLARLRSQEDE

SEQ ID NO: 32447 - DNA, 1344 bp, Panicum virgatum
  misc_feature: Ceres CLONE 1910910
  misc_feature: Encodes the peptide sequence at SEQ ID NO. 32448
ggtttgtgagtgatctctctctccccccgcgcgcggacagccagccgtataggggcgggatggcttcgcgagcggagcggggacgccgcgcccttgacgccatgaaagccctgggattctccaagaaggaggtcacccccgtcctcaggagcctcctcaagctctttgacaacagctgggagcccatcgaggacgagggctaccgtgccctggccgacgccaccctcgacgcccgtgaccgcccccaggggccagagcatggtagccaccgcccgagaatggttgcgccagaggaagatcactaccagccttctgcgtcccttgtggcccgtgtcggtccctgcgacttggacagtgagacagaggcacctcgcgtcaagaggcctagaaccagctctaataatttctcagcagatcactctattgatcatcaattgtccccgtcgtctcctcttactgcacacgagatggcaaggaagattatggatgaagatttccaacaagctgtcttcttgagagagcctaagcctgagcctgatatggatgcagcacagagcttgcatgatgttcaagtcggtattgtttcccatatgttcaacgccagctcctcaggtgctgcaggtcctctagcattgcgaccacccgatcaaaatcaaatagagacttcaggtaataaaggcaggccagttcagcgttgtggaacaaggcgaccatccacttcctttattgaacctgcggacagcatggggaagcaagctcaaaacccggaaagttcgtctgatcacatagctgtgatgcacaacactcggacgggatttgcaaatgaatatagacatgaagcacgttgcttgcacactgagatagcatcatccactatgggtgaggtcaagatgtcaataaaatgcaacatagacccatccaagttctgcatgcacagtttagaagcagttttcaggatggttgaggataaatgttttcgctcatacgagagtctgccaccaaatttttccattggcagcctgatcaatgagatatgcgaatgtgtagcacaactgggcaatgatcatactacagaatataatatacaatctgattctgttgacaatggcagaaacttgcaaaatgagccaatgatgaatggtgccgcacttgtggaaccaattgcttgcattagtaggggaggtaggaaatataaatctgtagaagattcatggattttagaaacttcagataatagccaagaaaattcaatggatgctcagcatctggcactttctcacctaaggcatgcccacaatgcatctgatatatcaaatggagaagaaaaaataaggataccagtgg

SEQ ID NO: 32448 - protein, 414 aa, Panicum virgatum
  misc_feature: Ceres CLONE 1910910
  misc_feature: SWISSPROT Homolog: EC 2.1.1.43 Histone-lysine N-methyltransferase
MKALGFSKKEVTPVLRSLLKLFDNSWEPIEDEGYRALADATLDARDRPQGPEHGSHRPRMVAPEEDHYQPSASLVARVGPCDLDSETEAPRVKRPRTSSNNFSADHSIDHQLSPSSPLTAHEMARKIMDEDFQQAVFLREPKPEPDMDAAQSLHDVQVGIVSHMFNASSSGAAGPLALRPPDQNQIETSGNKGRPVQRCGTRRPSTSFIEPADSMGKQAQNPESSSDHIAVMHNTRTGFANEYRHEARCLHTEIASSTMGEVKMSIKCNIDPSKFCMHSLEAVFRMVEDKCFRSYESLPPNFSIGSLINEICECVAQLGNDHTTEYNIQSDSVDNGRNLQNEPMMNGAALVEPIACISRGGRKYKSVEDSWILETSDNSQENSMDAQHLALSHLRHAHNASDISNGEEKIRIPV

SEQ ID NO: 32449 - DNA, 588 bp, Panicum virgatum
  misc_feature: Ceres CLONE 1910910-R
  misc_feature: Encodes the peptide sequence at SEQ ID NO. 32450
acccccttcttcgcgtttctggctgagttcaggccgcagtacctggagaagcaccctgagctcaagggcgtaaaggaggtttccaaggcggctggggagaagtggcgctctatgtccgatgaggagaaagcgaagtatggcgggggcaagaagcagcaggaagacaaggcaagcaagcccacaaacaagaaaaaggagagcactagctccaagaaggccaagactgatggtggggagggagaggaagtggaaggttctgacaagtccaagtcggaggttgaggatgatgatgagcaggatggcaacgaggatgaagatgaggagtaaatattaggatggggaacagcagctatccaattgggtgtttgcttcttttgtatacctagcttcctatgctgctgttccttttgatgttatatgctgtaaggagaatctgtagatggaaggtaccctagggctatgacatgctggagtacccgtttaactattagcagggaaagagctggatactgttgccagcctcatccgcatgtgtaaacagttgttttgcttgttttatcgaccgattggatgactacccttcagtgt

SEQ ID NO: 32450 - protein, 108 aa, Panicum virgatum
  misc_feature: Ceres CLONE 1910910-R
  misc_feature (1)..(63): Pfam Name: HMG_box Pfam Description: HMG (high mobility group) box
TPFFAFLAEFRPQYLEKHPELKGVKEVSKAAGEKWRSMSDEEKAKYGGGKKQQEDKASKPTNKKKESTSSKKAKTDGGEGEEVEGSDKSKSEVEDDDEQDGNEDEDEE

SEQ ID NO: 32451 - DNA, 1767 bp, Panicum virgatum
  misc_feature: Ceres CLONE 1910958
  misc_feature: Encodes the peptide sequence at SEQ ID NO. 32452
atttctgctctaatagtttaagtcgtgctccaaagaaaccctcagatgaagaaaacctaagcaatacgctgccaatctgccaccgagacggcgttgctgcctgctggacctggacgtgcacccctcgtctatttctttctccctctccctcccccctcctggccttccttttctggcggcggcgactgggcaagctgcggtgcccttcgcacgtcttcaccggcgactagcacccaccagtgcaggaggatggcggagccgtccaaggtaatccacatccgcaacgttgggcacgagattgctgagtctgatctactccagctgttgcagccgttcgggctggtctccaagattgtcatgctgcgtgccaagaaccaggctcttctgcagatggaagacatacatgcctctgtgagcgcgctgcaatattacagttcagttcaacctagtgtaaggggaaggaatatatacatgcaattctcatcccaccaagaacttaccacagaccagagctctcatggaaggaattctgatcaggagtctgaacccaaccgaatcctcttagttactatccaccacatgatctatcctataacggtggaggttctacatcaagtattcaaagcttatggatttgtggagaagatagtcacatttcaaaagtcagctggttttcaagctcttattcagtataactcgcgccaagaagctgtggaagcatttggttctttgcatggaagaaacatatatgatggttgctgccagctagacattcaatattcaaacctcagtgaactgcaagtccactacaacaatgaccggtctagggattttacaaatccatcattgcctacagaacaacgtcctaggacctctcagcagcaaggttatcctgatccagctggtctctatgccttccaacaacctggagcttcgtacgcacagatgggaagagtagcaatgattgcggctgcgtttggtggaacgttacctcatggagtgactggtaccaatgaacggtgcacgctcatagttagtaatttgaacactgataaagttgatgaggataggcttttcaatctgttttcgctgtacggaaacatagtacgaatcaagatattgcgtaataaaccagatcacgccctagttgagatggctgatggtttgcagactgagctagctgtgcattatctaaagcagggcgcaattctgtttgggaagaaactggaagttaactactcgaagtaccccaacatcacgcccgcccctgacgcccatgactacttaaactcgagccttaaccggttcaacagcaacgtagtcaagaactacagacattgctgcgctccaacaaagatgatacacatttctgcccttccccaagagatctccgaggaaacaatcctcaaccacgtgtctgagcatggttctgtcgtcaacacaaagctgttcgaggtgaatggcaagaggcaggctctcgtcatgtttgagacggaagaggaggcgacagaggctctcgtgtgtaaacacgccagctcactggaggggaacacgatccggatctctttctcccagatgcagagtatataagccgctcctccagggaaaggtctttaaccgctctcttggcctttgtgagctttgtttaggaagcatttgaaactaagatgtgaatcctatgcgctgttctcccagactgatgctctgtctgagctgtactaccctgacattcggtttcttcatttcttgtgacactggccttgcacc

SEQ ID NO: 32452 - protein, 446 aa, Panicum virgatum
  misc_feature: Ceres CLONE 1910958
  misc_feature (371)..(438): Pfam Name: RRM_1 Pfam Description: RNA recognition motif. (a.k.a. RRM, RBD, or RNP domain)
  misc_feature (260)..(328): Pfam Name: RRM_1 Pfam Description: RNA recognition motif. (a.k.a. RRM, RBD, or RNP domain)
MAEPSKVIHIRNVGHEIAESDLLQLLQPFGLVSKIVMLRAKNQALLQMEDIHASVSALQYYSSVQPSVRGRNIYMQFSSHQELTTDQSSHGRNSDQESEPNRILLVTIHHMIYPITVEVLHQVFKAYGFVEKIVTFQKSAGFQALIQYNSRQEAVEAFGSLHGRNIYDGCCQLDIQYSNLSELQVHYNNDRSRDFTNPSLPTEQRPRTSQQQGYPDPAGLYAFQQPGASYAQMGRVAMIAAAFGGTLPHGVTGTNERCTLIVSNLNTDKVDEDRLFNLFSLYGNIVRIKILRNKPDHALVEMADGLQTELAVHYLKQGAILFGKKLEVNYSKYPNITPAPDAHDYLNSSLNRFNSNVVKNYRHCCAPTKMIHISALPQEISEETILNHVSEHGSVVNTKLFEVNGKRQALVMFETEEEATEALVCKHASSLEGNTIRISFSQMQSI

SEQ ID NO: 32453 - DNA, 1557 bp, Panicum virgatum
  misc_feature: Ceres CLONE 1910962
  misc_feature: Encodes the peptide sequence at SEQ ID NO. 32454
aactcgccaagcaaatccccatggcggcgcatgcgctgccgttcctccggtggagccggagcgccgcctccctccgcgcgcgctcctccaccacagccgcaccgcactgcctcttctcggccctccgccgcccctccgctgccgcctgctgcgaggcgggctccaaggtcatgctcaaggggatggactactcggaactcgagaattgggtgcaggcgcaggggtttcggccaggccaggccatgatgctgtggaaatgcctatacgggaacaacgtttggactcactgccacgacgagctaactggtttaaacaaggacttcaggaagatgataaccgagcgtgctgatcttaaggcattaactgtgaaggacattctcactgcatcagatggaacccgtaagatactgttctctcttgaagatggcccagtgattgaaacagttatcattccttgcgctaggggcaggacaactgtctgtgtttctagtcaagttggttgtgccatgaactgtcagttttgcttcactggaaggatgggtctgagaaaacatctgtcaacagctgaaattgttgagcaggctgtgtttgctcgtaggctattctctgatgaatttggagcaattactaatgttgtatttatgggcatgggtgaaccatttcacaatattgataatgtaataaaagcctcagcaataatggttgacgatcaaggtcttcattttagtcctcgcaaggttactgtatccacaagtggtcttgtccctcagttaaaacgcttcctccgtgaatccaattgctccctggccgtcagtcttaatgcaacaacggacgaggttagaaattggataatgcccataaacagaaagtacaatcttaacatgcttcttagcactttaagggaggaactttgcctcagaaagaattacagagttctatttgaatatgttatgctttctggagtgaacgacagtatggatgatgcaaagaggcttatcgagctcgtccaagggatcccttgcaagatcaacctcatctctttcaatccccacactggttcccaattcaagcccacaccggatgagaagataatcgagttccgaaacgttttaattcaaggtggccttatagtttttgttcggctcagcagaggggatgatcagatggctgcctgcgggcagctaggagagcctggagactaccagctgcctctgctccgtgtacccgagaaattccaggtcgccttgtgaattgtgacgcatggtgagcaacttgatgaatacgttaagtaattggctttggatggagattcgatcaacttgatgaacacgtgaagtaatttggttcgggatggagattcgatcatgcagttactggaagttatgccatctccgaagactgatctggaatttttcgagatggtatcgaagtggttggtccttcatctgagcctggatatgtaagaacacatttcgatatgggcacatgatgcttctgccgatccggtgtaacctaatcgagcatttgataagagttaatataagctgggtatttgtc

SEQ ID NO: 32454 - protein, 409 aa, Panicum virgatum
  misc_feature: Ceres CLONE 1910962
  misc_feature (155)..(326): Pfam Name: Radical_SAM Pfam Description: Radical SAM superfamily
MAAHALPFLRWSRSAASLRARSSTTAAPHCLFSALRRPSAAACCEAGSKVMLKGMDYSELENWVQAQGFRPGQAMMLWKCLYGNNVWTHCHDELTGLNKDFRKMITERADLKALTVKDILTASDGTRKILFSLEDGPVIETVIIPCARGRTTVCVSSQVGCAMNCQFCFTGRMGLRKHLSTAEIVEQAVFARRLFSDEFGAITNVVFMGMGEPFHNIDNVIKASAIMVDDQGLHFSPRKVTVSTSGLVPQLKRFLRESNCSLAVSLNATTDEVRNWIMPINRKYNLNMLLSTLREELCLRKNYRVLFEYVMLSGVNDSMDDAKRLIELVQGIPCKINLISFNPHTGSQFKPTPDEKIIEFRNVLIQGGLIVFVRLSRGDDQMAACGQLGEPGDYQLPLLRVPEKFQVAL

SEQ ID NO: 32455 - DNA, 1428 bp, Panicum virgatum
  misc_feature: Ceres CLONE 1910967
  misc_feature: Encodes the peptide sequence at SEQ ID NO. 32456
ggtcttgggctttgcccttcttggcctggttctgctctgggtttacgaggggtgcccctttctttgtgctctgatggatgaacagagagttcgatgagccatgggcttggttcctaggggtttggtcttcttggtcaggttagaaggagaaagccccaacctttcttgccgggacctcgccagttctgaaaaatttcattgaagccatggggtccggggactggttcaagacgatcatcagcaagaaaaaatcaaaacgggcaaagtcaaagcacgcaaaggtcgctggtcaagtacaaaatggaggcaacaagacaaatcagaagtcgaatggcccttcttccagtagtgaccacgaagacaatgcagcactagaggaatgggctgctacacggattcagaacgcatttcggaaatacaaggcaaggaaaaccctccgttgtctcaggggagtcaaaagattgcgtatcgttggtcaggccaatccagttaagaagcagactgctgcaacactgagctacatacagtcttggaacaagttgcagtcagagataagaaaccggcgtgctttcatggtcactgaagggcgcaacaggaagaagcagcaggagaatcaaatgaaacttgaggcaaaactccataacttgcaggttgaatggaatggaggttcggatactatggatgagatacttgctaggatacaacaaagggaagaagcagcagtaaagcgtgagcgagccatggcctacgcgttcaaccatcagtggagagcaaggtctgccacaagtctaggaaacttcagctatgaagttgggaagggtggctggggttggagctggatggaccgctggatcgccgcacggccatgggagccgcggtccctggtccaccccgagaacctgaagaaagcacaggcaaagaaggagaacagcaacacgaacccatcggctctgaagctgcaaggctccatcagtctaagcaacaacatcaatgaccggaaagtccctaagaagaagccaacaccgtcatctactgatcagaaaaagtcgtcaccgtcacctacagatcagaagaagccatcaccatcaccttcaagcgatcagaagaaagcagcaccgaaggaacagagagcaaaggcggcaggcactcctccgaaaccgaaggccaaggaaatgaaagggagacaagaaaagcagctgcaacagcagcaagtggttccttcagtcagcgcatgaagatagcggccgcggaaatggttactgatcattgtacgatacatcatgtgaagtcgtcgtgtttttcacagtttgttgtttgtttttctttttcatttttgtcttctcattacggttatatactgatatggaacgagtgccaatgtagaatgtgcttggtttgagcgattatgcacatatgagtatatgacat

SEQ ID NO: 32456 - protein, 342 aa, Panicum virgatum
  misc_feature: Ceres CLONE 1910967
  misc_feature (58)..(78): Pfam Name: IQ Pfam Description: IQ calmodulin-binding motif
MGSGDWFKTIISKKKSKRAKSKHAKVAGQVQNGGNKTNQKSNGPSSSSDHEDNAALEEWAATRIQNAFRKYKARKTLRCLRGVKRLRIVGQANPVKKQTAATLSYIQSWNKLQSEIRNRRAFMVTEGRNRKKQQENQMKLEAKLHNLQVEWNGGSDTMDEILARIQQREEAAVKRERAMAYAFNHQWRARSATSLGNFSYEVGKGGWGWSWMDRWIAARPWEPRSLVHPENLKKAQAKKENSNTNPSALKLQGSISLSNNINDRKVPKKKPTPSSTDQKKSSPSPTDQKKPSPSPSSDQKKAAPKEQRAKAAGTPPKPKAKEMKGRQEKQLQQQQVVPSVSA

SEQ ID NO: 32457 - DNA, 1422 bp, Panicum virgatum
  misc_feature: Ceres CLONE 1910993
  misc_feature: Encodes the peptide sequence at SEQ ID NO. 32458
agcatctcaagacagcatctatccgcgttgccaaggcgggcctgccggtgagtcgagagcggcagcgcgatggcggcggcggcgggagaggaggtgccgaacaagagggtggtcctgaagcgctacgtgacggggttcccgtcggaggacgacatggaggtggtgacggcgacggcgcgcctggccgtgccgccggggtcgacggccatggtggtcaagaacctctacgtctcctgcgacccctacatgcgcggccgcatgaccaagcacgaacgccccagctacgtcccggacttcgtcctcggggaggttttggttaattttggcgtcagcagggtgctagcatctgggcacccggatttcaaggttggcgatcttgtgtgggggatgaccggatgggaggagtattctctcgtccctaaaccggagtcatttttcaagatcaaccaccctgagttgcctctgtcctactacacaggtgttcttggcatgcccggccttactgcttgggctggatttttcgatgtcggcaagcctaagaaaggcgattacgtttttgtctcggctgcatcaggtgccgttggtcaacttgttgggcagcttgctaagctcacgggctgttatgtggttggcagtgctggttctgatgagaaggttaaccttctgaaaaccaagtttggctttgacgaagcattcaactacaagaaagagcaggaccttgatgccgccttgaagaggtacttccctgggggcatcgacatctacttcgagaacatcggtggcgcgacactagaggccgtgctgtccaacatgcgcaaccacgggcggatccccgcgtgcggcatgatctcgcagtacaatcttgagcagccggagggcgtgcgcaacctcttccagatcgtcgccaagcgcctgcgcatggaaggattcatcgtcatggactacttcagcgagtactacaagttcgaggaggagatggcagggtacctcaaggaggggaagatcacctacgtcgaggacattgctgaagggctggagagggcgccggcggcgctgatcgggctctactccgggcgcaacgtcggcaagcaactggtcgccgtcgctcgggagtgagtactggccatccatgtgacggtgaagacagagtgtgtgcattctgaataatgcctgaactttcagagttaggtgtgcaacgaactgatggcttgtggtgcttgtagtcacagactcacagctgcttacgtgaaaagtttcaggttttctgttgtcggtcagtctcatagattcgtttacttgtgggttttgtgtagaagatgaaacattggtttctgaaattgaaaattattcagatgcatggccaagtcattgtgaattgtacagaccctttttgtaggtgctgaataacctggacttaatctg

SEQ ID NO: 32458 - protein, 348 aa, Panicum virgatum
  misc_feature: Ceres CLONE 1910993
  misc_feature (158)..(305): Pfam Name: ADH_zinc_N Pfam Description: Zinc-binding dehydrogenase
  misc_feature: SWISSPROT Homolog: EC 1.6.5.5 NADPH:quinone reductase
  misc_feature: Useful for biocontainment applications
  misc_feature: Useful for making plants with modulated nitrogen use efficiency
MAAAAGEEVPNKRVVLKRYVTGFPSEDDMEVVTATARLAVPPGSTAMVVKNLYVSCDPYMRGRMTKHERPSYVPDFVLGEVLVNFGVSRVLASGHPDFKVGDLVWGMTGWEEYSLVPKPESFFKINHPELPLSYYTGVLGMPGLTAWAGFFDVGKPKKGDYVFVSAASGAVGQLVGQLAKLTGCYVVGSAGSDEKVNLLKTKFGFDEAFNYKKEQDLDAALKRYFPGGIDIYFENIGGATLEAVLSNMRNHGRIPACGMISQYNLEQPEGVRNLFQIVAKRLRMEGFIVMDYFSEYYKFEEEMAGYLKEGKITYVEDIAEGLERAPAALIGLYSGRNVGKQLVAVARE

SEQ ID NO: 32459 - DNA, 578 bp, Panicum virgatum
  misc_feature: Ceres CLONE 1911005
  misc_feature: Encodes the peptide sequence at SEQ ID NO. 32460
tgagcacgggactcgcgccgggtgggggagcgatttccgtggggattttctccgtttcttctggactcagctgctttgttcagttcatctgtgtctctcgctagtttcctgttcataccactgccacgccaatatgccaccgagtgctctgtctcttgggggcaccactctgtggagccctcctggaagctggaataaagaaaagatgaaataaaatgcatcttggtaaaaaaaaaaaaaaaaaaaactctagggggggcccggtacccaattcgacctatattgagtctcattaccccccctcactgcccatccttttacaacaacatgactggcaaaaccctgactttacccaacttaatcaccttgacccccttccccctttcgccacctggtgtaataacaaagatgcccgcacccatcgcccttcccaacacttgctcaccctgaatggataaagggacgcaccctgtaacagcgcattaatctcctcgggtgtggagttaactcccaccatgaccgctacactagacggcgccctatcccccgctcctttctctttcttcccttcctttctc

SEQ ID NO: 32460 - protein, 80 aa, Panicum virgatum
  misc_feature: Ceres CLONE 1911005
  misc_feature: SWISSPROT Homolog: EC 3.2.1.23 Beta-galactosidase
MHLGKKKKKKNSRGGPVPNSTYIESHYPPSLPILLQQHDWQNPDFTQLNHLDPLPPFATWCNNKDARTHRPSQHLLTLNG

SEQ ID NO: 32461 - DNA, 1267 bp, Panicum virgatum
  misc_feature: Ceres CLONE 1911024
  misc_feature: Encodes the peptide sequence at SEQ ID NO. 32462
acttctcctcccatcatcgcttcctttcccttccggcctgctgcccatgtcacgcgacggcgacgcccgcggcctcgaggcggaggcggcggccgcggccgaggcggcgcgggagctgagggaggcggccgccgccctcgtagccacgcgcgcagccgaagaggacgcgctgcgccgccgcgccgtcgcgctcgacgccgacgtccgccgcctccagggctcgctccccgccctcgacccatccgcggtcgacaagatcgaggaggaattggagcgtgccagggtagccatcacagatagtgatgtggcttcgtttctccccagcaagcgaaatgggaagttccttaagatgtttctaggccctgtgaatgtgcgggttgccaggaaggaagataagctcaaaatcaaggatgagtacaataattatagggataggactgcctataagtttctgctgtttccatctatcctcctcctcctaagatggtggatatgggatggatgccttccagcgtgggcagttcagatctaccaggcttggttactattcctgtacacaagctttgctttgcgggagaatgtattgattgcaaatggaagtgacattcgtccatggtggatatatcaccactatctagctatggtaatggctcttattagccttacatgggagataaagggacaacctgattgttctagcaagcagaggggggtgcaactcttcctgcgttgggcaatcatgcaagggattgcaatgcatctacagaacagataccagcgtcaaagattacgcactcgcatagctctaggaaaggcaaaaagaatggatgttgtcgctggagaaacagcaggtgtggaggggcagctcttgttgctatatcctgtcctttttatattacagggttttgaggcgtatgttggagttttgcttcttcagacagctttgcacgggcttgcctctgaatggcaggttgtagtttgcgggatcctgctggtggtaatggcagtgggaaactttgtcaacactgtggagacactgatattgaagttgaggttcaaagcaaagatgaagaaagccaagggcaggcaggaccgcccgcatcaaaattgacgaaagcagaatgctgacaccatctcttttgtaaatcctttgacccgtaaaacatttttggctgcttgtaattccctgttttggtatttggtcctgtaacactgaagttgataccctatagaaacacgaagaaagatacatatgtttactcttcag

SEQ ID NO: 32462 - protein, 354 aa, Panicum virgatum
  misc_feature: Ceres CLONE 1911024
  misc_feature (2)..(342): Pfam Name: TMPIT Pfam Description: TMPIT-like protein
MSRDGDARGLEAEAAAAAEAARELREAAAALVATRAAEEDALRRRAVALDADVRRLQGSLPALDPSAVDKIEEELERARVAITDSDVASFLPSKRNGKFLKMFLGPVNVRVARKEDKLKIKDEYNNYRDRTAYKFLLFPSILLLLRWWIWDGCLPAWAVQIYQAWLLFLYTSFALRENVLIANGSDIRPWWIYHHYLAMVMALISLTWEIKGQPDCSSKQRGVQLFLRWAIMQGIAMHLQNRYQRQRLRTRIALGKAKRMDVVAGETAGVEGQLLLLYPVLFILQGFEAYVGVLLLQTALHGLASEWQVVVCGILLVVMAVGNFVNTVETLILKLRFKAKMKKAKGRQDRPHQN

SEQ ID NO: 32463 - DNA, 658 bp, Panicum virgatum
  misc_feature: Ceres CLONE 1911029
  misc_feature: Encodes the peptide sequence at SEQ ID NO. 32464
aagcttgctgctaaatcctgccattagtggtaagcaattaagtagatcaagcagcgtcggtgcaggtcggagagcttggggaggaggggccggatggcggcggggtactggggcgtgggcgggcggccgtgcggggcgtgcgggggctcgccggcggcggtgcactgccggacgtgccccggcggcgcgtacctgtgcgcggggtgcgacgcggggcacgcgcgggcggggcacgagagggtctgggtctgcgaggtgtgcgagcgcgcgccggccgcggtcacgtgccgggccgacgcggcggcgctctgcgccgcgtgcgacgccgacatccacgacgccaacccgctggcgcgccgccacgagcgcgtgcccgtgcagcccatcggggcggccgcacctgccgtggacccgctgctattcagcgctgtagtagcagaagagaaggatgctgacgccgcgctcgccgggatgcttgctggtcgcgcggtcggcggcgcctatagtaaggtcgacgggaagctggacttcctgttcacggacgtcatggacccgttcctcggccagggcttcgctaggttcgtgcacgccgacagcgtcgtgcctagcaacggatcaatcggcggcgcgctcgaccttgacttcggtggcgccgccg

SEQ ID NO: 32464 - protein, 188 aa, Panicum virgatum
  misc_feature: Ceres CLONE 1911029
  misc_feature (48)..(95): Pfam Name: zf-B_box Pfam Description: B-box zinc finger
MAAGYWGVGGRPCGACGGSPAAVHCRTCPGGAYLCAGCDAGHARAGHERVWVCEVCERAPAAVTCRADAAALCAACDADIHDANPLARRHERVPVQPIGAAAPAVDPLLFSAVVAEEKDADAALAGMLAGRAVGGAYSKVDGKLDFLFTDVMDPFLGQGFARFVHADSVVPSNGSIGGALDLDFGGAA

SEQ ID NO: 32465 - DNA, 641 bp, Panicum virgatum
  misc_feature: Ceres CLONE 1911030
  misc_feature: Encodes the peptide sequence at SEQ ID NO. 32466
ctctctcccttccccacccacacaccctctccctcgcgcatgtctacggccctccccgcggactccgtccccgcccccagctcccgaggtctagttacgagacgcggtcggctccggatcgggtcggctcgtcgctctagggatggcttttcctgcgcgggaggctctgctcgtcgcgggggtgttggtgatgctggggctctccgcggcggaggcggtggaggaagggcgagggatcgtgtgcttcccccggatgttcatcttcggggactccctcagggactccggctggttcctgctctcggtgtcagatgacttccaggaccccgcgcggaacctcccgtacggcgtcatcttcttcgggcggccatcgggacgctacttcgactgcctcttcctgctccagttctttccggaagcatttgggattccatacgtgccgtggtaccttggcggtggggaattctaatatggtgcagactttgctgtctgcggggccactgccttctaaggttcgttcttatcgtaacgtggtgtggagtctacatggacgccacgctggcttgatgaggctatgcagtggttcgagaaccttctcgcatcgattgcgacatcatatacagaagagagtgatatgatgt

SEQ ID NO: 32466 - protein, 108 aa, Panicum virgatum
  misc_feature: Ceres CLONE 1911030
  misc_feature: SWISSPROT Homolog: EC 3.2.1.51 Alpha-L-fucosidase
MAFPAREALLVAGVLVMLGLSAAEAVEEGRGIVCFPRMFIFGDSLRDSGWFLLSVSDDFQDPARNLPYGVIFFGRPSGRYFDCLFLLQFFPEAFGIPYVPWYLGGGEF

SEQ ID NO: 32467 - DNA, 1549 bp, Panicum virgatum
  misc_feature: Ceres CLONE 1911043
  misc_feature: Encodes the peptide sequence at SEQ ID NO. 32468
ggcgccgcccgcacagccgaagctgcaggagccatggcgagtgttctccggcgcagccagcccctcctccgccgattcctctccgcccgttccccttcgtcctcatcctccgcgctggtatgctgcaatcaaaatatgtcatatacagttcagctacagagcttgtctgcagaagggagggaacaatcaaaagcagaagaacatgattatggcgacaaaattattaagcaaaatgactttgcgctagagcaagctcttgaccaaattaaatctgcatttggtgaggagtcaataatgtggttaaatcatgcttatggtcataaagaagttcctgtcatatcgacgggatcctttgccttggacacagctttaggaattggtagacttccaaagggaagggttgttgaaatttatggtccagaggcttcagggaaaacaactttagcacttcatgtcatagctgaagcacaaaagagtggaggaaactgtgcttttattgatgctgagcatgctctggatccagccttagcagaatctataggtgtgaaggcagaacacatgctgctatctcaacctgactgtggtgaacaggctcttggccttgctgacatcctaattcgaagcggctctattgatgttgtggttgtggacagtgtagcagcacttgtccccaaaactgagctggatggtgagatgggagatgcacacgttgcacttcaagcaaggctcatgagtcaagcacttcgcaagttgagccattcactctctcgctccaggacaatcctattatttattaatcaggtaagatcaaagctgagcacatttagtgggtttggagtaccagcagaagtaacttgtggaggaaatgccttgaaattttatgcttctgttcgcatgagcaccaaaaggataggtcttataaaaaagtgtgaagaggctattggtgcacaaattcaagtcaagattgtgaagaacaaacatgctcctccatttaagattgtgcagcttgagcttgtgtttggcaagggcttaagccgtgaatcagagctcattgagctaggttgcaagcacaagtttataacaaaatcaggagtgttctatcatatgaatgggcaaactttccaaggcaaagatggcatcaaacgttatcttgctgagaacagagatgtccaggaagatttgatgatgatgctaagagaaaagataatgcaaaatggatccaaactagatagacacgaggagggtgttaacctggataagaatgcatcagaggagattgccgcagccacagatgatgaggtaaatgatgagcttgaaacctgaagctatatccctgaagtgtaaatatgctgcttgtctggacgaaactttcgaactaaagttaactaggtgcgcaatcatagccctgtagagctatgcatgaatgttttatcttccatttgtatttagttgtaactgttttgctcttttgtctgccaaaacaagtacattagaccttatgaatgttttttcacgctggtcaagtaatctctatatggttactttttgc

SEQ ID NO: 32468 - protein, 429 aa, Panicum virgatum
  misc_feature: Ceres CLONE 1911043
  misc_feature (69)..(393): Pfam Name: RecA Pfam Description: recA bacterial DNA recombination protein
MASVLRRSQPLLRRFLSARSPSSSSSALVCCNQNMSYTVQLQSLSAEGREQSKAEEHDYGDKIIKQNDFALEQALDQIKSAFGEESIMWLNHAYGHKEVPVISTGSFALDTALGIGRLPKGRVVEIYGPEASGKTTLALHVIAEAQKSGGNCAFIDAEHALDPALAESIGVKAEHMLLSQPDCGEQALGLADILIRSGSIDVVVVDSVAALVPKTELDGEMGDAHVALQARLMSQALRKLSHSLSRSRTILLFINQVRSKLSTFSGFGVPAEVTCGGNALKFYASVRMSTKRIGLIKKCEEAIGAQIQVKIVKNKHAPPFKIVQLELVFGKGLSRESELIELGCKHKFITKSGVFYHMNGQTFQGKDGIKRYLAENRDVQEDLMMMLREKIMQNGSKLDRHEEGVNLDKNASEEIAAATDDEVNDELET

SEQ ID NO: 32469 - DNA, 700 bp, Panicum virgatum
  misc_feature: Ceres CLONE 1911047
  misc_feature: Encodes the peptide sequence at SEQ ID NO. 32470
ggacacgagacgcgacacacgctatcggcgcctggccgcctgctcggctgctccggcgcgccaccccgccgcccggagggggcctcctccaccttgccttcccgtctggcgacgcctccttcggatcccgacttcgccgccccctccgtgcaggtcgaagtggtggcgcccccggctgccctgccccctgcaggccggcgcccctgcttccgtgaggccgacgcccctatagccatgttcgcagctccttaaggctgaaggtactcagccatggtgtttcttgaggcggagatgtcatggaatgtgttgatctcacctagccagctggaccgcaagggcctcctgctccgtaaggctatcattgtgcgtcttctggaggatgttacgaataggagggcttccaaggagcatggctactacattgccgtcaatcagctgaaggcgatatctgaagggaaagtgcgtgagctaactggagatgttctgttcccagttacgttcacctgcataacgcagaagcctatgaagggtgaggtcatggttggatacgtggataggatcctcaagcatggtgtgtttctcaaatctggacccatcgagagcatcttcatggctgagaagtcaatgagcgactacaagtacattggtggggagaacccgatcttcatgaatgaacactcgaagctggagaaggtcgctg

SEQ ID NO: 32470 - protein, 143 aa, Panicum virgatum
  misc_feature: Ceres CLONE 1911047
  misc_feature (9)..(82): Pfam Name: RNA_pol_Rpb7_N Pfam Description: RNA polymerase Rpb7-like, N-terminal domain
  misc_feature: SWISSPROT Homolog: EC 2.7.7.6 DNA-directed RNA polymerase
MVFLEAEMSWNVLISPSQLDRKGLLLRKAIIVRLLEDVTNRRASKEHGYYIAVNQLKAISEGKVRELTGDVLFPVTFTCITQKPMKGEVMVGYVDRILKHGVFLKSGPIESIFMAEKSMSDYKYIGGENPIFMNEHSKLEKVA

SEQ ID NO: 32471 - DNA, 1097 bp, Panicum virgatum
  misc_feature: Ceres CLONE 1911068
  misc_feature: Encodes the peptide sequence at SEQ ID NO. 32472
gccgagagagagtccgagagcggccgcactagtcccagcccggaggacgccctcgtccccgccgcgcctccgacccccaagcaaccccgcgccgctcgatggcggcgccgtatcaccagccgacgagcctggaggaggtccgcacgctgtggatcggcgacctccagtactggaccgacgagaactacctctacggctgcttcgcccacaccggggaggtacaatctgtcaaaataatacgcaacaaactaacaagccttccagagggttatgggttcatagaattcatttctcatgaagctgctgagaaagttctgcagacttacaatggcacacaaatgcctggaactgaacacacgttcagaatgaactgggcctctttcagctctggtgagaagcgtcctgatgcaggacctgatcattcgattttcgtaggggacctggcaccagatgtcacagattacttactacaggagacattccgtgtgaactatccatctgtcagaggagctaaggttgtcacagatccaaatactgggagatctaaaggatatggatttgtaaagttcgctgatgaaaatgaaaagaaccgtgcaatgacagaaatgaatggtgtgtactgctcaacaagacctatgcggataagtgctgcgatacctaagaaatctgctggctctcagcttcagtattcagctactaaagcgatatatccagcaacagcctatgcagtgcctcagctccagacagctctacctgatagcgatcctacaaacacaacgatatttatcggtaacttagacccgaatgtgacagaagatgagctgaagcagatatgtattcagtttggggagcttatatatgtaaaaattccagtcggtaaagggtgtggatttgtacagtatgcagctagggcatcagctgaagaggcagtacaacgtcttcatggcacaatgattggccaacaagcagttaggctttcatggggccgaagtcctgcaagtaaacaggacccatcagctgtgtggagtcagcaagcagatccaaatcaatgggcaagcacttactatggctatgggtatgatgcatatgggtatgct

SEQ ID NO: 32472 - protein, 332 aa, Panicum virgatum
  misc_feature: Ceres CLONE 1911068
  misc_feature (228)..(293): Pfam Name: RRM_1 Pfam Description: RNA recognition motif. (a.k.a. RRM, RBD, or RNP domain)
  misc_feature (110)..(182): Pfam Name: RRM_1 Pfam Description: RNA recognition motif. (a.k.a. RRM, RBD, or RNP domain)
  misc_feature (17)..(88): Pfam Name: RRM_1 Pfam Description: RNA recognition motif. (a.k.a. RRM, RBD, or RNP domain)
  misc_feature: The sequence is a functional homolog of SEQ ID NO 1484 in the 10/666,642 US patent application
  misc_feature: The sequence is a functional homolog of SEQ ID NO 278 in the 10/714,887 US patent application
  misc_feature: The sequence is a functional homolog of SEQ ID NO 278 in the 11/435,388 US patent application
  misc_feature: The sequence is a functional homolog of SEQ ID NO 536 in the 10/666,642 US patent application
  misc_feature: Useful for making plants with altered terpenoid content
  misc_feature: The sequence is a functional homolog of SEQ ID NO 252 in the 10/714,887 US patent application
  misc_feature: The sequence is a functional homolog of SEQ ID NO 252 in the 11/435,388 US patent application
  misc_feature: The sequence is a functional homolog of SEQ ID NO 568 in the 10/666,642 US patent application
MAAPYHQPTSLEEVRTLWIGDLQYWTDENYLYGCFAHTGEVQSVKIIRNKLTSLPEGYGFIEFISHEAAEKVLQTYNGTQMPGTEHTFRMNWASFSSGEKRPDAGPDHSIFVGDLAPDVTDYLLQETFRVNYPSVRGAKVVTDPNTGRSKGYGFVKFADENEKNRAMTEMNGVYCSTRPMRISAAIPKKSAGSQLQYSATKAIYPATAYAVPQLQTALPDSDPTNTTIFIGNLDPNVTEDELKQICIQFGELIYVKIPVGKGCGFVQYAARASAEEAVQRLHGTMIGQQAVRLSWGRSPASKQDPSAVWSQQADPNQWASTYYGYGYDAYGY

SEQ ID NO: 32473 - DNA, 655 bp, Panicum virgatum
  misc_feature: Ceres CLONE 1911077
  misc_feature: Encodes the peptide sequence at SEQ ID NO. 32474
atcgagcaccctccaatcttcaaggcgtcgcagcaggcaaggcatcgatcgatcaatcaccagcagcgcgtgccgcgtagagagatcgagagagagagagagagagagagagagagagagagagagagagagagagagagagagaggagtctcaccggagaagggaggaatcgtcatcgccaccgccaccgccatgggcaaggtccgctccttcttctcccgcagcggcaagcgcggcgccggcccgtcctcgccgtcctcctccgcggcgggcagcgcgccgtcgtcgccgtccccgaggaagtcgtcggcgtcggcgccggtggccccggcggcggagaccaaggacgagatggagcgcgtgttccgcaagttcgacgcgaacggcgacgggcggatctcgcggtcggagctggcggcgctgttcgagggcgtgggccacgcggccacggacgacgaggtgtcgcgcatgatggaggaggccgacgcggacggcgacggcgccatcagcctgcccgagttcgccgcgctcgtgcgctccgccgacgccgacgccgacgccgtcgaggaggacctgcgccacgccttcatggtcttcgacgccgacggcaacggcctcatcacgcccgccgagctcgcgcgcgtcctgcgcggc

SEQ ID NO: 32474 - protein, 153 aa, Panicum virgatum
  misc_feature: Ceres CLONE 1911077
  misc_feature (53)..(81): Pfam Name: efhand Pfam Description: EF hand
  misc_feature (89)..(117): Pfam Name: efhand Pfam Description: EF hand
  misc_feature: SWISSPROT Homolog: EC 2.7.11.1 Non-specific serine/threonine protein kinase
MGKVRSFFSRSGKRGAGPSSPSSSAAGSAPSSPSPRKSSASAPVAPAAETKDEMERVFRKFDANGDGRISRSELAALFEGVGHAATDDEVSRMMEEADADGDGAISLPEFAALVRSADADADAVEEDLRHAFMVFDADGNGLITPAELARVLR

SEQ ID NO: 32475 - DNA, 370 bp, Panicum virgatum
  misc_feature: Ceres CLONE 1911089
  misc_feature: Encodes the peptide sequence at SEQ ID NO. 32476
acgacacacagatacagcgctctcgctcgcacttcctccgctcgtctgacatctcctcccgtcctttcctttcgaagcctcggggatcccggcgatggccaccgccgccaccctggtgtcggtcgacgacaagctcgaccagcttcgcgccgaggtcgccaagctcgaccagatcagcgagaacgagaagtccgggttcatcagcctcgtgtcgcgctacctcagtggggaggcggagcagatcgagtggagcaagatccagaccccgaccgatgaggtggtggtgccgtacgacaccctcgcgtcgcctccccaagatatctaggagacgaacatgctgctggacgaactcgctgtgttcgctcttact

SEQ ID NO: 32476 - protein, 76 aa, Panicum virgatum
  misc_feature: Ceres CLONE 1911089
  misc_feature: SWISSPROT Homolog: EC 2.7.7.9 UTP--glucose-1-phosphate uridylyltransferase
MATAATLVSVDDKLDQLRAEVAKLDQISENEKSGFISLVSRYLSGEAEQIEWSKIQTPTDEVVVPYDTLASPPQDI

SEQ ID NO: 32477 - DNA, 736 bp, Panicum virgatum
  misc_feature: Ceres CLONE 1911091
  misc_feature: Encodes the peptide sequence at SEQ ID NO. 32478
tacaccactctccaagtcccaaggcaacggtttccatttccacccaaggagctcacaccaacaatgtccatggccgtggcattggcggccatcttagccgtattcatcctcaggtacgtgctcgctacgagtagcaagaagaaggctctgaaccttccacctggcccgcggggttggccggtgatcggcagcctcgccgcgctggcgggcgcgctcccgccgcaccgcgcgctggccgcgctcgcggcgcgccacggcccgctcatgcacctccgtctcggctcctacgacgtcgcggtcgcctcgtcggcggacgccgcccggctcgtcctcaagacccacgacctcgcgttcgccgaccgcccgtccacggctgccggcgaggtcgcctcctacggctacctcggcatcctgcacaccccgtacggcgcctactggcgcatggcgcgcaagctctgcgccaccgagctcttctcgacacgtcgcgtcgactcgttcgagggcgtccgcgcgcaggagatgcgcacgctggtgcgcgggctgttccggtgcgccggccgcgccgtcgccgtcagggagcacgtcgcgggcgccacgctgcggaacatcctccgcatggccgtgggagagaagtggtccggctgctacggcagcgccgacggcgaggcgttccggcgcacgctggacgaggcgttcgcagtgaccggcgcggtgagcaacgtcggcgagtggatcc

SEQ ID NO: 32478 - protein, 224 aa, Panicum virgatum
  misc_feature: Ceres CLONE 1911091
  misc_feature: SWISSPROT Homolog: EC 1.14.13.21 Flavonoid 3'-monooxygenase
MSMAVALAAILAVFILRYVLATSSKKKALNLPPGPRGWPVIGSLAALAGALPPHRALAALAARHGPLMHLRLGSYDVAVASSADAARLVLKTHDLAFADRPSTAAGEVASYGYLGILHTPYGAYWRMARKLCATELFSTRRVDSFEGVRAQEMRTLVRGLFRCAGRAVAVREHVAGATLRNILRMAVGEKWSGCYGSADGEAFRRTLDEAFAVTGAVSNVGEWI

SEQ ID NO: 32479 - DNA, 584 bp, Panicum virgatum
  misc_feature: Ceres CLONE 1911094
  misc_feature: Encodes the peptide sequence at SEQ ID NO. 32480
attacggacacggaccccccccgcagcggccagcgctcccctcctttctctccctcctcacccaagaactgcaaccgcgcacggctcgccacgaggagccccgcgtacggggggcgacgccgcatccggacaggataggcaggcatgaggacgaggcggggcgcgtgctactcctgccacgcggcggcgggcgacggccctgaggcgcaccgccggaagaggcgccggacggcagcggccgaggggtcgccgccgccggcggccggcggctgcggcatgttcgaggagctgcctgacgatctcgtcgtgtcgatactgcgcgatgtcgcggcgtccgcaggctcgccggccgacctcgccggcgccatgctcacgtgcaagaggttcagggagctcgggcagagcaaggtggtgctagcgcgggcctcgccgcggtgcctcgccgtgcgcgccgaggcctggtcggacgacgcgcaccgcttcctgcagcgctgcgcggacgccggcaacctggaagcctgctaccttcttggcatgatccggttctactgcctggggagccgcgggcccggcgcggcgctgat

SEQ ID NO: 32480 - protein, 146 aa, Panicum virgatum
  misc_feature: Ceres CLONE 1911094
  misc_feature: Useful for making plants with altered lignin content
MRTRRGACYSCHAAAGDGPEAHRRKRRRTAAAEGSPPPAAGGCGMFEELPDDLVVSILRDVAASAGSPADLAGAMLTCKRFRELGQSKVVLARASPRCLAVRAEAWSDDAHRFLQRCADAGNLEACYLLGMIRFYCLGSRGPGAAL

SEQ ID NO: 32481 - DNA, 671 bp, Panicum virgatum
  misc_feature: Ceres CLONE 1911100
  misc_feature: Encodes the peptide sequence at SEQ ID NO. 32482
tgtccaagctgtaccgcggcgtccggcagcggcattgggggaagtgggtggcggagatccgcctgccgcgaaaccgcacccgcctctggctcggcaccttcgacaccgccgaggaggccgcgctcgcctacgacagcgccgcgttccgcctccgcggggactccgccaagctcaacttccccgagctcaggcgcggcggcgcgcacctcggcccgccgctccacgccgcggtcgacgccaagctccacgccatctgcaacggcacggacgtagcgccgcagaaccagagccagagccagagccagagccaaagccagagccagagccagagcaacgccactgcggcaaccgccgcaacgactccgagtacattctcctcggcgagcccggacatcaagatcgagccgggctgctccgggtccgagagctcgtcgtccgcggatggcgacgtgtcctcgaccgactcctccgacgtggttccggagatgcagctcctcgacttctcagaagcgccatgggacgaatccgagagcctccacctgcgcaagtacccctcgctggagatcgactgggaatccatcctttcataatgcaaaggctctgctcgtctcgtccccgcagttcctgatcaaactgttcttggttgctctgtacttcacagaatcacagct

SEQ ID NO: 32482 - protein, 195 aa, Panicum virgatum
  misc_feature: Ceres CLONE 1911100
  misc_feature (2)..(53): Pfam Name: AP2 Pfam Description: AP2 domain
  misc_feature: The sequence is a functional homolog of SEQ ID NO 1289 in the 10/374,780 US patent application
  misc_feature: The sequence is a functional homolog of SEQ ID NO 1435 in the 10/412,699 US patent application
  misc_feature: The sequence is a functional homolog of SEQ ID NO 1290 in the 10/374,780 US patent application
  misc_feature: The sequence is a functional homolog of SEQ ID NO 1436 in the 10/412,699 US patent application
  misc_feature: The sequence is a functional homolog of SEQ ID NO 116 in the 11/479,226 US patent application
  misc_feature: The sequence is a functional homolog of SEQ ID NO 1712 in the 10/412,699 US patent application
  misc_feature: The sequence is a functional homolog of SEQ ID NO 1948 in the 10/374,780 US patent application
  misc_feature: The sequence is a functional homolog of SEQ ID NO 256 in the 11/375,241 US patent application
  misc_feature: The sequence is a functional homolog of SEQ ID NO 6 in the 10/412,699 US patent application
  misc_feature: The sequence is a functional homolog of SEQ ID NO 722 in the 10/225,066 US patent application
  misc_feature: The sequence is a functional homolog of SEQ ID NO 906 in the 11/435,388 US patent application
  misc_feature: The sequence is a functional homolog of SEQ ID NO 198 in the 10/374,780 US patent application
  misc_feature: The sequence is a functional homolog of SEQ ID NO 52 in the 11/375,241 US patent application
  misc_feature: The sequence is a functional homolog of SEQ ID NO 642 in the 10/412,699 US patent application
  misc_feature: The sequence is a functional homolog of SEQ ID NO 860 in the 11/435,388 US patent application
  misc_feature: The sequence is a functional homolog of SEQ ID NO 996 in the 10/225,066 US patent application
  misc_feature: The sequence is a functional homolog of SEQ ID NO 212 in the 10/666,642 US patent application
  misc_feature: The sequence is a functional homolog of SEQ ID NO 2600 in the 10/374,780 US patent application
  misc_feature: The sequence is a functional homolog of SEQ ID NO 2706 in the 10/374,780 US patent application
  misc_feature: The sequence is a functional homolog of SEQ ID NO 294 in the 10/225,066 US patent application
  misc_feature: The sequence is a functional homolog of SEQ ID NO 352 in the 10/225,066 US patent application
SKLYRGVRQRHWGKWVAEIRLPRNRTRLWLGTFDTAEEAALAYDSAAFRLRGDSAKLNFPELRRGGAHLGPPLHAAVDAKLHAICNGTDVAPQNQSQSQSQSQSQSQSQSNATAATAATTPSTFSSASPDIKIEPGCSGSESSSSADGDVSSTDSSDVVPEMQLLDFSEAPWDESESLHLRKYPSLEIDWESILS

SEQ ID NO: 32483 - DNA, 1929 bp, Panicum virgatum
  misc_feature: Ceres CLONE 1911107
  misc_feature: Encodes the peptide sequence at SEQ ID NO. 32484
acgatggatgcgatgcgccttcttctctgcacttcccgtgcccggaatacctgtcctgcagacttgcagagagaacgaacaaagaaacaaacaaacaagcagcgagatcattccggctcgcggtttcaattcagacaaggaaaaggaaaccaaaaaggccggccgtcaccgacaagtcttccggcctgcgcactccacggctgccctgccagttgacgcgcactgcctattaagcgtaggctagccacttgctgccccgtcgccttgcacgcttgtgcagcagcatcggcagaggcgatggggccgtcgacggcggctgccgcgcgcgcgcgcttcgccttcctcctcctccccctcctcgttgtcttcctcctcgccgtcccgtggcccggcgcggcggcgcaggccgggtaccgcgtggtgtcggtgggcgaggcgggaggccagctgtccgcgcggctggagctcgccggcggcggcgagaaggccgagctcgggcccgacgtccggaggctcagcctaaccgccagccttgagacgagcagccggctccacgtccacatcaccgacgccgaccacccgcggtgggaggtcccccaggacgtaatcccccgcgaggcgccccggcagcacgtccagctcgacgcgagcacggggggcgacgcctcgccgcgcagccgcgtcctctcggcggcgacctccgacctcaccttcaccctccacgcctccccgttccgcttcaccgtgtcccgccgctccacgggggacgccctcttcgacaccgccccgggcctcgtcttcaaggaccggtacctcgagctcaccacggcgctccccgccggcagggcgtcgctctacggcctcggcgagcacaccaagcgcaccttccggctgcagcgcaatgacaccttcacgctctagaacgccgacatcgccgcctccaacgtcgacctcaacctctacggctcccacccgttctacctcgacgtgcgctcggcggcccccggcggcgccgccgccggggccggcgcggcgcacggggtgctcctgctcaacagcaacggcatggatgtcgagtacggcgggtcgttcctcacctacaaggtcatcggcggcgtgctcgacttctacttcttcgccggccccgccccgctcgacgtcgtcgaccagtacacccagctcatcggccgcccggcccccatgccgtactggtccttcgggtttcaccagtgcaggtacgggtacaacaacctggctgacctggagggcgtggtggccggctacgccaaggccaggatcccgctggaggtgatgtggacggacatcgactacatggacgccttcaaggacttcaccctggaccccgtcaacttcccggccggcccgatgcggcagttcgtcgaccgccttcaccggaacggccagaaatacgtcgtcatcctcgacccagggatcaacgtgaacgagacgtacgggacgttcgtccgcgggatgcagcaggacgtgttcctgaagcggaacggcaccaactacctcggcaaggtgtggccggggctcgtctacttcccggacttcctcaacccgcgcgtcgccgcgttctgggcgacggagatcgcactgttccggcggaccctccccgtcgacgggctctggatcgacatgaacgaggtctccaacttcgtggacccgccgccgctggacgcgctggacgacccgccgtaccgcatcaacaactccggcgtgcgccgccccatcaacaacaagaccgcaccggcgtccgccgtgcacttcggcggcgtccgcgagtacgacgcgcacaacctctacggcctcctcgaggcgcgcgccacgcacggcgcgctgctcgccgacaccggccgccgccccttcgtgctcagtcgctccaccttcgtcggctccggccgctac

SEQ ID NO: 32484 - protein, 287 aa, Panicum virgatum
  misc_feature: Ceres CLONE 1911107
  misc_feature (22)..(287): Pfam Name: Glyco_hydro_31 Pfam Description: Glycosyl hydrolases family 31
  misc_feature: SWISSPROT Homolog: EC 3.2.1.20 Alpha-glucosidase
MDVEYGGSFLTYKVIGGVLDFYFFAGPAPLDVVDQYTQLIGRPAPMPYWSFGFHQCRYGYNNLADLEGVVAGYAKARIPLEVMWTDIDYMDAFKDFTLDPVNFPAGPMRQFVDRLHRNGQKYVVILDPGINVNETYGTFVRGMQQDVFLKRNGTNYLGKVWPGLVYFPDFLNPRVAAFWATEIALFRRTLPVDGLWIDMNEVSNFVDPPPLDALDDPPYRINNSGVRRPINNKTAPASAVHFGGVREYDAHNLYGLLEARATHGALLADTGRRPFVLSRSTFVGSGR

SEQ ID NO: 32485 - DNA, 791 bp, Panicum virgatum
  misc_feature: Ceres CLONE 1911107-R
  misc_feature: Encodes the peptide sequence at SEQ ID NO. 32486
tctcctaccccaggtccccaaggacgtgaacacctacggggtggaccggcagttcctgctcggccgcggcgtgctcgtgtcgccggtgctcgagccgggcgccaccaccgtcggcgcctacttccccgccggccggtggttcagcctcttcgactactcgctcgccgccgcctcggcgaccggcagccgcgtgacgctcccggcagccgcggacacggtgaacgtgcacgtcgccggcggcaacatcctgccgctgcagcagccggcgatgaccacggcgcgcgcgcgccggagcgcgttccagctcctggtcgcgctcggcgaggacggatccgccgccggggagctgttcctggacgacggcgagtcgccggagatggccgggccgcggggccagtggaccctggtacggttcacctgcaagacggggcgcggcggcgccacggtgaggtcgcatgtcgtgcacgactcgtacgggccgagccggaagctggtcatcggcaaggtggtgttcctgggcctgcgttcgccggcgccgccgagggggttcgccgtgtacgtcaacggcgtcaaggcggccaactcgaccggccgcgcccaggggtaccggggcagcgggacgctcggcgccgctcacgcggagggactgtcgctggccatcggcaaggagttcgagctcaaggtcgtcatgtcgtaacatgggattgaagctctgaattctgaaatggtgcgtatgctttgaataaaaattgatcatcagaagattaaacttgaaataaatggcatctcag

SEQ ID NO: 32486 - protein, 231 aa, Panicum virgatum
  misc_feature: Ceres CLONE 1911107-R
  misc_feature: SWISSPROT Homolog: EC 3.2.1.20 Alpha-glucosidase
LLPQVPKDVNTYGVDRQFLLGRGVLVSPVLEPGATTVGAYFPAGRWFSLFDYSLAAASATGSRVTLPAAADTVNVHVAGGNILPLQQPAMTTARARRSAFQLLVALGEDGSAAGELFLDDGESPEMAGPRGQWTLVRFTCKTGRGGATVRSHVVHDSYGPSRKLVIGKVVFLGLRSPAPPRGFAVYVNGVKAANSTGRAQGYRGSGTLGAAHAEGLSLAIGKEFELKVVMS

SEQ ID NO: 32487 - DNA, 749 bp, Panicum virgatum
  misc_feature: Ceres CLONE 1911146
  misc_feature: Encodes the peptide sequence at SEQ ID NO. 32488
atcgatcgacgagcaccgccgcttgccagccggaggttcaattcggccgagcaacatgacgcaggaatctgaccaaggcgccgcgcactcgtcgcggcccggcggcggcgacgtcgccgacgacgctcccgcgccgcccgtgtcggccaccaaggcgggcgccatgacgctcggcagcatcttcaccgtggcgagcatcctcctgctcttcgtcgtcttcgccttcgtcctcgtctcgctccagtactgcttcaacgcctgggacagaggggagctgcgccaggaagacacgccgagcgctcggcggcggcggcggcgccgtggcggcagtggtcgtgggatccggacccggaccaggggcggcggcgtcgacccggagctgctgcgctcgctgccggtcacggtgtaccgcgcggcggcgcccgattccaagggcgcggtggagtgcgccgtgtgcctcgcggagctcgaggacggcgaggcggcgcggttcctgccccgctgcagccacggcttccacgccgagtgcgtcgacgcgtggctcgcgtcccacaccacctgcccgctctgccgcctcaccgtcgccaggcccgacgcgccgccgtgctcggcgcttctccctccggctccgccggagcccgcgagctacgccgcctcgtccctgcccgccagcgtgctcctcggggtgcccgaaccacagggcgcggtcaccatggccgccgacgggggcgcgggcgcttccaccggcg

SEQ ID NO: 32488 - protein, 231 aa, Panicum virgatum
  misc_feature: Ceres CLONE 1911146
  misc_feature (131)..(172): Pfam Name: zf-C3HC4 Pfam Description: Zinc finger, C3HC4 type (RING finger)
  misc_feature: SWISSPROT Homolog: EC 6.3.2.19 Ubiquitin--protein ligase
MTQESDQGAAHSSRPGGGDVADDAPAPPVSATKAGAMTLGSIFTVASILLLFVVFAFVLVSLQYCFNAWDRGELRQEDTPSARRRRRRRGGSGRGIRTRTRGGGVDPELLRSLPVTVYRAAAPDSKGAVECAVCLAELEDGEAARFLPRCSHGFHAECVDAWLASHTTCPLCRLTVARPDAPPCSALLPPAPPEPASYAASSLPASVLLGVPEPQGAVTMAADGGAGASTG

SEQ ID NO: 32489 - DNA, 723 bp, Panicum virgatum
  misc_feature: Ceres CLONE 1911148
  misc_feature: Encodes the peptide sequence at SEQ ID NO. 32490
atcgagtcgataagatcgagctcggggaggttggggcgcaggaaaaaaaaatcatctccaatctccaaccaaactaaccctagcagcagccggcggttagggtttcgagcgagatggcggcggcggcgaggcagcgcgggacggtgaagtggttcaacgacaccaagggcttcggcttcatctcccccgaggacggcagcgaggacctcttcgtccaccagtcgtccatcaagtcggagggcttccgctccctcgtcgagggcgaggaggtcgagttctccgtctcggagggcgacgacggccgcaccaaggccgtcgacgtcaccggccccgacggatccttcgtcaagggcggctccggcggcggcgggggcgggggcggcttcggatctcgcggcggggccggatctggcggcggcggccgcagctacggcggcagctggggcggcgggaggagatccggccccggcggcggtggcggcggcggcggcgcgtgctacaagtgcggggagcccggccacatggccagggactgccccaccgccgacggaggcggcggatacggcgggggaggctacggtggcggcggcggcggcggcggcggctgctttaagtgcggggagcctggccacatggccagggactgctccagcggcggaggaggctatggaggtggcggctccggcggcggcggctgccgccgcttcggaggtgggcgccgcg

SEQ ID NO: 32490 - protein, 203 aa, Panicum virgatum
  misc_feature: Ceres CLONE 1911148
  misc_feature (6)..(73): Pfam Name: CSD Pfam Description: 'Cold-shock' DNA-binding domain
  misc_feature (126)..(143): Pfam Name: zf-CCHC Pfam Description: Zinc knuckle
  misc_feature (163)..(180): Pfam Name: zf-CCHC Pfam Description: Zinc knuckle
  misc_feature: The sequence is a functional homolog of SEQ ID NO 110 in the 10/225,066 US patent application
  misc_feature: The sequence is a functional homolog of SEQ ID NO 128 in the 10/666,642 US patent application
  misc_feature: The sequence is a functional homolog of SEQ ID NO 136 in the 10/374,780 US patent application
  misc_feature: The sequence is a functional homolog of SEQ ID NO 44 in the 11/375,241 US patent application
  misc_feature: The sequence is a functional homolog of SEQ ID NO 850 in the 11/435,388 US patent application
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
  misc_feature: The sequence is a functional homolog of SEQ ID NO 468 in the 11/479,226 US patent application
MAAAARQRGTVKWFNDTKGFGFISPEDGSEDLFVHQSSIKSEGFRSLVEGEEVEFSVSEGDDGRTKAVDVTGPDGSFVKGGSGGGGGGGGFGSRGGAGSGGGGRSYGGSWGGGRRSGPGGGGGGGGACYKCGEPGHMARDCPTADGGGGYGGGGYGGGGGGGGGCFKCGEPGHMARDCSSGGGGYGGGGSGGGGCRRFGGGRR

SEQ ID NO: 32491 - DNA, 1155 bp, Panicum virgatum
  misc_feature: Ceres CLONE 1911150
  misc_feature: Encodes the peptide sequence at SEQ ID NO. 32492
agtcaaatccccagctccacttctccagatccgcccaagaacagagacgccttcccggcctagcatcccaccaaccacagcgaaacagaaggggagggaactagaactcctgttcactctctgtttaaagcacgaggccaccatacgtgctctacacgcttctcaggtctctctcaagtctcaactcctgtcgctcgatcgacgagctgtccgtggcgggcggagagcgcgagccgccaccgtacagtccgggagaaggaggcggagggagaggagggaggagagcccgggcgagatggcagcggcctggctgggcgtgaaggcggcgccgttcgcgtacgcggcgcacgcgctggcggcggcggcggcggtgctggtgctggtgtggtgcgtccacttccgcggcggcctcgcgctcgaggcccagaacaagaacctcgtcttcaacgttcaccctgtgctgatgctaattggctacattatcctcggcagtgaagccattatgatctacaaggtgttcccaaaactgaaccacgacaccgccaagctgacgcacctgatcctccatgcgattgccactgttcttggcgccttcgggatctactgcgcgttcaagtaccacaacgacagcgggatcgcaaacctctacagccttcactcctggctcgggatcggaaccatctccctctacggcattcagtgggttttcggattcgtgaccttcttcttccccggcgcggcgccgagcgtgaggcgcagtgcgctgccgtggcacgcgctgctcgggctcttcgtctacgtgctggcgctggtgaccgcggagctcgggttcctggagaagctcaccttcctggagagcgggggggtcgacaagtacggcgccgaggcgttcctggtgaacttcacggcgctcgtcgtcgtgctgttcggcgcctcagtcgtcgtcgccgccgtcacgccggcgcacgttgaggcaccgcagggctacgagtcgattccggtcaactagagaggcgttactgaagggaaagattcagaagagtgccgctgtgttcagtttgaaccatgacatcaggcgtctggcttaagtctggaaaacatccggatttatgtgtaaatctggagtacttgataattggaagcgcatcttttttc

SEQ ID NO: 32492 - protein, 237 aa, Panicum virgatum
  misc_feature: Ceres CLONE 1911150
  misc_feature (14)..(232): Pfam Name: Cytochrom_B561 Pfam Description: Cytochrome b561
MAAAWLGVKAAPFAYAAHALAAAAAVLVLVWCVHFRGGLALEAQNKNLVFNVHPVLMLIGYIILGSEAIMIYKVFPKLNHDTAKLTHLILHAIATVLGAFGIYCAFKYHNDSGIANLYSLHSWLGIGTISLYGIQWVFGFVTFFFPGAAPSVRRSALPWHALLGLFVYVLALVTAELGFLEKLTFLESGGVDKYGAEAFLVNFTALVVVLFGASVVVAAVTPAHVEAPQGYESIPVN

SEQ ID NO: 32493 - DNA, 648 bp, Panicum virgatum
  misc_feature: Ceres CLONE 1911187
  misc_feature: Encodes the peptide sequence at SEQ ID NO. 32494
actatgtgtttgactggacaatattgaagtaccaacaatctcaaattgccaccgctccaccccgtgcgggtcatgttgcaggaccttctggattagcacctgcattacagaatgacaggcaatcaggccatgaggaagcaaggactagtggttggtcatcaatagatcgacgtcgtaccccacctcccatcacaagcgtggggacactatctaagcagaaagcgcctgtggggaatgatgttacttcttctaatggtgctgtgatatcggcatcgggaataaactttttgggaaggtctagtggatcttcaaggagacctgttgtttcgagtagccgtgatgtggtggccactgatagttctgagccttctcgagcacgtacaactgatgcaagccctggggtgctccgcagagcatcaggtcctcagagaagctcacctgtccattctgcagaacaaaagcgctcatcatcaggccggcatccatctaatgtgaagaactatgattctgccctcaaaggcattgaaggtcttaactttgatggtgacgagagggttcagtactagagctgcaagaaattctacatccactctgtaaaaatcataatcaggtggttagcattgagtttcctgttgagttttggatcaa

SEQ ID NO: 32494 - protein, 187 aa, Panicum virgatum
  misc_feature: Ceres CLONE 1911187
  misc_feature: SWISSPROT Homolog: EC 2.7.11.1 Non-specific serine/threonine protein kinase
YVFDWTILKYQQSQIATAPPRAGHVAGPSGLAPALQNDRQSGHEEARTSGWSSIDRRRTPPPITSVGTLSKQKAPVGNDVTSSNGAVISASGINFLGRSSGSSRRPVVSSSRDVVATDSSEPSRARTTDASPGVLRRASGPQRSSPVHSAEQKRSSSGRHPSNVKNYDSALKGIEGLNFDGDERVQY

SEQ ID NO: 32495 - DNA, 1104 bp, Panicum virgatum
  misc_feature: Ceres CLONE 1911192
  misc_feature: Encodes the peptide sequence at SEQ ID NO. 32496
accaccccgactgccaactgccgacgcaagcgccggcgccgccgagacccctccgcgccgactcgcctccgccgaccgcccctggatttgttgatcaaagaaccatggaagggtcgttccagttgaacccaaatgccagtcctttcatacctggatccctgagttcattcgcagacaaggccccagaaaaccaagcagagtcatcgtcaaagggtgactcttctggtgacacttttgatccttctgagtttgaggaaaatgacatggatccacttgctctagccaaaatggtcgtttcaatgttcccaaatgtctccacagatttcattgatgagttactcaaatcaactgattttgacataaatctgactattgatatgctgaatgagttgagctcacaagatatgcttcatgatgatgctgaagatatcaatgatctgcatgatgaccagggcctatctggtgagagttaccactgtgttgaaatgtctgagagtagcagcaatctcaatcaaggtctgcagaatgagaagtcagcaacaacttctgatgtgaaatctgtcctgccaaagttctcaaatatcaatttgcttgacaatgacctgggcgtgcctgatgataagtcagcgggggcttcagctgcaaagtgatagtcaagatgctctgtttgatctgaattactgcattctgatgtacatattagttgcacccagaagtgtggcttggaggacaaagcagtggaagcaatgattccatttccgttcgcagagctagcttgctgtttctggtcgccattctgagtttcgaatcccttgttcagctcgtttggacctagtagctagatatttctggtggttatcctgcgttttacaccccttggttcgctcatcaagaccgagtaatacctggtggtcgtcctgatttttacatcccttggttgaatggttggtacttaagtcagttcgaaccctgcaagttatgctgcggcagctcttttgcgtgtgatgttctgggagtgttatccatactgcttgtggtgctgtttactggattaccagtcatatatgaatactagctttatcagatcatgtcacctttcagtcg

SEQ ID NO: 32496 - protein, 181 aa, Panicum virgatum
  misc_feature: Ceres CLONE 1911192
  misc_feature (2)..(19): Pfam Name: PAM2 Pfam Description: Ataxin-2 C-terminal region
MEGSFQLNPNASPFIPGSLSSFADKAPENQAESSSKGDSSGDTFDPSEFEENDMDPLALAKMVVSMFPNVSTDFIDELLKSTDFDINLTIDMLNELSSQDMLHDDAEDINDLHDDQGLSGESYHCVEMSESSSNLNQGLQNEKSATTSDVKSVLPKFSNINLLDNDLGVPDDKSAGASAAK

SEQ ID NO: 32497 - DNA, 636 bp, Panicum virgatum
  misc_feature: Ceres CLONE 1911243
  misc_feature: Encodes the peptide sequence at SEQ ID NO. 32498
aaaatccccccaatcatcctctccacccagatttcgtctcctcaggggcggatccaacgtgggaccccgaacccgacggtcgccgccgcctgctcgccgtccggccgtcggccgccgctcgcctcccctcccctcccctccccaggcctgcgcctcccggctcccgccgtccgtcgagccgccaacgccacctcgggagcggtcgcgctggccagcggcaccgcctctcctcctaccgcctgctctcccctcctctccgaccagatccacctattctaactcggaggaactgctacgccgccactgggcggccggccactcctggttggagaccggcaaaatggttcaaatatggtactcttgtcataatgaatgagaatgtctattcgaggtttgaggtttatcactctagttttgttgatgatgatagcatcaccaaagcttgtggctgtcctttgcttccactaaaaactcatataaagggtccagcccccacctctgagccagataaagcggacatagttgatgaagccataaccttctttcgagcaaatgttttcttcaaaaacttccatgtgaaaagcccagcagacaagttactgatctatctgacattttacatcaatattgccctga

SEQ ID NO: 32498 - protein, 89 aa, Panicum virgatum
  misc_feature: Ceres CLONE 1911243
  misc_feature (12)..(89): Pfam Name: P21-Arc Pfam Description: P21-ARC (ARP2/3 complex 21 kDa subunit)
MNENVYSRFEVYHSSFVDDDSITKACGCPLLPLKTHIKGPAPTSEPDKADIVDEAITFFRANVFFKNFHVKSPADKLLIYLTFYINIAL

SEQ ID NO: 32499 - DNA, 1173 bp, Panicum virgatum
  misc_feature: Ceres CLONE 1911262
  misc_feature: Encodes the peptide sequence at SEQ ID NO. 32500
aatcctcgccttctctccgcgccgcgacgctaccccgccccatccgccaggccgtcgccgccagcagtctccccaccctcgatccgctccgccgtcgcgcttccggaggaggcagataggagaaggtgatcggctgcgatggcccgcttgtacgtcgggaacctggatcctcgggtgacggcacgggagctcgaggacgagttccgcacctttggagttcttcggagtgtttgggttgctcggaaaccacctggctttgcatttattgattttgatgacaagagggatgctgaggatgcaatccgtgatcttgatggcaagaatggatggagagttgagctatcacgtagtgccagcagtggtcgtggtggtcgtgatcggtatggtgggtctgagtctaagtgctacgagtgcggtgagactgggcactttgctcgtgagtgtcgtttgaggattggttctggaggtctaggcagtggaaggcgccgaagcaggagccgcagccgcagccgcagccgcagtcgcagccccagataccgacggagtccaagttatggaagaagaagctacagtcctgcagcacgctctccaaggcgtcgtagcgtgtcaccagccccagctcgtggacgcagctatagcaggtcaccacaccgtgcacgggagacgtctcctaacggataccgccgcagcaggagctagagccagatatttgtctgtgacagatattgctctttggcccatcatctatgatcaataacctactttaaagatccatcgcagactgcttgacttttggttaaggttctcataacttttatctatcttattatgcctgtgtttactttataatcagtagtaaaacatattggtgggtgtatctattgaactaagaccagctgtcttttcttgtgtggtataaaggcatcgtcctgcactgcttaaacgactcggccgactacggctcagtaatgtcttcatggttttgttctgcgctcttcattcttcgcacaccctcgcatgcttcattcagacgaatgctgcatgttatctgcctacagcacctcttcgtgatccatttgcctcgttgaagatgctgcgcatcgcacagcagtaatgatcttccttctcataccatttggtaaggtttgattgtgctgacaaatgcagcatctg

SEQ ID NO: 32500 - protein, 186 aa, Panicum virgatum
  misc_feature: Ceres CLONE 1911262
  misc_feature (4)..(70): Pfam Name: RRM_1 Pfam Description: RNA recognition motif. (a.k.a. RRM, RBD, or RNP domain)
  misc_feature (87)..(104): Pfam Name: zf-CCHC Pfam Description: Zinc knuckle
  misc_feature: SWISSPROT Homolog: EC 5.2.1.8 Peptidylprolyl isomerase
  misc_feature: Useful for making plants with modulated flowering time
MARLYVGNLDPRVTARELEDEFRTFGVLRSVWVARKPPGFAFIDFDDKRDAEDAIRDLDGKNGWRVELSRSASSGRGGRDRYGGSESKCYECGETGHFARECRLRIGSGGLGSGRRRSRSRSRSRSRSRSPRYRRSPSYGRRSYSPAARSPRRRSVSPAPARGRSYSRSPHRARETSPNGYRRSRS

SEQ ID NO: 32501 - DNA, 531 bp, Panicum virgatum
  misc_feature: Ceres CLONE 1911262-R
ctcacctgggcatcacttgtttcagagaacccaggtaagtgagtgccagaaagttaactgaccaggccgagtgctacattgagtcgatttctggctttgctccacgtttgccacttgccaccacacgttgcctgccttcaacagaggaagactgttgcattcagcaaaagaagtcttcctcgccttctgcctccgtcactgcaccctgattgacattcttcatagatgccttctacgagcgccttctgattgatgttcttcattagagcccgcggtgaagctgaatcctacgcccatcatatgctgtcattttgtggttatttttgcagataatatattatctttagcttctaatcctgttggataggttaaatgttgggacttaagatggtagaatatcggatgctattggatatctatacaaatggtagatacattctggtaaccatcagtttgacagtttgataactgtctgcgccctgaattcggaccgcccggctcatggttgctatctgcgcttccatgtttctt

SEQ ID NO: 32502 - DNA, 702 bp, Panicum virgatum
  misc_feature: Ceres CLONE 1911263
  misc_feature: Encodes the peptide sequence at SEQ ID NO. 32503
acacagacaaagcaacaagctaacaaaacccttctttctagtgccaacccagtctcgaaacgttcttcgagcttagcaagacgatcttacagttccattcgatccacaagtctagcttatagcttttggcccagcgagttcgcgatggcttctcgtcaggagcaggctagctaccacgccggcgagaccaaggcccgtgccgaggagaaggcggggcaggcgatgggcgcggcgcaggagaaagggcgggaggccaagtccaaggcttccggcgccgcggaggccaccagggccaaggcgcgcgaggccgcggaccgcaccatgggtgtgggccgcgacgccacggaggccaccagggacaaggcctaccaggccaaggacgcggcctccgacgccgcgggccgcgccgcggacaagggccgcggcgccgcggaggccgccagggacaaggcctgcgaggccaaggacaaggcgtccggcggcgcgcagcaggccgggggctacatctcgcagacggccgaggccgccaagcagaaggcggccggcgccgcgcagtacgccgtggtggccggcaaggacaagaccggcgccctcctgcagcaggcaggggagacggtgatgaacacggcggcggggggcaaggacaaggtggtgagcaccgccgtcggggccaaggacgccgtgatgaactcgctcgggatg

SEQ ID NO: 32503 - protein, 185 aa, Panicum virgatum
  misc_feature: Ceres CLONE 1911263
  misc_feature (45)..(88): Pfam Name: LEA_4 Pfam Description: Late embryogenesis abundant protein
  misc_feature: Useful for making plants with modulated water use efficiency
MASRQEQASYHAGETKARAEEKAGQAMGAAQEKGREAKSKASGAAEATRAKAREAADRTMGVGRDATEATRDKAYQAKDAASDAAGRAADKGRGAAEAARDKACEAKDKASGGAQQAGGYISQTAEAAKQKAAGAAQYAVVAGKDKTGALLQQAGETVMNTAAGGKDKVVSTAVGAKDAVMNSLG

SEQ ID NO: 32504 - DNA, 481 bp, Panicum virgatum
  misc_feature: Ceres CLONE 1911272
  misc_feature: Encodes the peptide sequence at SEQ ID NO. 32505
atgacccccgcctccacctccacctccgcccccgtcaccactgacgccccgccggtgcctgtcaccatcgaccgcccccgccgcgaagctctccgcatcgccgcgcagacaccctcccgaatcgccgccatggcacccgccgcaccggcaagctccgtcaaggaagtgctcccgtctcccctgacctacgactccgaccccccgcccctcttcgacggcccgatcaggttgtatgtggcgaaccactgcccatactcgcgtcgcgcttggattgacaagaactacgagggtttcccggacaagatcaggatagctgcaatcgatcttgctgactggccggcatggtaccaggagaaggttcctccagagaacgacgtgcctcccctagagcacaacatccaggcgaaaggagagagcctggatttggttaagtacattgatagcaatatcaaaggcccgtcattgcttcctgatgatcctg

SEQ ID NO: 32505 - protein, 117 aa, Panicum virgatum
  misc_feature: Ceres CLONE 1911272
  misc_feature: SWISSPROT Homolog: EC 2.5.1.18 Glutathione transferase
MAPAAPASSVKEVLPSPLTYDSDPPPLFDGPIRLYVANHCPYSRRAWIDKNYEGFPDKIRIAAIDLADWPAWYQEKVPPENDVPPLEHNIQAKGESLDLVKYIDSNIKGPSLLPDDP

SEQ ID NO: 32506 - DNA, 635 bp, Panicum virgatum
  misc_feature: Ceres CLONE 1911315
  misc_feature: Encodes the peptide sequence at SEQ ID NO. 32507
ccaagtccccaacaagcatgatgcagcagcctcaggggcaggcggcggcgctcgcggtggcgccgtcggcgtcggcggtggcccacccgaacgatccggcaggtggagacgcgccgccgaagcaggtggcgcaggcgatggagcgtctgggcggtgcggggcggctcatcgcggaaatccggctaggcgccgaccgcctcctcgaggccctgttcgtcgccagcggcgcgcccccgtatagcacgccccagcacatcgacaggacatcgcgcgctatcgtccaggaggaggccgccatgcgccgccacttccaggacctccgcgccctcggcaggcaattagaggagtctggagttcttaatggggcccttaaagctcgaggaaattcatggggcttgcacatgccccttgtttgtccagatggtgctgttgtagcttatgcttggaagcgtcaactggcaggtcaggctggtgcatctgctgtggacagaactaggttagctttaaaggccttcactgaccagaaaagaagattctttcctcatctagaagatgaagtccttagccatctccatgatggtgagcctggtgtcaccaaaaagccaaggttgtctgccagtaatggagagcttgaa

SEQ ID NO: 32507 - protein, 205 aa, Panicum virgatum
  misc_feature: Ceres CLONE 1911315
  misc_feature: Useful for making plants with modulated oxidative stress sensitivity
MMQQPQGQAAALAVAPSASAVAHPNDPAGGDAPPKQVAQAMERLGGAGRLIAEIRLGADRLLEALFVASGAPPYSTPQHIDRTSRAIVQEEAAMRRHFQDLRALGRQLEESGVLNGALKARGNSWGLHMPLVCPDGAVVAYAWKRQLAGQAGASAVDRTRLALKAFTDQKRRFFPHLEDEVLSHLHDGEPGVTKKPRLSASNGEL

SEQ ID NO: 32508 - DNA, 729 bp, Panicum virgatum
  misc_feature: Ceres CLONE 1911331
  misc_feature: Encodes the peptide sequence at SEQ ID NO. 32509
ctctccgccccccttctccggcagctcaggacagcgcggcacaatcccggcggcggcaaacgccgcgaggacccaacgcggcgcaggcgcaggcgcaggcgccatggctgtgccggaggcgccctcatgctacgtagggatcgcgcggcagtccgccgccttccgcctcatgaaacaaatgggatgggaagaaggtgagggccttggcaaagacaaacagggcattaaaggtcatgttagggtgaaaaacaagcaggatactctaggtgttggtgtagataatcctcgtgacaaatgggtatatgataccacccaatttgacaacatactgaagaaattgaaagtctcagctaagcctattcaagaagaagttgcagctgtaagtgattcgcctgacagcacacccaagaaagacaaaccagcaaatgttgaagttactaaagttactcgacctcaaggaagatacaagaaaagagagggggggaaaagagtgagctcttattcagcaatcgatcttcaaggcatacttgtacgcaaaagcgaagataattgccaagtggatcagaaacctgaacccatatgcttggatgaacctgatcctatcatttgccctgatgcagtatcccaagctgaagatgtgaactggtgggggcacaagtttggatttgtatcaggagggtttctaggagcaacatctcgtaaaagaaaatcttcacgaaaaagttcttg

SEQ ID NO: 32509 - protein, 208 aa, Panicum virgatum
  misc_feature: Ceres CLONE 1911331
  misc_feature (15)..(59): Pfam Name: G-patch Pfam Description: G-patch domain
MAVPEAPSCYVGIARQSAAFRLMKQMGWEEGEGLGKDKQGIKGHVRVKNKQDTLGVGVDNPRDKWVYDTTQFDNILKKLKVSAKPIQEEVAAVSDSPDSTPKKDKPANVEVTKVTRPQGRYKKREGGKRVSSYSAIDLQGILVRKSEDNCQVDQKPEPICLDEPDPIICPDAVSQAEDVNWWGHKFGFVSGGFLGATSRKRKSSRKSS

SEQ ID NO: 32510 - DNA, 1358 bp, Panicum virgatum
  misc_feature: Ceres CLONE 1911333
  misc_feature: Encodes the peptide sequence at SEQ ID NO. 32511
gcacgattgattgaatcttctccctccccatttgccagccacccactagtatctcttctcccgatccaagaagaaacctgccgccggagcgaatcccaagaaacgatcttgatctcgatccgcgaggaagctagtcggccacccagccagagccagagcagcggcgcgatccaggagagccagccagccgccatgaacaacctgttctcgagctcgtggaagcgcggcggcggcggcggtggggacggggacatcgagtccggcggcgtggagctgtccgcgccgccgggtgccgcggcgggggcgagcctggacaagttcttcgaggacgtggagtccatcaaggacgagctccgcgacctggagcgaatccagcgctccctccacgacgccaacgagggcggcaagtcgctgcacgacgcggcggccgtgcgcgagctccggtcccggatggacgccgacgtcgccgcggcgatcaagaaggccaaggtgttgaagctccggctcgagtccctggaccgcgccaacgccgcgaaccggtcggtgcccgggtgcggcccggggtcctccaccgaccgcacccggacgtccgtggtggccgggctccgcaagaagctccgggactcgatggaggccttctcctccctccggtcccgcatcgcgtccgagtaccgcgacacggtggcgcggcggtacttcacggtgacggggtcgcagccggacgaggcgaccctggacgcgctggcggagtccggagagggcgagcggttcctgcagcgcgcgatcgcggagcaggggcgcggggaggtgctgggcgtggtggcggagatccaggagcgacacggcgcggtggcggagctggagcgcagcctgcgggagctgctgcaggtgttcaacgacatggcggtgctggtggaggcgcagggggagcagctggacgacatcgagggcaacgtggggcgcgcccgctccttcgtcgaccgcggccgggagcagctgcaggtggcgcggaagcaccagaggagcacgcgcaagtggacgtgcatcggcatcctcatcctcctcgtcatcatcctcgtcatcgtcctccccatcgtgctcaagaccgtcaacaacaacaagagcaactagcagcagcctggccatcgttgttcatggcgatccggcggtgctcttgtggatacaatacaccgggagagattgttatttcttgtttccaattcgttatagttgtttgttcgtggcgtttgtatctatatggctagctgatccgatcgagctgactacatatatcggtgattttgtttatgatgatgacatttgggttggaatctcgagccgggtcatttctctgttag

SEQ ID NO: 32511 - protein, 312 aa, Panicum virgatum
  misc_feature: Ceres CLONE 1911333
  misc_feature (39)..(146): Pfam Name: Syntaxin Pfam Description: Syntaxin
  misc_feature (215)..(277): Pfam Name: SNARE Pfam Description: SNARE domain
MNNLFSSSWKRGGGGGGDGDIESGGVELSAPPGAAAGASLDKFFEDVESIKDELRDLERIQRSLHDANEGGKSLHDAAAVRELRSRMDADVAAAIKKAKVLKLRLESLDRANAANRSVPGCGPGSSTDRTRTSVVAGLRKKLRDSMEAFSSLRSRIASEYRDTVARRYFTVTGSQPDEATLDALAESGEGERFLQRAIAEQGRGEVLGVVAEIQERHGAVAELERSLRELLQVFNDMAVLVEAQGEQLDDIEGNVGRARSFVDRGREQLQVARKHQRSTRKWTCIGILILLVIILVIVLPIVLKTVNNNKSN

SEQ ID NO: 32512 - DNA, 647 bp, Panicum virgatum
  misc_feature: Ceres CLONE 1911358
  misc_feature: Encodes the peptide sequence at SEQ ID NO. 32513
aatccgcacctgccaccgccgcggcgtccacgccatgggcggcatagtaacaaagctcacagcagtttcacaccacgcctcctgcagcgtaaagctcatcacggtgactgactgtctgacaccggccgtgtgtgcaacgacgactgtaggcggctcagatcccgatcaaggacgacgcagcggcgaacgaggcggcgctggagctggtgcgcaaggacaagctgcgggaggtgcgcgcggggcacgacggcacgtgggcggcgcacccggggctcatcccggcgatccgggaggtcttcgagggccacctcggcgggaggcccaaccagatcggcgacgcccccgcggggcaggagcaggagcccgtcacggtcacggcggaggacctcatccagccgccgcggggcgcgcgcacggtggacggcctgcggctcaacgcccgcgtgggcgtgcagtacctcgcggcgtggctggccggctccggctccgtgccgctctacaacctgatggaggacgcggccaccgcggagatcagccgcgtccagaactgccagtggctgcggcacggcgcggcgctggacgccggcggcgtcgaggtgcgcgccacgccggagctgctcgcgcgcgtcatggaggaggagatggcc

SEQ ID NO: 32513 - protein, 46 aa, Panicum virgatum
  misc_feature: Ceres CLONE 1911358
  misc_feature: SWISSPROT Homolog: EC 2.3.3.9 Malate synthase
MEDAATAEISRVQNCQWLRHGAALDAGGVEVRATPELLARVMEEEM

SEQ ID NO: 32514 - DNA, 635 bp, Panicum virgatum
  misc_feature: Ceres CLONE 1911407
  misc_feature: Encodes the peptide sequence at SEQ ID NO. 32515
acccccaccgcggcgacgcatcatcatccactcccctcccaaaaccaccacctcagctcagctcattcctcccaggctcccaccactagtaccacctgatcaacgacgacgacgacgatgccgccgaggccgtggcgaccggtgctggcgtcggccaccaagtgctgcgcggcggaggacgcggcggtggcgcccgacgggctggcgcgctgccgcccgcagcagtcggagctctcgcgccggctggcctccttccggcgcctctcgtcgctggccaacagcccggcctcgggcgccgccgccggcaagggtggcggcgaggcggaggcggaggcggcggccgccggggagatggcgggcccgctgcagctgcactcgttcgggctgggcgagctccgcggcgtcacgcacgacttctccgccagcttcctgctgggcgagggcggcttcggcgccgtgtacaagggcttcgtcgacgccggcatgcgcccgggcctcgccgcgcagcccgtcgccgtgaagcagctcaacgccggcgggttccagggccaccgcgagtggctcgccgaggtcatcttcctgggccagttccggcacccgcacctcgtccggctgctgggctactgctgcgagga

SEQ ID NO: 32515 - protein, 172 aa, Panicum virgatum
  misc_feature: Ceres CLONE 1911407
  misc_feature: SWISSPROT Homolog: EC 2.7.11.1 Non-specific serine/threonine protein kinase
MPPRPWRPVLASATKCCAAEDAAVAPDGLARCRPQQSELSRRLASFRRLSSLANSPASGAAAGKGGGEAEAEAAAAGEMAGPLQLHSFGLGELRGVTHDFSASFLLGEGGFGAVYKGFVDAGMRPGLAAQPVAVKQLNAGGFQGHREWLAEVIFLGQFRHPHLVRLLGYCCE

SEQ ID NO: 32516 - DNA, 700 bp, Panicum virgatum
  misc_feature: Ceres CLONE 1911440
  misc_feature: Encodes the peptide sequence at SEQ ID NO. 32517
gtacggcgggaggggcgtggccgcggcgcatgcgcagcttcaattcagagacatgatgtcgcggcactgcgcaaatcgcatcttcctctccggaggttccaacatcctccatggtctaaaatctagaggcagagccactaggcgccacagcgccgtcagattcaggcggtgctgcgtgagagctaatttttggaggactgatcaccttcctgtcaaggttaccccgtcagagattattgaggtactgcaagcgtcagatgttttcggcggcatcaggaaatggagcaggttgcagctggtcaccatgacaggggtgatggcgtgcgtggttctggtagtcccttctgccgacgcagtcgatgctctcaagacgtgcacttgcctgctgaaggaatgcagaatagagcttgccaaatgcatagccaacccttcgtgtgcagcgaacgtagcatgcttgaacacatgcaacaatcgacctgacgaaactgaatgccagatcaagtgcggagacctgttcgagaacagtgtagtcgacgaattcaatgaatgtgctgtttcacgcaagaaatgtgtcccaagaaagtctgacgtcggcgagttcccagtccctgatccagctgcccttgttaagaacttcaatatgtcagattttaacggcaaatggtacatttcaagtgggctgaacccgacatttgacaca

SEQ ID NO: 32517 - protein, 215 aa, Panicum virgatum
  misc_feature: Ceres CLONE 1911440
  misc_feature: SWISSPROT Homolog: EC 1.10.99.3 Violaxanthin de-epoxidase
MMSRHCANRIFLSGGSNILHGLKSRGRATRRHSAVRFRRCCVRANFWRTDHLPVKVTPSEIIEVLQASDVFGGIRKWSRLQLVTMTGVMACVVLVVPSADAVDALKTCTCLLKECRIELAKCIANPSCAANVACLNTCNNRPDETECQIKCGDLFENSVVDEFNECAVSRKKCVPRKSDVGEFPVPDPAALVKNFNMSDFNGKWYISSGLNPTFD

SEQ ID NO: 32518 - DNA, 720 bp, Panicum virgatum
  misc_feature: Ceres CLONE 1911509
  misc_feature: Encodes the peptide sequence at SEQ ID NO. 32519
gctcctccttgacgcccgcgctcgcgatccgcggcatcctccgccgcccgccgcgcgcgaagggggcccctctacgatctccggcggagacgctggcagcgccggggggggcggctccaatggcttcggaggcggaggggcagtgggcgctgatggcgacggggcgggcgccgaccaacatcgcggtgatcaagtactgggggaagcgcgacgaggcgctcatcctccccgtcaacgacagcgtcagcgtcaccctcgaccccgaccacctctccgccaccaccaccgtcgccgtcagcccgtccttcgcctccgaccgcatgtggctcaacggcaaggaaatctcgttgtcaggaggaaggtttcagagctgcctgagagagatcaggaggcgtgctcgtgattttgaggatgaaaagaaggggatcaagataaagaaagaggactgcgagaagttgcatgtccacatagcttcgtataacaacttccccaccgctgctggtttggcctcctcagctgctggctttgcttgtctcgttttcacccttggaaagctaatgaatgtgaaagaagactatggagagctttcttcaatagcaaggcagggatctgggagtgcatgccgcagtatctatggtggatttgtgaaatggtgtatgggaaaaaagatgatgggagtgacagtattgcggtgcagcttgctgatgaagcacattggga

SEQ ID NO: 32519 - protein, 200 aa, Panicum virgatum
  misc_feature: Ceres CLONE 1911509
  misc_feature (116)..(174): Pfam Name: GHMP_kinases_N Pfam Description: GHMP kinases N terminal domain
  misc_feature: SWISSPROT Homolog: EC 4.1.1.33 Diphosphomevalonate decarboxylase
MASEAEGQWALMATGRAPTNIAVIKYWGKRDEALILPVNDSVSVTLDPDHLSATTTVAVSPSFASDRMWLNGKEISLSGGRFQSCLREIRRRARDFEDEKKGIKIKKEDCEKLHVHIASYNNFPTAAGLASSAAGFACLVFTLGKLMNVKEDYGELSSIARQGSGSACRSIYGGFVKWCMGKKMMGVTVLRCSLLMKHIG

SEQ ID NO: 32520 - DNA, 472 bp, Panicum virgatum
  misc_feature: Ceres CLONE 1911509-R
gcgttccaagccttcgcgatctgcctgaccagctttgacaccaaaccggcatgcgaataactgacggaggtgtaaagctgggcgcaagtcttgcttatccagacacaacctgcatcctgggtcgatggaaattctcgatctagctgtgccggtctgctgcccggctgaaatggtagcttgtgaggtgaaatatggtgtctgcaccataggaagatttgagcgacccagtgtatccaaccgtgttgcgcattaggatgccctatgtattattgttggggtgtttggctgcgaagtatcgctgccatatggataatggacgttgtgaccatcttgcctgcttctgcttgctctcattttgagccgtggtggtgtccagggtcggcaggagcatcgcttgcttactctgctgcctgttccttttggcttcctacttgatgatctgatgtgaaatgggtatcttttttttttctcg

SEQ ID NO: 32521 - DNA, 721 bp, Panicum virgatum
  misc_feature: Ceres CLONE 1911539
  misc_feature: Encodes the peptide sequence at SEQ ID NO. 32522
ataaaaataaacacaggctgagacgccggggatgagcaggattcgcgggggggaaggaaggagcagcaagcaagcagcaaggggagagccgtcaactcaagaggatcgtcaagaacaagaagatgggcaccacgcagcggcagctgctcctgctcttcttcctatctgcggtcgccccgcaggtagttagagcactgaaaccaatcccaaattccaatcttggggtcgaggagggagacaattccataggaatcatacagaaggacatcatagagacggtcaacaagcatcccgatgctgggtggacggctgcacacaatccttactttgccaactatactgtaagtgaaatagcattcataattttatctttcccccacctgttaaccttgaaaccatccctgtttctgcagattgcacaatttaaacgtatccttggagtgaagcccacaccacagggtgtgctgaccgatgttcctgccaaaacttattcaaaatcactgaaacttccaaaggagttcgacgccagatctaagtggtctcattgcagcacaattgggaacatacttggtaagtttacttgattaactcactgctaatgccctttcagcctgaaattgatttttgctcccttgtgaatgtactgacacacttcatttcatctttattaatttacaaatcatgtatgataccgtcttcatgatagatcaagtaagtttat

SEQ ID NO: 32522 - protein, 153 aa, Panicum virgatum
  misc_feature: Ceres CLONE 1911539
  misc_feature (45)..(112): Pfam Name: Propeptide_C1 Pfam Description: Peptidase family C1 propeptide
MGTTQRQLLLLFFLSAVAPQVVRALKPIPNSNLGVEEGDNSIGIIQKDIIETVNKHPDAGWTAAHNPYFANYTVSEIAFIILSFPHLLTLKPSLFLQIAQFKRILGVKPTPQGVLTDVPAKTYSKSLKLPKEFDARSKWSHCSTIGNILGKFT

SEQ ID NO: 32523 - DNA, 666 bp, Panicum virgatum
  misc_feature: Ceres CLONE 1911541-R
  misc_feature: Encodes the peptide sequence at SEQ ID NO. 32524
tcacgagcagctgtctgttgctgagatcaccaacagcgccttcgagccttcctccatgatggccaagtgcgacccgcgccatggcaagtacatggcctgctgcctcatgtaccgtggtgatgtagtgcccaaggatgtgaatgctgccgtcgcaaccatcaagaccaagcgcaccatccagtttgttgactggtgccctactgggttcaagtgtggcatcaactaccagccacccagtgtggtgcccggcggtgacctcgccaaggtgcagcgtgctgtgtgcatgatctccaactccaccagtatggttgaggtgttctcccgcattgaccacaagttcgacctcatgtacgccaagcgtgccttcgtgcactggtatgttggtgagggcatggaggagggtgagttctctgaggcccgtgaggaccttgctgcccttgagaaggactacgaggaggttggcgctgagttcgatgagggcgaggaaggcgatgagggtgatgagtactagatgatgatatgcttcctgctgctgtgtctggcatgtgtgctgcagttatcctgtgatctgcccgaggggctcgtgcttatcctgttctgtgtgtcggtttgaacaatctgcttccgtgtgtcgtttacaacatcttgtgttgtaagacttggttc

SEQ ID NO: 32524 - protein, 169 aa, Panicum virgatum
  misc_feature: Ceres CLONE 1911541-R
  misc_feature (1)..(111): Pfam Name: Tubulin_C Pfam Description: Tubulin/FtsZ family, C-terminal domain
  misc_feature: Useful for making plants with altered cell wall content and/or composition
HEQLSVAEITNSAFEPSSMMAKCDPRHGKYMACCLMYRGDVVPKDVNAAVATIKTKRTIQFVDWCPTGFKCGINYQPPSVVPGGDLAKVQRAVCMISNSTSMVEVFSRIDHKFDLMYAKRAFVHWYVGEGMEEGEFSEAREDLAALEKDYEEVGAEFDEGEEGDEGDEY

SEQ ID NO: 32525 - DNA, 714 bp, Panicum virgatum
  misc_feature: Ceres CLONE 1911541
acctgcaagtcagtcaacttagaggcaccacaccagttaatccatccggaaaagcaatccgcctcgccgccgccggagaagatgagcgagtggcggtacaccgagcaggaggaggccctcgagatcaagtccctccgccgcaccatcgccccctacgctaactatcaagatgcagcggaaagggatgtcaagagatacgagagatcattcaaaatgcttcctcctgcacacaaggaacttcttttccaccttggtctgaagtaccaaagactcagatggtgcatatccatgaatgcagcttttatcatgaaaatgcttgagacatttgaacctccttttgacatgagtcagtatgcaaatgtcggtggtcatgaccatccatcaaacatgcatggccacagtcatgtggattattgcacccattgctcgacagtttctatctccagaagcaattcgcaattggatgggcagcatgataaccccaaagaggatgccaagactcatgaatcttcaagacaaactgaaaataaaaaggacgaggaagagcatatggcaggctgttctcagcctgttggcagcaacttgggaacatcccaaggtgtagatgtatcatttaacagtgatacagatgtgagcacagctgcttactgtcaagataaagatgtctcttcatcttctgcttttgacaatgtaacaccacgacattgcaaaggg

SEQ ID NO: 32526 - DNA, 704 bp, Panicum virgatum
  misc_feature: Ceres CLONE 1911547
  misc_feature: Encodes the peptide sequence at SEQ ID NO. 32527
gccaatcccgcaattttccctccacaatcgcgcggtttccccctcccgccgcacaactgcaacccgcccgcgcgccatggccgcctcctcttccgccgccgcgcctgcccccgccgacacctatgacatcccatgggtggagaagtaccgccccacccgcgtggcggacgtcgtcggcaactccgacgccgtcgcccgcctggaggtcatcgcccgcgacggcaacatgcccaacctcatcctctcgggtcctccggggactgggaagacgacgagcattctggcgctggcccacgagctgcttgggcccagctaccgcgaggccgtgctcgagctcaacgcctcggacgacagggggctggatgtggtgcggaacaagatcaagatgtttgcgcagaagaaggtcactctgcagccagggcggcacaagattgtgatcttggatgaggctgacagcatgacatcaggagcacagcaagctctgcgaagaacaatggagatctattccaacaccactagatttgcacttgcgtgcaacacctcgtctaagataatcgaacccattcaaagtcgctgtgctattgtcaggttctcaaggctctctgatcaggagatccttggccgcctcatgattgttgtggcggctgagacggttccttatgtgccagatgggcttgaagctatcatatttactgctgatggat

SEQ ID NO: 32527 - protein, 209 aa, Panicum virgatum
  misc_feature: Ceres CLONE 1911547
  misc_feature (53)..(208): Pfam Name: AAA Pfam Description: ATPase family associated with various cellular activities (AAA)
  misc_feature: SWISSPROT Homolog: EC 2.7.7.7 DNA-directed DNA polymerase
MAASSSAAAPAPADTYDIPWVEKYRPTRVADVVGNSDAVARLEVIARDGNMPNLILSGPPGTGKTTSILALAHELLGPSYREAVLELNASDDRGLDVVRNKIKMFAQKKVTLQPGRHKIVILDEADSMTSGAQQALRRTMEIYSNTTRFALACNTSSKIIEPIQSRCAIVRFSRLSDQEILGRLMIVVAAETVPYVPDGLEAIIFTADG

SEQ ID NO: 32528 - DNA, 669 bp, Panicum virgatum
  misc_feature: Ceres CLONE 1911547-R
  misc_feature: Encodes the peptide sequence at SEQ ID NO. 32529
gggcacgccgcagtacgagttcatcgagcactgcctctccacggtggaccggaagcaccagccgtggctcatcttcgcgacgcaccgcgtgctgggctactcctccaacgcatggtacgccggcgaaggctccttcgaggagcccgagggccgcgagaacctgcagaaactgtggcagaagtaccgcgtcgacatcgcctactttggccacgtccataactacgagaggacctgcccaatgtaccagagccagtgcatgaccagcgagaagagccactactccgggacgatgaacggcaccatcttcgtggtggccggcggcggcggttgccacttgtcggactacacgacggcgatccccaagtggagcatctaccgcgaccatgacttcgggttcaccaagctcacggcgttcaaccactcgacgctgctgttcgagtacaagaagagcagcgacggcaaggtgtacgactccttcaccatccacagggactaccgcgacgtgctcagatgcgtgcacgacagctgtttccccactacgctcgccacctaattaatcaagccttgttgttaagacaccaacggtggttttggctttgatcgaaataaaatgagccaaccacttattagtagaataataataaaatgagccaacctcatgagcttctc

SEQ ID NO: 32529 - protein, 183 aa, Panicum virgatum
  misc_feature: Ceres CLONE 1911547-R
  misc_feature: SWISSPROT Homolog: EC 3.1.3.2 Acid phosphatase
GTPQYEFIEHCLSTVDRKHQPWLIFATHRVLGYSSNAWYAGEGSFEEPEGRENLQKLWQKYRVDIAYFGHVHNYERTCPMYQSQCMTSEKSHYSGTMNGTIFVVAGGGGCHLSDYTTAIPKWSIYRDHDFGFTKLTAFNHSTLLFEYKKSSDGKVYDSFTIHRDYRDVLRCVHDSCFPTTLAT

SEQ ID NO: 32530 - DNA, 1065 bp, Panicum virgatum
  misc_feature: Ceres CLONE 1911549
  misc_feature: Encodes the peptide sequence at SEQ ID NO. 32531
atctcaacgccccagcgccgccgctgcggttcacctcccctccccccgctctccgccttcgtcgcccttcccccgctcgctgccgccatcgcccttatctctcccccaacactcgtcgccctcgctccccaccctcctcccccccaactcggggtgttgtcgcctcccccctgtagtcgtcgcggtcccggccgccgatctgcttccccggccgccatccttgctgcgccgcagctctacatccccggcggatccgcgtcggcccgtctgccgatccgtgtccacggctccgcgcctattgagccggtccgccgcacaatggagaaatctaggcgtttggatccgcggcgtccgcggagggagcatcgtccggccgccctcccatcgacgacactcaggtcgacatccccgcagcgcatggagcgttgcctggccgcccacccatccacgacgagcgcaggccttgatttctactctaaccgatgcagttaaccatgtggagattgcgcatgcctatgagaagaatggtgtggcttgcttgagcatcctgacttgcgagaagcacttctaggggagctttgagaatctggagaccgtacacaacactggtgtgaatgtaagctaagggatcaaatatgctctacaatgtttacaaactgacagacatctaatgactgagtgattggagccgtcctacgtgatgctgctggaaatttttgcagacgacacgcacaatggcatccccatggcctggatgcgctaaccatggaggctctggcaatcagggacagaatggccttggcaagagaggggtgcagcgacaacaccttgaaaccgattgccatgattttgtgaagttttgtgaagttgctgttggtagtatgatattcttcctcttgttgtatcctctgttccaagtcactttgtatttatctatgttcagaagtaccatgtttctatcatgccttggttattctttgtctgaaattggcaaataagatttgcttgatcctgtttgaacgtgttattcatttgtcttctgttcaatataagtgcgttttctag

SEQ ID NO: 32531 - protein, 189 aa, Panicum virgatum
  misc_feature: Ceres CLONE 1911549
  misc_feature: SWISSPROT Homolog: EC 4.1.1.48 Indole-3-glycerol-phosphate synthase
SQRPSAAAAVHLPSPRSPPSSPFPRSLPPSPLSLPQHSSPSLPTLLPPNSGCCRLPPVVVAVPAADLLPRPPSLLRRSSTSPADPRRPVCRSVSTAPRLLSRSAAQWRNLGVWIRGVRGGSIVRPPSHRRHSGRHPRSAWSVAWPPTHPRRAQALISTLTDAVNHVEIAHAYEKNGVACLSILTCEKHF

SEQ ID NO: 32532 - DNA, 619 bp, Panicum virgatum
  misc_feature: Ceres CLONE 1911552
  misc_feature: Encodes the peptide sequence at SEQ ID NO. 32533
aagcaaaacaagcggcgcaaagaccccagctgcccccccccccccccccccccgcggcgccgcccagctcctccaccacctccgtccggcccggcatggcggcgctgtcccgcgcggcctcctgcctgacccggcggccgcaggcgcagccgtcgaggctgcaggcggcgagggcgatggcgtcgtcgctgttcggccacgtcgagccggcgcccaaggaccccatcctcggcgtcaccgaggccttcctggccgacccctcgcccgacaaggtcaacgtcggcgtcggcgcctaccgggacgacaacggcaagcccctcgtgctcgactgcgtgcgcgaggccgagcgccggattgccggcaacctcaacatggagtacctcccaatgggaggcagtataaagacgattgaagaatcgctgaagctggcgtacggagaggattccgaactcatcaaagacaagaggatcgcggcagtgcaggcgctttccggcactggtgcctgtcggctctttgctgatttccaaaagcgattcttgcctgattcgcaaatctacgtacctacaccaacgtggtccaaccatcacaatatttggagggatgctcaagtgccacagaa

SEQ ID NO: 32533 - protein, 174 aa, Panicum virgatum
  misc_feature: Ceres CLONE 1911552
  misc_feature: SWISSPROT Homolog: EC 2.6.1.1 Aspartate transaminase
MAALSRAASCLTRRPQAQPSRLQAARAMASSLFGHVEPAPKDPILGVTEAFLADPSPDKVNVGVGAYRDDNGKPLVLDCVREAERRIAGNLNMEYLPMGGSIKTIEESLKLAYGEDSELIKDKRIAAVQALSGTGACRLFADFQKRFLPDSQIYVPTPTWSNHHNIWRDAQVPQ

SEQ ID NO: 32534 - DNA, 642 bp, Panicum virgatum
  misc_feature: Ceres CLONE 1911556
  misc_feature: Encodes the peptide sequence at SEQ ID NO. 32535
agccccggtgaactactagtagcgccagcctgcagatcacctcatcgttaaaagcggcaatccctgcaggtcgatctgtcgccgccctcgacctcgagacagagcctttgcaagaccgaccggccgatggcaatggctcgcgagaggaagccgcttgccgttgccctggccgtggcgctgctcctgggtctgtgccgcggcgacgtcgtgcagttcatcttcggcgactcgctgtcggacgcgggcaacaacaactacctgaccaagagcctggcccgcgccgcgacgccgtggtacggcatcgacttcgggagcggcatgcccaacggcaggttctgcaacggccgcaccgtcgccgacatcgtgggcgacaagatgggcctgccgcgaccgccggcgttcctggacccgtcgctggacgccgacaccatcttcaagaacggcgtcaactacgcctccggcggcggcggcatcctcaacgagacgtcgtccctctttattcagaggttctcgctgtacaagcagatcgagctgttccagggcacgcaggcgttcatgcgggagaagatcggcgcggcggcggcgggcaagttcttcggcgagggctactacgtggtggccatgggcgccaacgacttcatc

SEQ ID NO: 32535 - protein, 171 aa, Panicum virgatum
  misc_feature: Ceres CLONE 1911556
  misc_feature: SWISSPROT Homolog: EC 3.2.1.51 Alpha-L-fucosidase
MAMARERKPLAVALAVALLLGLCRGDVVQFIFGDSLSDAGNNNYLTKSLARAATPWYGIDFGSGMPNGRFCNGRTVADIVGDKMGLPRPPAFLDPSLDADTIFKNGVNYASGGGGILNETSSLFIQRFSLYKQIELFQGTQAFMREKIGAAAAGKFFGEGYYVVAMGANDF

SEQ ID NO: 32536 - DNA, 691 bp, Panicum virgatum
  misc_feature: Ceres CLONE 1911562-R
  misc_feature: Encodes the peptide sequence at SEQ ID NO. 32537
gatcatcgtgcacggcgtgtccggctaccacatcgacccgtaccagggcgacaaggcctcggcgctgctggtggacttcttcgagaagtgcaaggaggactcgagccactggagcaagatctcgcagggcaggctccagcgcatcgaggagaagtacacatggaagctctactcggagaggctgatgaccctgaccggcgtgtacgggttctggaagtacgtgtccaacctggagaggcgcgagacccggcggtacctggagatgctgtacgcgctcaagtaccgcaccatggccagcacggtgccgctggccgtggagggagagccctccagcaagtgaggtggcggggacgacctgaatgaaagaagcagggagcacttggagtcgtgtctttttcctgggtttccttccgcatttcctcccctgattcggggttcggaggccaaaaaaaaaaaagaagagtttgcttttcctaggcgggctttcttcaagaattaaggtcgatcttcttccattgatgtggggtgttgctgctagttttgagttgattcggtagttggggtgagtgagtctggtcgggatggatggggtgtgtcagtgtgcagttggtcatgggtgctcccttgtttcctgggtggatggatggatgttgctccttgaataaacgcagcggccttggcgccgtttctg

SEQ ID NO: 32537 - protein, 112 aa, Panicum virgatum
  misc_feature: Ceres CLONE 1911562-R
  misc_feature: SWISSPROT Homolog: EC 2.4.1.13 Sucrose synthase
  misc_feature: Useful for making plants with altered carbohydrate content
  misc_feature: Useful for making plants with altered cell wall content and/or composition
  misc_feature: The sequence is a functional homolog of SEQ ID NO 2 in US patent 7091398
  misc_feature: The sequence is a functional homolog of SEQ ID NO 12 in US patent 7091398
IIVHGVSGYHIDPYQGDKASALLVDFFEKCKEDSSHWSKISQGRLQRIEEKYTWKLYSERLMTLTGVYGFWKYVSNLERRETRRYLEMLYALKYRTMASTVPLAVEGEPSSK

SEQ ID NO: 32538 - DNA, 693 bp, Panicum virgatum
  misc_feature: Ceres CLONE 1911562
  misc_feature (585)..(585): n is a, c, t, g, unknown, or other
gcacagcagcactctgacagagctggtgttctccgccaagccggtgccggtgccgatccccgggccacgaggttcacacaccaggtcctgaaatcttggcagctctacctgtgaggcgaagggggccttggagatggtcacctggtgaacgctcacatgatccggcagcaggttctcggacaaatccgcaatgtaaccaaggccatcgcccagcagagagaggcccccaatgttgctccccagcaccctgcaccaaaatctggggtccggatggtccctgagcaatcctcccacaatcttggctccgaagaatgatccgttcagcttccgggcgatcgccttgccggcggtcaccagcctcgggcgctcctcgaggtctctgccggcgaacgcgtgcgccttgaagaagaaccagtactccggggcgggcaggaccttgagcacgaccggctccaccgtccccaacgtcgaaacgcgccggttgctcgtcatgaagatcaccctgctcccctgctcggcgccggcgcgcctcagcttgagcaggagctcctccagcctctgcttcccgcgcatgtcgacgtcctncaacacgatcaggaaccgcttgctctgataattattccccttgatccaccgcagcgggtcgctgaggccgcgcggagcgtcgccgatgacgtgcttggaccggagggg

SEQ ID NO: 32539 - DNA, 773 bp, Panicum virgatum
  misc_feature: Ceres CLONE 1911568
  misc_feature: Encodes the peptide sequence at SEQ ID NO. 32540
atccatttcccaaatcgctaatcaccatccccgagccggccaaatcgaatcgcggggagcgagcgagcgcgcacgcgcaccgatcgccggcgatggccagcctcaccctgccgccggcgccccccaacccgcgccaggacgccatcgacctccacaaggccttcaaaggttttggttgtgacaatacagctgtgataaacatacttactcatcgcgattcagtgcaacgtggatatattcaacaggaatacaaggctatgtatcatgaggaactctcccagcgtatttcatctgaactcagtggacaccacaagaaagctatgttgctgtggattcttgatcctgctggacgtgatgcaactgttttgagagaagctctaagtggtgacactatggatctgagagcagccactgagataatatgttccaggacaccatcacagttgcaaataatgaaacaaacttatttggcaagattcggtacttatcttgagcatgacattggtcaccacacatctggcgatcaccagaagattttacttgcctatgtggggatcccacgctatgaaggccctgaggttgatcctactattgtgacacatgatgcgaaggacttgtacaaagctggtgagaaaaggcttggtacagatgagaagactttcatccgcattttcactgaacgcagttgggcacacatagcatctgtttcttctgctttacatcatatgtatgacccggaaattagagaaggttatcaagagcgaaacatctgg

SEQ ID NO: 32540 - protein, 226 aa, Panicum virgatum
  misc_feature: Ceres CLONE 1911568
  misc_feature (15)..(80): Pfam Name: Annexin Pfam Description: Annexin
  misc_feature (87)..(152): Pfam Name: Annexin Pfam Description: Annexin
MASLTLPPAPPNPRQDAIDLHKAFKGFGCDNTAVINILTHRDSVQRGYIQQEYKAMYHEELSQRISSELSGHHKKAMLLWILDPAGRDATVLREALSGDTMDLRAATEIICSRTPSQLQIMKQTYLARFGTYLEHDIGHHTSGDHQKILLAYVGIPRYEGPEVDPTIVTHDAKDLYKAGEKRLGTDEKTFIRIFTERSWAHIASVSSALHHMYDPEIREGYQERNI

SEQ ID NO: 32541 - DNA, 669 bp, Panicum virgatum
  misc_feature: Ceres CLONE 1911586
  misc_feature: Encodes the peptide sequence at SEQ ID NO. 32542
actcatattccccgacggcaagctcatctccaacaatggcgtcttcgctctgggcttcttctccccaaccaactcaagcacacgcttctacatcggcatatggtacaacaacgaccccgcgcacctcaccgtcgtgtgggtcgccaaccgtggcagcccaatcgtcaccccttcctcagcgacgctcgcggtaacgaaccggtctgacctcgtcctgtcagacactcgaggccgcatctactggactacgacgaacaacatcaccgccaccggcaccggaggcacggcggcggcgctgctcgacgacaagggcaacctggtcctccggtcatccgaaggcgcaaccctgtggcagagcttcgatcacccgaccgacaccatcctccccggcatgccggtctgggtgaactaccggacacgcttcacgcagagccagctggtttcttggagaagccccgaggacccgtccgccggcgacttctccctgggcgcggacgtcagctcgggcatccagtatgtcctcaaggacgggccccgcttgctgtggcgcagcggggcttggaacggcgagatggtcctggattacacgcccaacaattccagcaccgtcataatcatgtccatcgtcaccaacggcgacgacatctcgctcatgttcagcgtctccga

SEQ ID NO: 32542 - protein, 222 aa, Panicum virgatum
  misc_feature: Ceres CLONE 1911586
  misc_feature (41)..(156): Pfam Name: B_lectin Pfam Description: D-mannose binding lectin
LIFPDGKLISNNGVFALGFFSPTNSSTRFYIGIWYNNDPAHLTVVWVANRGSPIVTPSSATLAVTNRSDLVLSDTRGRIYWTTTNNITATGTGGTAAALLDDKGNLVLRSSEGATLWQSFDHPTDTILPGMPVWVNYRTRFTQSQLVSWRSPEDPSAGDFSLGADVSSGIQYVLKDGPRLLWRSGAWNGEMVLDYTPNNSSTVIIMSIVTNGDDISLMFSVS

SEQ ID NO: 32543 - DNA, 704 bp, Panicum virgatum
  misc_feature: Ceres CLONE 1911605
  misc_feature: Encodes the peptide sequence at SEQ ID NO. 32544
aaacccgctgctcccgtccgcgccgccctccaaccccgctcccagctccagccatgccaggccccgagatcaactcctggctgctccgcgtcggcgtcgagccgcagttccgcgacggcctccgcgtcacggacgcgctcaccatggaggtcgtcgagatggtgctcgtcggcaaggtcaacaagaacctcgtctccctcatcaacctcgccaagggcaccgccgtcggcctctgcggcaaggacgcgcgcctcatcaccgcgcgaccgtcccccaacgccgcggcgctcgggttcgtcggcgaggtcgcgagcgtcgacgcgaccgtcctccaccccatcattgcctcaggccatattccggtcatcgccaccgtggccgccgacgagactggtcaggcctataatatcaatgctgatacggcggcaggggagatcgccgctgccgtgggcgccgagaagctgctgctgctcacggatgtgtctgggatactggcggaccgtaatgatcctgggagcctggtgaaggagattgacattgccggggtgcgacggatggtagctgacggcaaggtggctggtgggatgatacccaaggtggagtgctgcgtgcgcgccctggcacaaggtgtgcgcactgcgagtatcattgatgggcgcgtcgaacactcgctgctgcttgagattctcacagatcagggtacc

SEQ ID NO: 32544 - protein, 216 aa, Panicum virgatum
  misc_feature: Ceres CLONE 1911605
  misc_feature (1)..(200): Pfam Name: AA_kinase Pfam Description: Amino acid kinase family
  misc_feature: SWISSPROT Homolog: EC 2.7.2.8 Acetylglutamate kinase
MPGPEINSWLLRVGVEPQFRDGLRVTDALTMEVVEMVLVGKVNKNLVSLINLAKGTAVGLCGKDARLITARPSPNAAALGFVGEVASVDATVLHPIIASGHIPVIATVAADETGQAYNINADTAAGEIAAAVGAEKLLLLTDVSGILADRNDPGSLVKEIDIAGVRRMVADGKVAGGMIPKVECCVRALAQGVRTASIIDGRVEHSLLLEILTDQG

SEQ ID NO: 32545 - DNA, 658 bp, Panicum virgatum
  misc_feature: Ceres CLONE 1911605-R
ccctgtttgctctgccctcatcgcctgttcaagccccccgtgaaggccatggtgcagcccgaggccgggttcgagcagcatccccggcagggcgacagcagctacgcccagatgtacacggacgtgggcttctactacgcccccggcgccgtgctgcgcggcgaggagttcgacggcgcggaggcggtgcggaagctggagcagtggctcatcgccaaccacggcttccaggcgcagtacgccgtgtcggagctgagcgataaggacttctggaggatgttcgacccctcccactacgaccactgccgccgcaagtacggcgccgcgggcaccttcatgagcaactactacaagtccaagaaggggaggaagacggacaaggaggtcagggacgccgaggcggaggcggcggcggccatcgtcgaaccggacgccgccgaatgaactccaatcaactgccaccagtcctgcttgcaagcctaataacaatgcatgcacccttttagtttagtttagtttaagtttatgtatgcagatgatgccgctgtgtgtccgttccgtggagcagcagcaccactttgtttgtttccgacttcctgagctagtgttgcaataaaataaagcagcaagcagttgttgtttctgctctgctcagctc

SEQ ID NO: 32546 - DNA, 747 bp, Panicum virgatum
  misc_feature: Ceres CLONE 1911606
  misc_feature: Encodes the peptide sequence at SEQ ID NO. 32547
accttccaccttcccttcctcctctgcccccgcctcctgcttccttccactcctcgctcccccgttgcttcctccttccctccacactcggctccactcatcggccctgcagctcttggtactgaccgattggtggaggtagctgctggcctgctgctgcttcttgctcctggcggtgcgttcagaccaggctctgattacgagccgtaggaaggccaaggagcaagataactgacagggaggtggcgatggagaggtatgaggtgatcaaggacataggatcgggcaacttcggggtggccaagctggtccgggacgtcaggaccaaggagctcttcgccgtcaagttcatcgagagggggatgaagattgatgagaatgtccaaagggagatcatgaaccatagatcactgaggcatccaaatattgttaaattcaaggaggttgtgctaactcccacacatttggccatagttatggaatatgctgctggtggcgagctattcgaaaggatctgcaatgcagggagatttagtgaggatgaggcaaggttcttcttccaacaattgatttcaggagttagctattgtcactccatgcaaatatgtcacagagatttgaaactagaaaatactttgctggatggtagtatagcacctcgtctaaagatatgtgatttttggttattccaagtctctgtgttgcactctcagcccaaatcaactgttggcacacctgcttacattg

SEQ ID NO: 32547 - protein, 166 aa, Panicum virgatum
  misc_feature: Ceres CLONE 1911606
  misc_feature (4)..(166): Pfam Name: Pkinase Pfam Description: Protein kinase domain
  misc_feature: SWISSPROT Homolog: EC 2.7.11.1 Non-specific serine/threonine protein kinase
  misc_feature: Useful for making plants with modulated water use efficiency
  misc_feature: Useful for biocontainment applications
  misc_feature: Useful for making plants with modulated biomass
  misc_feature: Useful for making plants with modulated time to senescence
MERYEVIKDIGSGNFGVAKLVRDVRTKELFAVKFIERGMKIDENVQREIMNHRSLRHPNIVKFKEVVLTPTHLAIVMEYAAGGELFERICNAGRFSEDEARFFFQQLISGVSYCHSMQICHRDLKLENTLLDGSIAPRLKICDFWLFQVSVLHSQPKSTVGTPAYI

SEQ ID NO: 32548 - DNA, 705 bp, Panicum virgatum
  misc_feature: Ceres CLONE 1911614
  misc_feature: Encodes the peptide sequence at SEQ ID NO. 32549
ccacccgggctccatcgaggccgccgccatcatggagcacatcctcgagggcagctccttcatgaagcacgcccacaaggtgaacgagctggacccgctgctcaagcccaagcaggaccggtacgcgctccgcacctcgccgcagtggctcggcccgcagatcgaggtcatccgcgccgccaccaagtcgatcgagcgcgaggtcaactcggtcaacgacaacccggtcatcgacgtccaccgcggcaaggcgctccacggaggcaacttccagggcacccccatcggcgtgtccatggacaacgcccgcctcgccatcgccaacatcggcaagctcatgttcgcgcagttctcggagctggtcaacgagttctacaacaacggcctcacctccaacctggccggcagccgcaaccccagcctggactacggcttcaagggcaccgagatcgccatggcctcctactgctccgagctccagtacctgggcaaccccatcaccaaccacgtccagagcgcggagcagcacaaccaggacgtcaactccctcggcctcgtctccgccaggaagaccgccgaggccgtcgacatcctcaagctcatgtcctccacctacatcgtcgcactctgccaggccgtcgacctgcgcccactcgaggagaacatcaagacctccgtcaagaacaccgtcacccaggtcggcaa

SEQ ID NO: 32549 - protein, 234 aa, Panicum virgatum
  misc_feature: Ceres CLONE 1911614
  misc_feature (1)..(234): Pfam Name: PAL Pfam Description: Phenylalanine and histidine ammonia-lyase
  misc_feature: SWISSPROT Homolog: EC 4.3.1.5 Phenylalanine ammonia-lyase
  misc_feature: Useful for making plants with altered cell wall content and/or composition
  misc_feature: Useful for making plants with altered lignin content
HPGSIEAAAIMEHILEGSSFMKHAHKVNELDPLLKPKQDRYALRTSPQWLGPQIEVIRAATKSIEREVNSVNDNPVIDVHRGKALHGGNFQGTPIGVSMDNARLAIANIGKLMFAQFSELVNEFYNNGLTSNLAGSRNPSLDYGFKGTEIAMASYCSELQYLGNPITNHVQSAEQHNQDVNSLGLVSARKTAEAVDILKLMSSTYIVALCQAVDLRPLEENIKTSVKNTVTQVG

SEQ ID NO: 32550 - DNA, 731 bp, Panicum virgatum
  misc_feature: Ceres CLONE 1911628-R
  misc_feature: Encodes the peptide sequence at SEQ ID NO. 32551
caatcgtagccactgcatctgatctcatgcaggacttcaagaccgggtaccttacactctcttcacctaggtccatgtttgtgtcacagttgattgggaccgcccttggctgtgtcattgccccactcaccttttggctctactggtcggcttttgatattggcaatcctgatggttcgttcaaagctccatatgctgtgatcttccgtgagatgtcaattctaggtgttgaaggattatctgcgctgccccaacactgcctagcgatctgctcatttttcttcgttgcgtccctagtgatcaatctcctcagggatgtaactccaaagaatgtgtctagattcattccgatcccgatggctatggcaattcccttctacattggtgcatacttcgccattgacatgtttgttgggacggtcatcctttttgtttgggagagggtgaatcgcaaggaatgtgatgattttgctggtgcagttgcctcaggcttgatctgtggtgatgggatctggactgttccttctgcgatattgtcgatccttaggatcgacccaccaatctgcatgtacttcaagccatcccttaccagctaaaattagaactagtgctgtcctttatttggatgtcgtaatgggacatccaactgtgtatatatgttctctgtgaattatagtgcgaagaaactgcagttgccttattcaatattcatcgacatgttattatgcttt

SEQ ID NO: 32551 - protein, 197 aa, Panicum virgatum
  misc_feature: Ceres CLONE 1911628-R
  misc_feature: The sequence is a functional homolog of SEQ ID NO 214 in the 10/412,699 US patent application
  misc_feature: The sequence is a functional homolog of SEQ ID NO 774 in the 10/412,699 US patent application
IVATASDLMQDFKTGYLTLSSPRSMFVSQLIGTALGCVIAPLTFWLYWSAFDIGNPDGSFKAPYAVIFREMSILGVEGLSALPQHCLAICSFFFVASLVINLLRDVTPKNVSRFIPIPMAMAIPFYIGAYFAIDMFVGTVILFVWERVNRKECDDFAGAVASGLICGDGIWTVPSAILSILRIDPPICMYFKPSLTS

SEQ ID NO: 32552 - DNA, 615 bp, Panicum virgatum
  misc_feature: Ceres CLONE 1911628
aagttccaatccgctccccccgacgccgaacgccgtccctccgggtacgccgccgcaatcccctcctcgccgcagctgcaccgagcagcggccatggtgaagaagcccaacggcgttgccaaggccactgcggcctctgccggcgcggcggccgggccatccaaggcgaatccgtccacccctgggtcgattaagacctcgaagtttaaaaagcggaaggtcaaggccaaccgcgagaaggcagcggccgccgctgcaactgttgaccaagtctcatcggtgggcgcagtcactgctggtggcgatgcatctgcattggcggtcttaccgcagccatcccatgttgctgaggcatcacctgtggcacaaatgccagagtcagccactactgctgaggcatcacctgtgacacagacgcctaagccagccactgctgaagcatcagcttcggcggcagagccaaagccaaaacctgctgatgctgatgctgatgctaatgctgatgctgcggctgcacctgccgcaagcaagggcaagggtgtgggtgctgataatagaagtggtgatggaaggatgaagagcagaagagtgaggactaggaatggcaaggggaag

SEQ ID NO: 32553 - DNA, 663 bp, Panicum virgatum
  misc_feature: Ceres CLONE 1911630
  misc_feature: Encodes the peptide sequence at SEQ ID NO. 32554
atcctgccgtaaagcccacacgacgcattgacttggcccctccctcctcctcccccatctgcctgcctcctcgcggagcggagctcacacgcccgcccacgcgagctgagcctgagctccctccctctccctccgtccctccacccgctggcgccggcggcggctctcgccccatgttgaaccactcccgctcccggcccgactcccgacccccgttcctccacggcctccagccgccgccccacgccgccgccgggacggagcagcagcagctccccagggaccggacgatggacccgccgtcgtcgtcggggaggggaccggccacgccgcggcgccagctgcagggcccgcgtccgcccaggctcaacgtccggatggagtcgcacgccatccggaagccctccggatcggcggggctcgcccccgccgcggcggtgcagggggcggcgccgccgaggcgggagcgggacgaccagcagcagcagcatgccccggcgcctccgcgggcgcccgtcatcatctacgacgcgtcgcccaaggtcatccacgccaagcccagcgagttcatggccatcgtgcagtccctcacgggcccgggatccggcgcgccgcagcagcagcggcaggagcgcccccgccgccaggcggacgacgacggcg

SEQ ID NO: 32554 - protein, 124 aa, Panicum virgatum
  misc_feature: Ceres CLONE 1911630
  misc_feature (79)..(109): Pfam Name: VQ Pfam Description: VQ motif
MDPPSSSGRGPATPRRQLQGPRPPRLNVRMESHAIRKPSGSAGLAPAAAVQGAAPPRRERDDQQQQHAPAPPRAPVIIYDASPKVIHAKPSEFMAIVQSLTGPGSGAPQQQRQERPRRQADDDG

SEQ ID NO: 32555 - DNA, 637 bp, Panicum virgatum
  misc_feature: Ceres CLONE 1911634-R
  misc_feature: Encodes the peptide sequence at SEQ ID NO. 32556
tattcgctgaagctgggttttcagatgtcacaaagaatttcttggctgtcttggcggacaatggcaggctgaaatatattgagcggattgctgagagatttgttgatttgaccatggcacataagggggaggtgaaggttgttgtcaggacagttattccacttcccgagaaggaggagaaagaactcaaggagacattgcaagatatccttgggaagaacaaaactattttggttgaacagaagattgactacagcatcatgggaggacttgtgattgaattcgggcagaaggtgtttgatatgtcgatcaagactagggcaaagcaaatggaggcgttcttgaggcaaccccttgaaatctaacttccttttggataaaaacatcatcagaatgcagtggctgtgctgcggaaggtttcctcatgtctgcaactgcaacttttatctggcctttgaataaaatgtttcctctaacaaaagaatgccactgtttttattttgtcttgtgggctagaggcctgctgaacaatttatgtttatttcttgttacttgaagaagcttgcaccgaaaacatgatggatgccatgaaaagtttttcagctccaagtcattggaatatatgaattttttcctc

SEQ ID NO: 32556 - protein, 120 aa, Panicum virgatum
  misc_feature: Ceres CLONE 1911634-R
  misc_feature (1)..(114): Pfam Name: OSCP Pfam Description: ATP synthase delta (OSCP) subunit
  misc_feature: SWISSPROT Homolog: EC 3.6.3.14 H(+)-transporting two-sector ATPase
FAEAGFSDVTKNFLAVLADNGRLKYIERIAERFVDLTMAHKGEVKVVVRTVIPLPEKEEKELKETLQDILGKNKTILVEQKIDYSIMGGLVIEFGQKVFDMSIKTRAKQMEAFLRQPLEI

SEQ ID NO: 32557 - DNA, 699 bp, Panicum virgatum
  misc_feature: Ceres CLONE 1911634
aaccgcgcgaattgagcattatccatccaaaactccgaaaggaacggcaacgcccctcgctcgccgccgcttcacccgcgccgccgcttcctctccggaggccagtagtgtccacgcgatggccgcgtgcaccgctcgctgcctcttcctctttcccctcctgcccccgaagttcccgctgcctcatcctccactcaggcggcagcgcgggggcggggcctgcattggtgctgcccgctgcagccccgaggccagcggtgggtggggaggcattgtcgaggacgaccttactgaacttctgcagattctaccaagagatttacgagataatctgcagaatgaacctagaaaggaccagctgttggaggtcgttctggatttggggagacgaccagaggcacgtttccttggtgactctggtggacaatacctaagggacagtgagatctcacaacaagagttggaggcagcgcagcaagctgtaggtgagtttggaggtgacaaccgtgcaggaattgaaggtactttacatagaatatctgctataaggagcagaaaaggaatggttgttggtttgacctgtcgagttggccgagctgttactggacatgttgatatggtccgtgatcccctaaattacaaagaaagcatttctgtttttgggaaggcctggggtaggcaagataactgttatgcgtg

SEQ ID NO: 32558 - DNA, 550 bp, Panicum virgatum
  misc_feature: Ceres CLONE 1911644
  misc_feature: Encodes the peptide sequence at SEQ ID NO. 32559
tcgcacaaacgcatcgagcacacgcacagagcagctcagcagagaactgagaagccaaagaagaacctctgcacgaatccggcttcgatccatcgacaggaacaccgcacaccgccagccagacgcagccgatcaaggcgggttaccggcaatgggcgagctgatccctgggttgcccgaggaggtggcgcgggagtgcctcggccgggtgggcttcgaccagctgcgcgtggtgcgccgcatctcgcgccagtggatgtcggaggtggagtcgccggactaccgccgcctgcgccgggccgaggggccggcgcgcccggggctcgcgccggcccgtgcgcgccccgcggcggcgggctgctgctcgggatcatggggccaggccccgtcggcggacgccgcctcgccctcctccgcgccctcgacgacgcgctcgtcgtcctcggatgtggcgtcgccgggagtaaagagactgcacaaagtcaggtcctgatcggaatggggctgcttgctggttcccctgtcttcctcatcaccctgctctggggaa

SEQ ID NO: 32559 - protein, 113 aa, Panicum virgatum
  misc_feature: Ceres CLONE 1911644
  misc_feature (3)..(50): Pfam Name: F-box Pfam Description: F-box domain
MGELIPGLPEEVARECLGRVGFDQLRVVRRISRQWMSEVESPDYRRLRRAEGPARPGLAPARARPAAAGCCSGSWGQAPSADAASPSSAPSTTRSSSSDVASPGVKRLHKVRS

SEQ ID NO: 32560 - DNA, 378 bp, Panicum virgatum
  misc_feature: Ceres CLONE 1911667
  misc_feature: Encodes the peptide sequence at SEQ ID NO. 32561
cccctccctccacacgcccccacaaccgaatatggtcgcctcagccctgcaccacacatccttcttcctcgggcacgccctgctaccccccccccccggcgctggcgccgacgccggcggccgtctcagcatgcgccccaccgtgcacagcgctccccacagcatctggtacgggcccgaccgccccaagtacctgggccccttctccaagcagacgccgtcgtacctgaccggcgagttccccggtgactacgggtgggacactgcggggctctccaccgacccggagaccttcgcgcgcaaccgcgagctggaggtgatccactcgcggtgggcgatgctgggcgcgctggggtgcgtgttcacggagatcctggc

SEQ ID NO: 32561 - protein, 115 aa, Panicum virgatum
  misc_feature: Ceres CLONE 1911667
  misc_feature (61)..(115): Pfam Name: Chloroa_b-bind Pfam Description: Chlorophyll A-B binding protein
MVASALHHTSFFLGHALLPPPPGAGADAGGRLSMRPTVHSAPHSIWYGPDRPKYLGPFSKQTPSYLTGEFPGDYGWDTAGLSTDPETFARNRELEVIHSRWAMLGALGCVFTEIL

SEQ ID NO: 32562 - DNA, 702 bp, Panicum virgatum
  misc_feature: Ceres CLONE 1911671-R
  misc_feature: Encodes the peptide sequence at SEQ ID NO. 32563
gctgaagaagctgtaaagagtgctggtggcaaacttggtaagccggagatattcccagcctctactgatgcccgctacttccggcagattgggttgccagcatttggcttttcacctatggcaaacacaccaatattgcttcacgaccataatgagtttctgcacaaagatgagtacctcaagggaatcgggatatacgagtctatcatcagggcgctggccacccacaaagatggcgctaaagatgatgaatctagagcagagctatgaggaaaacttgacttctcatcgtcttgtcgcgattcttactgccaactggagcactgaaatcatgaatccagagcactgaagtgcagctgcttatattgctgctcatgcggggaaatggtagaactgcaaacaccatccttgtacattttcaataagcgttcttatgcgctgaatatttggcgtggcatctgcagttcttctgtgcaattcatagtttcagcctattgcaacttagtgcctcagccgtgactgttgtatcaaacctgcattggctgtatcagcattcagtactgcacggcatgttactttgttgcctttcgttggatggcataacagtcgctgatgcacaaatcttccaaatgtttgtagctgatgtatgacacacaaatttcgtaagaactaagaattcatcggcacacttgcggttgagtt

SEQ ID NO: 32563 - protein, 89 aa, Panicum virgatum
  misc_feature: Ceres CLONE 1911671-R
  misc_feature: SWISSPROT Homolog: EC 3.5.1.14 Aminoacylase
AEEAVKSAGGKLGKPEIFPASTDARYFRQIGLPAFGFSPMANTPILLHDHNEFLHKDEYLKGIGIYESIIRALATHKDGAKDDESRAEL

SEQ ID NO: 32564 - DNA, 670 bp, Panicum virgatum
  misc_feature: Ceres CLONE 1911671
tttttccttattgcctttgaaattataattgtagcttcaaagaaacttgtaaacaccatatgtagttgcacattcagagcaggacaatctacttaggttgaagagccatcatcaatgaagctaatagtactctttgctctccatccgcaacacaaacccttgcctgaaagggtgtaagcataaagcactcccttgctgaaaggcttgttgtacttacggttgtttcaggtggcttaaatcatgctcatattgaacttgtatagtattgtactttaatcataggtgatactgatttttaatcttcaatgtgaccatcttaaatttgttttctgtaagttcatgtttgcttgtgcgatatacactttgctacctcaatgctatttgatgttgttagagcagccacaatgtagtaaaaaagcgatgctcgatttctctcttacttcgggcatcgatggacaaggattttgcccctgcagccggcaatgctcgataaaaattttctagcatcgacgccagtagagtcatcaatgcctgaatcctgatcgattaaaaaaatgaagccggcagagctgccatgcggcacccaactctcatctcccaccccaagtccagttaaagtttttttattttattctgtcacatgggaccccacacgatgcatgtacactgc

SEQ ID NO: 32565 - DNA, 642 bp, Panicum virgatum
  misc_feature: Ceres CLONE 1911672
  misc_feature: Encodes the peptide sequence at SEQ ID NO. 32566
atagctcacctatttttgcagtattaaatttctctgttttttgcccgttgccttgcagtgacacctcggttggggttgcaagggatgcattcaacacgttcttcagtgaaacaagtgcagggaagcatgttccgagagccttgttcgttgacttggagcccacggttatcgacgaggtgaagactgggacatatcgccagctcttccatccggagcagctcatctcccacaaggaagacgctacgaacaactttgcccgtggacattacacagttggaagagaagtaatagatctttgccttgatcggataagaaaattggcagacaactgcactggtcttcaaggctttctagttttcaatgctgttggtggcggaactggctctggacttggttcgttacttttagagcgtctatcagtcgattatggtaggaagttgaagcttggattcaccatctatccttcaccacagatttcaactgctgtcgtcgagccttataatagtgtgttctccacacattccctaattgaacacactgatgtcgtggtgcttcttgacaatgaagctatttatgacatatgcaagaggtcccttgacattgagcgcccaacatataccaatctgaacaggctcatatctc

SEQ ID NO: 32566 - protein, 213 aa, Panicum virgatum
  misc_feature: Ceres CLONE 1911672
  misc_feature (30)..(213): Pfam Name: Tubulin Pfam Description: Tubulin/FtsZ family, GTPase domain
  misc_feature: Useful for making plants with altered cell wall content and/or composition
SSPIFAVLNFSVFCPLPCSDTSVGVARDAFNTFFSETSAGKHVPRALFVDLEPTVIDEVKTGTYRQLFHPEQLISHKEDATNNFARGHYTVGREVIDLCLDRIRKLADNCTGLQGFLVFNAVGGGTGSGLGSLLLERLSVDYGRKLKLGFTIYPSPQISTAVVEPYNSVFSTHSLIEHTDVVVLLDNEAIYDICKRSLDIERPTYTNLNRLIS

SEQ ID NO: 32567 - DNA, 770 bp, Panicum virgatum
  misc_feature: Ceres CLONE 1911681
  misc_feature: Encodes the peptide sequence at SEQ ID NO. 32568
gagtacagatagctcagcctccgtctcttccgtcggcccatccatgctgctccgcctccgcccgccgccgcagccggctaccgcggctgctgctgcgagcctctcatcttttctcccctccccttccttccgcggcctcttccccttgtcgtcatggcggtcccctccgcaccgccgcctttccaccaccgccaccgcctcctcgaagggttctagaggccgattggattcggagcggtatgacgtcattgttgtcgggggtggccatgctggatgcgaggccgcgctggcgtcggcccgccttggcgcacgcacccttcttcttactctcaacatcgatcggattgcatggcagccttgtaaccctgcggtgggtgggcctgcaaagtctcaacttgtccacgaggtagatgcccttggtggtgaaattggcaaaattgctgataggtgctacctgcaaaagcgtgtactgaacagctcaaaaggccctgctgttcgtgcactgcgtgctcagactgataagagagagtatgcattagagatgaagaacatcgtggaaagcacagaaaatcttttcattagagaggcaatggctactgaagtgttgattgagaaaaatgacagtgttgagggtgttcgcactttctttggcatggacttttatgcaccgtctgttgtacttaccaccggaacatttatgagtggtaagatttgggttggtaggacatcaatgcctgctggacgagctggagaatcagcttctcatggac

SEQ ID NO: 32568 - protein, 242 aa, Panicum virgatum
  misc_feature: Ceres CLONE 1911681
  misc_feature (67)..(241): Pfam Name: GIDA Pfam Description: Glucose inhibited division protein A
MLLRLRPPPQPATAAAAASLSSFLPSPSFRGLFPLSSWRSPPHRRLSTTATASSKGSRGRLDSERYDVIVVGGGHAGCEAALASARLGARTLLLTLNIDRIAWQPCNPAVGGPAKSQLVHEVDALGGEIGKIADRCYLQKRVLNSSKGPAVRALRAQTDKREYALEMKNIVESTENLFIREAMATEVLIEKNDSVEGVRTFFGMDFYAPSVVLTTGTFMSGKIWVGRTSMPAGRAGESASHG

SEQ ID NO: 32569 - DNA, 682 bp, Panicum virgatum
  misc_feature: Ceres CLONE 1911681-R
tgtcacatgaaacatacattgtctcatggtgtgaagctatggtaatttatcgacaacaaattttcagtaactcagagacctaatcagaaactgttgatatactgtcatgctgatgaaggtttgaagttccttgaatgcagttttatgttggtatttcgtgacattgattttacaactaaactaaatcaccttgcagaaagtaacgactggccagcgcatgacagagagttctgtccttgatgcacactgtacagaggttgatggagaaccgtactggtattatgagtatctagttcggaaatcgccaacaaagtcagcaccagaaccaaatttgtttcgacataatgtagcgtgcactgctgagcgagatgggttcctgtactcactaaatgcttccactctcagcaagcagtgggaatctatggggccttttctacaaaagactgtggcatcctttcgccttcttccccctacagacagctatgttcctccttacaaggatccttggagattttggtgacatggttattctttttgctgtttcatttttttcacttctggtttagaccatgtttcacgtagtggatgtctagtgagtgcttgtactttcagcatgactgataaaatcagggactgagttttctttgaacagtcaactttaaatcagtcattctgattaatc

SEQ ID NO: 32570 - DNA, 726 bp, Panicum virgatum
  misc_feature: Ceres CLONE 1911689
  misc_feature: Encodes the peptide sequence at SEQ ID NO. 32571
gaaagccgcttcgcagatcgcaggttctactctaccgttctagaccaccgaacccagcggctccgctcagcgcaagccggcactcgcattcctgtcctcagattcgctgggtgttgggcggagtgcggaatggggggcggtggatccggatctttcctcaaggtcctggtcaataacctggatgttctcgccgggcctctagtttcacttgcatatcctctgtatgcctctgttagagcaattgaaacaaaatctgctgtagatgatcagcaatggctcacgtactgggtattgtactcatttatcactctatttgagctcacgtttgctccggtactggaatggcttcctttctggtcttatgcaaaattgtttttcaactgctggttggtattaccacagtttaatggcgctgcacatgtgtacgagcattttgtgaggccaatgattgtaaatcagcaagttgtaaacatctggtatattccaaagaagggtgaaccagagaggcctgatgatgtgatttcagctgcacagagatacattgagcaaaatgggtcacaagcatttgagaatcttgttaacaagtttaaaagttcaaacccaagacggtcaatactggaggaggtagaggttgaaaggagagccaggattcaacgagaatccgaagcaagggaagctaaccccttctttcatccagattaccgatactaggcagccccttcgctg

SEQ ID NO: 32571 - protein, 193 aa, Panicum virgatum
  misc_feature: Ceres CLONE 1911689
  misc_feature (10)..(107): Pfam Name: TB2_DP1_HVA22 Pfam Description: TB2/DP1, HVA22 family
MGGGGSGSFLKVLVNNLDVLAGPLVSLAYPLYASVRAIETKSAVDDQQWLTYWVLYSFITLFELTFAPVLEWLPFWSYAKLFFNCWLVLPQFNGAAHVYEHFVRPMIVNQQVVNIWYIPKKGEPERPDDVISAAQRYIEQNGSQAFENLVNKFKSSNPRRSILEEVEVERRARIQRESEAREANPFFHPDYRY

SEQ ID NO: 32572 - DNA, 679 bp, Panicum virgatum
  misc_feature: Ceres CLONE 1911699
  misc_feature: Encodes the peptide sequence at SEQ ID NO. 32573
gacccgacccgcacccgccgcctcctctcctctgctattcgcgccgaagccggcggcggcagcggcggcggcggcgcagcgaccatcaccgcggggactccgggagaaggcccacgtagaggtgttgcgagtttcattcgttggagtcgcggctcgcgcgtgaatcaaccatccaccacccccgccatggcgttctggggggtcgaggtgaagcccgggaagccctacacccacacctaccaggctgaccatggccgcctccgtatctgccaggctacacttagcaattgtgatgcttctggaaggactgtcctgcaatgcaatgttggcaacaagattcccatcaaactttgtagtttaaatccaaaattggcggagatgtgccatctagagattgagttagaggaggttgatgatgttgtcttctcagtaattggtcagagttccattcatctctccggatattatgtccgtgcaagcagcaggtctaatgcgggagatgatgaatcagaatcttatggggaagatattggacagtctgacactgatgaggagcatgatgccaatgaggacagctatgaatctgactttattgatgatcgtgatgttataactgttagtgatgatgaatgctcctctccacgccgcggcaaacaagcttctggaaaacagattcgta

SEQ ID NO: 32573 - protein, 164 aa, Panicum virgatum
  misc_feature: Ceres CLONE 1911699
  misc_feature: SWISSPROT Homolog: EC 5.2.1.8 Peptidylprolyl isomerase
MAFWGVEVKPGKPYTHTYQADHGRLRICQATLSNCDASGRTVLQCNVGNKIPIKLCSLNPKLAEMCHLEIELEEVDDVVFSVIGQSSIHLSGYYVRASSRSNAGDDESESYGEDIGQSDTDEEHDANEDSYESDFIDDRDVITVSDDECSSPRRGKQASGKQIR

SEQ ID NO: 32574 - DNA, 571 bp, Panicum virgatum
  misc_feature: Ceres CLONE 1911699-R
  misc_feature: Encodes the peptide sequence at SEQ ID NO. 32575
gccccccgagctggcggccggcctgctgcagaaggccatcgacgaccacgacgccgccgccgtcacgcggaggctcgaggagtacgaggccgcgcccaagctcttccactacagcgacgccgggcccaactgcgtcgccgtggggagctccccgcgcttcaaggtgtacgacgtcgacttcggcttcggcaggcccgagcgcatgcgcagcggcggcaacaacaagttcgacggcatggtctacctctacccggcccgcgccggcgacggaggcatcgacgtcgagctggcgctgcagccggagccgatgcagaggctccaggaggacgccgacttcctcctccaccagccggcctagctacctgctcatttaattaattgttaactaattggtattggattgacagtactgtactgtactgtagtattcgttccttgttgcattgcttcgtcaccattcaattccgtatgtttcatcagtcggtgttgtactcttgtaccttttttttgtgactttgtactcttgtgtcttgttatatatacttatgtaccactggatttgatcgtcaag

SEQ ID NO: 32575 - protein, 118 aa, Panicum virgatum
  misc_feature: Ceres CLONE 1911699-R
  misc_feature: SWISSPROT Homolog: EC 2.3.1.144 Anthranilate N-benzoyltransferase
  misc_feature: The sequence is a functional homolog of SEQ ID NO 34 in US patent 7105719
PPELAAGLLQKAIDDHDAAAVTRRLEEYEAAPKLFHYSDAGPNCVAVGSSPRFKVYDVDFGFGRPERMRSGGNNKFDGMVYLYPARAGDGGIDVELALQPEPMQRLQEDADFLLHQPA

SEQ ID NO: 32576 - DNA, 696 bp, Panicum virgatum
  misc_feature: Ceres CLONE 1911700
  misc_feature: Encodes the peptide sequence at SEQ ID NO. 32577
aaacccccgtgcgccccccaagtccgccgacgagcgagaccctgagctcaccccgacgaccatggcctcctccatcctctcctcctccgctaaaccctgctactccgccaccaaaacccccgctcccatcgccaaccgcttgccaccccctgccccagccacaacccgcgccgccgccccccgattcgcccatgacctctccgccgtcgccgtcagagcgagccccagcgcgcgccgcctccgcgcgctggcccgccccgtccgggcgtctcagcagcagccgcggcggcggcggcccgagtacgtccccaaccgcatcgacgaccccaactacgtccgcatcttcgacaccacgctccgcgacggcgagcagtcccccggcgctaccatgaccagcgccaagaagctcgtcgtggcccgccagctcgcccgcctcggcgtcgacatcatcgaggccggcttcccggcctcctcccccgacgacctcgacgccgtgcgctccatcgccatcgaggtcgggaacgcgcccgtcggggaggacggccacgtgcccgtcatctgcggcctctcgcggtgcaacaagaaggacatcgacgccgcatgggaggccgtcaggcacgcgcgccggccgaggattcacaccttcatcgccaccagcgagatccacatgcagcacaagctcaggaagacgcccga

SEQ ID NO: 32577 - protein, 211 aa, Panicum virgatum
  misc_feature: Ceres CLONE 1911700
  misc_feature: SWISSPROT Homolog: EC 2.3.3.13 2-isopropylmalate synthase
MASSILSSSAKPCYSATKTPAPIANRLPPPAPATTRAAAPRFAHDLSAVAVRASPSARRLRALARPVRASQQQPRRRRPEYVPNRIDDPNYVRIFDTTLRDGEQSPGATMTSAKKLVVARQLARLGVDIIEAGFPASSPDDLDAVRSIAIEVGNAPVGEDGHVPVICGLSRCNKKDIDAAWEAVRHARRPRIHTFIATSEIHMQHKLRKTP

SEQ ID NO: 32578 - DNA, 555 bp, Panicum virgatum
  misc_feature: Ceres CLONE 1911700-R
  misc_feature: Encodes the peptide sequence at SEQ ID NO. 32579
tgacggggaagctgacgctgcagagcgacgtgtacgcgttcggcgtggtgctgctggagctgctgacggggcggcgcgccatcgacctgagccaggggccgcaggagcagaacctcatcgtggggatccaccaggcggtgggcgactggcggaagctgcgcagggtggtggaccgggacatggccagggggtcctacacggtggagtcggtgtccatgttcgccgggctcgccgcgcgctgcgtctccttcgacggcgccgcccggccgtccatgccggactgcgtcaaggagctccagttcatcatgtacgccaacatgaagatctgatcgcgctcgccgcctcgctcgggtgtctggagtcgcgcatgggttttgggacggggcgcggccgccggatgggttgcaactgcaggtctgcagcttttctttggtcgatgaaatcagaatcggagaggattggtctcatgatcgggatacttgtacagggttatagtaatttctcattgcgataggaatgcatttcggtctgcataagggcaatgctattttttcc

SEQ ID NO: 32579 - protein, 108 aa, Panicum virgatum
  misc_feature: Ceres CLONE 1911700-R
  misc_feature: SWISSPROT Homolog: EC 2.7.11.1 Non-specific serine/threonine protein kinase
TGKLTLQSDVYAFGVVLLELLTGRRAIDLSQGPQEQNLIVGIHQAVGDWRKLRRVVDRDMARGSYTVESVSMFAGLAARCVSFDGAARPSMPDCVKELQFIMYANMKI

SEQ ID NO: 32580 - DNA, 687 bp, Panicum virgatum
  misc_feature: Ceres CLONE 1911712
  misc_feature: Encodes the peptide sequence at SEQ ID NO. 32581
gttcacgatagacttggtggtgaaagtttcgaaggtaggagcgacgagcagaaagacagagaagcatggtcttcgagagccaggatttttggcacatgtaggtggtgtggtcaagatggtcatcatcaggcaacctgcactaatgatcccctctgcttcagttgcaaaaaatctggccatattgctgctcagtgtccacaactcctgggttgcaaaatgaggatgtttggttttggctttccaggacagggatttcatagcttacagttacctgggccgcaaacctctcaaactgatgagaatctggggagtattcagattgtcagtggaaaagcatctgctgcttgggttgaggaggaattaaaacacttgattgatagctcctgggactggaaggttcgacagatctctgatcttgagtatttggtggtcttccccaacaaagccatgctggatactttatccaaattcaatggtgtgaaattggctatccacaacatatttgctatggtatctaaatccaatcttgatgcctctgcttcttctatcctttagactggttggatccaaattcatggaataccaagtctggccagaaacgaagacgcagttaggcagattgctgaactagctggtgaagtcgaagtaattgatgagctgtcgttaatcagagaaggtcctgttaag

SEQ ID NO: 32581 - protein, 184 aa, Panicum virgatum
  misc_feature: Ceres CLONE 1911712
  misc_feature (50)..(67): Pfam Name: zf-CCHC Pfam Description: Zinc knuckle
VHDRLGGESFEGRSDEQKDREAWSSRARIFGTCRWCGQDGHHQATCTNDPLCFSCKKSGHIAAQCPQLLGCKMRMFGFGFPGQGFHSLQLPGPQTSQTDENLGSIQIVSGKASAAWVEEELKHLIDSSWDWKVRQISDLEYLVVFPNKAMLDTLSKFNGVKLAIHNIFAMVSKSNLDASASSIL

SEQ ID NO: 32582 - DNA, 730 bp, Panicum virgatum
  misc_feature: Ceres CLONE 1911721
  misc_feature: Encodes the peptide sequence at SEQ ID NO. 32583
ttttttttgctccgtcctagcattaccgattcaaaagagaagaatattgttgcatcaaaggtttccgacccaaccaccagtcttcccagaaaggcagaaacccacacaaagactcagatcccaatctctcaaaatgcgatcttcgtgagctactgctacaataatgaagctcataattgtcttgttgcagatctttctcttactccccatcttctccttttcaatccagaccaactacagctacatcttcagcttcggcgattcctacactgacaccggcaatctcctcgtcctctacggcggcctggcgaccgccacgcccggtgtatggatagcgaagccgccgtacgggatgaccttcttcgggcttcccaatggccgcgcctccgacgggagattggccatcgatttcatcggtaactttagtttacttgcagcaagcacatgactgaactttgtttgggggattaactcaactgcaagtctgatgaaaccctttggcgacgatagttctgaagctgaatctgatgtatgcagctgaagcgttgggtctcggttggaaaaatagacaactataagtttaaattccgaactagatttatcataatgagaattaaacctaggatgcatgactctaacatactagacagtacgtatatcataaacatgatctcagaaaacatgattatgaaacagatctgatcacaaaatacatactggtgcgggagcc

SEQ ID NO: 32583 - protein, 94 aa, Panicum virgatum
  misc_feature: Ceres CLONE 1911721
  misc_feature: SWISSPROT Homolog: EC 3.2.1.51 Alpha-L-fucosidase
MKLIIVLLQIFLLLPIFSFSIQTNYSYIFSFGDSYTDTGNLLVLYGGLATATPGVWIAKPPYGMTFFGLPNGRASDGRLAIDFIGNFSLLAAST

SEQ ID NO: 32584 - DNA, 617 bp, Panicum virgatum
  misc_feature: Ceres CLONE 1911725-R
  misc_feature: Encodes the peptide sequence at SEQ ID NO. 32585
ctgctgcctcatgtaccgtggagatgttgtgcccaaggatgtgaatgctgctgtggccaccatcaagaccaagcgcaccatccagtttgtggactggtgcccgactgggttcaagtgcggcatcaactaccagcctcccagtgtggtgcctggtggtgatctggccaaggtgcagcgtgccgtgtgcatgatctccaactccaccagtgtggttgaagtgttctcccgcatcgaccacaagtttgacctcatgtatgccaagcgcgccttcgtgcactggtacgtgggtgagggcatggaggagggtgagttctccgaggcccgtgaggaccttgccgcgctggagaaggactatgaggaggtcggtgctgagtttgacgatggtgaggagggtgacgagggtgatgagtactagacccttcctggtgcatctgtgtcaggcctgcgtgctgctattatccagtgatctgccttagtggctcgtgctatcgtgttatgtgttgtctgtcagtttgaactatcagttgtgttaacgtgtggtttacaacacctgatgttgtaagaactctatgttgaatttcctgctctgctactgggtaatgaatgtcgttatgatc

SEQ ID NO: 32585 - protein, 137 aa, Panicum virgatum
  misc_feature: Ceres CLONE 1911725-R
  misc_feature (1)..(79): Pfam Name: Tubulin_C Pfam Description: Tubulin/FtsZ family, C-terminal domain
  misc_feature: Useful for making plants with altered cell wall content and/or composition
CCLMYRGDVVPKDVNAAVATIKTKRTIQFVDWCPTGFKCGINYQPPSVVPGGDLAKVQRAVCMISNSTSVVEVFSRIDHKFDLMYAKRAFVHWYVGEGMEEGEFSEAREDLAALEKDYEEVGAEFDDGEEGDEGDEY

SEQ ID NO: 32586 - DNA, 632 bp, Panicum virgatum
  misc_feature: Ceres CLONE 1911725
ctcctccccctcctcagatcccatccgctcctccaccacgccgcgcgcctgtcctccccgcgcacccgcctgctcctccgccgcgacgcgctcccgctcccgctcccgccggcgcgctccccgcaccactcgccgatccgcatggccgcctcctccggctccaacgccagctcccccgccccgtcgccgccgcctgcagtggtgcacaagtcaaagatacaattttgctctgcttgtggaagcccgacaaaattggctgtacctgatggagatgagaagatgagggctatttgttcttcttgtggaagagttcactacgaaaaccccaaaatggttgttggttgcctggtggagcatgataataaggttctcctttgtagaagaaagattgaaccggcttatggtctttggtaagttccctttgatatttctccttcgattatatgttgtggtaatgtgggtttgctctgatctataacagcgtagctgtactatgtttgaatattctcatgcagcattttttgagtatatgcgacagatgcagatttgcagaatatattaacctaaactatttgcctgcactgttcggaatatgaggtcatattataatgtaggttgtttttgttacattg

SEQ ID NO: 32587 - DNA, 749 bp, Panicum virgatum
  misc_feature: Ceres CLONE 1911732
  misc_feature: Encodes the peptide sequence at SEQ ID NO. 32588
caaccttggccttattgcttcatactactatattagctacacaactattgaacgtttcagttctatgctgacccagaagactaagatgaaaggactcctggagattctagcatctgcatcagagtatgcagagcttccaggtcgtccaggtgaggaagaattcatcgagaggcttgttcgccaccagaggttctctattgagaagcccaagtatggtgatccgcatgtgaaggccaatgctctgctgcaagcccatttttcaaggcacacagtagttgggaacctggcagctgatcagcgggagattctcctttctgcccataggttgctccaggcaatggttgatgttatttccagcaatggttggcttagtctcgctctcaatgcaatggaattgagtcaaatggtgacacaaggcatgtgggatcgtgattctgtcctgcttcaagttccacacttcacaaaggagttggctcgaaggtgccaggaaaatgaggggaagcccattgagagtgtctttgatcttgttgagatgggtatcgatgagatgcgggatctcctgcagctatcacactctcagctgcaggacatcattgaattcttcaagcggttccccaatgttgatatggcctatgaggtccgcgaagctgatgacataagtgccggtgacaatgtaacagtgcaggtaacgctggaacgtgacatgacgaacttgtctgaggttgggccagttcatgcgcctaggctcc

SEQ ID NO: 32588 - protein, 249 aa, Panicum virgatum
  misc_feature: Ceres CLONE 1911732
  misc_feature (1)..(249): Pfam Name: Sec63 Pfam Description: Sec63 Brl domain
NLGLIASYYYISYTTIERFSSMLTQKTKMKGLLEILASASEYAELPGRPGEEEFIERLVRHQRFSIEKPKYGDPHVKANALLQAHFSRHTVVGNLAADQREILLSAHRLLQAMVDVISSNGWLSLALNAMELSQMVTQGMWDRDSVLLQVPHFTKELARRCQENEGKPIESVFDLVEMGIDEMRDLLQLSHSQLQDIIEFFKRFPNVDMAYEVREADDISAGDNVTVQVTLERDMTNLSEVGPVHAPRL

SEQ ID NO: 32589 - DNA, 500 bp, Panicum virgatum
  misc_feature: Ceres CLONE 1911735
  misc_feature: Encodes the peptide sequence at SEQ ID NO. 32590
aaacctcccaaacccctccgtcctccttcccccaaacctcccaaaccccaccgcctcgccggaacccttgccccctcccccccagccgccgcgcccccccgatccgccgccatgagggagatcctgcacatccggggcggccagtgcggcaaccagatcggggcccagttctgggaggtgatctgcgacgagcacggcctcgaccacaccggccagtacgcgggcgactccgacctccagctcgagcgcatcaacgtctactacaacgaggcccgcggcggacggttcgtcccgcgcgccgtgctcatggacctcgagcccggcaccatggactcggtgcgctcggggccctacggccagatcttccgccccgacaacttcctcttcggccaggccggcgccgggaacaactgggccgaggggcactacgccgagggcgcatagctcatcgactcggtgctcgacgtcgtccgcaaggaggccgagaactgcgactgcct

SEQ ID NO: 32590 - protein, 110 aa, Panicum virgatum
  misc_feature: Ceres CLONE 1911735
  misc_feature: Useful for making plants with modulated flowering time
MREILHIRGGQCGNQIGAQFWEVICDEHGLDHTGQYAGDSDLQLERINVYYNEARGGRFVPRAVLMDLEPGTMDSVRSGPYGQIFRPDNFLFGQAGAGNNWAEGHYAEGA

SEQ ID NO: 32591 - DNA, 496 bp, Panicum virgatum
  misc_feature: Ceres CLONE 1911738
  misc_feature: Encodes the peptide sequence at SEQ ID NO. 32592
gcctcccctcttcacctcacccatctctctcgggagctcctcttcctactcctcagtcctcgccccttccaagcaacaaacccatggctctcgtccgccagcgccgccagttgccgcacctcaccctcccgctcgaccacttcgccctgcgcctgccgccgcaaccgcagccgcagcccgccgccgccgcgccgtccacctccgcctccgacgcccgcctctcggacttcgagaaaatctccgtccttgggcacggcaacggcggcaacgtctacaaggcgcgccaccgccagcccgcgcagccgttcgcactcaagctcttcggggccggggacccctccgcggctcacgaggccaagatactcacggtcgccgcggacgcgccctacgacgtgcgcgtccactcggtgatcacgtcggcgccggcggaggccgcagaggaggcgcctgcggagctggcgctggagctcatgaccggtggctacgtcgctggctt

SEQ ID NO: 32592 - protein, 137 aa, Panicum virgatum
  misc_feature: Ceres CLONE 1911738
  misc_feature: SWISSPROT Homolog: EC 2.7.12.2 Mitogen-activated protein kinase kinase
MALVRQRRQLPHLTLPLDHFALRLPPQPQPQPAAAAPSTSASDARLSDFEKISVLGHGNGGNVYKARHRQPAQPFALKLFGAGDPSAAHEAKILTVAADAPYDVRVHSVITSAPAEAAEEAPAELALELMTGGYVAG

SEQ ID NO: 32593 - DNA, 396 bp, Panicum virgatum
  misc_feature: Ceres CLONE 1911746
  misc_feature: Encodes the peptide sequence at SEQ ID NO. 32594
tctccaacccctagccccctactgcatctctccttcaggttcagccatagcagcactacgtgcaggcgcggcggcgagggagcaggcactggaaggaacgccatgaaggagttctcgtacgaggaggtggaggcggccacgggcggattcgcggccaagaacctcgtggggaagggcagccacggcagcgtatacaaggccaggctgcgggaaggcggcagcaggacggccaccgtcgccgtcaagcggccgtcgcacgcgcagggggaggccaagctcacgaacgagatcgccgtgctttccgccgcgccgcgccacccgggcatcgtcgccttcgtcggggtcgtcgtggcccggccggcgccggcggatgcgggggtgaagaaaggcggtggc

SEQ ID NO: 32594 - protein, 97 aa, Panicum virgatum
  misc_feature: Ceres CLONE 1911746
  misc_feature: SWISSPROT Homolog: EC 2.7.11.1 Non-specific serine/threonine protein kinase
MKEFSYEEVEAATGGFAAKNLVGKGSHGSVYKARLREGGSRTATVAVKRPSHAQGEAKLTNEIAVLSAAPRHPGIVAFVGVVVARPAPADAGVKKGG

SEQ ID NO: 32595 - DNA, 712 bp, Panicum virgatum
  misc_feature: Ceres CLONE 1911746-R
  misc_feature: Encodes the peptide sequence at SEQ ID NO. 32596
aacccattatgagatgaaagggattcctgtaagaatagagattggccctcgtgatgtcacaaataatagtgttgtggtttctaggcgtgatgtccctggaaagcaaggaaaggagtttggagtgtccatggacccttcaatattggtgaaccatataaagggccgtttagaagatatacaagcatcccttttacagaaagccatcacattccgtgatagtaacatagtagatgtaagctcatatggagaattgaaggaagccattgccgaaaggaagtgggctagagggccttggtcagctagcgatgctgacgaactgaaggtgaaagaagagactagcgccaccatcaggtgctacccgttcgagcagccagagggcaccaagaaatgtttcatgactggcaaccccgcagaggaggttgcaatttttgcaaagtcatactaggtcatctatgtgtctatcgggtttttttttgcaaagtcatacaagaaaaagtcataccagagacaaaatgagcctttttctctctttttaaggattggttaccctctgtttctgtaaagtttgcattaaccacggttcatgtactagctagcagtgtatgcttgtactgccgatatctttcttgtaaattcgataaacaataggccaattatgtgtaaccattgcaaattgcaatccaatctaagcaatgaagcttgttgcaagttt

SEQ ID NO: 32596 - protein, 147 aa, Panicum virgatum
  misc_feature: Ceres CLONE 1911746-R
  misc_feature (81)..(147): Pfam Name: ProRS-C_1 Pfam Description: Prolyl-tRNA synthetase, C-terminal
  misc_feature: SWISSPROT Homolog: EC 6.1.1.15 Proline--tRNA ligase
THYEMKGIPVRIEIGPRDVTNNSVVVSRRDVPGKQGKEFGVSMDPSILVNHIKGRLEDIQASLLQKAITFRDSNIVDVSSYGELKEAIAERKWARGPWSASDADELKVKEETSATIRCYPFEQPEGTKKCFMTGNPAEEVAIFAKSY

SEQ ID NO: 32597 - DNA, 214 bp, Panicum virgatum
  misc_feature: Ceres CLONE 1911753
  misc_feature: Encodes the peptide sequence at SEQ ID NO. 32598
agtggtcgccagcgacactagcctcttccttgctccttccctccctccccagcaaccgatcctcccctccgcctgctgctgcagcagcagccatgacggactccacggcgctctccaacgccgccaaccccacccagctctgccgcccccgcgcctctcccaacaacccggagaacggactgggcctcaggacaggtctcaacaacttctccca

SEQ ID NO: 32598 - protein, 40 aa, Panicum virgatum
  misc_feature: Ceres CLONE 1911753
  misc_feature: SWISSPROT Homolog: EC 1.10.99.1 Plastoquinol--plastocyanin reductase
MTDSTALSNAANPTQLCRPRASPNNPENGLGLRTGLNNFS

SEQ ID NO: 32599 - DNA, 715 bp, Panicum virgatum
  misc_feature: Ceres CLONE 1911754
  misc_feature: Encodes the peptide sequence at SEQ ID NO. 32600
gagccgcagccgacgccttttcagtttctcctctcctcttccctggcggcttcttcttcttcggcctcctcggctcctcgtcgcaacgcctcttctccgtctcgtcgtcgtctcgagcggccgccgtcgcgtcaagggttcgaggttcgagagctgagttgggaggaggactgccgccgcagccatgaaggcgctcattctcgtcggaggcttcggcacccgcctgcggccgctcacgctcagcgtgcccaagccgctcgtcgacttcggcaacaagcccatgatcctgcatcagatcgaagctctgaaggaagttggggtcacagaggtcgtcctggccatcaattaccagcctgaggtgatgctcaactttctcaaggacttcgagagcaagcttggcatcaagatcacatgctcccaggagacggagcccctggggaccgcgggccctctggccctggcccgcgacaagctcgccgacggctccggcgaccctttcttcgtgctcaacagcgacgtgatcagcgagtacccgttcgcggagctcatccagttccacaaggcccacggcggcgaggcgacgatcatggtcaccaaggtggacgagccgtccaagtacggcgtggtggtcatggaggagggcacgggcaaggtggagcgcttcgtggagaagcccaggtgttcgtgggcaacaagatcaacgccggcatctacc

SEQ ID NO: 32600 - protein, 176 aa, Panicum virgatum
  misc_feature: Ceres CLONE 1911754
  misc_feature (2)..(176): Pfam Name: NTP_transferase Pfam Description: Nucleotidyl transferase
  misc_feature: SWISSPROT Homolog: EC 2.7.7.13 Mannose-1-phosphate guanylyltransferase
MKALILVGGFGTRLRPLTLSVPKPLVDFGNKPMILHQIEALKEVGVTEVVLAINYQPEVMLNFLKDFESKLGIKITCSQETEPLGTAGPLALARDKLADGSGDPFFVLNSDVISEYPFAELIQFHKAHGGEATIMVTKVDEPSKYGVVVMEEGTGKVERFVEKPRCSWATRSTPAS

SEQ ID NO: 32601 - DNA, 668 bp, Panicum virgatum
  misc_feature: Ceres CLONE 1911779
  misc_feature: Encodes the peptide sequence at SEQ ID NO. 32602
atcttcttcccctttcttgacatgagagcaacgtgctccgaggcagcatcatcccattcccatagctgctagatcgctccatttctagacctatcataattccgtagcgtggtctaccatgaactgtgttctccaatctccatccatcaagctcttcttttggctactaaaaaaacaactcttttggtggtccttgaccagcgggacattccatgattagctgacaagcaaactcgcttaactattttttaatggttgctagattcggagacgccggcgcgggagtggaagccgctgtgcgacctcacgtcgaaccgccgcatcgactggtgcgagctcgacggcgacgtccgcgtgctcggcgccaacgccagcgtcaccctggtggcgccgcccgccgccgccgcccgcaccttccgggaggagtcgtggcgcatcaaaccgtacccgcgcaaggccgacccgaacgccatgcgcaacgtccgcgtggtgacggtgcggtcggtgtccgccggtgcgccggcgtgcacggaccggcacgacgacgtgccggcgctggtgttctcggaccgcgggtacacgggcaactacttccacgcgtacacggacgtgatcctgccgctgttcctgacggcgcggcggtacgccggcgaggtgctgctgctggt

SEQ ID NO: 32602 - protein, 65 aa, Panicum virgatum
  misc_feature: Ceres CLONE 1911779
  misc_feature: Useful for making plants with altered carbohydrate content
MRNVRVVTVRSVSAGAPACTDRHDDVPALVFSDRGYTGNYFHAYTDVILPLFLTARRYAGEVLLL

SEQ ID NO: 32603 - DNA, 578 bp, Panicum virgatum
  misc_feature: Ceres CLONE 1911785
  misc_feature: Encodes the peptide sequence at SEQ ID NO. 32604
aaagctagctaccacctcgaccgaccggcggccgatctgtgctgtgaacaagtcaggaagctagctcgcggatatacttggctggcgcggggggtgcgacggcggtgcagcatccggcggcgggggctccgccggctggggctaggagtggtgccggcgccggcgcaggcgcatcgggggcccccgtcgctcataccgtgctgctctccctcacgaggacgaggatggggtcaggacggccaccatatcccccgccacaagctcatcatctacaccgatcccggcatctatgatagcatggcaatcctaatggcgttcacagaaccaagcgtggaaatcattgcgttgacgaccgtatttggcaacgttagcacggagggtgcaacacggaatgcgctgttgctgtgtgagagagctgggcattctgaagttccactatcagagggaagccctgagcccctaaagggaggaaaaccccgtattgctgattttgttcatggctcagatggcattgggaatctgtttgttcctgaacccactactaggaaggttgaggaaagtgctgctgagttcttggt

SEQ ID NO: 32604 - protein, 192 aa, Panicum virgatum
  misc_feature: Ceres CLONE 1911785
  misc_feature: SWISSPROT Homolog: EC 3.2.2.8 Ribosylpyrimidine nucleosidase
KASYHLDRPAADLCCEQVRKLARGYTWLARGVRRRCSIRRRGLRRLGLGVVPAPAQAHRGPPSLIPCCSPSRGRGWGQDGHHIPRHKLIIYTDPGIYDSMAILMAFTEPSVEIIALTTVFGNVSTEGATRNALLLCERAGHSEVPLSEGSPEPLKGGKPRIADFVHGSDGIGNLFVPEPTTRKVEESAAEFL

SEQ ID NO: 32605 - DNA, 1518 bp, Panicum virgatum
  misc_feature: Ceres CLONE 1911789
  misc_feature: Encodes the peptide sequence at SEQ ID NO. 32606
aacttccactccgccacagttctagggtgcccagtgcccttcgccggcagattgattgacctgcgcactgatgggtagtcccaaaaagagtgcctgcgccgccgcggacctcaccgacgacctcatcatcgagatcctgtcgaggcttccggctaaatcgatctgccgcttcaagtgcgtttcctggcactggtacggtttaatcaccaaccccgagcaccgcaagaagatccctcagacgctctccggcttcttctaccccagcgacaggtggacacccgaggaccccgtcagaacactccccgatttcgttgacatcgtgagggacgaagagccattttcagacccctcgttgaccttcatggcctcctacaggtcgattattccaaagatctgctgcaatggccttcttttctgcttctgctggaaggtctccccaagggatgaatgtgatcttgttgtgtgcaatcctgcgacagagaaatgggttgtcgtgcctgactctgttgatgaaagcattgctttgaagtaccattttgtttttgacccagccatctccccccacttccaagtgtttgaaattacagacgcggatgaggattatggatacatcggtgatgtgaatatctactcatcggagacaggtgcatggagttgcatagggaatggttggggcgatgagcttcagttagtcgatagaggaggtgtttttctcaatggaatgttgcatcttctgacctatgatttaaagatattggcagtggacacaaaggggaagaaatggaggaccattcctttgctggaacctatgactgtctcttgcttttgtagaggtcctctcgcatttatcggtcagtctcaagggcgattgtattacataaatatgagggttggtgatacctcaaaattgtcagtctggattcttgaggactatgacagtggtgaatggatatttaagtacaacattagcactgcacagatttttggggagaagaatctaatgtttgagagggactacgctttggttgcgattcatccagaaagcaatttggttttctttgtttgtaggtgcaaggatttgctgatatcgtatgacatggatcgtggtaaagtgtctgttagcaatctcaaagagcatctgtataaccgcccatttcttccctatcttccatatgttccatttctcaaggattcactggctgctcaagcctagaagcataatttgcagtgcggaggccaacaatagttaccctcaagtgacatggatgcctacagccagttgtccccaaatttaagaatgtagctgcggcttgtgtaactcacctgtttttctggcccttattttttgtttaactatctatacagaggttgcatattcagttaagttttcttgcttttgactaattgtatttgtttccatttgttagctgtgtcagtgtgcatgctatgttatcaacatgcacttctttcgtcagatttcatccattttgttgaatacatagacgggtactgatgttt

SEQ ID NO: 32606 - protein, 380 aa, Panicum virgatum
  misc_feature: Ceres CLONE 1911789
  misc_feature (9)..(56): Pfam Name: F-box Pfam Description: F-box domain
MGSPKKSACAAADLTDDLIIEILSRLPAKSICRFKCVSWHWYGLITNPEHRKKIPQTLSGFFYPSDRWTPEDPVRTLPDFVDIVRDEEPFSDPSLTFMASYRSIIPKICCNGLLFCFCWKVSPRDECDLVVCNPATEKWVVVPDSVDESIALKYHFVFDPAISPHFQVFEITDADEDYGYIGDVNIYSSETGAWSCIGNGWGDELQLVDRGGVFLNGMLHLLTYDLKILAVDTKGKKWRTIPLLEPMTVSCFCRGPLAFIGQSQGRLYYINMRVGDTSKLSVWILEDYDSGEWIFKYNISTAQIFGEKNLMFERDYALVAIHPESNLVFFVCRCKDLLISYDMDRGKVSVSNLKEHLYNRPFLPYLPYVPFLKDSLAAQA

SEQ ID NO: 32607 - DNA, 753 bp, Panicum virgatum
  misc_feature: Ceres CLONE 1911794
  misc_feature: Encodes the peptide sequence at SEQ ID NO. 32608
actgccgctggaggctggagcatagacccagtccacactccacaccctcccacacgcgcttgtcctccctcgggatctcccgccgccgcctccggcgatctggcgagcgaaatgcccgcgcagccgccactgcccgccgccgttccccgccgccgatggcagaaacgcttcagccctacgctcgtgcgtgatcgctgctacacgcgctgcttccactccgcggggctccgccgggtcgctgtcccactccaggacggcgccgtcgtgcacctctggctcccgccggccgcgactactggggccgcccccctgcacccggtcctcctcctacacggattcggcgcgaacgccacctggcagtgggcccccttcctccgcccgctcctcgccgccggcctggccccctacgtcccggacctcatcttcttcggcgcctcctcctcccccgcggccgaccgctccccggcgtaccaggccgcctgcatcgccgcggccatgtcggcgctcccctccgcgccgcagcggtacgccgtcgtcggcgttagctacggcgggttcgtcgcgtaccacctcgcccacgcgttcccggcggcggtggagcggctcgtgctcgtcgcggcgggagtgtgcctccaggacgcagacctggcagcggggctcttcgctgtcgaggacatcgccgaggctgccagcctgctgctgccgcagcgggccggaagatctcagggaggctcgtggggctcaccttctgcc

SEQ ID NO: 32608 - protein, 213 aa, Panicum virgatum
  misc_feature: Ceres CLONE 1911794
  misc_feature: Useful for making plants with altered lignin content
MPAQPPLPAAVPRRRWQKRFSPTLVRDRCYTRCFHSAGLRRVAVPLQDGAVVHLWLPPAATTGAAPLHPVLLLHGFGANATWQWAPFLRPLLAAGLAPYVPDLIFFGASSSPAADRSPAYQAACIAAAMSALPSAPQRYAVVGVSYGGFVAYHLAHAFPAAVERLVLVAAGVCLQDADLAAGLFAVEDIAEAASLLLPQRAGRSQGGSWGSPS

SEQ ID NO: 32609 - DNA, 691 bp, Panicum virgatum
  misc_feature: Ceres CLONE 1911813
  misc_feature: Encodes the peptide sequence at SEQ ID NO. 32610
gtgctgtcgcctgtcgggttaggtgctaaatccaattcacaaaagtttccctggtgttcgttctcgcttcgcagaccaaaacaccctgctagagttttgctgcttttgtgttcctcaccgcacagattgccccgggttgatttcattcattcagttccgttcacttgaagctctgttttctttctttcattcgttgttgattcttgccggcagcggcgattcagcgcatggttgttcgcccgcacctgcgcggccgttgatcgcgacagcctcgtcgcagcggtcggaggagcagcgccggcggcgtccatggcggcggggtcgtcgaggcaagcggcggagaaggtggacaagtggatggcgttcccgtcgggcgccgacggcggcagcttcaccttcccgccgccgcgttccgggtcgggcggcggcaaggagatcgtggaggagccggcgtcgtcctctccgggcgccgccgccgccggaggcggcagctaccggcagccgtcgttccagcgcgggcgcgacagcggcggcgcgggcagcaccaagtcgtcgctggacggcgcgcgcggctcgggggagtcgtcgctgccgcgggtgtcgcaggagctcaaggacgcgctgtccaacctgcagcagaccttcgtcgtctccgacgcgacgcgcccggactgcccaatcatctacgcca

SEQ ID NO: 32610 - protein, 127 aa, Panicum virgatum
  misc_feature: Ceres CLONE 1911813
  misc_feature: SWISSPROT Homolog: EC 2.7.11.1 Non-specific serine/threonine protein kinase
MAAGSSRQAAEKVDKWMAFPSGADGGSFTFPPPRSGSGGGKEIVEEPASSSPGAAAAGGGSYRQPSFQRGRDSGGAGSTKSSLDGARGSGESSLPRVSQELKDALSNLQQTFVVSDATRPDCPIIYA

SEQ ID NO: 32611 - DNA, 642 bp, Panicum virgatum
  misc_feature: Ceres CLONE 1911813-R
aattgctagtagcaacacttattgacctggatgccatggatggaaaaagaagtgtttccttgatagctgaatgttcaagctctccagacgttaatactaggaaagccctagctaatgcattggctacagctccatctatgtggactctggggaacgctggcatgggtgcacttcagagattggctcaagatcccaactatgctgttgctagggctgcatcaagagccattgatgaactcaaaaagcagtgggaacttgaagaaggcgacagcctgaggtttgtaatgaaccaaaatttggtttctgagggaactgatgatgaaaattcagcagcagacgacacaacgtgaggtgcaaacaagatgaaaaatttcagttccaaaagtaccatgtaccaaagcataacaaaacatcatgagctgcacataaggcattccagtgtgagctttaggactgaagatcagatagacatgtaaggaaatctcacatataagtcgaagggggaaaaaacaatcatgtgctctgcgagcagaattcatgtctaggacaaagtaatttcagggaacagcgtaaataggagaagtctgttccctttggacattgttttcgtatatgaaagcaaaaggttacttcctctgttcc

SEQ ID NO: 32612 - DNA, 700 bp, Panicum virgatum
  misc_feature: Ceres CLONE 1911840-R
  misc_feature: Encodes the peptide sequence at SEQ ID NO. 32613
cagattcgccttcctcccaatggcccagctgatgggaagaacaaggacgacccgatgtgcaggatcatgaacaggaaggtgataatgaacttggaagaccctgctgctgccggcgtccacgacgacccgcgttatcagaacgtcacacgtctcaccgcccgcaacttccccatcctcgagtccctgcgattgagtcccgagagaggaactgtaagccagaacgcaattgttgcaccacactacaacataaactctcaagatgtggtgctgctgacccggggaagcgtccgagtgcaggttgttgataacgacggggtggcggtgttcgacggcgagcttcgtcaggggcagctgcttgtcataccacagtactacgtcgtcctacgcaaagcaggggcagatggttacgaatacatcttgttcaggaccaacgccaaccctctgataatcaacatggcagggccgggatccgtcctgctggccttgccggtcgatgtcatcgcagtttcctacaatgtctccacgacagatgccaagaagattaagaacagtgggagcaacgaggaacccatatgaactcgactgatatgattgcaacaatatatcagccaagtatgtacgtctagctatatgccaaagcgataggcgatattgcgatgaatactggctactaaagtaaataaatcatggcaagtgtgtc

SEQ ID NO: 32613 - protein, 191 aa, Panicum virgatum
  misc_feature: Ceres CLONE 1911840-R
  misc_feature (37)..(179): Pfam Name: Cupin_1 Pfam Description: Cupin
QIRLPPNGPADGKNKDDPMCRIMNRKVIMNLEDPAAAGVHDDPRYQNVTRLTARNFPILESLRLSPERGTVSQNAIVAPHYNINSQDVVLLTRGSVRVQVVDNDGVAVFDGELRQGQLLVIPQYYVVLRKAGADGYEYILFRTNANPLIINMAGPGSVLLALPVDVIAVSYNVSTTDAKKIKNSGSNEEPI

SEQ ID NO: 32614 - DNA, 723 bp, Panicum virgatum
  misc_feature: Ceres CLONE 1911840
atttcccaaattcttagctatccaccccttcttcctcaaatccaccaagctcacctccactctcttcctcttctctatccatgccagcggcagtggtggcagcccagctcccctcccctctgctttcctccacaagcagcactggcgcccctctcctttgcctcccactgaggtctggcagccatggctccgagcagagctagctcccttgcctcgcttcccctggagcaccaaaatttaagggagacacacacccgcgcagcacctagccctcggcatcgggcggcgggagggggcacgggctcatggcgctggctcgtcggcgccgccggcaggagctgcgccagctcgacggcgcatcggcgggagggggcatggacggcatgccggcgggagggggctgcgggtcttgacggcgcaccggcgggagggggcgagcagtgcgggaaaggaggctctgcgggagggggaggccaagattacgagtgcgagacatcgacaaatatgcctagaaagggggaatggattccgagcggaggtagatggcaagcctcttgggtgccggtttctgccctttctctcttttttttaccgatccaaatacagatggtgagcctgttgaagatgctcttgcatcgctatttcctatcttttgagtataatttcatcctgcaattgtatgcttaaaaattctacttcccctcgtttttttatacagtgacc

SEQ ID NO: 32615 - DNA, 536 bp, Panicum virgatum
  misc_feature: Ceres CLONE 1911841
  misc_feature: Encodes the peptide sequence at SEQ ID NO. 32616
gaaccactcgcagccgaatccccccgcacggctgctcgctcgctccggccatggcgcgcgccggcgtctccaccgcgccgctctcccgcctgcactccctgccgcctccgcgtcccgcgctcctccaccgctaccagcagcccggcccccacgtcgtcctccgcccccagcgcagggctcccagcaccgccgccgcggcgctgccgacggccgcggacctcccgccgctctccctgcccgcggctgcggccgcggccgcggcgctggcggcggcggtttcgctccccgaccccgagcgcaggcggcgcgcgcaagccgaggccgcgggcggcggcgacaaggaggccgtccgcgcctacttcaactcgacgggcttcgagcggtggcacaagatctacgggtcggcgacggagggcgtgaaccgcgtgcagctggacatccgggagggccacgcgcagacggtggccaaggcgctggccatgctccgcgactcgccgctgcagctggcgggcgcgacagtgtgcgacgccgggtgc

SEQ ID NO: 32616 - protein, 161 aa, Panicum virgatum
  misc_feature: Ceres CLONE 1911841
  misc_feature: SWISSPROT Homolog: EC 2.1.1.11 Magnesium protoporphyrin IX methyltransferase
MARAGVSTAPLSRLHSLPPPRPALLHRYQQPGPHVVLRPQRRAPSTAAAALPTAADLPPLSLPAAAAAAAALAAAVSLPDPERRRRAQAEAAGGGDKEAVRAYFNSTGFERWHKIYGSATEGVNRVQLDIREGHAQTVAKALAMLRDSPLQLAGATVCDAG

SEQ ID NO: 32617 - DNA, 1235 bp, Panicum virgatum
  misc_feature: Ceres CLONE 1911866
  misc_feature: Encodes the peptide sequence at SEQ ID NO. 32618
gcactcgacggacgcgccgcccgaccaacccgctcgagcgctgccgctcgccgttgccggcgacgagccgccgcccgccggaaggaggagtgccggctgcaatctccgaaaagcgaggtccagataagcagaaacaaacagtgcctacatcttccatggcactcgtcgtgatgtgtgggcagccttgcagcggcaaatcagccgctgctgcttgccttgctgctgcactgcgcacctcctcaacagaccttattgtccgtatcattgacgagtcatcactccatctcagacgcaatgatagctacaaagatatggtcgtggaaaaaaacttgagaggagttcttagatcagaagttgacagatcggtgtcacgagacagcataattattgtcgactcactgaacaatattaaggggtaccgatatgagctgtggtgtcttgcacgtgcatctggagtaagatattgtgtgcttttttgtgatacagaagtggaccattgtagggaatggaacagtaaccgccaggagaaaggagaaccagcatacgatagtaatatatttgaagatcttgtgaggaggtttgagaatccagataggcgtaatcgttgggattcccctctttttgaattgtttccatccagagatgaaatagtggaatcagctcctgtcattgccgaggctgtgtcgtatttgacaaaggaggtggattcaaaaacaagagatgtaaaagttctccaacctacaattgccactcagactgtgagaacatcagaggctaattccctttatgagatggacaaagcaacacaggaagtggtgaatgcaattgttgaagcacaatcctgtggtcttgggctggccatgaacaagatttctattggacctaacttgccaactatcaatcttcaaagatctgttggcctgcctgagctccgaagcctgcgacgaactttcattaagctggcggggcagtacagcctgagtggcccaccaccgccgactgatgccgatagtgcaaagaggatgtttgttgactacttaaaccgtgaagttggtgcttgatgggttttcctctctgatgcataaataatttgggggctaacatatacttttagtggcgttgactagactgcctgccctgattgtatcttcggtataggatttcaataatgctgatatcatacaggaattcatgtactttgtgtaaaacacaaaattctagggaaactgaacttg

SEQ ID NO: 32618 - protein, 301 aa, Panicum virgatum
  misc_feature: Ceres CLONE 1911866
  misc_feature (1)..(296): Pfam Name: KTI12 Pfam Description: Chromatin associated protein KTI12
MALVVMCGQPCSGKSAAAACLAAALRTSSTDLIVRIIDESSLHLRRNDSYKDMVVEKNLRGVLRSEVDRSVSRDSIIIVDSLNNIKGYRYELWCLARASGVRYCVLFCDTEVDHCREWNSNRQEKGEPAYDSNIFEDLVRRFENPDRRNRWDSPLFELFPSRDEIVESAPVIAEAVSYLTKEVDSKTRDVKVLQPTIATQTVRTSEANSLYEMDKATQEVVNAIVEAQSCGLGLAMNKISIGPNLPTINLQRSVGLPELRSLRRTFIKLAGQYSLSGPPPPTDADSAKRMFVDYLNREVGA

SEQ ID NO: 32619 - DNA, 711 bp, Panicum virgatum
  misc_feature: Ceres CLONE 1911869
  misc_feature: Encodes the peptide sequence at SEQ ID NO. 32620
gagaagacgagaacaccatggcccttccccccctccccgtcgcctctccgcccaaccgccgacgtgaatcccggtgaccgcgcgcgtgggcggaagttgcttgcttcagttaggtgggagatcgaggtcgctcccgtgtcccacacgctactaaacgccgccccgacgggttccggcgctttggactggctcggcctggccactaccgccccgtctctgcgcttgtgcggtggttggagtgcgggtgctggttgttagaaggatcgtcaagcctacccggattgaggggaagtagggggcgtgtccgagcagggctttccctgttagcaggaagtacaacagtcaagacggtaccaaggtggtgctaataccctttcatagaatcatgagtgagacagggtacacagtacaagtcactaacctctctagcagggtatctgaaagcgatcttcatgagttcttttcgttctctggtcctattgagcatatagaacttatcagagcgggagaatacggctctactgcttatgtgacattcaaggaacgctatgccctggaaactgcagcattgcttagtggggctactattgtggatcagccagtatgcataacttattggggacaacctgaggagacttttaatttctgggacaggccaagttgggaggttgaggaggaaatcgaatacaggaactaccaagcgtgccagtt

SEQ ID NO: 32620 - protein, 108 aa, Panicum virgatum
  misc_feature: Ceres CLONE 1911869
  misc_feature: Useful for making plants with modulated biomass
MSETGYTVQVTNLSSRVSESDLHEFFSFSGPIEHIELIRAGEYGSTAYVTFKERYALETAALLSGATIVDQPVCITYWGQPEETFNFWDRPSWEVEEEIEYRNYQACQ

SEQ ID NO: 32621 - DNA, 696 bp, Panicum virgatum
  misc_feature: Ceres CLONE 1911869-R
  misc_feature: Encodes the peptide sequence at SEQ ID NO. 32622
tccactactacctccatgttatgacacagaaacagccatcaattgaccatggatcatcagacgctcagtgtggttcatccaatgtgtttgatcctcctgttgaaggacacgctgcaaactacagtgtgaatggaggtgtctctgttggtcataatgggtgcaatgggcagaatggaagtagcgctgctcccaatattgcaagaccaaacatggagtgtgttaatggcaccatgagtaaaaatgtggctggaggtggtagtggaagtggaagtggcaatgacatgtatcagaatcggttccctcaacgagaagctgcattgaacaaattcagattgaagcggaaagatcggaacttcgataaaaaggttcgataccaaagcaggaagaggctggctgagcagcggccacgggtccgtgggcagtttgtgcgacaatctggacaagaagataaagcaggccaggattcagagagatgacacaagcctactaatacaaaagggtgttttcttcgtcggcagatctgagaattaggcaggtctttgcattgccgatagcagtccattgattcccaacgctagagtactcatcaataaataagaacccagttatcatttatatggctgactccagatgaagatcagagtgctatgaaattaatctgtgtaatatttatgggttttaatgtgttatagatgc

SEQ ID NO: 32622 - protein, 157 aa, Panicum virgatum
  misc_feature: Ceres CLONE 1911869-R
  misc_feature (102)..(146): Pfam Name: CCT Pfam Description: CCT motif
HYYLHVMTQKQPSIDHGSSDAQCGSSNVFDPPVEGHAANYSVNGGVSVGHNGCNGQNGSSAAPNIARPNMECVNGTMSKNVAGGGSGSGSGNDMYQNRFPQREAALNKFRLKRKDRNFDKKVRYQSRKRLAEQRPRVRGQFVRQSGQEDKAGQDSER

SEQ ID NO: 32623 - DNA, 732 bp, Panicum virgatum
  misc_feature: Ceres CLONE 1911889
  misc_feature: Encodes the peptide sequence at SEQ ID NO. 32624
ggccaggaagcttctcaagtatcatcgctcattgggtgttcaggttgtaataggtggcacacggttacctcaagagcaacggagcatgcaagctaacccatgtcagattcttgttgctacccctggaaggcttaaggatcatcttgagaacacacctggattctcgactcgaatcaaaggtgtcaaggttcttgttcttgatgaagctgaccgcctattggatatgggattcagaagagatattgagaaaataattgctttcattcctaaagaaaggcagacactacttttttctgctactgttccagaagaggtccgtcaaatttctcatgttgcaatgagaaaggattatgagttcattaacactgttcaagagggtgatgaggagacacattcacaggtaaaccagatgtacatgatcgcaccgcttgacctgcacttctatatattgtatgatgtattgaagaagcataccgcagaagatgcagagtacaaagtgattgtattctgtactactgcaatggtcacgaaacttgtagctgaggtgctttcccagctaaaacttaatataagagagattcattccagaaagtcacagtctgcgagaactaaggtctcagatgaattcaggaaagtcaagggccttatattagtcagttctgatgtatctgcccgtggtgtagattatcctgatggttacccttgttatacaggcttggcctgcctgctgat

SEQ ID NO: 32624 - protein, 243 aa, Panicum virgatum
  misc_feature: Ceres CLONE 1911889
  misc_feature (1)..(108): Pfam Name: DEAD Pfam Description: DEAD/DEAH box helicase
ARKLLKYHRSLGVQVVIGGTRLPQEQRSMQANPCQILVATPGRLKDHLENTPGFSTRIKGVKVLVLDEADRLLDMGFRRDIEKIIAFIPKERQTLLFSATVPEEVRQISHVAMRKDYEFINTVQEGDEETHSQVNQMYMIAPLDLHFYILYDVLKKHTAEDAEYKVIVFCTTAMVTKLVAEVLSQLKLNIREIHSRKSQSARTKVSDEFRKVKGLILVSSDVSARGVDYPDGYPCYTGLACLL

SEQ ID NO: 32625 - DNA, 714 bp, Panicum virgatum
  misc_feature: Ceres CLONE 1911933
  misc_feature: Encodes the peptide sequence at SEQ ID NO. 32626
ctctctcttcccagtccgctcggccaccagctttgaccgcctcctccgctcctgctcctccccatcccactcccccgcaggagcggcggcggcggcggctaggcgtaccccccacctcggcgagcggcaccggcggcggcgaaggcaagatgttcgggcgcgcgccgaagaagagcgacaacaccaagtactacgagatcctcggggtgcccaagtccgcgtcccaggacgacctcaagaaggcctaccgcaaggccgccatcaagaaccaccccgacaagggcggcgaccccgagaagttcaaggagcttgcacaagcttatgaggttttgagtgacccagagaagcgtgagatttatgatcagtatggtgaagatgccctcaaggaaggaatgggtggaggaggagcccatgtagatccatttgacatcttctcatcattctttgggccctctttcggaggaggtggtggcagcagcagaggcagaaggcaaaggaggggagaagatgttgtgcacccacttaaagtttctctagaggatctttacaatggtacctcagagaagctctcgctttcgcgtactgtcatctgctcgaagtgcaagggcgagggctccaagtctggtgcttcaatgaggtgcccaggttgccagggttcaggtatgaaggtcaccatccgccagctgggtccttccatgatacagcagatgcaga

SEQ ID NO: 32626 - protein, 188 aa, Panicum virgatum
  misc_feature: Ceres CLONE 1911933
  misc_feature (13)..(71): Pfam Name: DnaJ Pfam Description: DnaJ domain
  misc_feature (135)..(188): Pfam Name: DnaJ_CXXCXGXG Pfam Description: DnaJ central domain (4 repeats)
MFGRAPKKSDNTKYYEILGVPKSASQDDLKKAYRKAAIKNHPDKGGDPEKFKELAQAYEVLSDPEKREIYDQYGEDALKEGMGGGGAHVDPFDIFSSFFGPSFGGGGGSSRGRRQRRGEDVVHPLKVSLEDLYNGTSEKLSLSRTVICSKCKGEGSKSGASMRCPGCQGSGMKVTIRQLGPSMIQQMQ

SEQ ID NO: 32627 - DNA, 1314 bp, Panicum virgatum
  misc_feature: Ceres CLONE 1911937
  misc_feature: Encodes the peptide sequence at SEQ ID NO. 32628
atcattaaatttgtcaatatcgagaagcaaattcaaacaaatggttcaatgcctaaggtcccaggcatatttggaactgacattgcttccactttcccttttggaagcgtcatgtcgatagtatgatgcatccatactatcggagtttgggcaagttatttggttgcttgggaacatcgttgagtacattgctttctgtgcattttttcacttttaccgttctactgcatgttgtcttttgagttcctcacgtctgaagtgaaatattttctactgtggttttccaatgttttgatgcttgttggtatatgacctagtcactatttgctgttttagtttctatgcacttatacaagatgtatatagatcttcactgttggcttatcatgagttcatgacaatgagcatgcatgttgctaggtttcttctgttcattagcaatgaacgcaggaggaccttttgttgcccttgattattgttacactaagtggactatactcaggccttgtgccaagtattttcaaatatgcttgtagaataaatgaatacttttgttgttttattactatataattttttagtttaaacaaaaatccaagatacagaaacatgtgtcatattatcaatgacttctatgtgttgcaggtgacagatatctgaagccatggataattccagtccctgaggtaacaatagtacctcgggcgaaggatgatgaatgtctagttcttgccagcgatggcctctgggacgtaatgtcgaacgaagaggtatgtgatgttgcccgcaagcggatacttctatggcacaagaagaatggcacaagctcatcatcagccccacgggtcggtgattctgcagaccctgctgctcaagcggctgctgaatgtttgtcaaagcttgctcttcagaaagggagcaaagacaacatcaccgtcgttgtagttgacctgaaagcacaacgtaagttcaagagcaaaacctaacccaggatgactcgatgaacaactgcagcgacaagttgttaggaacatataatttggagaatccaaatttggtcagttttagtccgctatcagtagtacattacttagcccagttctttcttttcttggttctttttaagccatttgggctgccaagggatgtatcccacgtatatggtacagattgcgaccatcagggtttatgtttcctggtcgcagtgatggttcgttgccctgtattcttttttgtcaagctgggcgtccatgtatctggcaatgtatattcgagcttgtagggtgcaaaagaaacgagtgttataaagggttc

SEQ ID NO: 32628 - protein, 76 aa, Panicum virgatum
  misc_feature: Ceres CLONE 1911937
  misc_feature: SWISSPROT Homolog: EC 3.1.3.16 Phosphoprotein phosphatase
  misc_feature: Useful for making plants with modulated drought sensitivity
MSNEEVCDVARKRILLWHKKNGTSSSSAPRVGDSADPAAQAAAECLSKLALQKGSKDNITVVVVDLKAQRKFKSKT

SEQ ID NO: 32629 - DNA, 620 bp, Panicum virgatum
  misc_feature: Ceres CLONE 1911938-R
  misc_feature: Encodes the peptide sequence at SEQ ID NO. 32630
gcggcggcgacgcccccaggatcgacttcaagaccggtgtggaccacttctgcctcccccccggcggcacggcggtgatcgaggcggtgaagcagagcctgggcctggacgacggcgacgtggagccgtcgcggatgacgctgcaccggtgggggaacacgtcggcgagcagcctgtggtacgtgctgtcgtacatggaggccaaggggcggctcaaggtcggggacagggtgctcatggtgacgttcgggtcggggttcaagtgcaacagctgcgtgtgggaggtgaccggggacatggccgacaagggggcgtgggcggactgcatcggcagctacccgccggagagcctcgacaacccatacatggtcaagtttggctggatcaacgacgtcgaaggcgacgcattgatgctctaattgggctaatttggcaaccacgcacactttattgccttattggtacagcacagtaaagctgatgataacaacggaatcagtgaaaagcacgcacacatacgtccttcagtttcaacagcctttagcttttgggaacagaaatgtgtagcctccagtcagtggcagcatataaaatctgaaaaaaatatatactgttagtac

SEQ ID NO: 32630 - protein, 138 aa, Panicum virgatum
  misc_feature: Ceres CLONE 1911938-R
  misc_feature (7)..(95): Pfam Name: ACP_syn_III_C Pfam Description: 3-Oxoacyl-[acyl-carrier-protein (ACP)] synthase III C terminal
  misc_feature: SWISSPROT Homolog: EC 2.3.1.119 Icosanoyl-CoA synthase
  misc_feature: The sequence is a functional homolog of SEQ ID NO 2 in US patent 7038112
GGDAPRIDFKTGVDHFCLPPGGTAVIEAVKQSLGLDDGDVEPSRMTLHRWGNTSASSLWYVLSYMEAKGRLKVGDRVLMVTFGSGFKCNSCVWEVTGDMADKGAWADCIGSYPPESLDNPYMVKFGWINDVEGDALML

SEQ ID NO: 32631 - DNA, 733 bp, Panicum virgatum
  misc_feature: Ceres CLONE 1911938
acgcgggccggggcccacagaaaattaattacttcctcacacgctctctctctcgcgagtcttgcccgttctcgtccccaattacagacgccgccgtagcgagcccccgagatcctcgccccgctgccgccgggaaccgccgttctcctcgcgctgccggggaggcggctcgggcctacgcccgatgatcgccccgccgccgacaggaaccaccgatctccacgcgccgccggggaggcggatcgggcctacgcatgacgctcgcgccgccaccgtcgggaaccgctgatctcctcgagacgcaggggaggcggctcgagcctacttccggcacttgccgctgctatggtggggtggagcggtggcgagggcatcgagatccagacgcgggacacgactgttggagcgccatgccgcgcagcgtgcggggtgcccaacgaaggagacgggggtgttggtgcctgtggagaagcgcagtggcgaccggcacagcgaagggggttggggccatggcgaagcggatgatggaaccgaacgcgcaacgaggattgaagggtcagtggcctccattggaccggacaggaagtgatacctggtgaatcatcgccccttgctcccctccccccttcttcatgttatcttctcacatgcctcttcaacccttcccttttctctggatctgagttcagtaagctgatgagggcggagccatggcagagtgtagttgaatcgg

SEQ ID NO: 32632 - DNA, 547 bp, Panicum virgatum
  misc_feature: Ceres CLONE 1911967
  misc_feature: Encodes the peptide sequence at SEQ ID NO. 32633
accgcctccaaacactgtgacctcgccgcgaacaaacagcccatctcgatatcgctcagatgaactactcggctttagctacgctccaagtcactccgccacgctcctaccggccgccatggctatgcaggacgctgtcctcccttgcacactctccggccccacacagcgcaagggacaacctcgccgccgtggtgaaggacacagctttcctcaccgtacaccaaaaaagcacccagaagccgcgtgttccgtcgctttcggtgcgggcgcaggccgaggcgacagatcccgtggccaccccgggggccaacaccagcacgtccgccaacaagaagacgctgcggcggggggtggtggtgatcacggacgcgtcctctgggctgggcctggcggcggccaacgcgctggcggagacgggcgagtgacacgtcgtcatggcgtgccgcgacttcgtcgaggcggccaaggcggccaacggcgccggtatggcggatggcagctacagcatcatgcacctggacctggcctccctcgacagcgtccg

SEQ ID NO: 32633 - protein, 122 aa, Panicum virgatum
  misc_feature: Ceres CLONE 1911967
  misc_feature: SWISSPROT Homolog: EC 1.3.1.33 Protochlorophyllide reductase
MNYSALATLQVTPPRSYRPPWLCRTLSSLAHSPAPHSARDNLAAVVKDTAFLTVHQKSTQKPRVPSLSVRAQAEATDPVATPGANTSTSANKKTLRRGVVVITDASSGLGLAAANALAETGE

SEQ ID NO: 32634 - DNA, 734 bp, Panicum virgatum
  misc_feature: Ceres CLONE 1911970
  misc_feature: Encodes the peptide sequence at SEQ ID NO. 32635
atactaatcctcaggcaactcagcttcccctctcgccgccggcgccgccaatcccacgcccgcgtgtcctccggccggatccgccttcctccccgcacggcaggctcaggcttcggcgctcggagatgccatggagcttgaggaggccgcaacggagcgtgggagctcgggtggcgacgcggaccggctcagcgcgctgccggacagcctcctccacaccgtcatgtccttcctcaaggcccggcaggtggtgcagacgtgcgtgctgtccgcgcgctggaggcacctctggcgctccgtgccgtgcctcgacgtcgaccacgacgagttcaggaactcggtggcaagtgctcccagcaaccaccctgcggccatcaatgatttctctgactccgacgttgacagctatgaagactcagaggacgacaatgatgacagcgacgacaacagacaaagggagtgggagaattttgatgacttcgccgagagcctgatgcaccgcttcaacgttgctcagttggattccttgaggctgcgtgttaatagggccaaggcgcccagctttgcagacagacaagcaggtgggtggctgcgtcgcgcgatgaagtactgcaccccggatcctccccgcgagggactgagctccagttcttggcgccctcagaggctgtatctctgcaatgtggctctggaagatcatttcgcggagcatgtcgggtcagtgtgccactcat

SEQ ID NO: 32635 - protein, 201 aa, Panicum virgatum
  misc_feature: Ceres CLONE 1911970
  misc_feature (18)..(65): Pfam Name: F-box Pfam Description: F-box domain
MELEEAATERGSSGGDADRLSALPDSLLHTVMSFLKARQVVQTCVLSARWRHLWRSVPCLDVDHDEFRNSVASAPSNHPAAINDFSDSDVDSYEDSEDDNDDSDDNRQREWENFDDFAESLMHRFNVAQLDSLRLRVNRAKAPSFADRQAGGWLRRAMKYCTPDPPREGLSSSSWRPQRLYLCNVALEDHFAEHVGSVCHS

SEQ ID NO: 32636 - DNA, 662 bp, Panicum virgatum
  misc_feature: Ceres CLONE 1911972
  misc_feature: Encodes the peptide sequence at SEQ ID NO. 32637
aacgctttccctatcttctccattccctccgcccccacttctctctgccgccaacgatattgcggcactgctaaaaaaaaaacgatattgcagcaagctccgaggcaacgaaaaggaagccgatcagatcgaacaacatccatcgttccgtccatgggaaggcgggagatgagcgggcggctgtcggccgagtaccagggcctggaggtgaaggtgcccagcctcttccggtgccccatctcgctggacgtcatgcggtcgccggtgagcctctgcaccggtgtcacctacgagcgcgcctccatccagcgctggctcgactccgggaacactacctgcccggccaccatgctcccgctcccctccacggaccttgttcccaacctcaccctgcgccgcctcatcgcgctctgggcgtccactgccgcgcccgcctctccctcctcctcatcgtcgccccccgcggcgtccgccgtcggtcccacgccggccgccgccgcggctgagctccttcgccgggtcgccggccccggcgccgacccctgccccccgctccggaagctcgcggcttttctaaacgacgacgacgtggacgagttcgacaagaacgcgttcgcgagggcggccggcgccgcggagaccgtggcgtctgtgctccggcg

SEQ ID NO: 32637 - protein, 169 aa, Panicum virgatum
  misc_feature: Ceres CLONE 1911972
  misc_feature (20)..(94): Pfam Name: U-box Pfam Description: U-box domain
MGRREMSGRLSAEYQGLEVKVPSLFRCPISLDVMRSPVSLCTGVTYERASIQRWLDSGNTTCPATMLPLPSTDLVPNLTLRRLIALWASTAAPASPSSSSSPPAASAVGPTPAAAAAELLRRVAGPGADPCPPLRKLAAFLNDDDVDEFDKNAFARAAGAAETVASVLR

SEQ ID NO: 32638 - DNA, 496 bp, Panicum virgatum
  misc_feature: Ceres CLONE 1911992
  misc_feature: Encodes the peptide sequence at SEQ ID NO. 32639
aaacacacacaagaactcgagtatcgcagtctcgcacgtttcagttcaggagcgggtgttcagtctgcagcgccaggggtttattagttattactcgctcattcacgcgcagcagccatcgctttcgccactccatgctctcactgttcgttgcgctggccacgctggtggccgccgctcgggctcagctgtcgccgacgttctacgcctcgtcgtgccccgccgcgctcgtcaccatcaagaccgccgtgagggcggccgtgctgctggaccggcgcacggccgcctccctgctccggctccacttccacgactgcttcgtgcagggttgcgacgcgtccgttctgctcgacgacacgggcaacttccccggcgagaagggcgcgggcccgaacgcggggtccctgaggcggttcggcgtcatcgacaccatcaagccctttaatcaacatagcaccatttatgccatttcaaatgattttggtgatcgaatgac

SEQ ID NO: 32639 - protein, 120 aa, Panicum virgatum
  misc_feature: Ceres CLONE 1911992
  misc_feature: SWISSPROT Homolog: EC 1.11.1.7 Peroxidase
  misc_feature: Useful for making plants with altered cell wall content and/or composition
  misc_feature: Useful for making plants with altered carbohydrate content
  misc_feature: Useful for making plants with modulated nitrogen use efficiency
MLSLFVALATLVAAARAQLSPTFYASSCPAALVTIKTAVRAAVLLDRRTAASLLRLHFHDCFVQGCDASVLLDDTGNFPGEKGAGPNAGSLRRFGVIDTIKPFNQHSTIYAISNDFGDRM

SEQ ID NO: 32640 - DNA, 719 bp, Panicum virgatum
  misc_feature: Ceres CLONE 1912004
  misc_feature: Encodes the peptide sequence at SEQ ID NO. 32641
atgggccaaatggccatctataacccgcggcgcactgcgcttcatcgtcctctcctcccctcccccctgccgtgcaccctcgctttccacaacaccaatccgcgaagcgcgaaccctactccgcgccgccgccgccgccatgagccgccaacctgaggttttgtgggctcagcgctccgagaagatttacttgactatctcattgccagatgcaaaagatgttgagctgaagactgaacctaagggcctcgttactttctcagctgttgcccatggggaaccttttagcttcactttggagctctttgattccatactgccagagggaagtaaaacaaagacaaagatgggcttgcgaaacataatctgttcaatccagaaggaaaagaaaggttggtggaagcgcttgctgaagtcagaggaaaagcatccatacatcaaagttgactggaacaaatggtgtgatgaggatgaagagtctgaagcctcgggggattcggatgatgactttgatggggccaatgaagcagatgaaagtgatgaagatgacgggatgctttatctccctgaccttgaaaagttaaggggcaagtgacttggctgctctggtgaaggaaagtaggtctgctgtaacaggttatcattgatgtgacagattagctctctattaacgtagttgttaatatccgcaaagcatctgcgatggcactagacttttg

SEQ ID NO: 32641 - protein, 151 aa, Panicum virgatum
  misc_feature: Ceres CLONE 1912004
  misc_feature (5)..(81): Pfam Name: CS Pfam Description: CS domain
  misc_feature: SWISSPROT Homolog: EC 5.3.99.3 Prostaglandin-E synthase
MSRQPEVLWAQRSEKIYLTISLPDAKDVELKTEPKGLVTFSAVAHGEPFSFTLELFDSILPEGSKTKTKMGLRNIICSIQKEKKGWWKRLLKSEEKHPYIKVDWNKWCDEDEESEASGDSDDDFDGANEADESDEDDGMLYLPDLEKLRGK

SEQ ID NO: 32642 - DNA, 764 bp, Panicum virgatum
  misc_feature: Ceres CLONE 1912005
  misc_feature: Encodes the peptide sequence at SEQ ID NO. 32643
acctccgctccgcagcgaccagcgagagagataggggggaaatctcaaccaccagcaggttgattgattcgcacacgaaaccaatcgcagtcaagtatcgtcccacgaagagggttctttgagattggtccttgggaaaccaatcgcagtcaagtaataatcgaagttggtccttgggatctccaattccaactccaaccgatttcttcttggattgctgcgtctcttgctctgctcgagatgctgtctctgagctgccccggggtgtccgtgagcaagaaggcgtttgatttggggaagctggcatcctgccgctgcagctggccagtcacgcgcgcggcagcggcgccgaggcggcggcgcacgccatgtgtttgcttcgttgccttacccgccacccagcctggccttgctgcagttggcgtgcccccgcagacaattcctactgcgacggcagcgagcgtccctgagcgcatttctgtttcatcgctgctggaggtcgtctcggacgacctgctgaacctcaacaacaatctcaaatcgcttgttggtgcagaaaatccagttttagtttctgcagcggaacaaatttttggtgctggtggaaagagattaagaccagctttagtttttctggtgtccagagcaactgctgaattagctgctttgtcggagctaactacagaacatcagcgcttggcagagataatagagatgatccatactgcaagtttaatacatgacgatgtcatagatgatagtgg

SEQ ID NO: 32643 - protein, 174 aa, Panicum virgatum
  misc_feature: Ceres CLONE 1912005
  misc_feature: SWISSPROT Homolog: EC 2.5.1.30 Trans-hexaprenyltranstransferase
MLSLSCPGVSVSKKAFDLGKLASCRCSWPVTRAAAAPRRRRTPCVCFVALPATQPGLAAVGVPPQTIPTATAASVPERISVSSLLEVVSDDLLNLNNNLKSLVGAENPVLVSAAEQIFGAGGKRLRPALVFLVSRATAELAALSELTTEHQRLAEIIEMIHTASLIHDDVIDDS

SEQ ID NO: 32644 - DNA, 581 bp, Panicum virgatum
  misc_feature: Ceres CLONE 1912007
  misc_feature: Encodes the peptide sequence at SEQ ID NO. 32645
aggcagacacctcgaagtcgaagagctagctggctagctagtcgccaccagcaatggcagccaagtggtggctcaccgcctccctgctgctctgcctcgccgcggccacggcggcggcgagaggagcgccccgcggcgactgcgacgacgccgccaccttcgcgtccgccgtcgccggggacgacggagacgacagcgccaccgccaacgccgtggaggaagccaagaccgccggcgtgttcggcggccggaccgggggcggcggcctcttcagcggcgtccccgaggacctgggcgggaccgtcacggggttggccccgcccggggggggcatcctcggcatggaccagtccaacgggacctgcggaaagcggctgctctccctcggggtggacaacaccgaagtgaaccggggtgctcacccgacgctgctggtgaccccgccggggctggtccagaacatctccggcgccatcctcgtcgaggatacgctcgagcactccgccgtctaccgccgctagatcgtcgacatcctgtgggagcatggcgtcctccccgggatcaacgtcgacgagggcctc

SEQ ID NO: 32645 - protein, 155 aa, Panicum virgatum
  misc_feature: Ceres CLONE 1912007
  misc_feature: SWISSPROT Homolog: EC 4.1.2.13 Fructose-bisphosphate aldolase
MAAKWWLTASLLLCLAAATAAARGAPRGDCDDAATFASAVAGDDGDDSATANAVEEAKTAGVFGGRTGGGGLFSGVPEDLGGTVTGLAPPGGGILGMDQSNGTCGKRLLSLGVDNTEVNRGAHPTLLVTPPGLVQNISGAILVEDTLEHSAVYRR

SEQ ID NO: 32646 - DNA, 740 bp, Panicum virgatum
  misc_feature: Ceres CLONE 1912016
  misc_feature: Encodes the peptide sequence at SEQ ID NO. 32647
tcgtcgattcgtctgcccttgagcccgagtcgtcgtcgtcgagggcggcggcggcggagtcgcggtagggcggaagccggcggcggagccatcgaggcctgcagggaggggccccgtacggttcacctgcgcccccaacacccctccgttgagtctagggcctcctgccccgccgcctcgtccggcgccaaaaccctaagcgggttttgtgccagtcagagttgagtcatggcggagcacttggcttcgatctttggcactgagaaggacagggtcaactgccctttttacttcaagattggggcttgtcgtcatggggatcgctgctcccgcctgcacaacaggccaaccatatcgccaactcttgtgcttgctaacatgtatcagcgccctgatatgataacccctggggttgatgctcaaggccaacctattgatcctgagaagatgcaggagcattttgaggatttctatgaggacatctatgaggagttgggcaagtttggtgagattgagaacctcaatgtctgcgacaaccttgctgaccacatgattgggaatgtctatgtccagttcagggaggaagaacaggcagctgcagcatacaatgctcttcagggccgctattattctggccgcccgataattgtggagtattctcctgtgactgacttccgggaagcgacctgtaggcagtttgagggagaacagctgcaccgtggtggctactgtaatttcag

SEQ ID NO: 32647 - protein, 170 aa, Panicum virgatum
  misc_feature: Ceres CLONE 1912016
  misc_feature (13)..(39): Pfam Name: zf-CCCH Pfam Description: Zinc finger C-x8-C-x5-C-x3-H type (and similar)
MAEHLASIFGTEKDRVNCPFYFKIGACRHGDRCSRLHNRPTISPTLVLANMYQRPDMITPGVDAQGQPIDPEKMQEHFEDFYEDIYEELGKFGEIENLNVCDNLADHMIGNVYVQFREEEQAAAAYNALQGRYYSGRPIIVEYSPVTDFREATCRQFEGEQLHRGGYCNF

SEQ ID NO: 32648 - DNA, 771 bp, Panicum virgatum
  misc_feature: Ceres CLONE 1912019
  misc_feature: Encodes the peptide sequence at SEQ ID NO. 32649
agtcagccagtactccagtatccacgaccacgcagcacctgcgagcacacagcttcgaccccttcttctcagcgcgcgagcgttgccctgtgtgtgttcgttagcagcaggctcggcggcacggatggcgcagtccatgctcatgtcgacgagcgtcagcggcggccgcgcgctgccgtcgctgcagtccggccggccggcgccgtacccgcggctcgcgctgccgtcggcgtgcaggcactctaggtccgtctccgtgaagaccctggccatcttcaacaagtccaaggccaagaccgcgccggcgaagaaggctcctgcgcccaaaccgaaggttgaggacgggatcttcggcacgtccggcgggatcggtttcaccaaggagaacgaactgttcgtcggccgtgttgccatgcttggttttgccgtgagtgctcaacaaacacttaattatacgctcatgttctgaagctgcatagactggagtcagtggaccattcatgcacgcttaggaagtaaacaaagacttttttatgcatcttcatactggtcaaccagtacccaccatctctgatatcatcacaaaaaaaaaacgtcgacctgcagcagaaaaggcgcagccatacatttcgcactgctgtaggatatcaccacattgctgagcttgtttccctccacacgaaattcagtcggcaacaagaggggggaaaggaaaataatttcgaacggtcaaaaaataaaaatcacagtagctaggcttgaagccaaaat

SEQ ID NO: 32649 - protein, 114 aa, Panicum virgatum
  misc_feature: Ceres CLONE 1912019
  misc_feature: Useful for making plants with modulated light quality response
  misc_feature: Useful for making plants with modulated nitrogen use efficiency
MAQSMLMSTSVSGGRALPSLQSGRPAPYPRLALPSACRHSRSVSVKTLAIFNKSKAKTAPAKKAPAPKPKVEDGIFGTSGGIGFTKENELFVGRVAMLGFAVSAQQTLNYTLMF

SEQ ID NO: 32650 - DNA, 661 bp, Panicum virgatum
  misc_feature: Ceres CLONE 1912081
  misc_feature: Encodes the peptide sequence at SEQ ID NO. 32651
aattgaacactctgccagcctactaaacactcgagctcgtcagtcagtcgccactcggcagtcggcactgcgccactgccgtccactcgagccaaagccatatccgcagtggcgatggcaatggcaacggcaacggcgtcccccgccgggcgcatggctgtcgccccggcgctcctcgcgctcgccgtgcttgtgctcgttctcgtcccggccgcggcggcgtgctcggcggcggaccgcgacgcgctgctgtcgatccgcgcggcgctgtcggaggcgcgcctgggcgtgttctcgtcgtgggcgggcaccgactgctgcgccggctggtacggcgtgggctgcgaccccaccgacggccgcgtcgccgacctctccctccgcggcgaggccgaggacgccgtgatggcccccgcggggcgcccggcgtcgggcgtcatgtccgggtacatctccgacgccgtgtgccgcctgggccgcctctcgtcgctcgtgctcgccgactggaagcagatctccgggcccgtcccgtcctgcgtcgccacggacctcccctacctccgcatcctcgagctccccggcaaccgcctcaccggcgggatccccccgtccgtcggcggcctctcccgcctcgccgtgctcaacctccccgacaactcct

SEQ ID NO: 32651 - protein, 182 aa, Panicum virgatum
  misc_feature: Ceres CLONE 1912081
  misc_feature (38)..(78): Pfam Name: LRRNT_2 Pfam Description: Leucine rich repeat N-terminal domain
  misc_feature: SWISSPROT Homolog: EC 2.7.11.1 Non-specific serine/threonine protein kinase
MAMATATASPAGRMAVAPALLALAVLVLVLVPAAAACSAADRDALLSIRAALSEARLGVFSSWAGTDCCAGWYGVGCDPTDGRVADLSLRGEAEDAVMAPAGRPASGVMSGYISDAVCRLGRLSSLVLADWKQISGPVPSCVATDLPYLRILELPGNRLTGGIPPSVGGLSRLAVLNLPDNS

SEQ ID NO: 32652 - DNA, 696 bp, Panicum virgatum
  misc_feature: Ceres CLONE 1912081-R
  misc_feature: Encodes the peptide sequence at SEQ ID NO. 32653
gggcgccgcgcggccgcgtctacgggcatcgtctgcggcaaggtgaccaagggcagcgtgccgtccaacttcaccctcaaggaccagaacgggaggcccgtgtcgctgaacaagttcaagggcaagccggtggtggtctacttctaccccgccgacgagacgcccggatgcaccaaacaggcgtgcgcgttccgcgactcgtacgagaagttcaagaaggccggcgcggaggtgctgggcatcagcggcgacgacgcggcgtcgcacaaggcgttcgcgcagaagtaccggctgccgttcacgctgctgagcgacgaggggaaccgggtgcgcaaggagtggggcgtgcccggggacctgttcgggacgctgccggggcggcagacctacgtgctggacaagaacggcgtcgtccagtacatctacaacaaccagttccagcccgagaagcacatcggcgagaccctcaagatcctgcagggcctctgagctctgcatccgtcgctgtaaacgtaccggaactgtatgtgatgaatgaagagcctgatagtttgtccagcgattcagtctgtcagactcactcgacccatttgatggtcgaccagcctgttcgtgcttgtcttgggcagcttcaggtgttgtagttcagtgaaccccaacagttctgtatatgcaaatgcaattcatccccattgc

SEQ ID NO: 32653 - protein, 162 aa, Panicum virgatum
  misc_feature: Ceres CLONE 1912081-R
  misc_feature (16)..(141): Pfam Name: AhpC-TSA Pfam Description: AhpC/TSA family
  misc_feature: SWISSPROT Homolog: EC 1.11.1.15 Peroxiredoxin
GRRAAASTGIVCGKVTKGSVPSNFTLKDQNGRPVSLNKFKGKPVVVYFYPADETPGCTKQACAFRDSYEKFKKAGAEVLGISGDDAASHKAFAQKYRLPFTLLSDEGNRVRKEWGVPGDLFGTLPGRQTYVLDKNGVVQYIYNNQFQPEKHIGETLKILQGL

SEQ ID NO: 32654 - DNA, 469 bp, Panicum virgatum
  misc_feature: Ceres CLONE 1912088
  misc_feature: Encodes the peptide sequence at SEQ ID NO. 32655
gtatctagcacataactacatagatagataggtaagtgaacactacaaaatggtggggaagggattgatcacggtcgtgatcgccctgatggtgctcgccgccagcgtcgtgggcaccgcgtcggcgcacgcggccgggctgaagaaggggttctacaacaagagctgcccgcgggcggaggacatcgcgcgggaggtggtgtgggcgcgcgtcgccggcagccgcgagctcgccgccaagttcctccgcatgttcttccacgactgcttcgtcaggggctgcgacgcgtcgctgctgctggactcgccgaccaacacggcggagaaggacgcgccgccaaacctgtcgctggccggcttcgacgtgatcgacgaggtgaaggcggcgctggagcgggcgtgccccggggtcgtctcctgcgcggacatcgtctcgctcgccgcgagggactccgtctcgtggcactac

SEQ ID NO: 32655 - protein, 139 aa, Panicum virgatum
  misc_feature: Ceres CLONE 1912088
  misc_feature (47)..(139): Pfam Name: peroxidase Pfam Description: Peroxidase
  misc_feature: SWISSPROT Homolog: EC 1.11.1.7 Peroxidase
  misc_feature: Useful for making plants with altered carbohydrate content
  misc_feature: Useful for making plants with altered cell wall content and/or composition
  misc_feature: Useful for making plants with modulated nitrogen use efficiency
  misc_feature: Useful for making plants with modulated phosphate use efficiency
MVGKGLITVVIALMVLAASVVGTASAHAAGLKKGFYNKSCPRAEDIAREVVWARVAGSRELAAKFLRMFFHDCFVRGCDASLLLDSPTNTAEKDAPPNLSLAGFDVIDEVKAALERACPGVVSCADIVSLAARDSVSWH

SEQ ID NO: 32656 - DNA, 697 bp, Panicum virgatum
  misc_feature: Ceres CLONE 1912099
  misc_feature: Encodes the peptide sequence at SEQ ID NO. 32657
tacggaagtctactcaaaagagagtaaaggtgctgtatcagctgttgcctctcttcaaggtcatctactgatagcttctggtcctaagatcacattgaacaaatggactggtgctgaattgactgctgttgcattctatgatgccccgttgcatgttgtgagcctgaacattgtgaaaaactttattttgtttggtgatattcacaaaagcatatattttcttagctggaaggagcaaggttctcaattgagtctgctggcaaaagattttgggtcacttgaatgttttgcaactgagtttttaattgatggaagcaccttgagccttgtagtttcagattctgataagaatttgcagattttctactatgctcccaaaatggtggagagctggaagggtcaaaagctcctttccagagcagagtttcatgttggagcacatgtgtcaaaattgttgagaatacagatgttgcccacacaaggattggtatctgaaaagacaaatcgttttgctcttgtatttggaacgtgggatggtggaattgggtgcattgcacctgttgatgaattgacatttcgtcggcttcagagcttacagaggaagcttgtagacgctgtcccccatgtgtgtggcctgaacccaagatcatttatgcattttaagtccaacggcaaggcacatcgacctggaccagat

SEQ ID NO: 32657 - protein, 231 aa, Panicum virgatum
  misc_feature: Ceres CLONE 1912099
  misc_feature (1)..(213): Pfam Name: CPSF_A Pfam Description: CPSF A subunit region
TEVYSKESKGAVSAVASLQGHLLIASGPKITLNKWTGAELTAVAFYDAPLHVVSLNIVKNFILFGDIHKSIYFLSWKEQGSQLSLLAKDFGSLECFATEFLIDGSTLSLVVSDSDKNLQIFYYAPKMVESWKGQKLLSRAEFHVGAHVSKLLRIQMLPTQGLVSEKTNRFALVFGTWDGGIGCIAPVDELTFRRLQSLQRKLVDAVPHVCGLNPRSFMHFKSNGKAHRPGP

SEQ ID NO: 32658 - DNA, 710 bp, Panicum virgatum
  misc_feature: Ceres CLONE 1912114
  misc_feature: Encodes the peptide sequence at SEQ ID NO. 32659
aaacctctcgaaagcacagaaccctagcttccctttcatctcccatccgagctcactctgccaccgccggtccgccgctaggcgctagttcgattcccacatccatggtgctcggcctgtatctcttcgccgatatcgccgccgacggcgctccccgcctcgacgcggccgccggggaggagctcgtccgcgtccagcgcgcctctgcgctcgcccttggctcccgcgcgccggagccacccgggaccctattcctcacaaccaggagagtgatctgggtcggtgagggtggcatgggctacgccgtggacttcatcgccgtctcgctccacgccgtgtcgcgcgaccctgaggcgtacccatccccctgcatctacacgcagattgagacagaagctggctccgatgaggagtttgatgaatcagattctgaagtaaatggagaaatagagctctcaaaagtcaatgagatgcgcatcataccatcggatcctggtcaattggacagactctttgaagcgttctcccattgtgctgagttgaaccctgatcctaatgctgcgggtgatgaagagaatggctgggttcatggtgatgaaggtgatgaagatatgacagatggaagcgatgcagagttttcagatgtcaaccccataggtcaaactgatgaccacaacattactcatgttgtagttgagctccagatagac

SEQ ID NO: 32659 - protein, 201 aa, Panicum virgatum
  misc_feature: Ceres CLONE 1912114
  misc_feature (44)..(119): Pfam Name: ICln_channel Pfam Description: Nucleotide-sensitive chloride conductance regulator (ICln)
MVLGLYLFADIAADGAPRLDAAAGEELVRVQRASALALGSRAPEPPGTLFLTTRRVIWVGEGGMGYAVDFIAVSLHAVSRDPEAYPSPCIYTQIETEAGSDEEFDESDSEVNGEIELSKVNEMRIIPSDPGQLDRLFEAFSHCAELNPDPNAAGDEENGWVHGDEGDEDMTDGSDAEFSDVNPIGQTDDHNITHVVVELQI

SEQ ID NO: 32660 - DNA, 1321 bp, Panicum virgatum
  misc_feature: Ceres CLONE 1912122
  misc_feature: Encodes the peptide sequence at SEQ ID NO. 32661
gaacactccccctgcccacttcgcttccactccccatttctcctctgctagggtttcctccccctccaaatcctcgccgcacggccatggcgaagacgaagcagggcaagaaggacgtggattcgtacaccatccgcggcaccaacaaggtcgtcagagttggcaactgcgtgcttatgcggccgtcggactcggacaatcagccgtacgtggcgcgggtggagaagatggaggccgacgggcgcggcagcgtgcgggtgcgggtgcgctggtactaccgccccgaggagtccaagggcggccgccggcagttccacggcgccaaggagctattcctctccgaccatttcgacctgcagagcgcccacaccatcgagggcaagtgtgttgtccattctttcaagaactacaccaagctcgacaatgtggggcccgaggacttcttctgccgatttgagtacaaggcggccaccggctcattcacccctgatcgcgtcgcagtgtactgcaagtgtgagatgccgtacaaccccgacgatctcatggtacaatgtgacgcgtgcaaggactggttccatccatcttgcatgggcatgaccattgaacaggcgaaaaagctagaccactttgtttgttcagactgtgtgaaggaaaatggaccaaagagactttcaaacggatatgctacgtccccaaattcggagcctaaggctgaatccaaaaggcagaggcggtaacagctcggagcgctagcatccatcgctgaggagatgcgctgcttctgcagcgaaccagcccgtcgcggttcacgagcgcggaggtctacagtgcagtatagctagtgtttgcggagcctccttaggctccgttgtctcttgggctgccaggcattatgtcctgttatcgggggaacggttttgttcgtttcagtcggtgtggcatgccgtacattgtgcggcccggcgtgttgttcttgtgaggtaaacagggggtacagccttgccatgttatctagtcgtccgactaattgcgattagtcgcgattagtcgggcttatcggtccggtgaccccgataagggacaccgagtaggtctgggcgactagttttctagtcgtccgactagtcgtcgactagtcgcgattagtcgcacgatcaggttggaaaacgatcagacttgagattgttttgtgggctgtttgagttgtgagcctcggccagcgatgggctggcaagctggcccattaggtttttggtatatagaggctgagagacaggaatagggactatgggacaggaatacagagttctggacagttcac

SEQ ID NO: 32661 - protein, 216 aa, Panicum virgatum
  misc_feature: Ceres CLONE 1912122
  misc_feature (21)..(136): Pfam Name: BAH Pfam Description: BAH domain
  misc_feature (140)..(189): Pfam Name: PHD Pfam Description: PHD-finger
MAKTKQGKKDVDSYTIRGTNKVVRVGNCVLMRPSDSDNQPYVARVEKMEADGRGSVRVRVRWYYRPEESKGGRRQFHGAKELFLSDHFDLQSAHTIEGKCVVHSFKNYTKLDNVGPEDFFCRFEYKAATGSFTPDRVAVYCKCEMPYNPDDLMVQCDACKDWFHPSCMGMTIEQAKKLDHFVCSDCVKENGPKRLSNGYATSPNSEPKAESKRQRR

SEQ ID NO: 32662 - DNA, 1399 bp, Panicum virgatum
  misc_feature: Ceres CLONE 1912134
  misc_feature: Encodes the peptide sequence at SEQ ID NO. 32663
gaccacacgtcgccacaccaccggcccgcccccaggacccttaccttgttcggccacgcgggccgtgctccgctttgcctccgccatttccgcatttagaagctccccccgccgcagcccagatagtttcttcttctttagccgcctgccaagatattattagtggtgtgatacatatttaagcagcggcaagtgaggcggggcggggatggcggcgggcggcggcgcggcggcgccgttcgtgtggaagacgtacatgatggtggaggatccagggacggacggggtcatcggctggggccgggggaacaacagcttcgtcgtcgccgaccccttcgtcttctcgcagacgctgctgcccgcgcacttcaagcacaacaacttctccagcttcgtgcgccagctcaacacctatggcttccgcaaggttgatccggaccggtgggagttcgcgcacgcgtcgttcctgcgcggccagacgcaccccctgcgcaacatcgtccgccgcggcagcagcgccgcgggaggaggcggcggcaagaggaaggacgccggctccgcggacgacatggccatggtggccacggaggtggtgcgcctcaagcaggagcagcgcgccatcgacgaccgggtggcctccatgtggcgccgcgtgcaggagaccgagcgccggcccaagcagatgctcgccttcctcctcaaggtcgtcggcgaccgcgacaggctgcaccgcctcgtcggcgacgccgccgcgccggacgcccccgccggcgaggcggccgccgccgcggagggcggcgagaagcgggccaggctgctgctcgacggcgacggcggcatcgggtccttcggccctgacgccgtcgacttcgccgggttctacagcggcggcggcgcgctcggcgacgtcgccgtggatgctcccggcggcggctcgttcgcgttcggcgtcgacacggggtactgactgtcacgccgacatgcgtgcggcgcctgttgtgtcagccgcttggcgccccgtttcgcggctgtgttctgccatttcttgccaccgccgtgactgtcactttggaacgccggagagcggcggcggccggcaatgactggaggggactagaagtcaaccgatgataactatttcgaccatgttacatggatgtctatttgaagcttttggtggatctgattctatgggctggggtgactcgagtcggtgtcgagatcatccagcctaaataaggtactaccgtgacggggtgtgaccgtgaaagttccatgaaagggtaggtttgatgttgtacatgcatgcttattgtagtggtcaagcccacagagtgcagcagcactagatattccaaactcttgtagatttgccgtatcctaagattgtttgtgtgac

SEQ ID NO: 32663 - protein, 252 aa, Panicum virgatum
  misc_feature: Ceres CLONE 1912134
  misc_feature (9)..(163): Pfam Name: HSF_DNA-bind Pfam Description: HSF-type DNA-binding
  misc_feature: Useful for making plants with modulated heat sensitivity
  misc_feature: The sequence is a functional homolog of SEQ ID NO 1233 in the 11/479,226 US patent application
  misc_feature: The sequence is a functional homolog of SEQ ID NO 144 in the 10/666,642 US patent application
MAAGGGAAAPFVWKTYMMVEDPGTDGVIGWGRGNNSFVVADPFVFSQTLLPAHFKHNNFSSFVRQLNTYGFRKVDPDRWEFAHASFLRGQTHPLRNIVRRGSSAAGGGGGKRKDAGSADDMAMVATEVVRLKQEQRAIDDRVASMWRRVQETERRPKQMLAFLLKVVGDRDRLHRLVGDAAAPDAPAGEAAAAAEGGEKRARLLLDGDGGIGSFGPDAVDFAGFYSGGGALGDVAVDAPGGGSFAFGVDTGY

SEQ ID NO: 32664 - DNA, 728 bp, Panicum virgatum
  misc_feature: Ceres CLONE 1912175
  misc_feature: Encodes the peptide sequence at SEQ ID NO. 32665
aaccggttcccattccaactcggattcctccccctccccctccctccctccatccccgtcgtctccctcgacccgccgccatggtccgcaccccgtcggcggccagcaagccgccgtgcgcggccttccactcccaccccaccgatctggagctcgtcaactcgtacctccgccctttcctcgagaccggcgaggccgccgccttcatccacaagggcgacgtctacgccgccgaccccgccgacctcacacggcagttcgcgccggcggtcgcccaggacggcgagcgcgcctggtacttcttcaccccgctgcgccacaagagcgtccgcgggaagcgcaaggcgcgcaccgtggccacgggggaggggtgctggcacaacgaggccaaatccaagcccgtctgcacggccatccacgagaagcgccagattgggtaccgccagagcttctccttcatcaagaaggacggcggcgcgcgggtccgcacggggtggctcatgatggagctccgcctcctcaaggacgacgccggccagcaggggccgcgggcggaggaggagagcgcgctggggaatctcgtcctgtgcaaggtgtaccgcagcccgcgcaaccccgagcccagcggcgggaaggaggaggaggccgccgacggcgacggcgagtctagcgccgcgacggcggacgacgacgacgacgacgacgacagctccgacgcgcctgggccc

SEQ ID NO: 32665 - protein, 215 aa, Panicum virgatum
  misc_feature: Ceres CLONE 1912175
  misc_feature (10)..(147): Pfam Name: NAM Pfam Description: No apical meristem (NAM) protein
MVRTPSAASKPPCAAFHSHPTDLELVNSYLRPFLETGEAAAFIHKGDVYAADPADLTRQFAPAVAQDGERAWYFFTPLRHKSVRGKRKARTVATGEGCWHNEAKSKPVCTAIHEKRQIGYRQSFSFIKKDGGARVRTGWLMMELRLLKDDAGQQGPRAEEESALGNLVLCKVYRSPRNPEPSGGKEEEAADGDGESSAATADDDDDDDDSSDAPG

SEQ ID NO: 32666 - DNA, 618 bp, Panicum virgatum
  misc_feature: Ceres CLONE 1912184
  misc_feature: Encodes the peptide sequence at SEQ ID NO. 32667
aacacaaacgcatcgagcacacgcacagagcagctcagcagagaactgagaagccaaagaagaacctctgcacgaatccggcttcgatccatcgacaggaacaccgcacaccgccagccagacacagccgatcaaggcgggttaccggcaatgggcgagttgatccctgggttgcccgaggaggtggcgcgggagtgcctcggccgggtgggcttcgaccagctgcccgtggggcgccgcatctcgcgccagtggaagtacggaggtggagtcgccggactaccaccgcctgcgccgggccgaggggctggcgcgcccggtgctctcgctggccaatgcgcgccccgccgcgccggccggagggaggaactgggcgttgatgttcttggtggcaaggacggccttagagccctcaaggaatcagatgagaagggctatcttgaagttgagaccgaagggttaaagcagctcacatccatgggcagccttgtgctttgctgtggggatggtgctgtcatgaactcgactaatctgggcttactgaggcatggtgtctccatttggattgacgttcctctcgagatggcagcgaacgatatgctgaagagcacaggaaca

SEQ ID NO: 32667 - protein, 155 aa, Panicum virgatum
  misc_feature: Ceres CLONE 1912184
  misc_feature: SWISSPROT Homolog: EC 2.7.1.71 Shikimate kinase
MGELIPGLPEEVARECLGRVGFDQLPVGRRISRQWKYGGGVAGLPPPAPGRGAGAPGALAGQCAPRRAGRREELGVDVLGGKDGLRALKESDEKGYLEVETEGLKQLTSMGSLVLCCGDGAVMNSTNLGLLRHGVSIWIDVPLEMAANDMLKSTG

SEQ ID NO: 32668 - DNA, 515 bp, Panicum virgatum
  misc_feature: Ceres CLONE 1912188
  misc_feature: Encodes the peptide sequence at SEQ ID NO. 32669
ccgtgggtggccgcgctctacgccgcctgcttcctcctctgcgtctgcgtcgtcaacaggtactggccagttcccgagcctcccggttgccctgacaacgaaaactctgaccactcgaaggccgccctcaagcaggtgtcacacactcccaaagtaattatggctttccataagacgatttcccactttgatatgctcctggctgctgcacaagctgcccaagcgatgagccagggcatgtcttcgattgattctcagggcgacccaggaatcatgcggcacaggatgtcttttggtatgggtgtattcaccacttttgatcactccaagcggagagactcgataaggctgacatggatgccacatggagatcacttactgagattggaagagaagggtgctgtcatccgttttgtcattggacgcagtgaaaatccgaatcccaataatgaggtggactctcgcaattgatgcacaacatagagaataccatgactttttgagacttaatcatg

SEQ ID NO: 32669 - protein, 156 aa, Panicum virgatum
  misc_feature: Ceres CLONE 1912188
  misc_feature: Useful for making plants with altered carbohydrate content
PWVAALYAACFLLCVCVVNRYWPVPEPPGCPDNENSDHSKAALKQVSHTPKVIMAFHKTISHFDMLLAAAQAAQAMSQGMSSIDSQGDPGIMRHRMSFGMGVFTTFDHSKRRDSIRLTWMPHGDHLLRLEEKGAVIRFVIGRSENPNPNNEVDSRN

SEQ ID NO: 32670 - DNA, 1293 bp, Panicum virgatum
  misc_feature: Ceres CLONE 1912189
  misc_feature: Encodes the peptide sequence at SEQ ID NO. 32671
gcaaaaccctagcttttcctcctcccctgctttgcggcgcgccacaagaacacaggcgcgggagagatagagagctatggatcggggcaaggacgccaacggcggcctggcggaggcgacggcgtcgcggctgaggtttgaatccgacgaggaggcggaggaggtggagggccccgacgcggagggagaggaggagcaggcggcggaggaggtgattggcagcgacaagaccagcgccgactactacttcgactcctactctcacttcggtattcatgaagaaatgcttaaagatattgttcggacaaaaacgtatcaaaatgttatcacccagagtagctttcttatcaaggacaaaatagtccttgatgttggtgctggaactggcattctttcacttttctgtgcaaaagcaggagctaaacatgtctatgcgattgaatgttcccagatggcagacatggcaaatgaaattgtgaaagcaaatggatattctaatgtcatcactgtaataaaagggaaagttgaagaaatagagcttcctgtcccaaaagtagatgttataatctcagagtggatgggttatttcctcctgttcgagaatatgttgaacactgtcctgtatgcacgtgataaatggcttactgatgatggagtggtcctaccggacagagcctctttgcatcttactgcaatcgaagatgcggaatataaggaagataaaattgaattttggaataatgtatatgggtttgatatgagctgcataaagaaacaggcaatgatggagccactggtagatacagtggacgcaaatcagattgtcactaactgccggttactgaagacaatggatatctccaaaatgacacctggggatgcttccttcactgtaccattcaagcttacggctcagcggaatgattatattcatgctcttgttgcatatttcgatgtgtcattcactaaatgccataagctgatgggcttctcaacaggcccgagatcaaaagccactcactggaagcaaactgttctttaccttgaggatgtaataacaatctgcgagggggaaaccctgacgggtagcatgacagttgcgcccaataaaaagaacccccgggacatcgacattaagctcaagtactcgataaatgggaatagatgccaggtttcaagaacacagttctacaagatgcggtgaccaaggtgcaaacgggagatgccccagagccccctaaattttgtttaactgagtatcttgtttggcagaaatgatgcctttttctcatg

SEQ ID NO: 32671 - protein, 375 aa, Panicum virgatum
  misc_feature: Ceres CLONE 1912189
  misc_feature: SWISSPROT Homolog: EC 2.1.1.125 Histone-arginine N-methyltransferase
MDRGKDANGGLAEATASRLRFESDEEAEEVEGPDAEGEEEQAAEEVIGSDKTSADYYFDSYSHFGIHEEMLKDIVRTKTYQNVITQSSFLIKDKIVLDVGAGTGILSLFCAKAGAKHVYAIECSQMADMANEIVKANGYSNVITVIKGKVEEIELPVPKVDVIISEWMGYFLLFENMLNTVLYARDKWLTDDGVVLPDRASLHLTAIEDAEYKEDKIEFWNNVYGFDMSCIKKQAMMEPLVDTVDANQIVTNCRLLKTMDISKMTPGDASFTVPFKLTAQRNDYIHALVAYFDVSFTKCHKLMGFSTGPRSKATHWKQTVLYLEDVITICEGETLTGSMTVAPNKKNPRDIDIKLKYSINGNRCQVSRTQFYKMR

SEQ ID NO: 32672 - DNA, 154 bp, Panicum virgatum
  misc_feature: Ceres CLONE 1912189-R
gaaccgaggaccccggagggcagaaaggacgcccggaccacaagcccagggagcaccaagcacggggcgggcagacccgggggaaaccagcgaagggagagaggagaggaaacaggcccgcagaagagggagcgccggagggcaaaacgggcag

SEQ ID NO: 32673 - DNA, 580 bp, Panicum virgatum
  misc_feature: Ceres CLONE 1912190
  misc_feature: Encodes the peptide sequence at SEQ ID NO. 32674
aattttccttgctgcgcttgtacgacttctatctagctgagcgcagctagatggtgtacgcgctcctgctggccgccttggcggccgtcgccgccgcaacggtgctccgccactacctcccgctggtcctcggcggcctcctcaacggcagcttctgctggcccctcatctgcgagaccatcgtcttcctccacgcgcagccgtccaacgccgccggcggcttcctcaaggagcacatcgccagctacgggaccgagttcaagtcgcacctcttcagctcgccggtggtggtctcctgctactaggagctcaaccacttcgtgctgcacaacgaggagcacctgttcgagtgcagctaccccggcgccctccgcaccatcctccgcgagtcctccgcgctggcggtcaccggcgagcgccaccgccagatgcggagcatgttcctcgccctcgtcgcctccacggggctcaaggcctcctacttcgccagcgtccacgagtccgcgcgctcactcatcagcgtcctggagcggcctcgagaccatcaccttctgcgaggaggcgaggaagttcccctaca

SEQ ID NO: 32674 - protein, 84 aa, Panicum virgatum
  misc_feature: Ceres CLONE 1912190
  misc_feature: Useful for making plants with modulated oxidative stress sensitivity
MVYALLLAALAAVAAATVLRHYLPLVLGGLLNGSFCWPLICETIVFLHAQPSNAAGGFLKEHIASYGTEFKSHLFSSPVVVSCY

SEQ ID NO: 32675 - DNA, 350 bp, Panicum virgatum
  misc_feature: Ceres CLONE 1912206
  misc_feature: Encodes the peptide sequence at SEQ ID NO. 32676
ctcctgactctctcggccgccccgacccccttccccctcccccgctccctatacacaggcaaagctcgggccggcgcggcgccgcccccaccaccccgggatggacacctcgcagacgtggctcaagttccaggacgagtgcattttggtggatgagcaggacaatgttgttgcccatgaatcccactcctgctgccctctgatggaacagattttgctccatagggctttcagtgtgttccttttcaactcccactatgacctgctactccgccgctagtccgccacccaggttacgtttcctttactttgcaccaactcctgctgcacccatcctctgtaccgtgagt

SEQ ID NO: 32676 - protein, 59 aa, Panicum virgatum
  misc_feature: Ceres CLONE 1912206
  misc_feature: SWISSPROT Homolog: EC 5.3.3.2 Isopentenyl-diphosphate Delta-isomerase
MDTSQTWLKFQDECILVDEQDNVVAHESHSCCPLMEQILLHRAFSVFLFNSHYDLLLRR

SEQ ID NO: 32677 - DNA, 723 bp, Panicum virgatum
  misc_feature: Ceres CLONE 1912211
  misc_feature: Encodes the peptide sequence at SEQ ID NO. 32678
acatcagcattcaagaactcatggcttcaactaagatagttcttggtgcaatcttcattgcttccttctacttatctgcctcccttgccttcccacctgatcaccatgagggtgcctatccagttggaaatgccccaatctcaagtctttctccagattactacaagttcacatgcccacaagctgatgagattgtggtgtctatactgaagaaggctatcgcaaaggaaccaaggatagctgcttcccttctcaggctcctatttcatgactgctttgttcagggctgtgatgcatcagttcttttggatgacactgaggaattcgtaagcgagaaaaatgctattcccaataagaattcaattaggggatttgaggttatagatgagatcaaagccgcacttgaggaagcatgcccacatacagtctcctgtgcagacactattgccctagcagcccgaggttcaacagtactgagtggtggaccatattgggagcttccattaggaaggagagattcaaagacagcaaacatgaagctagcaaataagaaccttcctcccccaaatgcaacactacaccgtcttatcaagttttaaggactggataaggtggaccttgtggcactatcaggaagccacacaatcggaaaggccagatgtgtgagtttcaaacagcggctgtacaatcagcatagagataacagaccagacataacgctag

SEQ ID NO: 32678 - protein, 192 aa, Panicum virgatum
  misc_feature: Ceres CLONE 1912211
  misc_feature (59)..(191): Pfam Name: peroxidase Pfam Description: Peroxidase
  misc_feature: SWISSPROT Homolog: EC 1.11.1.7 Peroxidase
  misc_feature: Useful for making plants with altered cell wall content and/or composition
  misc_feature: Useful for making plants with altered carbohydrate content
  misc_feature: Useful for making plants with modulated nitrogen use efficiency
MASTKIVLGAIFIASFYLSASLAFPPDHHEGAYPVGNAPISSLSPDYYKFTCPQADEIVVSILKKAIAKEPRIAASLLRLLFHDCFVQGCDASVLLDDTEEFVSEKNAIPNKNSIRGFEVIDEIKAALEEACPHTVSCADTIALAARGSTVLSGGPYWELPLGRRDSKTANMKLANKNLPPPNATLHRLIKF

SEQ ID NO: 32679 - DNA, 1318 bp, Panicum virgatum
  misc_feature: Ceres CLONE 1912212
  misc_feature: Encodes the peptide sequence at SEQ ID NO. 32680
ccatccgaaagccaaagcgagtcccaccagtcaaagagcgagttctagtagctttgctgatctgttctgctgtttttagtttggaaatcctttagttccggcgatcatggaggacgagaggaacacccagcaccaccaggtcggcgaggcccaggagaaggccgccgatcaggtggaggtgaaggacaggggcctcctggacacccttctcggcaggaagaagcccgaggaacaccaggaggaggagctggtgaccggcatggagaaggtcacggtgtccgagcctcagaagcacggcgagcacaagaaggaggagcacgagaccggggagaagaaggagagcctcctcgccaagttgcaccgcaccagctccagctccagctcgtcgagcgacgaggaagaggaggtgatcgacgagaacggagagattgtgaagaggaagaagaagaagggcctcaaggagaagatcaaggagaagctacccggccacaaggaccacgccgagggcgaccaccacacggccgtgccggccccggcgcccgcgcccgtgggaacgcacgcttacaaggaggaggagcacaagccgtacgggggcccggcgcccgtggggacgcacgcttacaaggaggacgagcacaagccgtacgtgccggccccggctcccccgcccgcggtggagacgcacgtccaccaccacgaccacgccgtcgtcgtccrgaaggtcgaggacgactccccaccggcgccggaggaggagaagaagggcctccttgacaagatcaaggagaagctccccggcggccacaagaagccggaggacgccgccgccgccgcgcccgctgtccacgcgccagcgccggcgccgcacgcagaggacgtgagcagcccggacggcaaggagaagaagggcctgctgggcaagatcatggacaagatacccggctacaacaagggctccggcgaggaggaccacaaggccgccgccggcgagcacaagaccagctcttcttaagatggcccgcgcgtcgtgaccttgatcggaagcgtttgtttgccgtgcgtttggttctgctttgctttattaagtttgtttcaagatgggattgcgcggtcaaggtccggtgtgttgaggcccggccagtactggtagcgagagtattgctggcttgctgcttgtgttcgctctggtacgggctttagtttggttccgagtcagggactggaagttgttgagtttgttgaattattatcaacagttgcgtcggtattgtaattgtaattcggctgggctacctggggattatgccttaacatttat

SEQ ID NO: 32680 - protein, 301 aa, Panicum virgatum
  misc_feature: Ceres CLONE 1912212
  misc_feature (39)..(296): Pfam Name: Dehydrin Pfam Description: Dehydrin
  misc_feature (204)..(204): Xaa is any aa, unknown, or other
MEDERNTQHHQVGEAQEKAADQVEVKDRGLLDTLLGRKKPEEHQEEELVTGMEKVTVSEPQKHGEHKKEEHETGEKKESLLAKLHRTSSSSSSSSDEEEEVIDENGEIVKRKKKKGLKEKIKEKLPGHKDHAEGDHHTAVPAPAPAPVGTHAYKEEEHKPYGGPAPVGTHAYKEDEHKPYVPAPAPPPAVETHVHHHDHAVVVXKVEDDSPPAPEEEKKGLLDKIKEKLPGGHKKPEDAAAAAPAVHAPAPAPHAEDVSSPDGKEKKGLLGKIMDKIPGYNKGSGEEDHKAAAGEHKTSSS

SEQ ID NO: 32681 - DNA, 1212 bp, Panicum virgatum
  misc_feature: Ceres CLONE 1912230
  misc_feature: Encodes the peptide sequence at SEQ ID NO. 32682
atctcccacctctcggcgaatccgcagcagctggcggcagcatccgccaaagcccaattccaccttatccggcggggggcgagaaagggtggttcgaaagatcctcccacccacccacccacccaccgggccgccggttactgggagcagacctgggcggtgctgcagctaccggctggccgagtcgcgcctccgccagaaaagcgatgggctccggtcccgggacagcagcctcggtcaatcccggcgcctcgagtcaactggcacggccctccacctacgccttcacacgcgcggcgccggcggcggagaagaaggcgatggggaggcgggaggcggcgtgagcctgcgagcctcgggggcgcggcggcgagcgagacctcagactgacggagtattttggggaataatactctgcttgtttcactgcgttactccactagaggacctgcttccgctcacaaaattagcatttcaccacaacttgctgctagtatcgagccttgataggctgctcaggcaaagttttccaaggaactactctgatgctacagtggtaagagaaggaagatggagctgctcagcatcattctaattgtcgcatcactcgtcccattctcagcatctgatcgtcaaggtgatgccttgtatgatatgaagctgaaactaaatgctactggcagtcagcttgccgactggaaccaaaatcaagttaacccctgcacctggaattctgttatttgtgacaataataacaatgttgtgcaagtaacattggcttctatgggatttactggagttctgtcaccaagaattggagagctggagtatttgaatgttctgtccttgcctggtaacaacatcactggtggcataccagagcagtttggtaacctctcttgcttgacaagcttagatttggaagacaacctgttggttgggccaataccagcctctcttggccagctttcaaagcttcagcttctgatactgagtcaaaacaacctcaatggatctattcctgaaacgctagcaagtatctcaagcttgacagacatccggctagcttacaataaactcactggtcaaatacctcctcggttgtttcaagttgcacgttacaatttttctggtaataacttgacctgtggagcaaacttcctccatccatgtgcctcaagtgtgtcttaccaaggttcatcaaagggttcg

SEQ ID NO: 32682 - protein, 213 aa, Panicum virgatum
  misc_feature: Ceres CLONE 1912230
  misc_feature (19)..(59): Pfam Name: LRRNT_2 Pfam Description: Leucine rich repeat N-terminal domain
  misc_feature: SWISSPROT Homolog: EC 2.7.11.1 Non-specific serine/threonine protein kinase
MELLSIILIVASLVPFSASDRQGDALYDMKLKLNATGSQLADWNQNQVNPCTWNSVICDNNNNVVQVTLASMGFTGVLSPRIGELEYLNVLSLPGNNITGGIPEQFGNLSCLTSLDLEDNLLVGPIPASLGQLSKLQLLILSQNNLNGSIPETLASISSLTDIRLAYNKLTGQIPPRLFQVARYNFSGNNLTCGANFLHPCASSVSYQGSSKG

SEQ ID NO: 32683 - DNA, 697 bp, Panicum virgatum
  misc_feature: Ceres CLONE 1912232
  misc_feature: Encodes the peptide sequence at SEQ ID NO. 32684
ctctctctctctgcgaccgggcggggcgaaccctagccgagattagattggaggcgagcgccaccatcggcggaggacgacgacgacgacgacaagatgctgagggttgcggggaggaggctctcgtcttccctctcctggcgccccgccgcggccgctgccaggaacccgcttgccggcgctggcgcccccggcggggacgacgactccgcccgcggccggagccagccgcggttctccatcgagtcccccttcttcgccgccgccaggggtttctctttctcttcaactgaaacacttgtaccaaggaaccaagatgctggtctggctgacctcccagcaactgtggctgctgtgaagaaccctaacccaaaggtggtttatgatgagtacaaccatgaaagatatcctcctggagatcccagcaagcgtgcctttgcttactttgtcctgagtggtgggaggttcatttatgcgtcactgctgcgtctcctcatattgaagtttgtcctgagcatgtcagcaagtaaggatgtgcttgccctcgcttcacttgaggtggacctctccagcatcgaaccaggcaccacggtgactgtgaagtggcgtgggaagccggtcttcatcaggcgccggactgaggacgacatcaagctggccaacagtgtggacatcgtgtccctgcgccacccagagc

SEQ ID NO: 32684 - protein, 200 aa, Panicum virgatum
  misc_feature: Ceres CLONE 1912232
  misc_feature: SWISSPROT Homolog: EC 1.10.2.2 Ubiquinol--cytochrome-c reductase
MLRVAGRRLSSSLSWRPAAAAARNPLAGAGAPGGDDDSARGRSQPRFSIESPFFAAARGFSFSSTETLVPRNQDAGLADLPATVAAVKNPNPKVVYDEYNHERYPPGDPSKRAFAYFVLSGGRFIYASLLRLLILKFVLSMSASKDVLALASLEVDLSSIEPGTTVTVKWRGKPVFIRRRTEDDIKLANSVDIVSLRHPE

SEQ ID NO: 32685 - DNA, 668 bp, Panicum virgatum
  misc_feature: Ceres CLONE 1912253
  misc_feature: Encodes the peptide sequence at SEQ ID NO. 32686
tcgcgagctcaaagcggtcaagactcaagacaagaggcgttaaagcagagagcttcgaagcgaaccttccagaagagccccccgccgcagcctcctcgaggccacgaccccgacgcggtggcgccgtccacgccccagccaccccagggtctctcccgccgccgcaccgcctccgccgaccaccagccgagtccgtcgggggccgcgaccgccagcctcgccgccgccctcgcgcgcgagcgtatctggcgccgcggcgaggggaacgcgggccctgaggagcgggaggccctgcccttctggcagaggacctggttcctcgcgctgctgctggcgatggccgccgcgtcgttcgcgctcgctatcctgctgtacctcggcctcgacctccacgaggccgcgccggcgcagtcctacgctgccgacccggatgccgtcgttgagattacatacgggtcagtgatcaagttgatgcatgagaggaccaagtttcggctgcattctcacgacgtgccttatggatctggcagcggccagcagtcggtcaccagcttccccaacgtcgacgacgccaatagctactggattgtgagacctcagccaaattcttcagcaaaacaaggtgatcccattacacatggaactataataaggcttcaacacatgag

SEQ ID NO: 32686 - protein, 110 aa, Panicum virgatum
  misc_feature: Ceres CLONE 1912253
  misc_feature: SWISSPROT Homolog: EC 2.4.1.109 Dolichyl-phosphate-mannose--protein mannosyltransferase
MAAASFALAILLYLGLDLHEAAPAQSYAADPDAVVEITYGSVIKLMHERTKFRLHSHDVPYGSGSGQQSVTSFPNVDDANSYWIVRPQPNSSAKQGDPITHGTIIRLQHM

SEQ ID NO: 32687 - DNA, 1364 bp, Panicum virgatum
  misc_feature: Ceres CLONE 1912256
  misc_feature: Encodes the peptide sequence at SEQ ID NO. 32688
gaatccaaccccacctcagccgcagcgcggcgccccccccggaatcccagcgccggtgcgcgcacggcacccgcagggcgcggcgcggccatggacatggacagcgtggagtgtctctccctcccggacgccgccatggacgtggacgacgtcgacacccacccgcaccacggccaccacgcccacctcggcctcccgctccaccccgcccacctgccctccgccggggccggccgcgcgttccccaaggtgaatgccggggccggcgcggcggcggcggcggctgctgctgctgccgcggctgcggcgggggcagcggccgcggcaggagcgggcgggggcccgccggcgaccagcgtgcacgagctgctggagtgccctgtctgcaccaactccatgttcccgcccatccatcagtgccaaaatggacatactttgtgttcgacgtgcaaggccagggtgcataaccggtgccctacatgcagacaagagcttggtgatatcagatgcttggcactggaaaaagtaacggagtcactagagcttccctgtaagtactgctcttttggttgccccgagatcttcccgtactacagcaagataaagcatgaagcacagtgcagcttcaggccgtataattgcccttatgctggctctgaatgtgctgtatctggtgatattccattccttgttgcacatttgagggatgatcacaaagtcgacatgcacagtggctgcacattcaaccatagatacgtcaaatccaacccacgagaggttgaaaatgccacatggatgctaacagtattccattgttttgggcagtacttctgcctgcactttgaagctttccagctcggaatggctccagtttatatggctttcctccgatttatgggggatgagaatgaagcaaggaactatacatacagcctagaggttggtggtaacggtaggaaaatggtatgggaaggcactccaaggagtatccgtgatagccaccgcaaggttcgggacagccatgacggcctcatcatccagaggaacatggcactgttcttctcgggcggtgataggaaagagctgaagctgagggtgactggccggatctggaaagagcaaaccaacccggacggagcctgcattccgaacctttgcagctgagcaaaggaaacgattgaaaagagagagaaaagattgtgctacttggctggcttgttatttcaaaattgccatgttgttgtgttttcattatagtatgtggctgttgcaatgttgtaccgtaagcgaaattttaggatgtaaaatgttcttgtaaagtaattgtgtataacaaatccaagaaatcatacaagttggcccac

SEQ ID NO: 32688 - protein, 357 aa, Panicum virgatum
  misc_feature: Ceres CLONE 1912256
  misc_feature (138)..(337): Pfam Name: Sina Pfam Description: Seven in absentia protein family
MDMDSVECLSLPDAAMDVDDVDTHPHHGHHAHLGLPLHPAHLPSAGAGRAFPKVNAGAGAAAAAAAAAAAAAAGAAAAAGAGGGPPATSVHELLECPVCTNSMFPPIHQCQNGHTLCSTCKARVHNRCPTCRQELGDIRCLALEKVTESLELPCKYCSFGCPEIFPYYSKIKHEAQCSFRPYNCPYAGSECAVSGDIPFLVAHLRDDHKVDMHSGCTFNHRYVKSNPREVENATWMLTVFHCFGQYFCLHFEAFQLGMAPVYMAFLRFMGDENEARNYTYSLEVGGNGRKMVWEGTPRSIRDSHRKVRDSHDGLIIQRNMALFFSGGDRKELKLRVTGRIWKEQTNPDGACIPNLCS

SEQ ID NO: 32689 - DNA, 745 bp, Panicum virgatum
  misc_feature: Ceres CLONE 1912282
  misc_feature: Encodes the peptide sequence at SEQ ID NO. 32690
cttcctcctcatctgccctcgattccgttcgtgggcgtgttctccgtggcccgaggaccgcccgatcctgacgcttgtggtggtttcgctttgcgcgcagatctgctgtacaaggactacaacacgcaccagaagttctccttcaccacctgctccccccacggcgtcgcaatcacagccgcaggaacaaggaaaaatgagtccatatttggcgagcttcacacccagattaagaacaagaagttgacagttgatgtcaaagcaaactcagagtcagatcttttgacaacaatcactgtggatgagtttggaacgccagggctcaaatcgattctcagcttggttgttccagaccagagatcaggaaagcttgagctccagtacttgcatgcatttgctggtgtgaatggaagcattgggcttaatcccaaccctatggttaacttttctggtgtctttggaagcaaagcactctcggttggcgttgatgtttcatttgatacggcaactagcaatttcaccaagtacaatgcggcactgagccttaccaatccagatcttattgcttccctccatttgaataaccatggtgataccatggttgcatcctactaccacttggtaaagcatcattcaggcaccgctgtcggggctgagctgtcacacagcttctctagaaatgagagcacgctgatctttggttctcagcattcgttggatccccacaccatcgtaaaggcacgct

SEQ ID NO: 32690 - protein, 248 aa, Panicum virgatum
  misc_feature: Ceres CLONE 1912282
  misc_feature (19)..(248): Pfam Name: Porin_3 Pfam Description: Eukaryotic porin
  misc_feature: Useful for making plants with modulated drought sensitivity
LPPHLPSIPFVGVFSVARGPPDPDACGGFALRADLLYKDYNTHQKFSFTTCSPHGVAITAAGTRKNESIFGELHTQIKNKKLTVDVKANSESDLLTTITVDEFGTPGLKSILSLVVPDQRSGKLELQYLHAFAGVNGSIGLNPNPMVNFSGVFGSKALSVGVDVSFDTATSNFTKYNAALSLTNPDLIASLHLNNHGDTMVASYYHLVKHHSGTAVGAELSHSFSRNESTLIFGSQHSLDPHTIVKAR

SEQ ID NO: 32691 - DNA, 1118 bp, Panicum virgatum
  misc_feature: Ceres CLONE 1912288
  misc_feature: Encodes the peptide sequence at SEQ ID NO. 32692
gatcctcttcacatctcagtccaaatacccattttgctcaactaaaaaaaaaaatcccactttctgctgggaggagcgactgtacagcacatggcggcagccaccggctacggcgacgccccgacggaggaggagctgctcgcgtacggcgacctgcccaggcacggccgcgacatggcggaggtttttgccgtgcgcgtccctgcggctgccgccgccgccggtggaggaggaggagacaggtccccgccttgcggcaccatcttcttctacggcggcaactcctgcagcgaccttatctacagccgggaatggagcgtgaccgacgagcccgccgccccgcaaccctgcccctgcgacagcgagggcaacctcgtgctgaccggcccgtcagtgaccacctcggcgtacggtccagtcggcttcgacttccaactccacgacggcaaccacggcgagtcctccttgcaggccgacgacagcggcggcgacgaccaggacgacagcaacaccgggagggtattctgcgacaccgtctccggcgagttctccacctacgacagggtcataacggagacggtcgccaccgggtacggccccgcggacgtagtctacgccgtcctcagcaacgccgtccaaggccgggtcgccgtgaagctcaccgctctccctgccggaggcggagacggcgatggcgccgccgcaactggcgttcacgggagggtcatcgcccgcagcaagctcttggacgccggctgcgtgctcttctacagcgagcgcgacggcgagggcgttcctgtgcaacccggggagctggtgccgctggcgaggcaagcgctcgcggtgccacttcacaagccgctgacgatcgagctgaacctgcgcggcgactccggcgagaagattgtcaaaggcgccgtccagttcgatccggcgatcaccggagagcatgttgagcgtgtcgtcggcacgagtggcgcagaaatcgaagttacagtctcatggtcaaactacccttggtagatcgagcccattatccattagttatatgtgcgagtggggctatgtactctcaaataatctaaaatggttacaaataagaatcttttgatatggct

SEQ ID NO: 32692 - protein, 310 aa, Panicum virgatum
  misc_feature: Ceres CLONE 1912288
  misc_feature: SWISSPROT Homolog: EC 3.2.2.22 rRNA N-glycosylase
MAAATGYGDAPTEEELLAYGDLPRHGRDMAEVFAVRVPAAAAAAGGGGGDRSPPCGTIFFYGGNSCSDLIYSREWSVTDEPAAPQPCPCDSEGNLVLTGPSVTTSAYGPVGFDFQLHDGNHGESSLQADDSGGDDQDDSNTGRVFCDTVSGEFSTYDRVITETVATGYGPADVVYAVLSNAVQGRVAVKLTALPAGGGDGDGAAATGVHGRVIARSKLLDAGCVLFYSERDGEGVPVQPGELVPLARQALAVPLHKPLTIELNLRGDSGEKIVKGAVQFDPAITGEHVERVVGTSGAEIEVTVSWSNYPW

SEQ ID NO: 32693 - DNA, 1546 bp, Panicum virgatum
  misc_feature: Ceres CLONE 1912289
  misc_feature: Encodes the peptide sequence at SEQ ID NO. 32694
ggagacccaccaccaaacgagtccaaatccgccggcgacgccattcgcctcaggccctccgccgagcaggagcccccaacccgtccaagcggctgcaggagcgcgggggccggacgagcgcctcccaaatttagtagccgcggagctcgtggcgcgtgggcgtttgccgtggcgcgaggagcgggggagggtcaatggggtacctgccgtccctgggcagcaaggcggcgcacttcgtgtccgacctcacgaccgtcatcctcaaccccgtctccgagcgcgagagctcccacctccccgaggttgatgaagtgcaagaaaattcggaggatggtaacgattctgagcacaactcttacagccttgatggccctgacacgtcttcctttagagcattcttgatctcatttttgtcgtcatctagctctaataataacgattcaatggagatacttcctgaacaaaatgtggacatgagttacccaactttgacacccatggggaagggaagcaagggaaggtcaggtctgataagtagagggaagcattcaattggaaaaattattaacaaggcagctaggattggtggttttaaacaagctactgcagcgcctaaaattgacagggagacagtaaatcataccgaaccagttgcacctgttttggagcttgaggaaacaaaggaagttgcttctgtcagtagtttgccaactatgtcagaaccatctgttcttttgtcagaaatgatgcaatcaattctctatacctctctccctgttcttgcccagggaaggaactgggtgttgctatacagcacatggaggcatggcatatctttatctactttatataggaggagcatgctttgccctggtttctcacttttggtagtgggggataagaaaggcacagtttttggtggtttagttgaggctccattgcagccatccagttcaaagaagtatcaggggaccaataattgctttgttttcactaatttacatgaccgccctgttatatatcgtccgaccggtgcaaataactatttcaccgtgtgctccactaactatttggctctgggaggaggaggtcattttgcactctatctagatggagacctcttgactggttcaagttctaattcagagacttttaacaacgagtgtttatcgcattccccagacttctccgtgaaagatgttgagctgtggggcttcgtctatccttccaagtatgaggagatgctcacactctgccggactgagaaaccaggaatttgtcgatggtgatcgccagtcggaattcgcaatcaatcaatcatagacatgctgcacatctgtacagttttcagtagactccgtgagttgcgagcattttttttatcttcttctttagtgcgcagggcaaagtaggagtactggacttgcttttctcaagccagtttgctcagatttgtaaataccgtactttgtaatttttcatgctgtcactttgctcagatttgtaaataccgtactttgttgttccagcgctatcatttcgatgc

SEQ ID NO: 32694 - protein, 364 aa, Panicum virgatum
  misc_feature: Ceres CLONE 1912289
  misc_feature (204)..(342): Pfam Name: TLD Pfam Description: TLD
  misc_feature: Useful for making plants with altered protein content
MGYLPSLGSKAAHFVSDLTTVILNPVSERESSHLPEVDEVQENSEDGNDSEHNSYSLDGPDTSSFRAFLISFLSSSSSNNNDSMEILPEQNVDMSYPTLTPMGKGSKGRSGLISRGKHSIGKIINKAARIGGFKQATAAPKIDRETVNHTEPVAPVLELEETKEVASVSSLPTMSEPSVLLSEMMQSILYTSLPVLAQGRNWVLLYSTWRHGISLSTLYRRSMLCPGFSLLVVGDKKGTVFGGLVEAPLQPSSSKKYQGTNNCFVFTNLHDRPVIYRPTGANNYFTVCSTNYLALGGGGHFALYLDGDLLTGSSSNSETFNNECLSHSPDFSVKDVELWGFVYPSKYEEMLTLCRTEKPGICRW

SEQ ID NO: 32695 - DNA, 780 bp, Panicum virgatum
  misc_feature: Ceres CLONE 1912291
  misc_feature: Encodes the peptide sequence at SEQ ID NO. 32696
accggcaagtccatgcccctcctccccaccgccatggcctccccattctccaccttctcccccacctccgccgcgagggccctcctcccggcctccacctcccgccctctctccctcgccgccgcagcctcctcagggcgcgttccgccgtccaggaaggggctcgggttccgccgcggccggttcaccgtctgcaatgtcgcagcccccaccgccgccgagcaggaggcgacggcgtcgggcgccaaggagagccagcgccccgtgtacccgttcgcggcgatcgtggggcaggacgagatgaagctctgcctgctgctcaacgtcatcgaccccaagatcggcggcgtcatgatcatgggcgacaggggcaccggcaagtccaccaccgtgcgctccctcgtcgacctgctcccggacatccgcgtcgtcgtcggcgaccccttcaactccgacccggacgacccggaggtcatgggccccgagatccgccagcgggtcctccagggggacaccaccctccccgtcaccaccgccaagatcaccatggtcgacctgcccctcggcgccaccgaggaccgggtctgcggcaccatcgacatcgagaaggccctcaccgagggcgtcaaggccttcgagccgggcctgctcgccaaggccaacagggggatactctacgtcgacgaggtcaacctgctggacgaccacctcgtcgatgtgctgctggattctgccgcatcggggtggaacacggtgggagaggggagggtatctccatat

SEQ ID NO: 32696 - protein, 248 aa, Panicum virgatum
  misc_feature: Ceres CLONE 1912291
  misc_feature: SWISSPROT Homolog: EC 6.6.1.1 Magnesium chelatase
MASPFSTFSPTSAARALLPASTSRPLSLAAAASSGRVPPSRKGLGFRRGRFTVCNVAAPTAAEQEATASGAKESQRPVYPFAAIVGQDEMKLCLLLNVIDPKIGGVMIMGDRGTGKSTTVRSLVDLLPDIRVVVGDPFNSDPDDPEVMGPEIRQRVLQGDTTLPVTTAKITMVDLPLGATEDRVCGTIDIEKALTEGVKAFEPGLLAKANRGILYVDEVNLLDDHLVDVLLDSAASGWNTVGEGRVSP

SEQ ID NO: 32697 - DNA, 734 bp, Panicum virgatum
  misc_feature: Ceres CLONE 1912301
  misc_feature: Encodes the peptide sequence at SEQ ID NO. 32698
ggttggagatgctctaatccccacgcggccgcaacctctcttcctcgatagcacgacggcgcggaatttgctcttgcccctccgccgctgatggggcggcgacgtgtgcttcgttctcctccggctgtggcgcaacggaccgagccttgtcttaatcttccgccggaattagtccgcagtatagcggacaacttggggaattatggaatgatgatggtgctgtttgagacgccttctggctttgcaattctaactattgatggggtgtgcctgtaccttccagatgccatggagaatatctgggcaaacttcacagttggttatagagcacgagatgttgtttggctcaaggaatttaaaacttttaaggacaagtccagcgccattaggcttgatactggtgttgacagcaagctgtctaagatgatcatgaagtggcgccgtcgtgggcagacgttggttgttgggaaacctgaatataaaacaatcatagaaatgaacatgggtatacgctgcctgtgtgatgaaagtgtgatgaaggtgatgtggggtctcaagaatatcatgcctactttagtacctgaagaaaaatcacggctgactagggaggaccgccttcccatgagtcaaggactaataaagttcctgaatcgttatggcttttatatcgaaccagagatggttaatgagcagattattctggcagcctgtaccttgcttgattgtgaacttat

SEQ ID NO: 32698 - protein, 214 aa, Panicum virgatum
  misc_feature: Ceres CLONE 1912301
  misc_feature (41)..(108): Pfam Name: NOP5NT Pfam Description: NOP5NT (NUC127) domain
MGRRRVLRSPPAVAQRTEPCLNLPPELVRSIADNLGNYGMMMVLFETPSGFAILTIDGVCLYLPDAMENIWANFTVGYRARDVVWLKEFKTFKDKSSAIRLDTGVDSKLSKMIMKWRRRGQTLVVGKPEYKTIIEMNMGIRCLCDESVMKVMWGLKNIMPTLVPEEKSRLTREDRLPMSQGLIKFLNRYGFYIEPEMVNEQIILAACTLLDCEL

SEQ ID NO: 32699 - DNA, 710 bp, Panicum virgatum
  misc_feature: Ceres CLONE 1912306
  misc_feature: Encodes the peptide sequence at SEQ ID NO. 32700
agccagccagagccccacagccccagccgcggccgcctcgacccctcgacgcgccgctagcgaccgacgagccggcgaccaggcgcgcgatgggcagcctcggcggcgaggagcggccggcggaggggcggaggggcccgcgcttcctgtgcctgcacggcttccgcaccagcgccgagatcatgcgcaagcaggtgctggggaagtggcccgccgacgtcaccgcgcgcctcgacctcgtcttcggcgacgcgccctgccccgccgagggcaagtccgacgtcgacggcatcttcgacccgccgtactacgagtggttccagttcgaccaggatttcgcggagtacaggaatttcgacgagtgcctggcctacatcgaggagctgatgatcaaatatggtcccttcgacggccagatgggtttctcccagggtgccattctatccgcggcgcttcccgggctccaagaacgagggctggccctgactagagttcccaagatcaagtacctgataatcatcggcggcgccaagttcctgtctccggccctggccgagaaggcgtacgccagcaagatcgcatgcccctcgcttcacttcatcggtgacaacgacttcctgaaagtccatggtgagaagctcatagaatcatgcgtggacccgttcgtaattcgtcacccaaagggccacacggttccaaggctcgatgac

SEQ ID NO: 32700 - protein, 206 aa, Panicum virgatum
  misc_feature: Ceres CLONE 1912306
  misc_feature (17)..(206): Pfam Name: FSH1 Pfam Description: Serine hydrolase (FSH1)
  misc_feature: SWISSPROT Homolog: EC 1.5.1.3 Dihydrofolate reductase
MGSLGGEERPAEGRRGPRFLCLHGFRTSAEIMRKQVLGKWPADVTARLDLVFGDAPCPAEGKSDVDGIFDPPYYEWFQFDQDFAEYRNFDECLAYIEELMIKYGPFDGQMGFSQGAILSAALPGLQERGLALTRVPKIKYLIIIGGAKFLSPALAEKAYASKIACPSLHFIGDNDFLKVHGEKLIESCVDPFVIRHPKGHTVPRLD

SEQ ID NO: 32701 - DNA, 704 bp, Panicum virgatum
  misc_feature: Ceres CLONE 1912315
  misc_feature: Encodes the peptide sequence at SEQ ID NO. 32702
aagtggcgcttgcttcatatcgtcctcgtctgcgatctccgtccatccagccgtctcgggacagccacgagatcgagatcgcgagcggcgtagatctgcgcgtcaggggatgaagattacagcgcttctggtgctgaagccgtcgacctccggcgccgggagctcctcgtcaggcggcgggtcgggcccggaggcggtggtgctcgcgaacgcgacggacgggagccacttcggctacttccagcgcggcgccgcccgcgagttcatcgtcttcgtcgcccgaaccgtcgcgcagcgcacccagcctggccagcgtcagtccgtccagcacgaagaatataaggtccattcacacaacagaaatggtctttgtgcggtggcattcatggacgatcactatcctgtacggagtgcattttctcttctgaataaggttcttgatgagtaccagaaggattttggggactcctggaaatctgctactgcagatggaactcaacagtggcctttcctcacggatgctttgacaaaatttcaggaccctgcagaagctgacaaattaatgaaaatccagagggacttggatgaaacaaaaatcatcctacataaaactattgagagtgtccttgccaggggagagagactggatagcttggttgagaaaagctctgacctgagcgctgcttcacagatgttctacaagc

SEQ ID NO: 32702 - protein, 198 aa, Panicum virgatum
  misc_feature: Ceres CLONE 1912315
  misc_feature (114)..(198): Pfam Name: Synaptobrevin Pfam Description: Synaptobrevin
MKITALLVLKPSTSGAGSSSSGGGSGPEAVVLANATDGSHFGYFQRGAAREFIVFVARTVAQRTQPGQRQSVQHEEYKVHSHNRNGLCAVAFMDDHYPVRSAFSLLNKVLDEYQKDFGDSWKSATADGTQQWPFLTDALTKFQDPAEADKLMKIQRDLDETKIILHKTIESVLARGERLDSLVEKSSDLSAASQMFYK

SEQ ID NO: 32703 - DNA, 738 bp, Panicum virgatum
  misc_feature: Ceres CLONE 1912323
  misc_feature: Encodes the peptide sequence at SEQ ID NO. 32704
atcacaagcgaagcagagcacacaggaagcactccaccttcttcagccgcgctacctgctttccttcctgcttgctcgtgatcaccgagatcaggatgtctggttgcagcggcggcaactgcgggtgcggctccgcctgcaactgcggcggcggatgcaacggctgcaagatgttccctgacgtggaggccgcctccaccaccaccaccatggtcatcgccgccgccagcaacaaggcgagctccggcgggttcgaggcggccaccgagagcggcggctgcgactgcaacacctgcaagtgcggcaccagctgcggctgctcctgctgcagctgcaactgaggcggccatgcgccgccgccatggaagcacgaggagaaagccccccggcgtagtatataggagcagcgtctaaataagatcttgccaactgcgccatccatcatctaccgtgtcgtgtcgtgacatccatggtcgcctgccgtgtctcagctggggttgttgtctgaacgtctctggtgatcgacgacgcatgccggtcgtcgatctttagcttgtgtgtccgtcctcctcgtgcacgccacctttaatatatgtatttcagaactacctgtgtgtggagaaatttgcaaaaatgggaccgcaaacattgacctttgcagttttgccattggccccacatttcataggcacatatggtcccaccgtgtcattcactgggagtggcaaattcacgagt

SEQ ID NO: 32704 - protein, 81 aa, Panicum virgatum
  misc_feature: Ceres CLONE 1912323
  misc_feature (1)..(80): Pfam Name: Metallothio_2 Pfam Description: Metallothionein
MSGCSGGNCGCGSACNCGGGCNGCKMFPDVEAASTTTTMVIAAASNKASSGGFEAATESGGCDCNTCKCGTSCGCSCCSCN

SEQ ID NO: 32705 - DNA, 638 bp, Panicum virgatum
  misc_feature: Ceres CLONE 1912347
  misc_feature: Encodes the peptide sequence at SEQ ID NO. 32706
gtggagctgggatcaaccactaacctacacctcttcctccttccccatcgagatgcatccacgttccatacgatgacaacacctgaattgcaatcaggtcgagtgcgcggtcgtcccccgcctgggaggagtacctcgaggacaattccagaattgcccagcggaccctgagggatagggcggtgaggatgggcctctccaccgtgcccacgcccaaggacagcctgggggggttcgtcctgtacgacaccgaggtgtcggtggccatcctggctgggctggtgcgcgcggcgctggtgttcctgggcctggcggcgccgtctccgtgggagggcctcgccgccgacaaccaccaccaccgccgccaggtggtgtcgtctatctcgcccctggggccgagcctcgcggaccggttccggagccggttccccccgtcgcggttcgggcggtggcgcggcggcgccggcgcggactgccgcgtgtgcctggcccggttcgagccggagacggtggtgaaccggctcccctgcgggcacctcttccaccgggcctgcctcgagacctgactggactacgaccacgccacctgcccgctctgccgactccgcctcctctcccccgccgccgccgatgactac

SEQ ID NO: 32706 - protein, 125 aa, Panicum virgatum
  misc_feature: Ceres CLONE 1912347
  misc_feature: SWISSPROT Homolog: EC 6.3.2.19 Ubiquitin--protein ligase
MGLSTVPTPKDSLGGFVLYDTEVSVAILAGLVRAALVFLGLAAPSPWEGLAADNHHHRRQVVSSISPLGPSLADRFRSRFPPSRFGRWRGGAGADCRVCLARFEPETVVNRLPCGHLFHRACLET

SEQ ID NO: 32707 - DNA, 721 bp, Panicum virgatum
  misc_feature: Ceres CLONE 1912355
  misc_feature: Encodes the peptide sequence at SEQ ID NO. 32708
attatagccgcatccctcctcctcctcctcctctcgatctgattcggagcgcgatcagcagcaagccaagatgcattcgacgaatctcctgctcgaggagcccatccgcatggcctcaatcctcgagccatccaagaccagcttcttccccgcgatgacgaagatcgtggggacgctcgggcccaagtcgcgcaccgtcgacaccatctccgcctgcctcaaggccggcatgtccgttgcgcggttcgatttctcgtggggagacgccgcctaccaccaggagacgctcgagaacctcaagctcgccatcaaggccaccaagaagctatgcgccgtcatgcttgatactgtcggccccgagttgcaggtggttaacaagaatgaaaccccgatttccctcgaggagaatggcactgtggttctcacacctcatcaggggcaagaagcctcctccagcttgctgcccatcaacttctccggactcgccaaggctgtgacaccaggcgcaacaatatttgtgggacaatacttgttcactggcagtgagactacttcagtttggttggaggtttctgaagttcaaggagatgatgtggtctgtataatcaagaacacagctacattggctgggtcactgttcacactgcattgctcccagattcatattgacttgccaacgctatctgatgaggataaggacgttatcagaaaatggggtgct

SEQ ID NO: 32708 - protein, 216 aa, Panicum virgatum
  misc_feature: Ceres CLONE 1912355
  misc_feature (30)..(216): Pfam Name: PK Pfam Description: Pyruvate kinase, barrel domain
  misc_feature: SWISSPROT Homolog: EC 2.7.1.40 Pyruvate kinase
MHSTNLLLEEPIRMASILEPSKTSFFPAMTKIVGTLGPKSRTVDTISACLKAGMSVARFDFSWGDAAYHQETLENLKLAIKATKKLCAVMLDTVGPELQVVNKNETPISLEENGTVVLTPHQGQEASSSLLPINFSGLAKAVTPGATIFVGQYLFTGSETTSVWLEVSEVQGDDVVCIIKNTATLAGSLFTLHCSQIHIDLPTLSDEDKDVIRKWG

SEQ ID NO: 32709 - DNA, 745 bp, Panicum virgatum
  misc_feature: Ceres CLONE 1912356
  misc_feature: Encodes the peptide sequence at SEQ ID NO. 32710
atccatccaaaaacccctcaaaaaaaaaaaaaatccccaatctctcgaagcagttctccgagcgaccgaggcgaatcgaaggagtctctcacgatcctatcaagatgcagatcttcgttaagaccctcaccggcaagaccatcactctcgaagttgagtcctcggacaccattgataatgtcaaggctaagatccaggacaaggaaggcattcctcctgaccagcagaggctcatctttgctggcaagcagcttgaggatggccgcaccctcgctgattacaacattcagaaggagtcaaccctccacctagtcctccgtctgcgtggtggtatgcagatttttgtcaagaccctcactggcaagaccatcacccttgaggttgagtcctcagacaccattgacaacgtgaagactaagatccaggacaaggaaggcatcccccctgaccagcagaggctcatctttgctggcaagcagcttgaggatggtcgcaccctcgctgactacaacattcagaaggagtccaccctccacctggtgctccgtttgcgtggtggtatgcagatttttgtcaaaaccctcactggcaagaccatcacccttgaggttgagtcctcggacaccatcgacaatgttaaggcaaaaatccaggacaaggagggcattcccccagaccagcagcgtctcatcttcgctggtaagcagcttgaggatgggcgtacacttgccgactacacattccg

SEQ ID NO: 32710 - protein, 213 aa, Panicum virgatum
  misc_feature: Ceres CLONE 1912356
  misc_feature (6)..(74): Pfam Name: ubiquitin Pfam Description: Ubiquitin family
  misc_feature (82)..(150): Pfam Name: ubiquitin Pfam Description: Ubiquitin family
  misc_feature (158)..(213): Pfam Name: ubiquitin Pfam Description: Ubiquitin family
  misc_feature: Useful for making plants with modulated nitrogen use efficiency
  misc_feature: Useful for making plants with modulated cold sensitivity
  misc_feature: Useful for making plants with modulated flowering time
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKTKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYTF

SEQ ID NO: 32711 - DNA, 712 bp, Panicum virgatum
  misc_feature: Ceres CLONE 1912357
  misc_feature: Encodes the peptide sequence at SEQ ID NO. 32712
cacaatgaggataacttgaatcgaacactcagtggaaatgtcctgtatccagttgatcaacaccaccttgatgatccacatgttaaagccaacttgctctttcaggcacatttctcaagagctgaattaccaattagtgattacgccacagacttgaaatcagttcttgatcagagcatacgtattatacaggcaatgattgacgtatgtgccaatagtggatggctttcaagtgctttgtcttgcatgcatctcttgcagatgatcatacagggtctctggtttgagagggactcatcactctggatgttgccatccatgaatgatgatattctaggtcatctccggggtagaggagtctcaacagtctcagccttgctggatttttctcatgaagaattgcacaggctccttcaaccattttctgcatcagagttgtaccaggatctgcaacatttccctcgtgttgatgtgaaacttcagcttcagaatgaacaagatcggtccaaatctccaactttaaacatcagagtgcaattgaaaaattcacggcgttcaacatcaagagcatttgcacctagatttcccaaggcaaaacaagaagcttggtggctggtcctggggaatgctacaagctcagagttgtatggtttaaaaagaattagttttgcagatcgggtggttaacactcgcatggaattgccacagatgt

SEQ ID NO: 32712 - protein, 237 aa, Panicum virgatum
  misc_feature: Ceres CLONE 1912357
  misc_feature (1)..(237): Pfam Name: Sec63 Pfam Description: Sec63 Brl domain
HNEDNLNRTLSGNVLYPVDQHHLDDPHVKANLLFQAHFSRAELPISDYATDLKSVLDQSIRIIQAMIDVCANSGWLSSALSCMHLLQMIIQGLWFERDSSLWMLPSMNDDILGHLRGRGVSTVSALLDFSHEELHRLLQPFSASELYQDLQHFPRVDVKLQLQNEQDRSKSPTLNIRVQLKNSRRSTSRAFAPRFPKAKQEAWWLVLGNATSSELYGLKRISFADRVVNTRMELPQM

SEQ ID NO: 32713 - DNA, 678 bp, Panicum virgatum
  misc_feature: Ceres CLONE 1912369
  misc_feature: Encodes the peptide sequence at SEQ ID NO. 32714
atccattccctcccgcttctcgtcgcgtcgctagggtttctcccctccgtctccgccccaattccggccgatccccggccgcgatggtctccggcgccgggccctccggcgggccggcccattccgcgtccaccggcgccgggggcggctccccctccgacaggggcggccccgcgccgtctgcctctgcctcggtctccacgccggccagcgagagcaccgtggcccgccgcctcaacggactcgacctccaggccgacgacgcgccatcgtcgcacccagccgtgagcaagaagaaaaagagaggggtgcgtgctgttggtcctgacaaaaatggccgtggattgcgccaattcagcatgagagtatgtgagaaagttgaaagcaaacggagaacaacctacaatgaggttgctgatgagctggtcgctgagttttcagaccccaacattaatattgactctccagatcctgataatccctccacacaacaatatgatgaaaagaatatccgaccaagagtttatgatgcgctgaatgtcctaatggctatggagattatatctaaagataaaaaggagatacagtggagaggcttgcccaagacaagtatgaatgatattgaagaattgaagacagagatctttggactgaaaggtcggattgacaacaaaagtg

SEQ ID NO: 32714 - protein, 198 aa, Panicum virgatum
  misc_feature: Ceres CLONE 1912369
  misc_feature (83)..(171): Pfam Name: E2F_TDP Pfam Description: E2F/DP family winged-helix DNA-binding domain
  misc_feature: The sequence is a functional homolog of SEQ ID NO 1550 in the 10/666,642 US patent application
  misc_feature: The sequence is a functional homolog of SEQ ID NO 610 in the 10/666,642 US patent application
MVSGAGPSGGPAHSASTGAGGGSPSDRGGPAPSASASVSTPASESTVARRLNGLDLQADDAPSSHPAVSKKKKRGVRAVGPDKNGRGLRQFSMRVCEKVESKRRTTYNEVADELVAEFSDPNINIDSPDPDNPSTQQYDEKNIRPRVYDALNVLMAMEIISKDKKEIQWRGLPKTSMNDIEELKTEIFGLKGRIDNKS

SEQ ID NO: 32715 - DNA, 713 bp, Panicum virgatum
  misc_feature: Ceres CLONE 1912370
  misc_feature: Encodes the peptide sequence at SEQ ID NO. 32716
acgtcactatgcgagctctcctctcccgcatccacctgcacccgcccgcggccgccgcacccttcctcctccccacctccccggccgcctccaaaaccctagccccgacccccgccctcgccccgctccgcctcgtccgccgcttcgccgccatggccgccggcgccgccgaggagttcgtcaagggccgcgtcttccccaacggcgttgccgtcatcacgctcgaccgccccaaggccctcaacgccatgaacctcgaaatggacattagatacaaggcacttcttgatgaatgggaaacaaatccaagtgtcaagtgtattcttgtggaaagcagctctccccgtgccttctcagctgggatggatattaagggtgttgccgcggaaatacaaaaggacaaaaacacaccacttgtgcaaaaggttttcacagcagaatactcgttgatttgcaagatacatgagtatgcaaaaccttatatatgcttgatggatggagtgacgatgggatttggaattggtctgtcaggacatggccgctaccgtattattactgagaagacactcctagccatgcctgagaatggtattggcctgttcccagatgttggctttgcttacattggtgcaaaagccccaggagggggtgcagttggagcttaccttgggattacaggaaaaaagatatcatcacctgctgatgctctattc

SEQ ID NO: 32716 - protein, 234 aa, Panicum virgatum
  misc_feature: Ceres CLONE 1912370
  misc_feature (68)..(234): Pfam Name: ECH Pfam Description: Enoyl-CoA hydratase/isomerase family
  misc_feature: SWISSPROT Homolog: EC 3.1.2.4 3-hydroxyisobutyryl-CoA hydrolase
MRALLSRIHLHPPAAAAPFLLPTSPAASKTLAPTPALAPLRLVRRFAAMAAGAAEEFVKGRVFPNGVAVITLDRPKALNAMNLEMDIRYKALLDEWETNPSVKCILVESSSPRAFSAGMDIKGVAAEIQKDKNTPLVQKVFTAEYSLICKIHEYAKPYICLMDGVTMGFGIGLSGHGRYRIITEKTLLAMPENGIGLFPDVGFAYIGAKAPGGGAVGAYLGITGKKISSPADAL

SEQ ID NO: 32717 - DNA, 687 bp, Panicum virgatum
  misc_feature: Ceres CLONE 1912380
  misc_feature: Encodes the peptide sequence at SEQ ID NO. 32718
gaacgcgtgggcgtgctgcgtgtgtgttgccttggagcagcaggaagggagggcagtggagagcgcgccgtgccgtgtgctgcgatctgggatccaaccggccgccgccggctgcgcgcgttgcggcactagcttgctatcctatacgacccgagctttgtcttgtcgaccggccatgagggtggtggtgtcgggcgcgacggggttcatgggcggccgcctgtgcgcggcgctggccgacgccggccacgacgtgcgcgcgttcgcgctccgcggcgtcgacgcctccggcctccctccctccgtcgaggtggtctacggcgacgtcaccgacgaggagtcgctcgccgccgccttccgcgggcgcgacgccgtgttccacaccgccgcggccgtcgaggcgtggctccccgacgccttcgttttccacaccgtcaatgtagggggacttgagaatgtgttgaaggctgccaagagaacgccaacagtgaagaagatagtttacacatcgtcatactttgcaattggcccaacggatggttatgtcgctgatgagaaacaggtccatcaagggaaagcattttgtacagaatatgagaaatcaaagtttctagcagacaggattgcgctgcaggcagccgcagagggggtgccaatcaccatagtctatccaggcgtcatgtatgg

SEQ ID NO: 32718 - protein, 170 aa, Panicum virgatum
  misc_feature: Ceres CLONE 1912380
  misc_feature (3)..(168): Pfam Name: Epimerase Pfam Description: NAD dependent epimerase/dehydratase family
  misc_feature: SWISSPROT Homolog: EC 5.1.3.7 UDP-N-acetylglucosamine 4-epimerase
MRVVVSGATGFMGGRLCAALADAGHDVRAFALRGVDASGLPPSVEVVYGDVTDEESLAAAFRGRDAVFHTAAAVEAWLPDAFVFHTVNVGGLENVLKAAKRTPTVKKIVYTSSYFAIGPTDGYVADEKQVHQGKAFCTEYEKSKFLADRIALQAAAEGVPITIVYPGVMY

SEQ ID NO: 32719 - DNA, 759 bp, Panicum virgatum
  misc_feature: Ceres CLONE 1912389
  misc_feature: Encodes the peptide sequence at SEQ ID NO. 32720
gaagcaaccaggcacgcacaaccgcaggcggcaggctcagctcagctacagaagtcaagcttttttatctgccacagccgcggcgccgggcgtacggatcggagatggcggactgcatgcaggagtggccggagcccgcggtgcgcgtgcaggcgctcgccgagagcggcctctccgccatcccgcgctgctacgtcaagccgccgtgcgaccgccccgtgccgccgccgccgctggacaaggagctctcggacgacgtcagcattccggtggtcgacctcggcgagctgctggcggacggcgccgccgccggcctcggcagcgccgccgccgtcaccgaggccgtcgcggccgcctgccgggagtgggggttcttccaggtcgtcaaccacggggtgcgccccgagctgatgcgcgcggcgcgggaggcctggcgcggcttcttccgccgcccgctcgccgagaagcagcgctacgccaactcgccgcgcacgtacgagggctacggcagccggctcggcgtgcagaagggcgccgtcctggactggggcgactacttcttcctccacctcgcgccggaggcggccaagagcccggcaaagttctggccggccaaccccggcaactgcaaggaggtgtcggaggagtacggtcggccggtggtgcggctgtgcgagctgctgatgcgggtgctgtccgtgagcctggggctggacgaggggcacctccagcggggcgtcggcgggggcgggtgcggcg

SEQ ID NO: 32720 - protein, 218 aa, Panicum virgatum
  misc_feature: Ceres CLONE 1912389
  misc_feature: SWISSPROT Homolog: EC 1.14.11.19 Leucocyanidin oxygenase
MADCMQEWPEPAVRVQALAESGLSAIPRCYVKPPCDRPVPPPPLDKELSDDVSIPVVDLGELLADGAAAGLGSAAAVTEAVAAACREWGFFQVVNHGVRPELMRAAREAWRGFFRRPLAEKQRYANSPRTYEGYGSRLGVQKGAVLDWGDYFFLHLAPEAAKSPAKFWPANPGNCKEVSEEYGRPVVRLCELLMRVLSVSLGLDEGHLQRGVGGGGCG

SEQ ID NO: 32721 - DNA, 980 bp, Panicum virgatum
  misc_feature: Ceres CLONE 1912394
  misc_feature: Encodes the peptide sequence at SEQ ID NO. 32722
atccgaaagccaaagcgagtctcaccagtcaaagaacgagttctagtagctttgctgatctgttctgctgtttttagtttggaaagcctttagttccggcgatcatggaggagaaggacaggggcctcctggacactcttctcggcaggaagaagcccgaggaacaccaggaggaggagctggtgaccggcatggagaaggtcacggtggccgagcctcagaagcacggcgagcacaaggaggagcacgagaccggggagaagaaggagagcctcctcgccaagttgcaccgcaccagctccagctccagctcgtcgagcgacgaggaagaggaggtgatcgacgagaacggagagattgtcaagaggaagaagaagggcctcaaggagaagatcaaggagaagctacccggccacaaggaccacgccgagggcgaccaccacacggccgtgccggccccggcgcccgcgcccgtgggaacgcacgcttacaaggaggacgagcacaagccgtacgtgccggccccggctcccccgcccgcggtggagacgcacgtccaccaccacgaccacgccgtcgtcgtccagaaggtcgaggacgactccccactggcgccggacgaggagaagaagggcctccttgacaagatcaaggagaagctccccggcagccacaagaagccggaggacgccgccgccgccgcgcccgctgtccacgcgccagcgccggcgccgcacgcacaggacgtgtgcagctcggacggcaaggagaagaagggcctgctgggcaagatcatggacaagatacccggctacaagggctccggcgaggaggaccacaaggccgccgccggcgagcacaagaccagctcttcttaagatggcccgcgcgtcgtgaccttgatcggaagcgtttgtttgccgtgcgtttggttctgctttgctttattaagtttgtttcaagatgggattgcgcggtca

SEQ ID NO: 32722 - protein, 257 aa, Panicum virgatum
  misc_feature: Ceres CLONE 1912394
  misc_feature (15)..(252): Pfam Name: Dehydrin Pfam Description: Dehydrin
MEEKDRGLLDTLLGRKKPEEHQEEELVTGMEKVTVAEPQKHGEHKEEHETGEKKESLLAKLHRTSSSSSSSSDEEEEVIDENGEIVKRKKKGLKEKIKEKLPGHKDHAEGDHHTAVPAPAPAPVGTHAYKEDEHKPYVPAPAPPPAVETHVHHHDHAVVVQKVEDDSPLAPDEEKKGLLDKIKEKLPGSHKKPEDAAAAAPAVHAPAPAPHAQDVCSSDGKEKKGLLGKIMDKIPGYKGSGEEDHKAAAGEHKTSSS

SEQ ID NO: 32723 - DNA, 1895 bp, Panicum virgatum
  misc_feature: Ceres CLONE 1912414
  misc_feature: Encodes the peptide sequence at SEQ ID NO. 32724
cccaaaccccttcgattcgtccatcgccatcgcacgcgctgcgcccgccgcccagcccctccccttctccccggctcctcgctctgctgaattccacgccccgccgccccaaggcctccgatccgatctccgagactccggcacccccgaacgctagcgctgacgtccgcctccatggagccgaggcctccggcgccggcgtctgaggcggcgacgccgcggttcaggctggggaagcagtcgtcgctggcgcccgagaggggcggcgagggcggtgccggcgcgggctcggcggaagggtccgcccaggccgacggcgtcatgagcttccagctgatgtacctggcccacgcgggcagcgtggaggggatccgcgagctcctcgacggcggcgccgaccccaacttccgcgacaccgacggccgcacggcgctgcacatcgccgcgtgcgagggatacgccgaggtcgtcgagctcctcctccagcgcggcgcggaggccgccgtcgaggaccaatggggcagcacgcctttggcggatgcaatgcattatcagaatcatgatgtgatcaagatcttggagaagcatggctccaagcataagatcgctcctatgcatgtgaagaatgtccgtgaagttcctgaatatgagattgacccggctgagcttgatttcagtaatggcaatgatatatccaagggtacttttagaaaagcaacatggaggggcattccggttgctgttaagaagctggatgacgatctaattgtggatgagaacaaagtgagggcattcagagacgagcttgatgtgctgcaacttatacgccatccaaatgttgtgcaatttttgggtgctgtgacacaaagcaacccaatgatgattgtcatggaatttatgcacaagggtgacttgcgcactcacttgaataagagaggagctctgctgccatcatatgcagtgaagctagctcttgatattgcaagaggaatgaattacttacatgagcataagcctcaagctatcattcatcgtgatcttgagccttcgaacatattgagggatgacactggacatctgaaggtggcagattttgatttgtgtaagatgctaaaatggagaagaaaagttagagaagagaaagcggtaacttcacctggcaatgcttgtaggtatgctgctccagaagtcctgcgaaatgaagagtacgataccaaagttgatgtcttctcattcgctttgatactacaggaaatgattgaaggatgtcttccttatcatgataagaaaaatgatgaaattgagaaggcacacaattctaaagaaaggccgccttttagagctcctccaaagcattatgctcacgggttaagagagttgattgagcagtgctggagtgaaaatcctgcagataggcctgattttagagtaattatcaaccggttgtctgctatccacaatgagattgctcaaagaaaccgttggaaggtaagacctctcagatgtttcctgagcgtcgaaggaatgtggaagaaagaccgcaacgagggcagcaccacccgttcatcacgttcgtcgcgatccaagttttaaccaccacccaggctgtatatcatatcttcgtgctctgggcttccgaaaaggggttgttttgcagattgttgctgatcatagttttgttgtatatcagacatttatcaccgagcactggaagaatccacggattctttggcactggcctcaacctcatgtacagattgttgctgtcgatttattgtttataatacaaaaaaatctggcggaagagcagccccttggttggggcagtataattgttttggcatcttccaggctcctgtctgattagctttataaaacttttgttgctttttgtt

SEQ ID NO: 32724 - protein, 472 aa, Panicum virgatum
  misc_feature: Ceres CLONE 1912414
  misc_feature (167)..(424): Pfam Name: Pkinase Pfam Description: Protein kinase domain
  misc_feature (82)..(114): Pfam Name: Ank Pfam Description: Ankyrin repeat
  misc_feature: SWISSPROT Homolog: EC 2.7.11.1 Non-specific serine/threonine protein kinase
MEPRPPAPASEAATPRFRLGKQSSLAPERGGEGGAGAGSAEGSAQADGVMSFQLMYLAHAGSVEGIRELLDGGADPNFRDTDGRTALHIAACEGYAEVVELLLQRGAEAAVEDQWGSTPLADAMHYQNHDVIKILEKHGSKHKIAPMHVKNVREVPEYEIDPAELDFSNGNDISKGTFRKATWRGIPVAVKKLDDDLIVDENKVRAFRDELDVLQLIRHPNVVQFLGAVTQSNPMMIVMEFMHKGDLRTHLNKRGALLPSYAVKLALDIARGMNYLHEHKPQAIIHRDLEPSNILRDDTGHLKVADFDLCKMLKWRRKVREEKAVTSPGNACRYAAPEVLRNEEYDTKVDVFSFALILQEMIEGCLPYHDKKNDEIEKAHNSKERPPFRAPPKHYAHGLRELIEQCWSENPADRPDFRVIINRLSAIHNEIAQRNRWKVRPLRCFLSVEGMWKKDRNEGSTTRSSRSSRSKF

SEQ ID NO: 32725 - DNA, 727 bp, Panicum virgatum
  misc_feature: Ceres CLONE 1912421
  misc_feature: Encodes the peptide sequence at SEQ ID NO. 32726
tttattcagttccagctcactgtaaatgttgcagctcttgtcataaatgttgttgctgccgtttcgtcaggaaatgttcctctaaatgctgttcagcttctctgggttaatctcatcatggacacacttggtgcacttgcattggctactgaaccaccgacagatcaacttatgaggcggccacctgttggacggagagaacctcttgtgactaatatcatgtggagaaacttgtttattcaggctgtctttcaagttgctgtccttcttaccctcaactttaggggccggaatcttttgcatttgactcaagacacattagaacactccagtaaagtgaaaaatacagttatattcaatacatttgtcttatgtcaggtgtttaatgagttcaattctcgtaaaccagaagagctgaatatctttagtggagtttcaagaaatcatcttttcttgggagtagtgaccataaccgttgtgatgcaggtgataattattgagttccttgggaaatttacatcgactgtgagactggattgggagctttggcttgtttctgtagttattgcttttgtaagttggcccttggcttttgttggaaagttcattccagttccaaagactcaattgaaggatctcattctagggtgttggcccaaacgtgatgagggacaggatgagagaagagcagaatcacaggtgtgaagctgctcgggcaagtgttcag

SEQ ID NO: 32726 - protein, 234 aa, Panicum virgatum
  misc_feature: Ceres CLONE 1912421
  misc_feature (60)..(207): Pfam Name: Cation_ATPase_C Pfam Description: Cation transporting ATPase, C-terminus
  misc_feature: SWISSPROT Homolog: EC 3.6.3.8 Calcium-transporting ATPase
FIQFQLTVNVAALVINVVAAVSSGNVPLNAVQLLWVNLIMDTLGALALATEPPTDQLMRRPPVGRREPLVTNIMWRNLFIQAVFQVAVLLTLNFRGRNLLHLTQDTLEHSSKVKNTVIFNTFVLCQVFNEFNSRKPEELNIFSGVSRNHLFLGVVTITVVMQVIIIEFLGKFTSTVRLDWELWLVSVVIAFVSWPLAFVGKFIPVPKTQLKDLILGCWPKRDEGQDERRAESQV

SEQ ID NO: 32727 - DNA, 1589 bp, Panicum virgatum
  misc_feature: Ceres CLONE 1912423
  misc_feature: Encodes the peptide sequence at SEQ ID NO. 32728
actccctccgccatctgccgtgacgtctccctcttctccatccccacccccaaccccccgcgactattttaccctcccctcgctcgctcgcgggtacgcgcgcctgccctgcccacgaggctcgcaacaacttgtcagttggacccgagggggtgggcagcacagcaggcgggacggagcgggaagattcctcgggatctcgtcggccgggggaggagagggagagggggagagcgggcgatggcgggggacggcgtggactgggagagcctggcggaggccacgtcgggggcggtcggcgcgctcgtcagcaccaccgtgctctacccgctcgacacctgcaagaccaagttccaggccgagctccagacgcaccagggcacgcacaagtacaggaacctttcagatgtcttttgggaagcaatccgtaaaaggcaacttttgtccttatatcagggccttaacacgaagaacattcagtcttttatttcgtcattcttttacttttacgggtatagttactttaaaagactttacttggagaagagtggagcaaagtctgttggaacaacagccaacttgttagttgcagctgccgctggtgcttgcacagttatcgtgacacagccactagatacagcagcttctaggatgcagacaagtgcctttgggaagtctaaagggctgagggaaactctttcagagggtacttggatggaagcattcgatggcttgggcatttccattatattgacttgcaatccttctattcagtatactgtatttgatcagctcaagcaaaggataattcagaggcagcgacgtaaaaatggaggatcagcagacgataattcccgagttgctctgtctgctttctcagcttttctccttggggctgtctccaaaagtattgctacagtattgacttatccattaatcaggtgcaaggtgatgattcaggctgcagaccctgatgaggatgatgaatctgaaagaccaagcaaatcaagagcacccaaaacgatgctaggtgccttgcatgctatctggagcaaggaaggcattccaggcttcttcaaaggtctacatgctcagatcctgaaaacggtgctgagctccgcattgctgctgatgataaaggagaagatctcaaagttcacctgggtctcgctgcttgccctgcgccgttatcttttcgtttctcagaagaggatcaagtctgcgtaactgtaactatgttagcttcaaacaactagcaccccatggtaacatggtgcatcaggagctcatataccaaggaataaatctgaggaataacgaacagaactacagaaggaaaaaggtggtttatatgtggcgggttggccttttttccccgagaatactacgtggggttcatgttgatagcgtcagggagtgttcttcaataagtttgttcattgcttctttttatctctgaatctctgatagttaagtgttgccggacccaggactggactgtatgtttacgttgtttgttgtccgttatgtgtaaaatagcagacccctttttgaagcaaatggatcgatttctatagtaagatgttgcc

SEQ ID NO: 32728 - protein, 328 aa, Panicum virgatum
  misc_feature: Ceres CLONE 1912423
  misc_feature (210)..(311): Pfam Name: Mito_carr Pfam Description: Mitochondrial carrier protein
  misc_feature (9)..(103): Pfam Name: Mito_carr Pfam Description: Mitochondrial carrier protein
  misc_feature (109)..(193): Pfam Name: Mito_carr Pfam Description: Mitochondrial carrier protein
MAGDGVDWESLAEATSGAVGALVSTTVLYPLDTCKTKFQAELQTHQGTHKYRNLSDVFWEAIRKRQLLSLYQGLNTKNIQSFISSFFYFYGYSYFKRLYLEKSGAKSVGTTANLLVAAAAGACTVIVTQPLDTAASRMQTSAFGKSKGLRETLSEGTWMEAFDGLGISIILTCNPSIQYTVFDQLKQRIIQRQRRKNGGSADDNSRVALSAFSAFLLGAVSKSIATVLTYPLIRCKVMIQAADPDEDDESERPSKSRAPKTMLGALHAIWSKEGIPGFFKGLHAQILKTVLSSALLLMIKEKISKFTWVSLLALRRYLFVSQKRIKSA

SEQ ID NO: 32729 - DNA, 722 bp, Panicum virgatum
  misc_feature: Ceres CLONE 1912430
  misc_feature: Encodes the peptide sequence at SEQ ID NO. 32730
tgagttccccctcgcctagcccgtaccctctctttagctacctcctgcagcagccgccaacaagttcctgatcgagaagaacacttcggagtagtgttcagaggtgatgtctcttagtcacctggatctaaagctaatggattagatcgtgcagctgcgaagcgtagagctagtaggtcatatctagctatctagcagctaaggaacatgaggggcatgggagagaagaggagacatgggggagggcatcatgtccatggtgttgggtttggagccggaggaggagttggacatgccgagcaagacgagaagcgcagggagccgaagaagctggacatgagcggcatgtccatggacagcatcccgcatctcagcatgcctcttggcaacatcactaccttggatctctccaacaacaacctacagagcattccagagtccataatcgcgaggcttctgaacgtggtggtgctggacgtgcgctccaaccagctcacgtcgctgcccaactccatcggctgcctctccaagctcaaggtcctcaacgtctccggcaacctcctccgcgacctgcccgccaccatcgaggaatgccgtgcgctggaggagctgaacgccaacttcaaccagctgacgaagctgccggacacgctggggttcgagctccacggtctccgccgcctctccgtcaactccaacaagctcgcctacctgccgtcgtc

SEQ ID NO: 32730 - protein, 171 aa, Panicum virgatum
  misc_feature: Ceres CLONE 1912430
  misc_feature: SWISSPROT Homolog: EC 4.6.1.1 Adenylate cyclase
MRGMGEKRRHGGGHHVHGVGFGAGGGVGHAEQDEKRREPKKLDMSGMSMDSIPHLSMPLGNITTLDLSNNNLQSIPESIIARLLNVVVLDVRSNQLTSLPNSIGCLSKLKVLNVSGNLLRDLPATIEECRALEELNANFNQLTKLPDTLGFELHGLRRLSVNSNKLAYLPS

SEQ ID NO: 32731 - DNA, 1216 bp, Panicum virgatum
  misc_feature: Ceres CLONE 1912466
  misc_feature: Encodes the peptide sequence at SEQ ID NO. 32732
acacgtcagcgtccctctgcggccgtgttgatcccaactccaaaactcctctccttcccctgcaaggaaggctaggacgccacgtccccaccgcccgccaccgctccggccctccccccaaatccaagcgacaagtatcggagacggagaggccgagagagaggagagtctaaaaccctaacccccgaatcggatcccgccgccggagagcggaacccgccccccggccgccatggagatgggagcgatgagcgacgcggagcggatgttcttcttcgagctcgcctgcaggaacgccgaggccgcgtacgagcagaacccgctcgacgccgacaacctgacgcggtggggaggcgcgctgctggagctgtcgcaggtgcggaccggccccgacagcctcaagagccttgaagatgccgaatccaagctggaggaggcactgaaaattgatcccagcaaggctgatgcactctggtgcttgggaaatgctcagacctctcatggattcttcactccagacacacagaaggcaaatgagtactttgtgaaggcagcagagtgtttccagaaggctgttgatgtggaacctgcaaatgatctgtacaggaagtctttggacttgtcagctaaggcacctgaactgcatttggagatccataggcaaatggcttctcaggcggcagcgccacaagcatcctcagcctcaaatccacggcaatcaaggaagaagaagaaggatactgacttctggtacgatgtttgtggatgggtgatccttggtgttggcatttttgcttgggttggaatggccagagcaaacatcccccctccaccaccgcctccagccaggtgaactggatgcaccaccgacagaaccttgcacgtggcatgcctatgtcaagtgcctcaggcatgaatcttgctaggagttagtttgtgtatgcagaggaggaaatgttatttccttgttacggtttggtcaaatttttcatgcctttttccccgtagagcctttatgaggtttcctcattatcatcggacgtaccgtgctggataattttgtagttgcctaccttactgctgttttgaggttaaaaccattgcatgctgcgatattagttctgtgaactttgataccggatgttatcagaaggtaccacacatcaagtggtatcctattttagcaatgcatgaaataaatgtatacgattatgtc

SEQ ID NO: 32732 - protein, 206 aa, Panicum virgatum
  misc_feature: Ceres CLONE 1912466
  misc_feature (9)..(202): Pfam Name: TOM20_plant Pfam Description: Plant specific mitochondrial import receptor subunit TOM20
MEMGAMSDAERMFFFELACRNAEAAYEQNPLDADNLTRWGGALLELSQVRTGPDSLKSLEDAESKLEEALKIDPSKADALWCLGNAQTSHGFFTPDTQKANEYFVKAAECFQKAVDVEPANDLYRKSLDLSAKAPELHLEIHRQMASQAAAPQASSASNPRQSRKKKKDTDFWYDVCGWVILGVGIFAWVGMARANIPPPPPPPAR

SEQ ID NO: 32733 - DNA, 1155 bp, Panicum virgatum
  misc_feature: Ceres CLONE 1912469
  misc_feature: Encodes the peptide sequence at SEQ ID NO. 32734
gtaagccactaagccctcgttgttaacctcggccaagaacctaccagaactcccaaatcgaaaaggaaagcggcgagctttcgcgtgcgccgtccgccgggtacgtcaccgacagccatggacatcgacgagcacgacgacggcgacggcgacgaggagtgcctcaagaaccacgcggtcggcatcggcgggcacgccgtcgacggctgcggcgagttcatggccgcgggcgaggagggctccatcgacgcgctccgctgtgccgcctgcggctgccaccgcaacttccaccgcaaggagtccgagtcgcccacgggcggggtctcgccggccgatcccgccgccgccgccgccatcaccgcctacggcgcggcggcgcaccaccacccgttctccccctactaccgcacgcccgccgggtacctcctccaccaccaccagcagctggcggccgcggccgcggctgcggggcacatgcagcgcccgctcgcgctcccgtccacctcccagtcggggcgcgacgagggcgacgacatgtccgggctgatcggccccatgatggtgggcatgtccctgggctccggcggcggcccgtcggggtccgggtccgggtccggcaagaagcggttccgcaccaagttcacgcaggagcagaaggaccggatgctggcgttcgcggagcagctggggtggcgcatccagaagcacgacgaggccgccgtgcagcagttctgcgaggaggtcggcgtcaggcgtcacgtgctcaaggtctggatgcacaacaacaagcacaccctgggcaagaagccatgatcccattcccccggcgcctggtacaccgccactgatcgcaattgcatcatcgatctccctagcagctagtcttttttccccctcattgccttccttctttttttagctagaaaaaaaatgcaagctaggttcgtagcgagcagtagttcttggatttagctaggatggaggagacggccgttgttctttttttttcgccctattttattctggttctttggctgcgtgtgttgtttcgtggtagatgagacgatcgtgacgttggtgttgggaaggaggagggcagggcatggccatttgccgatttggatcttgggaatgtactactcgcttttgtgttgc

SEQ ID NO: 32734 - protein, 231 aa, Panicum virgatum
  misc_feature: Ceres CLONE 1912469
  misc_feature (10)..(66): Pfam Name: ZF-HD_dimer Pfam Description: ZF-HD protein dimerisation region
  misc_feature: The sequence is a functional homolog of SEQ ID NO 110 in the 10/714,887 US patent application
  misc_feature: The sequence is a functional homolog of SEQ ID NO 110 in the 11/435,388 US patent application
  misc_feature: The sequence is a functional homolog of SEQ ID NO 108 in the 10/714,887 US patent application
  misc_feature: The sequence is a functional homolog of SEQ ID NO 108 in the 11/435,388 US patent application
  misc_feature: The sequence is a functional homolog of SEQ ID NO 106 in the 10/714,887 US patent application
  misc_feature: The sequence is a functional homolog of SEQ ID NO 106 in the 11/435,388 US patent application
  misc_feature: The sequence is a functional homolog of SEQ ID NO 104 in the 10/714,887 US patent application
  misc_feature: The sequence is a functional homolog of SEQ ID NO 104 in the 11/435,388 US patent application
  misc_feature: Useful for making plants with modulated low light sensitivity
MDIDEHDDGDGDEECLKNHAVGIGGHAVDGCGEFMAAGEEGSIDALRCAACGCHRNFHRKESESPTGGVSPADPAAAAAITAYGAAAHHHPFSPYYRTPAGYLLHHHQQLAAAAAAAGHMQRPLALPSTSQSGRDEGDDMSGLIGPMMVGMSLGSGGGPSGSGSGSGKKRFRTKFTQEQKDRMLAFAEQLGWRIQKHDEAAVQQFCEEVGVRRHVLKVWMHNNKHTLGKKP

SEQ ID NO: 32735 - DNA, 1187 bp, Panicum virgatum
  misc_feature: Ceres CLONE 1912481
  misc_feature: Encodes the peptide sequence at SEQ ID NO. 32736
atcttccttcttccagcctaccggggcgggcgacaagccaggccatggagaaggccgcctccttcctctcctccctcctcggcggcggcggcgatggggagccggcggcgacggtgaagtccatcctgatatacccaatcaagtcctgcaggggcatcgccgtgccccaggcccccatcacctccactgggttccggtgggatcggcagtggttggtggtgaacgccaaggggcgagcctacacccaacgagtggagcccaagctcgcgctcgtccaggtggagctgccgccggaggccttcgccgaggactggcaacccacggccgacgaccacatggtaatcagagcacccggaatggaaccgttgaagatccctcttgctgcggaacacgccacaatcgatgatgtctctgtgtgggagtggtctggctctgcgtacaatgaaggagccgaagcggctgaatggttctccacttactttgagaagccaagtcgactggtgcgcttcaaagaagcgtcagaaactagaccgaccgatcctgattatgcccaaggttacaagatcatgtttacagattgtttcccgtttctgatagcctctcagggctcactggatgcactaaatgagattcttaaagaacctataccaatgaaccgcttcagaccaaatattttagtggatggatgccaaccatattcagaggatctgtggaaaaccataaagataaacaacctaacatttcaaggtgtgaagttatgcaaccgttgcaaggtaccaaccattaatcaagacaatggaatatctggcaccgaaccaactgaaactttacagacatttcggtctgacaaagtgctgcgtccaagccacaaaaataaacggcaggtgtactttggtcagaatttagtctgcaaggaatctctatcaggaaacaacaaaggaaagatcatcaaggttggcgatccagtttatgttcagcaggcattcacttcttctaatgaagccccagcctgaatcagggcttttcagtttcccatgtgcaatggactatagtagcatttaaaccaagttgtcaacaaaacaagagaaatgcatttgtcatgtgcattgtgctcagattaaagaaacagcaggctgttaagactattggatgatgcaataaaacatttccactgcacactactcatg

SEQ ID NO: 32736 - protein, 322 aa, Panicum virgatum
  misc_feature: Ceres CLONE 1912481
  misc_feature (21)..(149): Pfam Name: MOSC_N Pfam Description: MOSC N-terminal beta barrel domain
  misc_feature (162)..(310): Pfam Name: MOSC Pfam Description: MOSC domain
MEKAASFLSSLLGGGGDGEPAATVKSILIYPIKSCRGIAVPQAPITSTGFRWDRQWLVVNAKGRAYTQRVEPKLALVQVELPPEAFAEDWQPTADDHMVIRAPGMEPLKIPLAAEHATIDDVSVWEWSGSAYNEGAEAAEWFSTYFEKPSRLVRFKEASETRPTDPDYAQGYKIMFTDCFPFLIASQGSLDALNEILKEPIPMNRFRPNILVDGCQPYSEDLWKTIKINNLTFQGVKLCNRCKVPTINQDNGISGTEPTETLQTFRSDKVLRPSHKNKRQVYFGQNLVCKESLSGNNKGKIIKVGDPVYVQQAFTSSNEAPA

SEQ ID NO: 32737 - DNA, 752 bp, Panicum virgatum
  misc_feature: Ceres CLONE 1912486
  misc_feature: Encodes the peptide sequence at SEQ ID NO. 32738
tctgaccaacaccactacacccagccgaccaaatcgtcggagaagggcgcgccatggagccggcggtagagaagaaggaggccgaacaggaggagcagcagctgccgcaagcgcgcaaggaagacgcgcccgccgccgaggaggacgaggcagattcggaggagaccgagcgccgcaaccgcgacctcaaggccggcctccacccccttaggggcaagctggttctctggtacacgcgccggacgcctggggcgaggtcgcagtcgtacgaggacaacatcaagaagatcatcgatttcagcactgtcgaatcgttctgggtttgctactgtcacctcgcgcgcccgtcttctctgccgagccccactgatcttcatctcttcaaggatggcatccggccactttgggaggaccctgcgaatcagaatggtggcaagtggataattaggttcaagaaggctgtttcaggccgtttctgggaggatttggtaagcgggcctagacctgtctatgtgctggtgctagtaggcgaccaacttgaatatagtgatgatgtttgtggtgttgtgctcagtgtccgttttaatgaagacattttaagtgtttggaatcggaacgcatctgaccatcaggctgtgatgactttaagggattcaatcaagagacaccttaagctgccacacagctatttgatggagtacaaaccacatgatgcttcgcgacgcgacaactcatcctacaggaacacatgg

SEQ ID NO: 32738 - protein, 232 aa, Panicum virgatum
  misc_feature: Ceres CLONE 1912486
  misc_feature (22)..(232): Pfam Name: IF4E Pfam Description: Eukaryotic initiation factor 4E
MEPAVEKKEAEQEEQQLPQARKEDAPAAEEDEADSEETERRNRDLKAGLHPLRGKLVLWYTRRTPGARSQSYEDNIKKIIDFSTVESFWVCYCHLARPSSLPSPTDLHLFKDGIRPLWEDPANQNGGKWIIRFKKAVSGRFWEDLVSGPRPVYVLVLVGDQLEYSDDVCGVVLSVRFNEDILSVWNRNASDHQAVMTLRDSIKRHLKLPHSYLMEYKPHDASRRDNSSYRNT

SEQ ID NO: 32739 - DNA, 1506 bp, Panicum virgatum
  misc_feature: Ceres CLONE 1912491
  misc_feature: Encodes the peptide sequence at SEQ ID NO. 32740
gtccacgccctggctgcggcccctcccccaatagcagcctaacccagcgagcacgaacccaagtcaccagcgctcctcttctcttctcttctcttctccgtcgcgtcagaaatcaggaggcacaagaggaaagaatcgaagaggctttgtttgatcaagaaccgtcgcttcgattccatcagctgcaacaaccgcgacgacgacgacgacgagaggcctcccctcctccgacggcacggccaccgaggcggcgccaccgcgatgggttctctggcgctgaggtgtagtaacccgccgccgcctttctccaagtcgccgggttccctgctgctgctctccaagtcgctcaccctctactgctgagctgagccacccccgcggttgctgtcgctcagctcatgggcgccgtagcctcgtcggcgagaggggggcggggagttgaggggacggtgctgggggacttgccggagagctgcgtcgcggaggtgctgctcaggctggaccccccggagatctgccggatggcgcggctcagccgcacgttccgaggggccgcgtccggggatggcgtctgggagtccaagctgccgaggaactacgctcgcctcctcgccgtagcagcggccggcgatggaggagatcggcaggctgccgccgccgccgcggcgcttgaggcggagtcgctgcccaagaaggaggtgtacgcgcggctctgccgccggaatcgcttcgatggcggcaaaaaggagttctggctggacaagggtggtcgaggtgtctgcatgtcaatctcgtcaatggcactttcaataacgggcattgatgatagacgatattggaacttcattcccaatgatgaatcaagatttcacactgttgcttatctctcacaaatttggtggttcgaagtcaaaggggaggttgaattctgcttcccagaaggtacatatagcctattttaccgcgttcacctaggccgaccattcaagcggcttagacgacgggtttgtagctcagagcacatccatggctgggacataaagccagtccgcttccaaatgtcaacttctgatggacagcaagctcagtccaagtgctatttaaccgatcccggtgtctggatcaatcaccatgtcggggacttcgtcgtgaaggactcaagcaaaccgacaaacatccggtttgcgatgattcagatagactgcacacacacgaaaggaggcctctgtgtggattcagtggtggtgaaaccgcagtacctcacgcagaaaaagtcgcctcaatgttatgtgtagtggtgttgatatacgtagagatacacatatgctctagagtttttgttctttatacaaaaagtgcagttgcatttacaaagtattttccagccctgtaatgtaactgaaggggtaagtgatttttagttactcttgtccctataggaacatggtgcgcctatgtaaattgcccattttttactctgaaatatactatgtctggtgtacctcc

SEQ ID NO: 32740 - protein, 298 aa, Panicum virgatum
  misc_feature: Ceres CLONE 1912491
  misc_feature (17)..(64): Pfam Name: F-box Pfam Description: F-box domain
MGAVASSARGGRGVEGTVLGDLPESCVAEVLLRLDPPEICRMARLSRTFRGAASGDGVWESKLPRNYARLLAVAAAGDGGDRQAAAAAAALEAESLPKKEVYARLCRRNRFDGGKKEFWLDKGGRGVCMSISSMALSITGIDDRRYWNFIPNDESRFHTVAYLSQIWWFEVKGEVEFCFPEGTYSLFYRVHLGRPFKRLRRRVCSSEHIHGWDIKPVRFQMSTSDGQQAQSKCYLTDPGVWINHHVGDFVVKDSSKPTNIRFAMIQIDCTHTKGGLCVDSVVVKPQYLTQKKSPQCYV

SEQ ID NO: 32741 - DNA, 679 bp, Panicum virgatum
  misc_feature: Ceres CLONE 1912495
  misc_feature: Encodes the peptide sequence at SEQ ID NO. 32742
gtgctcatcaatcatcatcacttagcttgggatatatacttcgttcacggcacacacacacctacacagacatggcttgctcatcgtcccgttccacggccgccgccggtgtggtactcgcaatggtggtggccgcgttgtgcctccatggcgcggcggcgcagctctgcgaggactactacgacgacacgtgccctgacgcttacgccatcgtgaagaaggtgctcgtcgacgcccacaggtccgacgtccggatcttcgccagcctcatccgcctccatttccacgactgcttcgtccagggctgcgacgggtcgctgctgctggacggcgtgccgggggtgatcaactccgagaagggggcgcggcccaacaacggctcggcgcgtggttacgaggtggtggacaaggtcaaggcggcgctggaggacgcctgccacggagtcgtctcctgcgccgacatcctcgccatcgccgccgagatctccgtcgagctgtccggtggcccgaagtggggcatcctgctgggaagactggacggccggacggccaacttctcaagcgcatccaacctgccatcgcccttcgacaacctcaccgtactcgagaagaagttcagggacgtccgccttaacactgtcgacctcatccccctctccagggcccacacattttggcc

SEQ ID NO: 32742 - protein, 202 aa, Panicum virgatum
  misc_feature: Ceres CLONE 1912495
  misc_feature (48)..(202): Pfam Name: peroxidase Pfam Description: Peroxidase
  misc_feature: SWISSPROT Homolog: EC 1.11.1.7 Peroxidase
  misc_feature: Useful for making plants with modulated nitrogen use efficiency
  misc_feature: Useful for making plants with altered carbohydrate content
  misc_feature: Useful for making plants with altered cell wall content and/or composition
  misc_feature: Useful for making plants with modulated oxidative stress sensitivity
MACSSSRSTAAAGVVLAMVVAALCLHGAAAQLCEDYYDDTCPDAYAIVKKVLVDAHRSDVRIFASLIRLHFHDCFVQGCDGSLLLDGVPGVINSEKGARPNNGSARGYEVVDKVKAALEDACHGVVSCADILAIAAEISVELSGGPKWGILLGRLDGRTANFSSASNLPSPFDNLTVLEKKFRDVRLNTVDLIPLSRAHTFW

SEQ ID NO: 32743 - DNA, 698 bp, Panicum virgatum
  misc_feature: Ceres CLONE 1912527
  misc_feature: Encodes the peptide sequence at SEQ ID NO. 32744
aagcaggcacaagtgcacaactagagcccaggaaatcaagaaagctcgtgcaagcagccatggcgggagttgcgtccctcaccctcaccctccgcgcgtcttccccatcacccgcagccccgtacccacgcggcggcagcgacgccgccctcgcgttcccgaccccggcgcgcttccggtcgctgcgcgccgcgcggcgccgcgtcctgacgcgtgcggtggcggcgggtggtggggatcccgaggacgagtgggtgccggagcctgagggcgggtccacggtcacgggggtggccgaggcgcccgcgccggaggcgagcgaggtggcgcagctcaaggcgcggctcaaggaggcgctggacggcgcggaacggggcctgcgcgcgtccagcgagacgcgggcggacgtggtcgagctcatcgcgcagctcgaggcgcgcaaccccacgccggcgcccacggaggcgctcgcgctcctcgacggcaagtggatcctcgcatacacatcattttctcaacttttccctctgctggggtccggaaggctgcctgagcttgtaaaggtggaggagatatcacagactattgattcagagaacttcacagtgcaaaactgcatcaagttttcaggaccattggctacaacctcagtttccaccaatgctaaatttgaagttagaagcccccagcgtgtgcag

SEQ ID NO: 32744 - protein, 212 aa, Panicum virgatum
  misc_feature: Ceres CLONE 1912527
  misc_feature (90)..(212): Pfam Name: PAP_fibrillin Pfam Description: PAP_fibrillin
  misc_feature: Useful for making plants with modulated nitrogen use efficiency
  misc_feature: Useful for making plants with modulated salt sensitivity
MAGVASLTLTLRASSPSPAAPYPRGGSDAALAFPTPARFRSLRAARRRVLTRAVAAGGGDPEDEWVPEPEGGSTVTGVAEAPAPEASEVAQLKARLKEALDGAERGLRASSETRADVVELIAQLEARNPTPAPTEALALLDGKWILAYTSFSQLFPLLGSGRLPELVKVEEISQTIDSENFTVQNCIKFSGPLATTSVSTNAKFEVRSPQRV

SEQ ID NO: 32745 - DNA, 722 bp, Panicum virgatum
  misc_feature: Ceres CLONE 1912532
  misc_feature: Encodes the peptide sequence at SEQ ID NO. 32746
tatttttatgatgctcaccatgggggctgtgcttgtgactgaaggatgcaggaagataaagcttcagtactatggatttaaattggcttcgggtgcagggaatgagagcaccccagttacagaggttgagccatatatccccttcaacatcaatccgactggaatgcagcccttgcttacaacctcatacctgctagcctttccaagcatcatggccagcatttttgggtcgcacttttggaaaaacttgaaggacattttgaatccaagaacttcagctggtggtagtccctgggtttattatttgacatatgcttttcttgtcttcgtcttcaacatttttgacattgccaacttacccaaagagatatctgactacctgaataagatgagtgcgagggtaccaaagataaagcctggaagagcaacagtagattatcttacaaagatacaaacctcaacgcgtttctggggtggcctacttctgagcttgcttgcaacttcctctttgttgcttgaccgatatctcaggcaaataaatgagggattctctataggattcacatcagttttgattattgtgggctcaattattgagctgagaaggtcataccaagcatacaatgtgatgccagcactaagcaaagttttgaggagatatggtgcctaagcgtatgtgagggcatatgttggtgatgatggcatcatccactagaccacta

SEQ ID NO: 32746 - protein, 222 aa, Panicum virgatum
  misc_feature: Ceres CLONE 1912532
  misc_feature (1)..(203): Pfam Name: SecY Pfam Description: eubacterial secY protein
IFMMLTMGAVLVTEGCRKIKLQYYGFKLASGAGNESTPVTEVEPYIPFNINPTGMQPLLTTSYLLAFPSIMASIFGSHFWKNLKDILNPRTSAGGSPWVYYLTYAFLVFVFNIFDIANLPKEISDYLNKMSARVPKIKPGRATVDYLTKIQTSTRFWGGLLLSLLATSSLLLDRYLRQINEGFSIGFTSVLIIVGSIIELRRSYQAYNVMPALSKVLRRYGA

SEQ ID NO: 32747 - DNA, 685 bp, Panicum virgatum
  misc_feature: Ceres CLONE 1912543
  misc_feature: Encodes the peptide sequence at SEQ ID NO. 32748
atttctctcatcatctgaaaataaaagaaattccgcccctttcttccatctccgctcctccgagcgtgacaagctcccgattcgatcggccgcgtttccgttcttctctgattcgcggcgggggcggggggcgagagagatgaggaagcgtgagcgcgagaacccgtgcgggatctgcgggcactaccacaagtacgaggagggggaggtgtgcggcgtctgcggccaccgcccgcccgcggcgccggcggcggcgggggcgaggcagctggactccgcgttcccgtcggagatcctcaaggagttcctcttcctcggcagctacgacaacgcctcccgctccgagctcctcaagaccatcggggtctcgcacatcctcaatactgtaccattatgccaaaacctgtaccggaattcattcacttatcactgccttcaagaggacaaaactctgcagtttgatgatgcaatccagtttctagaacaatgtgagagggagaaagcacgtgtccttgtgcattgcatgtcagggaaaagtagatcggcagcatttgttatagccttcttgatgaaatcaagggggtggagactggcacaatcttttcagtgggtgaaagaacggagaccacaagtacaactatctgatggggcacagcagcagttgattgagtacgaaacgaagctt

SEQ ID NO: 32748 - protein, 181 aa, Panicum virgatum
  misc_feature: Ceres CLONE 1912543
  misc_feature (48)..(181): Pfam Name: DSPc Pfam Description: Dual specificity phosphatase, catalytic domain
  misc_feature: SWISSPROT Homolog: EC 3.1.3.48 Protein-tyrosine-phosphatase
MRKRERENPCGICGHYHKYEEGEVCGVCGHRPPAAPAAAGARQLDSAFPSEILKEFLFLGSYDNASRSELLKTIGVSHILNTVPLCQNLYRNSFTYHCLQEDKTLQFDDAIQFLEQCEREKARVLVHCMSGKSRSAAFVIAFLMKSRGWRLAQSFQWVKERRPQVQLSDGAQQQLIEYETK

SEQ ID NO: 32749 - DNA, 623 bp, Panicum virgatum
  misc_feature: Ceres CLONE 1912548
  misc_feature: Encodes the peptide sequence at SEQ ID NO. 32750
acccgctccttctgacccgtcggagtcggggtctccgtctctccgagatgaggaaccaggcaacaccgggcgccgtcaccgagtcggcggtgctggtcctgccgttgctaccgccgcgtgacctcgccgccgcggcatccgcttgccgcgccctccgagcggccgcggccgccgtcaccacgcgccgcgccgccgacgcggcacgaggcctggagccgctccccatcccgttccacaaccgcgtcgactcgaagccctatgcctacttcctctacacacccttctccctcgcccggctgtctcccggcgcctcctcctcccccagcgcccaggcccagccgtggggtggcgcctgggcccggccgccactcccgacctggccccgccccagcgtcgacggcttcacatctgccgtgtgcgggtgcgcgtgcgaggcgggggagtgcggcggcccccggtgcgcctgcgccgatgcggaggccgacgcggccgcctcgggctcggagggcgggatggggagcctcggggagtgtggcgatgggtgtgcgtgcgggccttcgtgcgggaaccggcggacgcagcgcggcgttgctgtgcggctgcgcgtcgtgcgccacctgcag

SEQ ID NO: 32750 - protein, 191 aa, Panicum virgatum
  misc_feature: Ceres CLONE 1912548
  misc_feature (50)..(175): Pfam Name: Pre-SET Pfam Description: Pre-SET motif
  misc_feature: SWISSPROT Homolog: EC 2.1.1.43 Histone-lysine N-methyltransferase
MRNQATPGAVTESAVLVLPLLPPRDLAAAASACRALRAAAAAVTTRRAADAARGLEPLPIPFHNRVDSKPYAYFLYTPFSLARLSPGASSSPSAQAQPWGGAWARPPLPTWPRPSVDGFTSAVCGCACEAGECGGPRCACADAEADAAASGSEGGMGSLGECGDGCACGPSCGNRRTQRGVAVRLRVVRHL

SEQ ID NO: 32751 - DNA, 1691 bp, Panicum virgatum
  misc_feature: Ceres CLONE 1912552
  misc_feature: Encodes the peptide sequence at SEQ ID NO. 32752
agtgacccgtctccctcccggtcccggctcccgcaactgcatctctcgcgtcttctcgcctctccctacttcctaaccgccaccggcgtccccaatcccgaaaccctagcaccgcccagccctcgccgccggcggccatggccgagaccgtcgacgacaaggtcagctacttccaggtcgtcaccggcatctccgacccggacctctgcacggagatcctcgccgcgcacaactgggacctgcaggtcgccgtgtcctccatcaccgccaacccctcctccccctccccctccgcctccgcctccacgtcctcgcgcgagcagggcccgtccgccccgctggcagatgctgagttcgtcgcgcccccgccgccgatgccgccggcgccccagcagccggggatcgcgtggaagctggtgacgctccccttctacgtggtctctggaggggtcggcctcgtcgccggcaccttccgcctcggcgcctgggtcgctgggggcgtgctgtcccgctccctctccctcttcggcctcgcggggcaggccggagtcgaccgcctgctcgaactgccgccgtccgccgccgaggcggctgaattcgtcgcggagttcgagcgcgagttcggcgccggccgtggcccgcacttcgtggccgagggtttctccgacgcgttgcagcgagcgcagcgggaattcaagctcctgttcgtgtatctccactctcctgatcacccggatacccctgccttctgtgggggctgcctctgcgccgagcccgtcgcggccttcatagatgagaacttcgttgcgtggggcggtagcatcagaaggactgaagggttcaagatgagtaacagcctgaacgcgtcgaggttccccttttgtgctgtggtcatggcttctacgaaccaaagaatcatgctattgcaacaggttgaagggcctaaatcacctgaagagatgataacaattcttcaacgggttgttgaagaatgtgctacatcactcgttgctgccaggattgaagctgaagagagactaaataaccagcgtttacgtgaagagcaagatgctgcctacagagctgcacttgaagctgaccaggccagggaacgggaaaggctagaggaactggaaagacgtgaaagagaggcggcagaagctgagagaaaacgtaaagaggaagaggaagctctagcgagggctgcccaagaagcagctgaaaaggaagctgctcttgcaaggagaaggcaagataaagccatggctcttggagctgaacctgataaagggcctggcgttactcgggttctcataagatttccgactggagaacgcaaagagaggagattccacagctctgcccccatcacttcgctctatgactacgttgattctttggattgcttggaagcagagaagtacagcctagtttcgaatttcccacgggtcacatacggtccagagaagcactccctgacgctggaagaagcaggcttgcatccacaggcgagcctgtttatcgagatagaacaatgatgttgtaagttcagaaaaccaaaactcgcaagtataggtgctcctttttccaatttgttcagcaacagttaaggatttccagatgtattacaccacaggtgcatccttcttttgtactcggtttattcaataaattcaccttcaccatgtatc

SEQ ID NO: 32752 - protein, 466 aa, Panicum virgatum
  misc_feature: Ceres CLONE 1912552
  misc_feature (383)..(464): Pfam Name: UBX Pfam Description: UBX domain
MAETVDDKVSYFQVVTGISDPDLCTEILAAHNWDLQVAVSSITANPSSPSPSASASTSSREQGPSAPLADAEFVAPPPPMPPAPQQPGIAWKLVTLPFYVVSGGVGLVAGTFRLGAWVAGGVLSRSLSLFGLAGQAGVDRLLELPPSAAEAAEFVAEFEREFGAGRGPHFVAEGFSDALQRAQREFKLLFVYLHSPDHPDTPAFCGGCLCAEPVAAFIDENFVAWGGSIRRTEGFKMSNSLNASRFPFCAVVMASTNQRIMLLQQVEGPKSPEEMITILQRVVEECATSLVAARIEAEERLNNQRLREEQDAAYRAALEADQARERERLEELERREREAAEAERKRKEEEEALARAAQEAAEKEAALARRRQDKAMALGAEPDKGPGVTRVLIRFPTGERKERRFHSSAPITSLYDYVDSLDCLEAEKYSLVSNFPRVTYGPEKHSLTLEEAGLHPQASLFIEIEQ

SEQ ID NO: 32753 - DNA, 745 bp, Panicum virgatum
  misc_feature: Ceres CLONE 1912561
  misc_feature: Encodes the peptide sequence at SEQ ID NO. 32754
tgaagtggtgttatctaacaaggcaaaatattctgcaaatgcgaataatcaagagagtggcagttctgacgttgaagtaccatatgaagacaatagcgggtcaacatcgacctcatcactctcagctgatgaaccaattgtagttgggagagaggaaattgcaagagttgcctcattatggtcagggataccagtgcagcagttgacagctgatgataaaaagcttctagtaggactagatgatgagctcaggaaacgggtcattggccaagatgatgcagttgtggccatatctcgtgcagtgaagagatcgcgtgttggccttaatgaccctgacagacctatcgctaccctgcttttctgtggcccaacaggagttggtaaaacggagcttaccaaggctctagcagcaagttattttggatcggaatctgctatgcttagattagacatgagcgagtatatggagaggcacactgtgagcaagctcataggctctcctccagggtacattggctatggtgaaattggtactttgacagaagcagtcaggaggaaaccatttactgtggtattgctggatgagatagagaaagctcatcctgatattttcaacatccttctccaaatctttgaggatggtcatttgacagactcacagggccgcagggtttccttcaagaatacattgattgtgatgacttcaaatgttggttctacatcaatttcaaagggaagacggagc

SEQ ID NO: 32754 - protein, 247 aa, Panicum virgatum
  misc_feature: Ceres CLONE 1912561
  misc_feature (113)..(247): Pfam Name: AAA_2 Pfam Description: ATPase family associated with various cellular activities (AAA)
  misc_feature: Useful for making plants with modulated heat sensitivity
EVVLSNKAKYSANANNQESGSSDVEVPYEDNSGSTSTSSLSADEPIVVGREEIARVASLWSGIPVQQLTADDKKLLVGLDDELRKRVIGQDDAVVAISRAVKRSRVGLNDPDRPIATLLFCGPTGVGKTELTKALAASYFGSESAMLRLDMSEYMERHTVSKLIGSPPGYIGYGEIGTLTEAVRRKPFTVVLLDEIEKAHPDIFNILLQIFEDGHLTDSQGRRVSFKNTLIVMTSNVGSTSISKGRR

SEQ ID NO: 32755 - DNA, 740 bp, Panicum virgatum
  misc_feature: Ceres CLONE 1912562
  misc_feature: Encodes the peptide sequence at SEQ ID NO. 32756
agatagccacagcgcaaaacttgctttgaaatctgacttcactgcgaacgctgcggcggaggaagaaaaaggaggggggaaaacaattcgtagaaaaatcagcaatcaaagaagaaaataatttccataggaaatcgcccaatcccctttcctcttctctctcgaggcttcggaacgtgcggggaacttagccaggatggtgggcctggtggcgatcgagaaccagagccaggtcgcgcgggcggtggtggcggaggcggtgccggcggcggggccgcggatccccaaggaggcgcggctgctgctgcacgagctggcggcggcgtgggcggacgtggcggactgccgcgcgctccaggtcgtgccgctcaagggcgccatgaccaacgaagtctaccaggtgcgctggctcaccggcgtcccctccgcgggcggcgaggcggaggagccccggggggagagggaggtgaggaaggtgctcgtgaggatatacggtgacggggtcgacctcttcttcgaccgcgaggacgaggtgcgcaccttcgagtgcatgtcccgccacggccagggtccccgcctcctcggccgcttccccaacggccgcgtcgaggagttcatccacgcaaggacactatcagctaccgaccttcgcgatcctgagatttcagctctcgttgcttcccaactgagggaattcaacaaccttgacatgcctggtcccaaatctgtgctcatttggg

SEQ ID NO: 32756 - protein, 181 aa, Panicum virgatum
  misc_feature: Ceres CLONE 1912562
  misc_feature (90)..(181): Pfam Name: Choline_kinase Pfam Description: Choline/ethanolamine kinase
  misc_feature (4)..(53): Pfam Name: Choline_kin_N Pfam Description: Choline kinase N terminus
  misc_feature: SWISSPROT Homolog: EC 2.7.1.82 Ethanolamine kinase
MVGLVAIENQSQVARAVVAEAVPAAGPRIPKEARLLLHELAAAWADVADCRALQVVPLKGAMTNEVYQVRWLTGVPSAGGEAEEPRGEREVRKVLVRIYGDGVDLFFDREDEVRTFECMSRHGQGPRLLGRFPNGRVEEFIHARTLSATDLRDPEISALVASQLREFNNLDMPGPKSVLIW

SEQ ID NO: 32757 - DNA, 734 bp, Panicum virgatum
  misc_feature: Ceres CLONE 1912569
  misc_feature: Encodes the peptide sequence at SEQ ID NO. 32758
gtgccactattctggttctagggccttcggtcgcagcatctctagccgagacattgacttgagcaaatctcatctacctctccggctctcccactccccgcaccgccttttacgcttggatcagcatacccttttgggcagcagcagcgcggaccgatcgagatcgatcgaaccattcaaccatcgaggtggagtggcccgagtagtagctagctagctagcaaggcgcgcggcggccggcatgaaggtgcagtgcgacgtgtgcgcggccgaggcggcctccgtcttctgctgcgccgacgaggccgcgctgtgcgacgcgtgcgaccgccgcgtccaccgcgccaacaagctcgccgggaagcaccgccgcttctccctcctccacccctcgccgtcgacgacgacgtcctcgtccgcgcagacgaagccgccgctctgcgacatctgccaggagcggagggggttcttgttctgcaaggaggacagggcgatcctgtgccgggagtgcgacgtgccggtgcacaccgcgagccagatgacgcggcggcacagccgcttcctgctcaccggcgtgcgcctctcgtcggcgccggtggactccaacgccgcgtcagaggaggaggaggaggagaacagcggcagcccctgcaacgccgactcctgcagcgccggcgacgccggcgccacggccgcggcgagcgcgagcgacgggagcagcatctccgagtacc

SEQ ID NO: 32758 - protein, 164 aa, Panicum virgatum
  misc_feature: Ceres CLONE 1912569
  misc_feature (62)..(109): Pfam Name: zf-B_box Pfam Description: B-box zinc finger
  misc_feature (1)..(47): Pfam Name: zf-B_box Pfam Description: B-box zinc finger
  misc_feature: The sequence is a functional homolog of SEQ ID NO 1023 in the 10/666,642 US patent application
  misc_feature: The sequence is a functional homolog of SEQ ID NO 1645 in the 10/374,780 US patent application
  misc_feature: The sequence is a functional homolog of SEQ ID NO 1671 in the 10/412,699 US patent application
  misc_feature: The sequence is a functional homolog of SEQ ID NO 1024 in the 10/666,642 US patent application
  misc_feature: The sequence is a functional homolog of SEQ ID NO 1646 in the 10/374,780 US patent application
  misc_feature: The sequence is a functional homolog of SEQ ID NO 1672 in the 10/412,699 US patent application
  misc_feature: The sequence is a functional homolog of SEQ ID NO 1478 in the 10/666,642 US patent application
  misc_feature: The sequence is a functional homolog of SEQ ID NO 1890 in the 10/412,699 US patent application
  misc_feature: The sequence is a functional homolog of SEQ ID NO 2148 in the 10/374,780 US patent application
  misc_feature: The sequence is a functional homolog of SEQ ID NO 454 in the 11/435,388 US patent application
  misc_feature: The sequence is a functional homolog of SEQ ID NO 676 in the 10/225,066 US patent application
  misc_feature: The sequence is a functional homolog of SEQ ID NO 234 in the 10/666,642 US patent application
  misc_feature: The sequence is a functional homolog of SEQ ID NO 288 in the 10/374,780 US patent application
  misc_feature: The sequence is a functional homolog of SEQ ID NO 582 in the 10/225,066 US patent application
  misc_feature: The sequence is a functional homolog of SEQ ID NO 662 in the 11/435,388 US patent application
  misc_feature: The sequence is a functional homolog of SEQ ID NO 906 in the 10/412,699 US patent application
  misc_feature: Useful for making plants with altered lignin content
  misc_feature: The sequence is a functional homolog of SEQ ID NO 236 in the 10/666,642 US patent application
  misc_feature: The sequence is a functional homolog of SEQ ID NO 908 in the 10/412,699 US patent application
MKVQCDVCAAEAASVFCCADEAALCDACDRRVHRANKLAGKHRRFSLLHPSPSTTTSSSAQTKPPLCDICQERRGFLFCKEDRAILCRECDVPVHTASQMTRRHSRFLLTGVRLSSAPVDSNAASEEEEEENSGSPCNADSCSAGDAGATAAASASDGSSISEY

SEQ ID NO: 32759 - DNA, 733 bp, Panicum virgatum
  misc_feature: Ceres CLONE 1912570
  misc_feature: Encodes the peptide sequence at SEQ ID NO. 32760
aagtgcctgctcataatcaatcgtgtggttgagcaatcaggataggctctgacgtatacagtgccgttggcaaggccagatcgagctctcaggatgaagatgagcagcggcctggcaggcccggtggcgctggccgccgccgtgtgcctgctgctgccggcggcgagcctggcgcagctgcaggtggggttctacaacacctcctgccccaacgccgaggcactcgtgcgtcaggccgtcacggccgccttcgccaacaactccggcgttgcgcccgggctcatccgcctccatttccatgactgctttgtcaggggctgcgacgcctccgtcctcctgaccgtgaaccccgccggcggcaacaccgagcgcgacgccccgcccaacaacccgagcctgcgcggcttcgaggtcccctcgggccgccgcgacgggcgcgtgtccaacgcgacggaggccctctccctcccggggcccaacagcacggcgcagaacctcaccgacggcttcggccgcaagggcctcagcgccgaggacatggtggtgctctccggctcccacaccatcggccgctcccactgcgcctccttcctgttccggaaccggcagcggctcgccgccgggaccatcagcccggcgtaccaggcgctgctggaggcgctgtgcccgccaccacgggccagctcacccccacaccacggagatcgacctcagcacgccggcgttgctggac

SEQ ID NO: 32760 - protein, 213 aa, Panicum virgatum
  misc_feature: Ceres CLONE 1912570
  misc_feature (45)..(189): Pfam Name: peroxidase Pfam Description: Peroxidase
  misc_feature (31)..(107): SWISSPROT Homolog: EC 1.11.1.7 Peroxidase
  misc_feature (107)..(162): SWISSPROT Homolog: EC 1.11.1.11 L-ascorbate peroxidase
MKMSSGLAGPVALAAAVCLLLPAASLAQLQVGFYNTSCPNAEALVRQAVTAAFANNSGVAPGLIRLHFHDCFVRGCDASVLLTVNPAGGNTERDAPPNNPSLRGFEVPSGRRDGRVSNATEALSLPGPNSTAQNLTDGFGRKGLSAEDMVVLSGSHTIGRSHCASFLFRNRQRLAAGTISPAYQALLEALCPPPRASSPPHHGDRPQHAGVAG

SEQ ID NO: 32761 - DNA, 705 bp, Panicum virgatum
  misc_feature: Ceres CLONE 1912572
  misc_feature: Encodes the peptide sequence at SEQ ID NO. 32762
gagccccccatcctgccgctgcgctccactctcctccgcttgaatccagtggctctgctttgttcgtcctcgtcgtctctctcgcgagcggggcaggcacttcggacaggggttggaggctcgggaggaccggagaagtagattgtgttctcgccatggagcagcagaagggaggagcggtttctgcgccggcggccgccgccgccaacgggaccggggagctgatcgggtacgtcgacgtgcacgtgcggagcgcgcgggacatccagaacatctgcatctaccacaagcaggacgtgtacgcgcgggtgtctctgccgggggacggcgcgccggtggcgtccacgcaggtggttaacggcggcggccgcaacccggtgttcgaccagtcgctgcgcctcggcgtgcgcgcgggggacgtcgacgccgcgctccgctgcgaggtctggatgctcagccggatcaagaactacctggaggaccagctgctggggttcgcgctcgtgccgctcccggaggtcatcgccgccgacggcggcacgctcgcccgggagttcccgctcaccaccagcgacctcttccagacgccctcggggttcctccagctcgagctgtcctacatcggggtcgtgccggaggtcgtgcccatctctccgacgcccaagccggcgctggccgacccggaggaggtgccggggactaacg

SEQ ID NO: 32762 - protein, 183 aa, Panicum virgatum
  misc_feature: Ceres CLONE 1912572
  misc_feature (27)..(116): Pfam Name: C2 Pfam Description: C2 domain
  misc_feature: Useful for making plants with modulated biomass
MEQQKGGAVSAPAAAAANGTGELIGYVDVHVRSARDIQNICIYHKQDVYARVSLPGDGAPVASTQVVNGGGRNPVFDQSLRLGVRAGDVDAALRCEVWMLSRIKNYLEDQLLGFALVPLPEVIAADGGTLAREFPLTTSDLFQTPSGFLQLELSYIGVVPEVVPISPTPKPALADPEEVPGTN

SEQ ID NO: 32763 - DNA, 677 bp, Panicum virgatum
  misc_feature: Ceres CLONE 1912599
  misc_feature: Encodes the peptide sequence at SEQ ID NO. 32764
acagcaattgcacacaagcatctcaacagctgagggcctttgatcctctgctctcagtgctctgctcggcatggcatcttcggtttcttcagtagtcttgctgctactctgcatggccgccatcgcggcggcgcagctctcgccgacgtactacgacacgtcgtgccccaacgctctgtccaccatcaagagcgccgtgacggccgccgtgaccaaggagaaccgcatgggagcctccttgctcaggctgcacttccatgactgctttgtccagggttgcgacgcgtccgtactgttggccgacatccccggcagcttcaccggcgagcagggggcgttgcccaacgtgggatctctgaggggcttcgacgtcatcgccaacatcaaggcgcaggtggaggccatctgcaagcagaccgtctcctgcgccgacatcctcgccgtcgccgcccgcgactccgtcgtcgcgttgggagggccctcatggacggttcccctggggcggagggactccacaaccgcgagccagaccctggcaaacaacgacctgccgcctcccttcttcaacctcaccgacctcatcagcgccttcggcaacaagggtttcaccgcgaccgacatggttgccctctccggggcgcacacgatcgggcagtcgcagtgcctcaacttcaggg

SEQ ID NO: 32764 - protein, 202 aa, Panicum virgatum
  misc_feature: Ceres CLONE 1912599
  misc_feature (39)..(202): Pfam Name: peroxidase Pfam Description: Peroxidase
  misc_feature: SWISSPROT Homolog: EC 1.11.1.7 Peroxidase
  misc_feature: Useful for making plants with altered carbohydrate content
  misc_feature: Useful for making plants with altered cell wall content and/or composition
MASSVSSVVLLLLCMAAIAAAQLSPTYYDTSCPNALSTIKSAVTAAVTKENRMGASLLRLHFHDCFVQGCDASVLLADIPGSFTGEQGALPNVGSLRGFDVIANIKAQVEAICKQTVSCADILAVAARDSVVALGGPSWTVPLGRRDSTTASQTLANNDLPPPFFNLTDLISAFGNKGFTATDMVALSGAHTIGQSQCLNFR

SEQ ID NO: 32765 - DNA, 699 bp, Panicum virgatum
  misc_feature: Ceres CLONE 1912602
  misc_feature: Encodes the peptide sequence at SEQ ID NO. 32766
ctctcggcacggccctgcccctccctcctcctcccgtcccacccccacccgcgcccgtcaaagcgagagcgccgtatcaccggcctttcctcgcgtccccctccgatccgcgcccccaaagataccttttttccccccgcgccgccgttttgctgcgaccatggcggcggagggggaggccaagaacccgtcgggcggcggcggcggcggcggaggaggaggaggggataacccccaggtagaggcggcgccgtcggcgccggcgccggcgccggccgagggggaggcggtgttggcggcggcgcaagggacggggcaagggccggagggggagaaggcggatcgagagggggagaaggacgacggagcgtgcagagatctggtcctggtcgaggatccggaggtggtcgccgtggagaatccggaggaagctgcagcaacagcagcacttcaggaagaaatgaaagcgcttgtggcatcgatccctgatggtgctggtgcagcattcacagcgatgcaacttcaggagctagagcagcagtcccgggtatatcaatacatggctgcccgagtacctgtgcctactcatctcgtctttccaatatggaagagtgtaactggtgcatcctctgaaggcgcccagaagtaccctaccttgatgggcttggcaacactgtgcttggactttgggaagaaccc

SEQ ID NO: 32766 - protein, 179 aa, Panicum virgatum
  misc_feature: Ceres CLONE 1912602
  misc_feature (114)..(150): Pfam Name: QLQ Pfam Description: QLQ
MAAEGEAKNPSGGGGGGGGGGGDNPQVEAAPSAPAPAPAEGEAVLAAAQGTGQGPEGEKADREGEKDDGACRDLVLVEDPEVVAVENPEEAAATAALQEEMKALVASIPDGAGAAFTAMQLQELEQQSRVYQYMAARVPVPTHLVFPIWKSVTGASSEGAQKYPTLMGLATLCLDFGKN

SEQ ID NO: 32767 - DNA, 738 bp, Panicum virgatum
  misc_feature: Ceres CLONE 1912605
  misc_feature: Encodes the peptide sequence at SEQ ID NO. 32768
actcattgctggagcgcaggaggagcttgtttgtttgcgcaaacctgcgtgcgtgcccacgcagcatccagctgccatcagttcattgcaagcgcagcggtggtagtgtagctgtagcctgtagctagcagaggagggaagagcagagcagggcagggcgcgcgctctgtgggaagctaggtcgatagagagagatagctccgggttgccgccggtcatctcggtcgatagaggtaaagatagcagcttgggcgatcggagggggctaggatggtgaacacggcggcgagcctcggagtcggcggcagggcgggcggcgtgctgccgctggcgtcgctgaaccacatcagcatcgtgtgccggtcggtggaggagtcgctgcgcttctacaccgacgtgctgggcttcgtccccatccgccgcccgggctccttcgacttcgacggcgcatggctgttcaactacgggatcggcatccacctgctgcagtcggaggaccccggcagcctgccggagaagagagagatcaaccccaaggacaaccacatctccttccagtgcgagagcatggcggcggtggagcggcggctcaaggagctgggcatcccgtacgtgcagcggtgcgtggaggagggcggcatcaacgtcgaccagatcttcttccacgaccccgacggcttcatgatcgagatctgcaactgcgacaacctccccgtcatccggctcgccggcggcgcg

SEQ ID NO: 32768 - protein, 155 aa, Panicum virgatum
  misc_feature: Ceres CLONE 1912605
  misc_feature (22)..(141): Pfam Name: Glyoxalase Pfam Description: Glyoxalase/Bleomycin resistance protein/Dioxygenase superfamily
  misc_feature: SWISSPROT Homolog: EC 5.1.99.1 Methylmalonyl-CoA epimerase
MVNTAASLGVGGRAGGVLPLASLNHISIVCRSVEESLRFYTDVLGFVPIRRPGSFDFDGAWLFNYGIGIHLLQSEDPGSLPEKREINPKDNHISFQCESMAAVERRLKELGIPYVQRCVEEGGINVDQIFFHDPDGFMIEICNCDNLPVIRLAGG

SEQ ID NO: 32769 - DNA, 1485 bp, Panicum virgatum
  misc_feature: Ceres CLONE 1912624
  misc_feature: Encodes the peptide sequence at SEQ ID NO. 32770
gattcgggcggctcctgcgccgccagtcgcctcctgcgcggccctgcgcgcgaccgcggtgcccccgtccgtgcgccatcgggcaccgccgccctgccgcggccaccaggcctaccgcgctgccgggccaccaccacgccgtcgtcgccatgaccgggaaatgaaggggaggagcagcgccgtcgccttgcgcagagcagaggaggaagccggcccgccgcgcgccgaggccgcgcgccgtcgtggccgcctgctgcctggccgcgcgcgcataaagcctccgacaaccctgcgccaagaaacagagaggcaagaacagagggaggagcacgggaaagaagggaaggaggagaggggacgcgccaggaagaacaaacagagaagaaggagggtgacagaagaagaagaaaagaagggaagggggagctcgacgccgtcggccgtgggaggagaaggacgccgccgtcgctacaccgaagaatgccgatgcccggagcacgtagcgccgccgtcgtggacgccgatccggagccacgttcgtcgatgcccgcaacctgttcgatggaacaccgcacccgggagcacgctgctgtcgtggacgccgcaagccggtgcctgtacgactccatcgacgaagccgcacgacacggcacagcttcgacccaccggcatcgcctcgtcacggcaccgagaaccgcacctccgagcccgaacactgtacgggcgcccatttttgttccacaaagtgatgcccgtttcccaggtctgcgcgcccctggaacatgagggagaggaaaaaggttcttgttgttgaacgtgaaaagaagctccttgattcatctctcaggcatttatcaaggaggcgtgtggaaggtcagagtagaactgccaaatgcatattcatacaaatcccagtcaattggtttcatcaataagatatatcacccaaatgtccatgaaatgtcttgctcagtctgtttggatgtcatcaaccaaacatggagcccaatgtttggatgtgtcattagcatggaacataggtcgtgctgtcgtgcagaaggctaaattggagagcctttagaagaagctatcatattgtgcatcttgaagcccataaattggagagcctgtagaagcagatgctgcaaagcaggacctacagcttgccttcataagcctggcgctatgtgttgacggttgcatcatctacatcaagtaaacagggtatgaacacaagccaccttcttctgccgccggctcctcaattcaaagttagctgctacaatctggaaaaggaatctctatgtactcattcgtcaacaacaaacctaagaatctacctagctgtgtaacagctattcctacactcattgaccagtgtttgcctccacaaatgatgagactaaaatggattgttcatctcatcaagaaaaatgtttgtataaccattacagcaaccactttagtatgccattagtttttttt

SEQ ID NO: 32770 - protein, 34 aa, Panicum virgatum
  misc_feature: Ceres CLONE 1912624
  misc_feature: SWISSPROT Homolog: EC 6.3.2.19 Ubiquitin--protein ligase
MSCSVCLDVINQTWSPMFGCVISMEHRSCCRAEG

SEQ ID NO: 32771 - DNA, 680 bp, Panicum virgatum
  misc_feature: Ceres CLONE 1912629
  misc_feature: Encodes the peptide sequence at SEQ ID NO. 32772
attttatttctccccctcacgcctgctcacagaagcaaccggcaaagaggaagagagcctctgctgattcagtagcaattctctggttggttgttctctgctgctgctgtgtgtgtgtctgcgaagaaacgaggagagggagagatggcttgccctgcgcagtacatgctctcggccagcggctgcatcttcctggggagcagcaagcctcaggcgagccttgtccgaggcgccgtcatcggcggcgttagcggcagcaggccgttcctgctcacctgcagcgcctcgtcgtctccgtctccttccacgccggcgcaggaggactccgactgcaacgaggaggagtgcgccccggagaaggaggtcgggagcctgagcgccgagtggctggcggaggagcggaccagggtcgtcggaaccttcccgcccaggaagagagggtggaccggcctcgtcgagaaggacaccgccggccagaccaacatctactccgtcgaggtacgccagccatacaaattctgcgacgagataacatagcactagctctgcagctgacggcctggacctgcgctgcgcagccgacggtgtacgtggcggagagcgccgtcagctccggcacggcgggcacgtcggcggagggggccgagaacacggccgccatcgcggcggggctggtcctc

SEQ ID NO: 32772 - protein, 130 aa, Panicum virgatum
  misc_feature: Ceres CLONE 1912629
  misc_feature: Useful for making plants with modulated flowering time
MACPAQYMLSASGCIFLGSSKPQASLVRGAVIGGVSGSRPFLLTCSASSSPSPSTPAQEDSDCNEEECAPEKEVGSLSAEWLAEERTRVVGTFPPRKRGWTGLVEKDTAGQTNIYSVEVRQPYKFCDEIT

SEQ ID NO: 32773 - DNA, 730 bp, Panicum virgatum
  misc_feature: Ceres CLONE 1912634
  misc_feature: Encodes the peptide sequence at SEQ ID NO. 32774
gtctcgagaccccaactcgcccccctccttccctcccctttcctctctctcccctcctctcctttcgcatcccatcgcagaccccaccgccggctggcttgcttctgctccggcctcttccccctccgcctcgcgtgaggtcgtcctccggtgctcggctctcggccgccgggggggtgtctgcgtcggcggcggagagggatcggcggggacgatggtcagggagcgccgggagataaagaggatagagagcgcggcggcgcggcaggtcacgttctccaagcgccgccgcggactcttcaagaaggccgaggagctctccgtgctctgcgatgccgacgtcgcgctcatcgtcttctcctccacggggaagctctcccagttcgccagctccagtatgaatgagatcattgccaagtacaacacacattctaaaaatctggggaaagaagaaccgccttcacttgacttgaatttggaacatagcaaatatgcaaatttgaatgagcaacttgcggaagcaagccttcgactcaggcagatgagaggcgaggagcttgagggattgagtgttgaagaactacagcagttggagaagaaccttgaagctggtcttcacagggtgcttcaaacaaaggatcaacaattcttggaacagataagcgagctccaacgaaagagttcacagctggcagaggagaacacgcaactgaggaatcaagtatcccag

SEQ ID NO: 32774 - protein, 171 aa, Panicum virgatum
  misc_feature: Ceres CLONE 1912634
  misc_feature (9)..(59): Pfam Name: SRF-TF Pfam Description: SRF-type transcription factor (DNA-binding and dimerisation domain)
  misc_feature (69)..(170): Pfam Name: K-box Pfam Description: K-box region
  misc_feature: Useful for making plants with altered alkaloid content
  misc_feature: The sequence is a functional homolog of SEQ ID NO 1453 in the 10/374,780 US patent application
  misc_feature: The sequence is a functional homolog of SEQ ID NO 2064 in the 10/374,780 US patent application
  misc_feature: The sequence is a functional homolog of SEQ ID NO 572 in the 10/412,699 US patent application
  misc_feature: The sequence is a functional homolog of SEQ ID NO 816 in the 10/225,066 US patent application
  misc_feature: Useful for making plants with modulated flowering time
  misc_feature: The sequence is a functional homolog of SEQ ID NO 1454 in the 10/374,780 US patent application
  misc_feature: The sequence is a functional homolog of SEQ ID NO 122 in the 10/225,066 US patent application
  misc_feature: The sequence is a functional homolog of SEQ ID NO 234 in the 10/374,780 US patent application
  misc_feature: The sequence is a functional homolog of SEQ ID NO 1965 in the 10/412,699 US patent application
  misc_feature: The sequence is a functional homolog of SEQ ID NO 1967 in the 10/412,699 US patent application
  misc_feature: The sequence is a functional homolog of SEQ ID NO 1963 in the 10/412,699 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
MVRERREIKRIESAAARQVTFSKRRRGLFKKAEELSVLCDADVALIVFSSTGKLSQFASSSMNEIIAKYNTHSKNLGKEEPPSLDLNLEHSKYANLNEQLAEASLRLRQMRGEELEGLSVEELQQLEKNLEAGLHRVLQTKDQQFLEQISELQRKSSQLAEENTQLRNQVS

SEQ ID NO: 32775 - DNA, 617 bp, Panicum virgatum
  misc_feature: Ceres CLONE 1912636
  misc_feature: Encodes the peptide sequence at SEQ ID NO. 32776
cgtctagactctagaggagacagtcgcaggaggccacgagaagcagccggcgagcaacaagccatggcgtccaccacctgcttcctccaccagtccaccgcccgcttcggcgccgccgccgcctcggcgcgcccccaggcgccgcgggcccagcagctcgtgtgcagggcgcagaagccgcaggacgccgccgccgagggcgacgccgcggtcacccgccgcgccgcgctcacgctcctcgcgggcgccgccaccgtcggcgccaaggggaaccccgccgccgccgcctacggaaaagcagccaacgggttcggaaagcccaagacgaacacagaattcatcgcctacagcggcgacggcttcaagctgctgatcccgtccaagtggaaccccaacaaggagcgcgagttccccggccaggtgctccgctactaggacaacttcgacgccaacagcaacgtctccgtcatcgtccatcccaccaccaagaagaccatcaccgactacggctcgtccgaagagttcctcgcccacgtcgactacctcctcggcaagaacgtctacgactgaaagacggactcctagggcgggttcaagacagacgcggtggccaccgt

SEQ ID NO: 32776 - protein, 123 aa, Panicum virgatum
  misc_feature: Ceres CLONE 1912636
  misc_feature: Useful for making plants with altered lignin content
  misc_feature: Useful for making plants with modulated nitrogen use efficiency
MASTTCFLHQSTARFGAAAASARPQAPRAQQLVCRAQKPQDAAAEGDAAVTRRAALTLLAGAATVGAKGNPAAAAYGKAANGFGKPKTNTEFIAYSGDGFKLLIPSKWNPNKEREFPGQVLRY

SEQ ID NO: 32777 - DNA, 1621 bp, Panicum virgatum
  misc_feature: Ceres CLONE 1912645
  misc_feature: Encodes the peptide sequence at SEQ ID NO. 32778
accgcagctcgcactcgcactcgcactcgcactcgcactcgccctcgccctcgccctcgccctcgccctcgccctcgcatttgatccatcgctaataacaatggcgtcgttgctgccggcgttcacggtgcggcggggggagccggagcccacgccgcgggaggtcaagccgctgtcggacatcgacgacggggagggcatgcggttctacagctcggggatccacctgtaccgcagcaacccggccaaggcggggcaggacccggccagggtcatccgggaggcgctcgccagggcgctcgtcccgtactacccgctcgcgggccgcctccgcgaggagcaagggaggaagctcgtcgtcgactgcgccggccagggcgtcatgttcgccgaggccgacgccgacctcaccgccgacgacttcggggacgtgcagagcccgccgttcccgtgcttcgagcgcttcatcctggagagcaccaccatcgccggcgtcgagcccgtcgtcgaccgccctctgctctacatccaggtgacgcggctcaggtgcgggggcttcatcttcggccagcgcttctgccactgcatcgtggacgccccgggcggcatgcagttcgagaaggccatctgcgagctcgcgtgcggcgccggcgcgccgtcggtggcgccggcgtggggcagggagatgttcatggcgcggcggcccccgcggccgtcgtacccgcacctcgagtaccgcgagccggcgggcggacacgacaggatgctgtcgacgcccccggccgacatggcgcgcgtccccttcttcttcgggccccgggagatcgccgggctgcgccagcgcgcgccgccgggcatgcgctgctcccgcttcgagctcgtggccgcctgcatctggcgcagccgcgcggcggcgctcgggtacgcgcccggcgaggaggtgcgcctgtccttcatcgtgaacgcgcgcggccgccccgagatcccgctccccgagggcttctacgggaacgcgttcgcctactccgtggcggcgaccaccgccggggagctctgcggcaaggacctcgggtacgcgctggagctggtgaagaaggccaagtcggcggtgacgtacgactacctgctgtcggtggcggacctgatggtgctccaggggcggccgctgttcgcgctgtcgcggacgtacatcgtgtcggacgtgagccacgccgggttcaagagtgtggacttcgggtggggggaggccgtctacggcgggccggccaagggcggcgaggggccgctcctcggcgtcaccaactacttctcgagggccaagaacggcaagggggaggagggcaccgtggtgcccatctgcctgcccaaggacgccatggagaagttccagctcgaggtccaaggactcaccgcggagctctaggcggcgcgcgcgccggttggccggccagtgagtgcatggtcataccagtagccttgacgcaggcacaaccgcacaactagctggtcatatattattattacacggcccgtccggtgtgtgtgtgtgtgtgtatatatatatatatatttgtattactatacacaggaaatgtgatatcgatggtggtgtgttcttgtt

SEQ ID NO: 32778 - protein, 440 aa, Panicum virgatum
  misc_feature: Ceres CLONE 1912645
  misc_feature (8)..(436): Pfam Name: Transferase Pfam Description: Transferase family
  misc_feature: SWISSPROT Homolog: EC 2.3.1.162 Taxadien-5-alpha-ol O-acetyltransferase
MASLLPAFTVRRGEPEPTPREVKPLSDIDDGEGMRFYSSGIHLYRSNPAKAGQDPARVIREALARALVPYYPLAGRLREEQGRKLVVDCAGQGVMFAEADADLTADDFGDVQSPPFPCFERFILESTTIAGVEPVVDRPLLYIQVTRLRCGGFIFGQRFCHCIVDAPGGMQFEKAICELACGAGAPSVAPAWGREMFMARRPPRPSYPHLEYREPAGGHDRMLSTPPADMARVPFFFGPREIAGLRQRAPPGMRCSRFELVAACIWRSRAAALGYAPGEEVRLSFIVNARGRPEIPLPEGFYGNAFAYSVAATTAGELCGKDLGYALELVKKAKSAVTYDYLLSVADLMVLQGRPLFALSRTYIVSDVSHAGFKSVDFGWGEAVYGGPAKGGEGPLLGVTNYFSRAKNGKGEEGTVVPICLPKDAMEKFQLEVQGLTAEL

SEQ ID NO: 32779 - DNA, 698 bp, Panicum virgatum
  misc_feature: Ceres CLONE 1912649
  misc_feature: Encodes the peptide sequence at SEQ ID NO. 32780
gaagtttccagacacgagccgactaatcgaagcgctcctcctcctccccctcgagcttccgactgatccgtcctcgtttgcgatcaatatgagaaggggttacagttacagtccttcaccaccaaggggttacaggagaagggctcgcagcccaagcccccgtgatcattacggtggccgtggtagagatctcccaaccagtcttttggtcaggaatctccgtcgggactgcaggccagaagaccttcgtcgcccattcggacagtttgggcgacttaaagatatatatctaccaagagattattacactggggagcctagaggatttggttttatccagtattatgatccagaagatgctgctgatgcaaagtactacatggatgggcagctggttcttggcaggcaaataactgttgtatttgcagaggagaataggaagaagcctcaagagatgagagctagggacagagtcagaggtcgttcttatgatcggaggtactctcgctctaggtcccctctttattctaggggtcgttctccttcccgcagctactcatggtctctttcacctccaaatcccaaacacaggcttagagagcggtcctactcccgctcacctgttgacagcagatcaagaagcgggagcccctacgaggaggaataccgcagatcctcacgaagagagaggtctctct

SEQ ID NO: 32780 - protein, 203 aa, Panicum virgatum
  misc_feature: Ceres CLONE 1912649
  misc_feature (39)..(110): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with altered terpenoid content
MRRGYSYSPSPPRGYRRRARSPSPRDHYGGRGRDLPTSLLVRNLRRDCRPEDLRRPFGQFGRLKDIYLPRDYYTGEPRGFGFIQYYDPEDAADAKYYMDGQLVLGRQITVVFAEENRKKPQEMRARDRVRGRSYDRRYSRSRSPLYSRGRSPSRSYSWSLSPPNPKHRLRERSYSRSPVDSRSRSGSPYEEEYRRSSRRERSL

SEQ ID NO: 32781 - DNA, 717 bp, Panicum virgatum
  misc_feature: Ceres CLONE 1912653
  misc_feature: Encodes the peptide sequence at SEQ ID NO. 32782
cacccccacaccacaaccgccaaaaaatatcccaccccaccggggccagggccagtcgccaccatggctcgccgcggcctccgccccctcgccgcctccgcgctcctcctcctcgtcgtcgccctcttctccgccgccgcgctctgctcggcggagcccgaggacgccgcctccgccgcggaggacccgctcatcgagcaggtggtcggggcggacgacgacgagctggagctggacgcggaggcgcacttcgccagcttcgtccgccggttcggcaagtcgtaccgcgatgaggacgagcgcgcgcgccgcatggccgtgttcagggccaacctccgccgcgcgcggcgccaccagcggctcgaccccacggcggcgcacggggtcaccaagttctccgacctcaccccggccgagttccgccgccagttcctcggcctccgccgctcctccgcccgggacctgctcaaggggtcgtccgcgcacaaggcgcccatcctccccaccgacggcctcccggccgacttcgactggcgcgaacacggcgccgtcgggcccgtcaagaaccagggctcgtgcgggtcgtgctggtccttcagcacgtcgggggcgctggagggggcgcactacctcgccaccggcaaactcgaggtgctcagcgagcagcagatggtcgactgcgaccacgagtgcgatgcatcagacccacgctcatgc

SEQ ID NO: 32782 - protein, 217 aa, Panicum virgatum
  misc_feature: Ceres CLONE 1912653
  misc_feature (63)..(119): Pfam Name: Inhibitor_I29 Pfam Description: Cathepsin propeptide inhibitor domain (I29)
  misc_feature: SWISSPROT Homolog: EC 3.4.22.16 Cathepsin H
MARRGLRPLAASALLLLVVALFSAAALCSAEPEDAASAAEDPLIEQVVGADDDELELDAEAHFASFVRRFGKSYRDEDERARRMAVFRANLRRARRHQRLDPTAAHGVTKFSDLTPAEFRRQFLGLRRSSARDLLKGSSAHKAPILPTDGLPADFDWREHGAVGPVKNQGSCGSCWSFSTSGALEGAHYLATGKLEVLSEQQMVDCDHECDASDPRS

SEQ ID NO: 32783 - DNA, 1688 bp, Panicum virgatum
  misc_feature: Ceres CLONE 1912654
  misc_feature: Encodes the peptide sequence at SEQ ID NO. 32784
ctcttcctcggcagaaccacaccccctcctcctcctccctctctttctctctacctctcccggtgcgcggctgaagtgaaggtcaggaccatgcaggcggcggcggtgaatggcgggggcgacgtgcagaagcctcagcagcagccgcagccggtggttgtgggggcgccgcatccgccggcggcggcagtggtgccgccccattgggtggccatgccgttcacgccgccgccaggggccgcggccatggtgatgccgccgcaccagatggcgccgccgccccagttcgcgcccgcgcacttcgtcccgttccacgccgtcgcggcgccgccgccgccgccgccgcgggcggcgcccgtggcggccgtcgccctgggctcccccgcgccgcatcaggccgggcaggaggagaacaagaccatctgggtcggcgacctccattactggatggacgagaactacctccacagctgcttcggctacaccggcgaggttgtggccattaaagttattcgcaataaacagactggacagtctgaaggatatggatttgttgagttctacagccatgctgcagctgaaaaagttcttgaaggtttttctggtcatataatgccaaatactgaccaaccttttaggttaaattgggcatcatttagcatgggagataggcgctcggatgttgcttcagatcattccatattcgtaggcgatcttgcttctgatgtcaatgatgctacacttctggagactttctccagcaggtactcctctgtcaaaggtgccaaagttgttattgatgctaacactggcagatccaagggctatggtttcgtgagatttggagatgacagtgagaagacacatgccatgactgagatgaatggtgtatattgctcttctaggcccatgagaattggccctgcaactcccagaaaatcatcaggtacttctggatcaaatggttcatctgcccgttcagatggaggagacttgacaaacacaactgtatttgtcggcgggctcgacccaaatgttagtgaagaggaccttaggcagaccttctcccagtatggcgaaatatcttctgtaaagattccagtcggtaaacaatgcggcttcgtgcaatttgctcagagaaagaatgcagaggatgcattgcaaggactaaacggaagcaccattggcaagcagaccgtgcgcctttcatggggccgcaacccagcaaacaagcagtttaggggcgacaacgggaaccagtggaacaacgggatgtactacgcggcgtccccgttctacaacggctacggctaccctgcggcgccgttccctgaccccggcatgtacgccgctccggcctacggcgcctacccgttctacggcaaccagcaacaagtgagctgagctgctcgttctgaactgaactgccggcgcgtcccgggcgaagctggagctggaggtattaggctgttaggtgtagcaaagctcatggtagaagaaggtagacgacgacggtttcttaggtgagctagatgcggtgacttgcctttgtaaagtgcgctacacgatctagcgcctagcgccaccaagagtccgagacacctattgattggccaccactgtctgtcggattcaacggcaaaaaaagaatttttgatgacctggagctgtatgcgaccttgaagcag

SEQ ID NO: 32784 - protein, 437 aa, Panicum virgatum
  misc_feature: Ceres CLONE 1912654
  misc_feature (307)..(372): Pfam Name: RRM_1 Pfam Description: RNA recognition motif. (a.k.a. RRM, RBD, or RNP domain)
  misc_feature (204)..(276): Pfam Name: RRM_1 Pfam Description: RNA recognition motif. (a.k.a. RRM, RBD, or RNP domain)
  misc_feature (111)..(182): Pfam Name: RRM_1 Pfam Description: RNA recognition motif. (a.k.a. RRM, RBD, or RNP domain)
  misc_feature: The sequence is a functional homolog of SEQ ID NO 536 in the 10/666,642 US patent application
  misc_feature: The sequence is a functional homolog of SEQ ID NO 252 in the 10/714,887 US patent application
  misc_feature: The sequence is a functional homolog of SEQ ID NO 252 in the 11/435,388 US patent application
  misc_feature: The sequence is a functional homolog of SEQ ID NO 568 in the 10/666,642 US patent application
  misc_feature: The sequence is a functional homolog of SEQ ID NO 1484 in the 10/666,642 US patent application
  misc_feature: The sequence is a functional homolog of SEQ ID NO 278 in the 10/714,887 US patent application
  misc_feature: The sequence is a functional homolog of SEQ ID NO 278 in the 11/435,388 US patent application
MQAAAVNGGGDVQKPQQQPQPVVVGAPHPPAAAVVPPHWVAMPFTPPPGAAAMVMPPHQMAPPPQFAPAHFVPFHAVAAPPPPPPRAAPVAAVALGSPAPHQAGQEENKTIWVGDLHYWMDENYLHSCFGYTGEVVAIKVIRNKQTGQSEGYGFVEFYSHAAAEKVLEGFSGHIMPNTDQPFRLNWASFSMGDRRSDVASDHSIFVGDLASDVNDATLLETFSSRYSSVKGAKVVIDANTGRSKGYGFVRFGDDSEKTHAMTEMNGVYCSSRPMRIGPATPRKSSGTSGSNGSSARSDGGDLTNTTVFVGGLDPNVSEEDLRQTFSQYGEISSVKIPVGKQCGFVQFAQRKNAEDALQGLNGSTIGKQTVRLSWGRNPANKQFRGDNGNQWNNGMYYAASPFYNGYGYPAAPFPDPGMYAAPAYGAYPFYGNQQQVS

SEQ ID NO: 32785 - DNA, 725 bp, Panicum virgatum
  misc_feature: Ceres CLONE 1912658
  misc_feature: Encodes the peptide sequence at SEQ ID NO. 32786
attttgtctcgtctcgctctcaggctcgcgtcaccggagctctccagaagcaaagggccgggcggatccgatccccttcgcctccttgtcaacccgccaagaatactgtgaggaatggctgaagaggatatccagccccttgtctgtgacaatggcactggaatggtcaaggccggtttcgctggcgacgatgcaccaagggctgtctttccgagcattgtaggccgaccacgccacactggtgtcatggttggcatgggccaaaaggatgcctacgtgggcgatgaagctcaatccaaaagaggtatattgacactgaagtacccaatcgagcatggcattgtcaacaactgggatgacatggagaagatctggcaccacaccttctacaacgaacttcgtgtggcacctgaagagcatcctatactgctgacagaggcccctctcaacccaaaggcaaacagggagaagatgacccagatcatgtttgagacattcaactgcccggcaatgtatgtcgccatccaggccgttctttccctgtacgcaagtggtcgaacaaccggtattgtgctcgactctggtgatggtgtgagccacactgtcccaatctacgaagggtacacgcttcctcatgctattcttcgattggaccttgctggccgtgaccttaccgacaacctgatgaagatccttaccgagaggggttactccttcaccacgac

SEQ ID NO: 32786 - protein, 203 aa, Panicum virgatum
  misc_feature: Ceres CLONE 1912658
  misc_feature (3)..(203): Pfam Name: Actin Pfam Description: Actin
  misc_feature: SWISSPROT Homolog: EC 2.7.10.2 Non-specific protein-tyrosine kinase
  misc_feature: Useful for making plants with modulated biomass
  misc_feature: Useful for making plants with modulated flowering time
MAEEDIQPLVCDNGTGMVKAGFAGDDAPRAVFPSIVGRPRHTGVMVGMGQKDAYVGDEAQSKRGILTLKYPIEHGIVNNWDDMEKIWHHTFYNELRVAPEEHPILLTEAPLNPKANREKMTQIMFETFNCPAMYVAIQAVLSLYASGRTTGIVLDSGDGVSHTVPIYEGYTLPHAILRLDLAGRDLTDNLMKILTERGYSFTT

SEQ ID NO: 32787 - DNA, 721 bp, Panicum virgatum
  misc_feature: Ceres CLONE 1912684
  misc_feature: Encodes the peptide sequence at SEQ ID NO. 32788
attcctcgacggatcgatcttgatttctcgccgccgtccgcgcatctctgccaccgccgccgccacctgcctgtttgggaggttgccaggccgcgcgcccatggccgtcaccgtgtgcgtcaccggcgccggcggcttcatcgggtcttggatcgtcaagctcctcctcgaccgcgggtacgccgtccggggcacctcccgccgcgcagatgaccccaagaacgcgcacctctgggcgctcgacggcgcggcggagcgcctcacgatgctgcaggtggacctgctcgaccgggccagcctccgcgccgccttcgacggctgcgacggcgtcatccacaccgcctcgccgatgcacgacaaccccgttagtgccgccgccgatgagctcggatgagaacaccccttgatgcagcggaaagataagctgaagtgtttttctttcttcctccccacctgttattaggaggagatcatcgagccaattatcgccgggacgcggaacgtcgttgaggccgcggccgacgccggcgtgcggcgcctggtgatctcctccaccatcggcaccatgtacatgaacccgcaccgcgaccccgacgcgcccctggaggagtggagctggagcgacctcgagcactgcaagaagaccgcgaactggtactgctacgccaagacgatcgcggagcagagcgcgtggcaggcggcgcgggcgcggggcctggac

SEQ ID NO: 32788 - protein, 97 aa, Panicum virgatum
  misc_feature: Ceres CLONE 1912684
  misc_feature: SWISSPROT Homolog: EC 1.1.1.219 Dihydrokaempferol 4-reductase
  misc_feature: Useful for making plants with altered carbohydrate content
  misc_feature: Useful for making plants with altered lignin content
  misc_feature: Useful for making plants with altered cell wall content and/or composition
MAVTVCVTGAGGFIGSWIVKLLLDRGYAVRGTSRRADDPKNAHLWALDGAAERLTMLQVDLLDRASLRAAFDGCDGVIHTASPMHDNPVSAAADELG

SEQ ID NO: 32789 - DNA, 710 bp, Panicum virgatum
  misc_feature: Ceres CLONE 1912718
  misc_feature: Encodes the peptide sequence at SEQ ID NO. 32790
ctcaaaccgccggcctccaagcccccgcagccatggtcgcggtggaggacccggaatccttcttcgccacagcgccgccgctgggggatgccggcgccgtcgccgccaggctgcaggagttcctcgcgcgcaactcttcccatccctcctcagagggcggcgggcggcggcggatcgtgtgcgtcacgtcgggcgggacgacggtgccgctggagcagcggtgcgtgcgctacatcgacaacttcagctccggccaccgcggcgccgcgtccaccgagtatttcttaaaggctggttatgccgtcatcttcgtgcatcgacgtgggagctgccaacctttctgtaggttcctgcctgatgattcatttctcaatttctttgatgtaactacagaatctaaggttcaagtggttgagtcccacacgacggaggtaaagaaggcaattggggagtatggcaaggctattgaaggaggagctctgctgaaactcccattcaccacgatatttgaatatcttcagttactgaagatggtggctacatctatgagctctgtgagtctccacgggatgttctatctcgctgccgccgtctctgacttttatgttccatgggatagcatggcaaaacataagattcagtcagccggaggcccactggatatgaagctaagccaggtccccaaaatgctttcagttcttcgaaaccaa

SEQ ID NO: 32790 - protein, 225 aa, Panicum virgatum
  misc_feature: Ceres CLONE 1912718
  misc_feature (42)..(225): Pfam Name: DFP Pfam Description: DNA / pantothenate metabolism flavoprotein
  misc_feature: SWISSPROT Homolog: EC 6.3.2.5 Phosphopantothenate--cysteine ligase
MVAVEDPESFFATAPPLGDAGAVAARLQEFLARNSSHPSSEGGGRRRIVCVTSGGTTVPLEQRCVRYIDNFSSGHRGAASTEYFLKAGYAVIFVHRRGSCQPFCRFLPDDSFLNFFDVTTESKVQVVESHTTEVKKAIGEYGKAIEGGALLKLPFTTIFEYLQLLKMVATSMSSVSLHGMFYLAAAVSDFYVPWDSMAKHKIQSAGGPLDMKLSQVPKMLSVLRN

SEQ ID NO: 32791 - DNA, 741 bp, Panicum virgatum
  misc_feature: Ceres CLONE 1912720
  misc_feature: Encodes the peptide sequence at SEQ ID NO. 32792
ccccgaggatttgaggagccaggatgacgtcggagaagagcaagatcctggtggtcggcggcacggggtacctgggcaggcacgtcgtcgcggcgagcgcgcggctgggccacccgaccttcgcgctcgtcagggacacggcggcgtccgacgcggccagggcggcgctgctcaagagcttccaggacgccggcgtgactctcgtcaagggtgacctctacgaccgggccagcctggtgagcgcggtcaagctcgcggacgtggtcatctccacggtcggggcgccgcagatcgccgaccagaccaggctcatcgacgccatcaaggaggccggcaacgtcaagaggttcatcccgtcggagttcggcctggacgccgaccgctcgggcgccgtggagccggccaggtccacgttcatcaccaccaaggccgccgtccgccgcgccgccgaggccgccggcgtcccctacacgctcgtgtggacgggctacttcttcggctacgggctgcccggcatcgggcaggtcctggcgcagtcgccccccgccgacacggccgtcgtgctcggcggcggcgacgccagggtgtcgttcgtggacgagggcgacatcgggacgtacacggtgctggccgccgacgacccgcgcgcggcgaaccggacgctgtacgtgaagccgccggccaacacgctgtcgcacaacgagctcctggcgctgtgggagacaagaccggcagggcgtt

SEQ ID NO: 32792 - protein, 239 aa, Panicum virgatum
  misc_feature: Ceres CLONE 1912720
  misc_feature (8)..(237): Pfam Name: NmrA Pfam Description: NmrA-like family
  misc_feature: SWISSPROT Homolog: EC 1.3.1.45 2'-hydroxyisoflavone reductase
MTSEKSKILVVGGTGYLGRHVVAASARLGHPTFALVRDTAASDAARAALLKSFQDAGVTLVKGDLYDRASLVSAVKLADVVISTVGAPQIADQTRLIDAIKEAGNVKRFIPSEFGLDADRSGAVEPARSTFITTKAAVRRAAEAAGVPYTLVWTGYFFGYGLPGIGQVLAQSPPADTAVVLGGGDARVSFVDEGDIGTYTVLAADDPRAANRTLYVKPPANTLSHNELLALWETRPAGR

SEQ ID NO: 32793 - DNA, 660 bp, Panicum virgatum
  misc_feature: Ceres CLONE 1912749
  misc_feature: Encodes the peptide sequence at SEQ ID NO. 32794
taattgctcatgtggctgaaggtgacgtggaggatgttaaccgtgccgtcgctgcagcacgcaaggcttttgatgaggggccgtggccgaagatgactgcatatgtaaatactcatcttgacattttagtttccgttgtgtcattgtagcctacagccatgctcacagctggtcggaatttatctttgcaggagaggtcccttatcctgctacggtttgctgatttgatcgagaagcacaatgacgagattgctgctttggagacatgggacaatgggaaaccatatgaacaagctgcccaaattgaagtaccgatggtggcccgtcttatgcgttactatgctggttgggctgataagatccatgggctcgttgtgccggctgatggaccacaccatgtacaggtcttgcacgagccaattggtgttgcaggtcagatcatcccatggaacttcccactgctgatgtttgcctggaaagttggccctgctttggcatgtgggaacactcttgtgctcaagactgctgaacaaactcctctttcggccttgtacatctccaagttgttgcatgaggctggactccctgagggtgtcgtgaatgttgtctctggttttggtcctactgctggtgctgctcttgctagtcacatggatgttg

SEQ ID NO: 32794 - protein, 167 aa, Panicum virgatum
  misc_feature: Ceres CLONE 1912749
  misc_feature (2)..(167): Pfam Name: Aldedh Pfam Description: Aldehyde dehydrogenase family
  misc_feature: SWISSPROT Homolog: EC 1.2.1.3 Aldehyde dehydrogenase (NAD(+))
  misc_feature: Useful for making plants with altered carbohydrate content
MLTAGRNLSLQERSLILLRFADLIEKHNDEIAALETWDNGKPYEQAAQIEVPMVARLMRYYAGWADKIHGLVVPADGPHHVQVLHEPIGVAGQIIPWNFPLLMFAWKVGPALACGNTLVLKTAEQTPLSALYISKLLHEAGLPEGVVNVVSGFGPTAGAALASHMDV

SEQ ID NO: 32795 - DNA, 1474 bp, Panicum virgatum
  misc_feature: Ceres CLONE 1912767
  misc_feature: Encodes the peptide sequence at SEQ ID NO. 32796
actctctcctctcctctcctctcctctcgtctctccccccccctgtggcccctccctctcccacgcgcaaggcacaacacaaggcaggcaacggcacatcacttggtggagcagctagccagttgggaagagagagagagaagcagagcaggaggggggagaagaggagggaggagagaagagcggcagccaagaagaggagaggaggggcaagatgctgcgcggcggcacgagcgtgctgggatcgtcaacttcatcaccttcctgatctcgatccccatcctgggcggcggcatctggctggcgtcccgggccaactccaccgactgcatccgcttcctgcagtggcccatcatcatcgtggggctcgtcctcatggtcatctccctcatgggcttcgccggcgcctgctaccgccagacctggctcctccgcctctacctcttcgccatgttcttcgtcgtcctcgcgctcctcttcttcatcgtcttcgccttcgccgtcaccgaccgcggcgacggccaggtcgtcatgaaccgccgcttcctcgagtaccagctctccgactacagcggctggctccgcgaccgcgtcgccgacccggagtactgggccaccatcagcgcctgcctccgcgacggccacgcctgctccggcatgaggcgatacgcgcgcgaccccaacaccggcatgcgcgtgccggagacgcccgacttgttctacgcccgcaacctctcccccattcagtctggatgctgcaaaccaccatcatcatgtgggttcacctacaataacgagacatactggacaccaaaccccggtgtcccggcgatcagcgatccggattgcaacaggtggagcaacgaccagcagacgctctgcttccagtgtaactcgtgcaaggcgggtgtcctggcaggcatcaagaagagctggcgcaaggtggccatcctaaacattgtagtgctgatcattctcgttatcgtctatgttgctggctgtgctgcgttccgtaacgccaagaggatcgagaacgatgagcccatcggcatggcgcggatgaccaagtcccagccgagcaggttccagttctagactgccgtgggaggctcggaagtttttgccttgtacaaatgaccacactgggtggtgctacggcttggcctttgttagatcttactgaaatgtggggtcaactacatttgggtggtgaacagggaaggagttcgcttatcaaaaagtttaagtgtggtttatttttgtgcttgccttagtgtttagggtaggtctattatgtattgggtgcaaaaaagatgggatctgcaagaaacaagagtacttcacttaggaatgtattgttctgtatgggagatttttatgtcatctttcctagaagaatttgtcatcttctgcattctagaagatagtgttacgatggtaccatgatggaatgtactctgaatttcaagattgc

SEQ ID NO: 32796 - protein, 364 aa, Panicum virgatum
  misc_feature: Ceres CLONE 1912767
  misc_feature (80)..(326): Pfam Name: Tetraspannin Pfam Description: Tetraspanin family
  misc_feature: Useful for making plants with modulated nitrogen use efficiency
TLSSPLLSSRLSPPLWPLPLPRARHNTRQATAHHLVEQLASWEERERSRAGGGRRGGRREERQPRRGEEGQDAARRHERAGIVNFITFLISIPILGGGIWLASRANSTDCIRFLQWPIIIVGLVLMVISLMGFAGACYRQTWLLRLYLFAMFFVVLALLFFIVFAFAVTDRGDGQVVMNRRFLEYQLSDYSGWLRDRVADPEYWATISACLRDGHACSGMRRYARDPNTGMRVPETPDLFYARNLSPIQSGCCKPPSSCGFTYNNETYWTPNPGVPAISDPDCNRWSNDQQTLCFQCNSCKAGVLAGIKKSWRKVAILNIVVLIILVIVYVAGCAAFRNAKRIENDEPIGMARMTKSQPSRFQF

SEQ ID NO: 32797 - DNA, 695 bp, Panicum virgatum
  misc_feature: Ceres CLONE 1912778
  misc_feature: Encodes the peptide sequence at SEQ ID NO. 32798
ttacacgcaccagatcactagccactagcagaaaggaaatgaggcatcgtcaggaagagatgcacctcatcagctgcagcagcttgttgctcgtgctcgtgctggccgcaggcggcggtggtgtatctgctgctgctgctgccaacaccacgacgaccacgacgagatcatcgaccaagccgcaggcggccgccctcatcgtgttcggcgactccatcgtcgaccccggcaacaacaacggcatcaacaccatcgtcaaggccgacttccctccctacggccacgacttcctcaaccaccgacccaccggacgcttctgcaacggcaggataccaacggacttcatagcgtcccggctgggcctcaaggacctcctcccgccctacctctcccctgagccgctggacaagcacgacctcctcaccggcgtcagcttcgcctccggcggcaccggcttcgacccgctcacgcccaagctcgcctccgtcatctcgatgcccgaccagctggccatgttccacgagtacctgggcaaggtgcgcgccgccgccggggacgccaaggccgccgagatcctctcccggggcatcttcgccatctgcgccggcagcgacgacgtggccaacacctacttcaccatgcgcgcgcgcagcaactacgaccacgcctcgtacgcgcggctcctcgtgcggcac

SEQ ID NO: 32798 - protein, 218 aa, Panicum virgatum
  misc_feature: Ceres CLONE 1912778
  misc_feature: SWISSPROT Homolog: EC 3.2.1.51 Alpha-L-fucosidase
MRHRQEEMHLISCSSLLLVLVLAAGGGGVSAAAAANTTTTTTRSSTKPQAAALIVFGDSIVDPGNNNGINTIVKADFPPYGHDFLNHRPTGRFCNGRIPTDFIASRLGLKDLLPPYLSPEPLDKHDLLTGVSFASGGTGFDPLTPKLASVISMPDQLAMFHEYLGKVRAAAGDAKAAEILSRGIFAICAGSDDVANTYFTMRARSNYDHASYARLLVR

SEQ ID NO: 32799 - DNA, 1282 bp, Panicum virgatum
  misc_feature: Ceres CLONE 1912784
  misc_feature: Encodes the peptide sequence at SEQ ID NO. 32800
gctaaaaaccaacccaacagcccactctgtcctctcccctctggcccctccctctcccacgtgcaaggcacagcacaaggcaggcaacggcacaacacttggtggagcaaccagccagagagaaagagaagcagagcaggaggaagaagaaagagggagaagaagagcggcagccaagaagaggaggagcaagatgctgcgcggcggcacgagcatgctggggatcgtcaacttcatcaccttcctgatctcgatccccatcctgggcggcggcatctggctggcgtcccgggccaactccaccgactgcatccgcttcctgcagtggcccatcatcgtcgtggggctcgtcctcatggtcatctccctcatgggcttcgccggcgcctgctaccgccagacctggctcctccgcctctacctcttcgccatgttcttcgtcgtcctcgcgctcctcttcttcatcgtcttcgccttcgccgtcaccgaccgcggcgacggacaggtcgtcatgaaccgccgcttcctcgagtaccagctctccggctaccgcggctggctccgggaccgcgtcgccgacccgcagtactgggccaccatcagcgcctgcctccgcgacggccacgcctgctccggcatgaggcgattcgggcgcacccccaacaccggcatgctcgtgccggagacgtcggacatgttctacgcccgcaacctctcccccattcagtctggatgctgcaaaccaccaacatcatgtgggttcacctacaataacgagacatactggacgccaaaccctggagtcccgatcagcgatgcagactgcaacaggtggagcaacgaccagcggacgctctgcttccagtgtgactcgtgcaaggcgggtgtcctggcaggcatcaagaagagctggcgcaaggtggccatcctaaacattgtggtgctgatcatcctcgttatcgtctatgttgctggctgtgctgcgttccgtaacgccaagaggatcgataacgacgagccgatcggcatggcgcggatgaccaagtcccagccgagcaggttccagttctagactgctgtggcgggttcgcaagcttttgccttgtacaaatgaccacactgggatacgcggatacttcgcaaaactcaagtaccggtatcggataccgtatcggatacccgtactccatggatattcccgaatacgtattccgtaagtatcggactatttagatattttcaaataataaaaataaatcggatactcgtgggatacctgtcc

SEQ ID NO: 32800 - protein, 292 aa, Panicum virgatum
  misc_feature: Ceres CLONE 1912784
  misc_feature (6)..(254): Pfam Name: Tetraspannin Pfam Description: Tetraspanin family
  misc_feature: Useful for making plants with modulated nitrogen use efficiency
MLRGGTSMLGIVNFITFLISIPILGGGIWLASRANSTDCIRFLQWPIIVVGLVLMVISLMGFAGACYRQTWLLRLYLFAMFFVVLALLFFIVFAFAVTDRGDGQVVMNRRFLEYQLSGYRGWLRDRVADPQYWATISACLRDGHACSGMRRFGRTPNTGMLVPETSDMFYARNLSPIQSGCCKPPTSCGFTYNNETYWTPNPGVPISDADCNRWSNDQRTLCFQCDSCKAGVLAGIKKSWRKVAILNIVVLIILVIVYVAGCAAFRNAKRIDNDEPIGMARMTKSQPSRFQF

SEQ ID NO: 32801 - DNA, 704 bp, Panicum virgatum
  misc_feature: Ceres CLONE 1912792
  misc_feature: Encodes the peptide sequence at SEQ ID NO. 32802
atctatcatcaactagatatgcaccgaggccaagaccatcctctccgtcgacgacatcctggcgctcattggcgaccggtgcgacgctgtcatcgggcagctcaccgaggactggggggaggtgctcttctcggccctcaagcgcgccggcgggacggctttcagcaacatggccgtcggctacaacaacgtcgacgtcgaggctgccaacaggaacggcatcgccgtcggcaacacgccgggcgtcctcaccgagaccacggctgagctcgccgcctccctcacgctggcagcagccaggaggatcgtggaggcggaccagttcatgagggctggcctatacgagggatggctcccgcacctgttcgttggcaacctgctcaaggggcagactgttggggtcatcggagctggtcgcatcggctccgcgtatgcacgcatgatgatcgagggcttcaagatgaacctcatcaactacgacctctaccaggccacacgccttgagaagttcgtcacagcatatgggcagttcctcaaagccaacggtgagcagcctgtcacctggaagagggccgccaccatggaggatgtcctcagggaggctgatgtgataagtctgcatccggtgctggacaagaccacttaccatctcataaaccctgagaggctggccatcatgaagaaggatgcggttcttgtgaaac

SEQ ID NO: 32802 - protein, 178 aa, Panicum virgatum
  misc_feature: Ceres CLONE 1912792
  misc_feature (36)..(178): Pfam Name: 2-Hacid_dh_C Pfam Description: D-isomer specific 2-hydroxyacid dehydrogenase, NAD binding domain
  misc_feature: SWISSPROT Homolog: EC 1.1.1.29 Glycerate dehydrogenase
MAVGYNNVDVEAANRNGIAVGNTPGVLTETTAELAASLTLAAARRIVEADQFMRAGLYEGWLPHLFVGNLLKGQTVGVIGAGRIGSAYARMMIEGFKMNLINYDLYQATRLEKFVTAYGQFLKANGEQPVTWKRAATMEDVLREADVISLHPVLDKTTYHLINPERLAIMKKDAVLVK

SEQ ID NO: 32803 - DNA, 1286 bp, Panicum virgatum
  misc_feature: Ceres CLONE 1912801
  misc_feature: Encodes the peptide sequence at SEQ ID NO. 32804
accagacgcgcgccaccgcttccatctcgcgccggccctcctacgccatcacatcaccaccaagccaagccaagccaagccaagcaagcctcgcctccgcattgctccgctcgccatggcgcgcctgctccgtgccacggcgttgctcctcgcgctcgcggcgctggccgccgcggcgccgggcggggacctcggccacctcgtgatgcggcgcagcgcgcgggcgtgccgcggcaccgtgggcgagtgcatgggctacctcgacgtggacgccgagggcgaggccgacgtggccgggatggccaccggcggcagcaagcgccgggtgctgcagggcggctccgggtacatcggctacgacgcgctgcgccgggacaacgtgccctgctcccagcgcggcgcctcctactacaactgccagcccggcgccgaggccaacccctactcccgcggctgcagcgccatcacccagtgccggggctgatcgcgccctgcacgcgtcttccacctcaaatcatgttgctgctagcttcatggtgatgtttgtcttacgagttcgagagatgggttgcgcagtggagatgtgtctgctctgttctagctgagcttcgccttcagggtttaagtaaaagtaatttatatacgatcgtgtaattcttgtgtctctgaatttaccgccaaatgaattttcatcatatgttcctgcatatatttgatcgaatttcctggcaaaaacatgtcgactgaacaaacatttctgcatttcctctatcgacagagttgcgctcaagaaactcattactggatatatatgaactttggcaaattttctggaggtttgtcaggaaagagatgtcaattccttttgagttgagctgtcagttctgagtatcaacttcaacccccatttttttttcactttttttgggtgatgatcagcagattcggatcagaccaggcactatggtgaccaatctttagtcatatttggtctcaaagggaaaacgaccctgtcttgttgaagagatcaattcaactggggccgtgatcaaattagtgtttagatatactgtttaaaaattgttcatttgctgatgccaccaactgtggttgggctgtcatttttcaccttttgtggagtcaatgtacataggagctttattgttggcataaataaaagcagattcctttgctcttcaaagggacatgtaactactcctttgagttgtgcatcctatagcgaagtgacaataaatctttaccatggccaactgggaccaaggact

SEQ ID NO: 32804 - protein, 122 aa, Panicum virgatum
  misc_feature: Ceres CLONE 1912801
  misc_feature (56)..(122): Pfam Name: RALF Pfam Description: Rapid ALkalinization Factor (RALF)
MARLLRATALLLALAALAAAAPGGDLGHLVMRRSARACRGTVGECMGYLDVDAEGEADVAGMATGGSKRRVLQGGSGYIGYDALRRDNVPCSQRGASYYNCQPGAEANPYSRGCSAITQCRG

SEQ ID NO: 32805 - DNA, 725 bp, Panicum virgatum
  misc_feature: Ceres CLONE 1912813
  misc_feature: Encodes the peptide sequence at SEQ ID NO. 32806
atccatcgacggccggtgcgaggcgaagcaagcagagcagtcggagaaggagcacttgagaggcagaacacctaaccagtggcaatggccatggaagtggagcaggacctcccgggcttcaggttccaccccacggaggaggagctcctcgacttctacctcgaccgcatggtccacggcaagaagctccacttcgacatcatcggcacgctcaacatctaccgccacgacccctgggaccttcctgcgatggcgaagatcggggagagggagtggtacttcttcgtgccgcgggaccggaaggccggcagcggcgggcggccgaaccggacgacggagcgcgggttctggaaggccacggggtcggacagggccatccggagcagcgccgactccaagcgggtgatcgggctcaagaagacgctcgtcttctaccaggggcgcgccccgcggggcaccaagacggactgggtcatgaacgagtaccgcctccccgactccggcgccggcagaggagcacgagcaccgccgcctcccaaggaggacatggtgctatgcaagatctacaggaaggccaccccactcaaggagctggaacagagagcctctgccatggaggagatgcagaggcgcagcaacgcgcactacacgaacacggccagggcaccccaggtccaggccgcggcctccgccggcgacgactacctgtcgtcggacgacgccac

SEQ ID NO: 32806 - protein, 213 aa, Panicum virgatum
  misc_feature: Ceres CLONE 1912813
  misc_feature (8)..(137): Pfam Name: NAM Pfam Description: No apical meristem (NAM) protein
  misc_feature: The sequence is a functional homolog of SEQ ID NO 745 in the 11/479,226 US patent application
  misc_feature: The sequence is a functional homolog of SEQ ID NO 2 in US patent 7230164
  misc_feature: The sequence is a functional homolog of SEQ ID NO 6 in US patent 7230160
  misc_feature: The sequence is a functional homolog of SEQ ID NO 116 in the 10/225,066 US patent application
  misc_feature: The sequence is a functional homolog of SEQ ID NO 2476 in the 10/374,780 US patent application
  misc_feature: The sequence is a functional homolog of SEQ ID NO 88 in the 11/375,241 US patent application
  misc_feature: The sequence is a functional homolog of SEQ ID NO 2592 in the 10/374,780 US patent application
  misc_feature: The sequence is a functional homolog of SEQ ID NO 288 in the 10/225,066 US patent application
  misc_feature: Useful for making plants with altered cell wall content and/or composition
  misc_feature: Useful for making plants with altered lignin content
  misc_feature: Useful for making plants with modulated water use efficiency
  misc_feature: Useful for making plants with modulated light quality response
MAMEVEQDLPGFRFHPTEEELLDFYLDRMVHGKKLHFDIIGTLNIYRHDPWDLPAMAKIGEREWYFFVPRDRKAGSGGRPNRTTERGFWKATGSDRAIRSSADSKRVIGLKKTLVFYQGRAPRGTKTDWVMNEYRLPDSGAGRGARAPPPPKEDMVLCKIYRKATPLKELEQRASAMEEMQRRSNAHYTNTARAPQVQAAASAGDDYLSSDDA

SEQ ID NO: 32807 - DNA, 651 bp, Panicum virgatum
  misc_feature: Ceres CLONE 1912819
  misc_feature: Encodes the peptide sequence at SEQ ID NO. 32808
atgtgcttgctcccatcaatacacacacgcacgcacaccggccgggcggccaggcagccaacgacacagctctccctttcctttcctgttcctccctgcattccttctccagcaagagctttctagctagctaggggttacactacagaaatactaggacagaggcatcgatcgaacagcgctccagcttcctgggcgacgccgccacccgaattccggcgtgaggagtcaggcgcgctcgctcgctctcagctagctcaggggcagccggccatcccgtcagattcagcggaaggggccatggtgcaagttatttgagctcatctgagagggaggaagtgtggactcttggtcatgcttgtgtgatcaagatcgcggtggctagcttaagatgataaggggcaacctcacaaatgaagagctggcggccaggtgcaccaaggtcgaggccccgggcggcggcgccggcgccgtcctcgccaagagtcctgccgtgccgagctcgcgggactggccgccgtccaaggagtcgaggatcatgcgcgtgtcgcgggtgttcggcggaaaagaccggcacatcaaggtgaggaccggcaaggggctgcgcgaccggagcgtgcggctgtccgtgccgacggcgatccagctcta

SEQ ID NO: 32808 - protein, 86 aa, Panicum virgatum
  misc_feature: Ceres CLONE 1912819
  misc_feature: The sequence is a functional homolog of SEQ ID NO 1202 in the 10/666,642 US patent application
  misc_feature: The sequence is a functional homolog of SEQ ID NO 184 in the 10/225,066 US patent application
  misc_feature: The sequence is a functional homolog of SEQ ID NO 2816 in the 10/374,780 US patent application
MIRGNLTNEELAARCTKVEAPGGGAGAVLAKSPAVPSSRDWPPSKESRIMRVSRVFGGKDRHIKVRTGKGLRDRSVRLSVPTAIQL

SEQ ID NO: 32809 - DNA, 509 bp, Panicum virgatum
  misc_feature: Ceres CLONE 1912823
  misc_feature: Encodes the peptide sequence at SEQ ID NO. 32810
gcgaaagctcaagtaatctaacaacagtcgcctaatccactctcaaatcaagcccctaatagcctccatatcccccgatagaggtgcacccaccgcagcctctgcagcaagatggctccagagattgccggccagatgaccgctaacgccgccgccgccgccgccgccgccgccgccgcattaaagcccgcaaccagggcatacttaacgttcctggcgggtgactgcaactactgtaagggcgtggtgggtctgggcaatggcctgcgcaaggtccgctctccttacccgctggtgggcgccgtgctgcccgacgtgcccgacgcccacctccggatcctcgtatcgcgtggctacatcgaccatcagatccaccccctgtacccgccggagaaccaagacgcagttccccatggatctactacgctctcaactactcccagctccaatatctgggagttcgtggagtacgatcggatggtgtacatggacgcatacatccatgtgta

SEQ ID NO: 32810 - protein, 132 aa, Panicum virgatum
  misc_feature: Ceres CLONE 1912823
  misc_feature: Useful for making plants with altered carbohydrate content
  misc_feature: Useful for making plants with altered cell wall content and/or composition
MAPEIAGQMTANAAAAAAAAAAALKPATRAYLTFLAGDCNYCKGVVGLGNGLRKVRSPYPLVGAVLPDVPDAHLRILVSRGYIDHQIHPLYPPENQDAVPHGSTTLSTTPSSNIWEFVEYDRMVYMDAYIHV

SEQ ID NO: 32811 - DNA, 693 bp, Panicum virgatum
  misc_feature: Ceres CLONE 1912831
  misc_feature: Encodes the peptide sequence at SEQ ID NO. 32812
gtcccctcccaaaccgcggcaactgccaccggacccgcccgcgccgccgcgcccgcacctacgccccccgccggtgctctccttgcgacccgccggcgccgatccaggagcaacgccgccgccgggggccatgacctccgctcactccaagctctactccgatgacgtcagcctcgtggtggtggtcgtcgacacgaaccccttcttctgggccgctgctgcgctccccttcgccgacttcttcgcgaatctgatccacttcgtgaactcactcctactgctgaaccacctcaaccgtgtggtcgtcatcgccgctggagtcagctcctgtgcctacatctttgattccagcgatgccagccccgctggtggtgtaggcgtcacggccacctttgaaaacgcaagccgcaaggtggaggagttcattgcacaagatgctcgtgccactgcgggcaacggttccgttgcttctgccaatgccgcgtcactgctgtctggggcactgtcccttgctttgtgctatatacagagggtttccaggtctgggactcgacatccgcaacctcggggttctccagatggtcctgaacaatatgtggcagtgatgaattcaatattttctgctcaacgttccatggttccaattgattcatgtattgtgggaacccatgattctgctttcttgcaacaggc

SEQ ID NO: 32812 - protein, 187 aa, Panicum virgatum
  misc_feature: Ceres CLONE 1912831
  misc_feature (12)..(187): Pfam Name: Tfb4 Pfam Description: Transcription factor Tfb4
MTSAHSKLYSDDVSLVVVVVDTNPFFWAAAALPFADFFANLIHFVNSLLLLNHLNRVVVIAAGVSSCAYIFDSSDASPAGGVGVTATFENASRKVEEFIAQDARATAGNGSVASANAASLLSGALSLALCYIQRVSRSGTRHPQPRGSPDGPEQYVAVMNSIFSAQRSMVPIDSCIVGTHDSAFLQQ

SEQ ID NO: 32813 - DNA, 686 bp, Panicum virgatum
  misc_feature: Ceres CLONE 1912836
  misc_feature: Encodes the peptide sequence at SEQ ID NO. 32814
gtcaacagcagcgcggccagtgtagcggaggggtggagcagtgatcggtgtgccgtgtgcgagcgtgcagtgcgtgcgcatggcggcgcagctgggactcgtcggccacgaggcgtacgccgccgcctgctcctacccgccgcccgccgccgcctcctcctacttcttccctcccgagctcgtggcggacagcggtggtgctggtgccgtgatgatggagttcccgccgcccgccgcctgcacggctgactactgcctcccggagatcatgggcgcgcgaacgcacgactactactgctcgccgccggctccggcgctggccaacggcggcgctgccgccgccgagaacgagatgatgaacatgagctacgtggacgatggcgggaggatgacgatgatgggcgggtcggccaggaacggcggccgtcagccatcgccgcggatcgggttccggacgaggtcggaggtggacgtcctggacgacggcttcaagtggcgcaagtacggcaagaaggcggtcaagagcagccccaacccgaggaactactaccggtgctcggcggaggggtgcggcgtgaagaagcgcgtggagcgggaccgcgacgatccacgcgacgtcgtcaccacctacgacggcgtccacaaccacgccgtgcccggccgcggcggcgccgcccagcagccgg

SEQ ID NO: 32814 - protein, 202 aa, Panicum virgatum
  misc_feature: Ceres CLONE 1912836
  misc_feature (133)..(192): Pfam Name: WRKY Pfam Description: WRKY DNA -binding domain
  misc_feature: The sequence is a functional homolog of SEQ ID NO 146 in the 10/714,887 US patent application
  misc_feature: The sequence is a functional homolog of SEQ ID NO 146 in the 11/435,388 US patent application
  misc_feature: The sequence is a functional homolog of SEQ ID NO 206 in the 10/714,887 US patent application
  misc_feature: The sequence is a functional homolog of SEQ ID NO 206 in the 11/435,388 US patent application
  misc_feature: The sequence is a functional homolog of SEQ ID NO 148 in the 10/714,887 US patent application
  misc_feature: The sequence is a functional homolog of SEQ ID NO 148 in the 11/435,388 US patent application
  misc_feature: The sequence is a functional homolog of SEQ ID NO 210 in the 10/714,887 US patent application
  misc_feature: The sequence is a functional homolog of SEQ ID NO 210 in the 11/435,388 US patent application
MAAQLGLVGHEAYAAACSYPPPAAASSYFFPPELVADSGGAGAVMMEFPPPAACTADYCLPEIMGARTHDYYCSPPAPALANGGAAAAENEMMNMSYVDDGGRMTMMGGSARNGGRQPSPRIGFRTRSEVDVLDDGFKWRKYGKKAVKSSPNPRNYYRCSAEGCGVKKRVERDRDDPRDVVTTYDGVHNHAVPGRGGAAQQP

SEQ ID NO: 32815 - DNA, 601 bp, Panicum virgatum
  misc_feature: Ceres CLONE 1912847
  misc_feature: Encodes the peptide sequence at SEQ ID NO. 32816
aatcagtaatcacaccacagtctcacacaccgccattgcccgcggcggcggcgccagcagcagcagcagcgcgatgggagtgaagtcggagtgcgacaggataaagggcccctggagccccgaggaggacgaggcgctgcggcggctcgtggagcggcacggcgcgcggaactggacggcgatcgggcggggcatccccggccggtcgggcaagtcgtgccggctgcggtggtgcaaccagctgtcgccgcaggtggagcggcggcccttcacgcccgaggaggacgccgcgatcctggcggcgcacgcgcggctcggcaaccggtgggcggccatcgcgcgcctgctccccggccgcaccgacaatgccgtgaagaaccactggaactcgtcgctcaagcggaagctcgccaccgcggcggcgccggaggccgccgacgcggagcggccgtgcaagcgcgcgagccccgggccggggagcccgacggggtcggagcgcagcgagctcagccacggctccggcggcggcggcggcgcgcaggtgttccgccccgtcccgcgcgcgggcgggttcgacgccatcggcgccgcggacgcgcgc

SEQ ID NO: 32816 - protein, 175 aa, Panicum virgatum
  misc_feature: Ceres CLONE 1912847
  misc_feature (11)..(57): Pfam Name: Myb_DNA-binding Pfam Description: Myb-like DNA-binding domain
  misc_feature (63)..(108): Pfam Name: Myb_DNA-binding Pfam Description: Myb-like DNA-binding domain
  misc_feature: The sequence is a functional homolog of SEQ ID NO 118 in the 10/412,699 US patent application
  misc_feature: The sequence is a functional homolog of SEQ ID NO 188 in the 10/225,068 US patent application
  misc_feature: The sequence is a functional homolog of SEQ ID NO 2256 in the 10/374,780 US patent application
  misc_feature: The sequence is a functional homolog of SEQ ID NO 284 in the 11/479,226 US patent application
  misc_feature: The sequence is a functional homolog of SEQ ID NO 772 in the 10/225,066 US patent application
  misc_feature: The sequence is a functional homolog of SEQ ID NO 910 in the 11/435,388 US patent application
  misc_feature: The sequence is a functional homolog of SEQ ID NO 128 in the 11/375,241 US patent application
  misc_feature: The sequence is a functional homolog of SEQ ID NO 166 in the 10/412,699 US patent application
  misc_feature: The sequence is a functional homolog of SEQ ID NO 2272 in the 10/374,780 US patent application
  misc_feature: The sequence is a functional homolog of SEQ ID NO 373 in the 11/479,226 US patent application
  misc_feature: The sequence is a functional homolog of SEQ ID NO 914 in the 11/435,388 US patent application
  misc_feature: The sequence is a functional homolog of SEQ ID NO 150 in the 10/412,699 US patent application
  misc_feature: The sequence is a functional homolog of SEQ ID NO 830 in the 11/435,388 US patent application
  misc_feature: The sequence is a functional homolog of SEQ ID NO 1054 in the 10/225,066 US patent application
  misc_feature: The sequence is a functional homolog of SEQ ID NO 144 in the 10/412,699 US patent application
  misc_feature: The sequence is a functional homolog of SEQ ID NO 2264 in the 10/374,780 US patent application
  misc_feature: The sequence is a functional homolog of SEQ ID NO 912 in the 11/435,388 US patent application
  misc_feature: The sequence is a functional homolog of SEQ ID NO 126 in the 10/412,699 US patent application
  misc_feature: Useful for making plants with altered cell wall content and/or composition
MGVKSECDRIKGPWSPEEDEALRRLVERHGARNWTAIGRGIPGRSGKSCRLRWCNQLSPQVERRPFTPEEDAAILAAHARLGNRWAAIARLLPGRTDNAVKNHWNSSLKRKLATAAAPEAADAERPCKRASPGPGSPTGSERSELSHGSGGGGGAQVFRPVPRAGGFDAIGAADA

SEQ ID NO: 32817 - DNA, 1459 bp, Panicum virgatum
  misc_feature: Ceres CLONE 1912861
  misc_feature: Encodes the peptide sequence at SEQ ID NO. 32818
aaaaaaaaacaacacggacgctgcgcaggaatcaatcacccacgcgcacacctcccttgtcccttccccccttcgctccctccccagcgtcccggagagagagagagacaagtctcctcccttcacccccgccttcaccctccctccctcgcttcccatggatctccgcctcgcccactaggcggctggggagtggtggaggaggatggggctccccgggcggctgccactgctgctgctgcttctcggcctcgcttcgccggccgtcgccgtcgccgccgaagcctccgagggcgacgccgatccgctctacaaagcttgtgttgaggaatgccaacagacaggctccctgaaagatacttcaattaagcactgtctcgtgccagccgacggcaaacctgcagccaaatcatggtacacgcacgaaccattgtacctgcaatggaaagagtggaactgcaagtgtgaatgcggttaccactgcatgatggaaagggaaaacgaaaggacagagcttggcttaccgcctgtgaagtatcacggcaagtggccgttgaagcgtgcttctgtgtttcaggaacctttatctgccgctctctctgctctcgctcttgttgtgcaattcaatgggtggctatcgtttttcctattgctttactataagctacctctacggccagaaactcataagacctactatgagtttactggcttgtggcacatttatgggcttctagccatgaattcatggttctggagtgctatatatcacagttgtgatactatttggacagagaagctgcatttttcatccgccgctgcctttctggggtactctttcattttggcgatattgcggacttcaaatttaagagacgaagcttctagagttatggttgctgctccaattctggcttttgtgacaacccacattttatacctcaacttctaccaacttgacaaaggcctgaacatgaaggtttgtactgtgataagtattgttcagtttctcctgtgggcactgtgggctgtcatgactcggcacccctcacgtctgaagatcatatttgttgccattggaggcgtgctttcagtatttctggaagcttatgacatccctccacgatggggatatgtagatggtcgtgctatctgccttgctgttgctatccccatatcgtacctttggtggagctttgccaaggaagatgctgagatgcgcacatcagcaatcacaaagaagacacgataatgagcaaatactatctgccatctgtgactattttatgtcagcactcagcctttgtaaagataaacgtttcacgtgtaatcttaggtaacttagtatgtgaattatcatctactttttaccacgatgtctcttgccttagttcaaaaggccatgtggttgaattggcacttctattctttaatttatataaagcaactgaacacttgg

SEQ ID NO: 32818 - protein, 348 aa, Panicum virgatum
  misc_feature: Ceres CLONE 1912861
  misc_feature (72)..(344): Pfam Name: Per1 Pfam Description: Per1-like
MGLPGRLPLLLLLLGLASPAVAVAAEASEGDADPLYKACVEECQQTGSLKDTSIKHCLVPADGKPAAKSWYTHEPLYLQWKEWNCKCECGYHCMMERENERTELGLPPVKYHGKWPLKRASVFQEPLSAALSALALVVQFNGWLSFFLLLYYKLPLRPETHKTYYEFTGLWHIYGLLAMNSWFWSAIYHSCDTIWTEKLHFSSAAAFLGYSFILAILRTSNLRDEASRVMVAAPILAFVTTHILYLNFYQLDKGLNMKVCTVISIVQFLLWALWAVMTRHPSRLKIIFVAIGGVLSVFLEAYDIPPRWGYVDGRAICLAVAIPISYLWWSFAKEDAEMRTSAITKKTR

SEQ ID NO: 32819 - DNA, 1085 bp, Panicum virgatum
  misc_feature: Ceres CLONE 1912884
  misc_feature: Encodes the peptide sequence at SEQ ID NO. 32820
gctctcttctcttttccgctggagaaaatttccattcgaagcgcagcctcgtttcgattcccaattccccacccaccaccatcgtctctccattccatgcccccatggccggctacccgccgcccggctccggctacccctacggccccgccgccgggggaagcggaggctacggcgccccgccctcctcccagccctacggcggcggcagcggaggctacggcgcccagcagtacggtgcgccctacggcgccccgccgccctcgtccgcccctccctacggcgcgccgccgcacgcgcccgcgccctacggggccccgccgccggcgtacggggccccgggcgggtacggcgggagccccttcgcgtcgctggtcccgtccgcgttcccgcccgggaccgaccccaacgtggtggcctgcttccaggcggcggaccgcgacggcagcgggatgatcgacgacaaggagctgcagtccgcgctctccggctacaaccagagcttcagcctccgcaccgtccacctcctcatgtacctattcaccaacaccaacgtccgaaagatcgggcacaaggaatttacttctgtgttttacagtcttcagaattggagagcaatatttgaaaggttcgatcgtgatcggagtggtaagattgactcatctgaactccgtgatgctcttctcagtctgggatattctgtctctccaactgtgctggacctgcttgtgtctaaatttgacaagactgggggcaagagcagagcaattgaatatgataacttcattgaatgttgtctcactgttaagggacggactgagaagttcaaggagaaggacacggcatactcgggatctgcgacttttacttatgaggctttcatgctgaccgtgctccctttcctcatcgcctagtggcacagttcagagcaaaagctaaacataccatgccagttgtgtaaaaaatgttcggagagttgttttggatttgactagtgttgctggggttgcgaatcataaagttgatgggtggttatgttgaacttagaaaatgctacaactgatatatagcgttggatctctttc

SEQ ID NO: 32820 - protein, 269 aa, Panicum virgatum
  misc_feature: Ceres CLONE 1912884
  misc_feature (168)..(196): Pfam Name: efhand Pfam Description: EF hand
  misc_feature: SWISSPROT Homolog: EC 3.4.22.53 Calpain-2
MAGYPPPGSGYPYGPAAGGSGGYGAPPSSQPYGGGSGGYGAQQYGAPYGAPPPSSAPPYGAPPHAPAPYGAPPPAYGAPGGYGGSPFASLVPSAFPPGTDPNVVACFQAADRDGSGMIDDKELQSALSGYNQSFSLRTVHLLMYLFTNTNVRKIGHKEFTSVFYSLQNWRAIFERFDRDRSGKIDSSELRDALLSLGYSVSPTVLDLLVSKFDKTGGKSRAIEYDNFIECCLTVKGRTEKFKEKDTAYSGSATFTYEAFMLTVLPFLIA

SEQ ID NO: 32821 - DNA, 682 bp, Panicum virgatum
  misc_feature: Ceres CLONE 1912891
  misc_feature: Encodes the peptide sequence at SEQ ID NO. 32822
gaggtcacatattcagcttttcttcctgggctcttctcaagtcctgcacgctctggaggttaggttagaaggttccgggcttccatctacaagaagcaatcggcgcagctctgttctgtttctcctggctcttggcatcgtctggtagctcgctcttggcatcgtctggtagctcgctcttggcatcgtctggtagctccggttcaaaggtggtcgtggataatactgtcggttggacactggaatagtaaaatgtgggacaaaagattgcacgggtgcctgcttcttctggtcttccttctcgcgaacgcgtcaggcagccatgctgaaaccgccgtcgattcagagcaaggcaagaggcgatccctggccacggggagcggcatgttctgcgtggcgatgcagggcgcggacccggcggcgctgcaggcggggctgaactgggcgtgcgggccggggcacgccgactgcacggccatccagccaggcgggccgtgctacaagcagaacaacctgcaggcgctggcgtcctacgcctacaacgactactaccagcgtagcgccaaaaccagcaccgcctgcgacttcaacggcaccgccaccaccaccaccacggatcccagttcggggcagtgcgtcttcacaggaagctccacggccggcggcactccggcggcaagcg

SEQ ID NO: 32822 - protein, 143 aa, Panicum virgatum
  misc_feature: Ceres CLONE 1912891
  misc_feature (45)..(130): Pfam Name: X8 Pfam Description: X8 domain
  misc_feature: SWISSPROT Homolog: EC 3.2.1.39 Glucan endo-1,3-beta-D-glucosidase
  misc_feature: Useful for making plants with altered carbohydrate content
  misc_feature: Useful for making plants with altered cell wall content and/or composition
MWDKRLHGCLLLLVFLLANASGSHAETAVDSEQGKRRSLATGSGMFCVAMQGADPAALQAGLNWACGPGHADCTAIQPGGPCYKQNNLQALASYAYNDYYQRSAKTSTACDFNGTATTTTTDPSSGQCVFTGSSTAGGTPAAS

SEQ ID NO: 32823 - DNA, 1248 bp, Panicum virgatum
  misc_feature: Ceres CLONE 1912893
  misc_feature: Encodes the peptide sequence at SEQ ID NO. 32824
acgccacgccacagcagcgcttccgtttcttctgcaggcggatagcctcagccgggggagccgacggcgatcaccgatggcggtggcggggggcgtggacctccccttggtggacctcgcgtgcccggatccccgcgccgccgccgcctccgtccgccaggtgacctcgcccgatccccccgtgccctccaacttcccgcgaagactctaacgagcgatttggttcgtgcaggcgtgcgtggagcacgggttcttctacgtgaccaaccacggcgtggacggcgccctgatcgaggcggtgttcgcggagagcaaggggttcttcgacctgcccatggaggagaagatgaagctgcagaggcgcaaccaccgggggtacacgccgccctacgccgagaagctcgatgcctcttccgagttcgtaggagacctcaaggagagtttctacattgggcctattggggacagtgatttgcagaatgatctaaaccaatggccttctgaagagtgttttccatcttggaaggagacaatgaagttatacattgcaactgttctggataccggcaaaaggatactctctctaattgctttgggtttggatttggatgctgaattttttcacaaaattggtgcattggactgcccgtcaacatttcttcggttactgcattacccaggtgaagtaaacgagtctgatagtggaaactatggtgcatcagcccactcagactatggtgcactaacccttttagtaacggatggcactcctggcctgcagatatgcagggagaaggatagggatcctcagctatgggaagacgttcatcacattgatggggcccttattgttaatattggcgacttgctagaaaggtggacaaattgtgttttcagatccacactgcatcgtgttgttgctgttggtaaagagcggtattcggtggctttcttttttgacccaaactctgatacggtggttcggtgcattgaaagctgttgcagtgaggcagatccgccgaggtttccacctatcagggccggagaatatataaccgggcgaataaattccacatacaaataagcatccatcattacattccacacataaataatcatccatcgttacatgtgttgatgtgtaaagctatatatgcacctttataacagcttggtgccatattctcgtttgatcccggatctaaaattatttttcaagaacatgcagagagctaagcgtgtgagcgg

SEQ ID NO: 32824 - protein, 249 aa, Panicum virgatum
  misc_feature: Ceres CLONE 1912893
  misc_feature (105)..(210): Pfam Name: 2OG-FeII_Oxy Pfam Description: 2OG-Fe(II) oxygenase superfamily
  misc_feature: SWISSPROT Homolog: EC 1.14.11.19 Leucocyanidin oxygenase
MEEKMKLQRRNHRGYTPPYAEKLDASSEFVGDLKESFYIGPIGDSDLQNDLNQWPSEECFPSWKETMKLYIATVLDTGKRILSLIALGLDLDAEFFHKIGALDCPSTFLRLLHYPGEVNESDSGNYGASAHSDYGALTLLVTDGTPGLQICREKDRDPQLWEDVHHIDGALIVNIGDLLERWTNCVFRSTLHRVVAVGKERYSVAFFFDPNSDTVVRCIESCCSEADPPRFPPIRAGEYITGRINSTYK

SEQ ID NO: 32825 - DNA, 646 bp, Panicum virgatum
  misc_feature: Ceres CLONE 1912910
  misc_feature: Encodes the peptide sequence at SEQ ID NO. 32826
accggcgagcacagcgaaacgcgggagcagagagagagagagagagagagagagagagacccgccccctcctccctccgtccggtccccgatggcggctcgcgtcgcggccctcgccgcgctcctcgccctcgccgccgccactgcgcgggcgtccaacgacgagggcgacgcgctctacgcgctgcggcagcggttcagggaccccaacggcgtgctgcagagctgggaccccacgctcgtcaacccctgcacctggttccacgtcacctgcaaccaggccagccgcgtcgaacgcctggacttggggaactccaatatctccggctccctcggccctgagctcgggcgccttgtgaacctcaaatacctggagctgtacaggaacaatttcgatggcgagatcccaaaggaattgggtaagctgaagaatctgatcagcttggatttgtacgccaacaagctcaccggagaaatccccaagtcactttccaagctcaactcactcagattcatgcgcttgaacaacaacaagcttaccggatcaattccaagggagcttgccaagcttttcaacctcaaagtcattgacctgtctaacaatgatctctgtggaaccattcctgttgatggaccttttctcacct

SEQ ID NO: 32826 - protein, 185 aa, Panicum virgatum
  misc_feature: Ceres CLONE 1912910
  misc_feature (22)..(62): Pfam Name: LRRNT_2 Pfam Description: Leucine rich repeat N-terminal domain
  misc_feature: SWISSPROT Homolog: EC 2.7.11.1 Non-specific serine/threonine protein kinase
MAARVAALAALLALAAATARASNDEGDALYALRQRFRDPNGVLQSWDPTLVNPCTWFHVTCNQASRVERLDLGNSNISGSLGPELGRLVNLKYLELYRNNFDGEIPKELGKLKNLISLDLYANKLTGEIPKSLSKLNSLRFMRLNNNKLTGSIPRELAKLFNLKVIDLSNNDLCGTIPVDGPFLT

SEQ ID NO: 32827 - DNA, 1224 bp, Panicum virgatum
  misc_feature: Ceres CLONE 1912915
  misc_feature: Encodes the peptide sequence at SEQ ID NO. 32828
actgaacggtttgcattgcaaaacccttcctcccgttatcacctcgccgccgccgccgctcgccggcggagccttctgccgacagaccagccaaggcgggaccccacctcccctgcccttatggccctcctccttcgccggggcgcggcgctcgccgcccgcttcttccgcgccgcggccgccgcttcgtccgcctccgccgccgcgcaccgcctccccgccgcgggatccctcgcgggcgctggggagctcgctccggcgcggctctttctcctcgacagccggagaggcttcgcgaaggggaagaaatcgaaggatgaccgaggtgacacggttcaagccgctcctgacattggtccaaccgtcaaatcaactgccaccgcgcaaatggatgctgcagtgatcgcgctgtcgcgagagctgagcaaactgcggacaggaagagctactcctggtatgcttgaccatatcatggtggagactgcagatgttaaagttgcgttgaatcgtattgctgttgtttctgtcctggatgcacataccctatcagtgatgccttatgatcctagttccatgaagtctattgagcacgctatcatctcgtcacccttgggcattaatccaactcctgatggaaataggattattgcaaatatccctccgttaacaaaggagaatatacaggcactgtgcaagattgttactaaatctgctgaggattttaaacaaagcattagaagagcacgccaaaaggcacttgatacaataaagaaatctgcatctagcatgcccaaggatgatgcaaagaggctggagaaggagattgaagaattgaccaagaagttcattaagtcagcagatgacatgtgcaaggcaaaggagaaggaaatcagcggaagctgaagtcatacgtcttgatgaagtaatgttttattccaattccgacgatgttgagactgcaattgtgctgttgcgcagccaatcaaaaaatttatttcctttcgtgccattctaactacactgttagcagttcaaaacggtgtgatgcccagggcagggtggccctgtggtattgtaattgagtcacgcagtcacaaattcttacagaacgaaagttagtgtagtttggatatgattcatctttgtttaaaattaccatgccttattttctgtgaaagaacctgatgtcactctgttgatttcaatgcagacacctttgcctgt

SEQ ID NO: 32828 - protein, 260 aa, Panicum virgatum
  misc_feature: Ceres CLONE 1912915
  misc_feature (96)..(258): Pfam Name: RRF Pfam Description: Ribosome recycling factor
MALLLRRGAALAARFFRAAAAASSASAAAHRLPAAGSLAGAGELAPARLFLLDSRRGFAKGKKSKDDRGDTVQAAPDIGPTVKSTATAQMDAAVIALSRELSKLRTGRATPGMLDHIMVETADVKVALNRIAVVSVLDAHTLSVMPYDPSSMKSIEHAIISSPLGINPTPDGNRIIANIPPLTKENIQALCKIVTKSAEDFKQSIRRARQKALDTIKKSASSMPKDDAKRLEKEIEELTKKFIKSADDMCKAKEKEISGS

SEQ ID NO: 32829 - DNA, 707 bp, Panicum virgatum
  misc_feature: Ceres CLONE 1912924
  misc_feature: Encodes the peptide sequence at SEQ ID NO. 32830
acacaatcacacggctcgcccattctctcctctctctctctctcgcggcccccctttcctgccggcgacgaccgggcgagcggcggcgtcacccgccacgtctacgccgggcccttcgccggcgacgagctcccacaagatcgactcttttatgagtccacaaggcacccaggatgaagtttttagaatacacccccttcgacagcataaatctgttcctcgaccaactcaacctcggcgattgtacaatcaggggcaaccttgaagccttctcatgcaagcacaccgctacagaccgccggctttcaataagcctagaacatgagattcttgattacttaggaaagtcctctgacagtgacccttcttcaccagtggagcacctatcctccagatcaagccggaagacattgatatatctagttcttactcttgggcatatgtatccagattatgatttcagtgctgttcgggcacacttgttcttccaagaagaggagatggaaagtttcaagcagatgatagacacctacttatctgatgcttctaggcaatgggcagcaacaaatgagggcagttctcttctggacagtatgactaaagctattgatgaggttatcaaaatcagagagtgtgacatctacagctataacccagactctgatggagatccagttcaagagaaaggggccatatggtcattctac

SEQ ID NO: 32830 - protein, 177 aa, Panicum virgatum
  misc_feature: Ceres CLONE 1912924
  misc_feature (25)..(177): Pfam Name: Maf1 Pfam Description: Maf1 regulator
MKFLEYTPFDSINLFLDQLNLGDCTIRGNLEAFSCKHTATDRRLSISLEHEILDYLGKSSDSDPSSPVEHLSSRSSRKTLIYLVLTLGHMYPDYDFSAVRAHLFFQEEEMESFKQMIDTYLSDASRQWAATNEGSSLLDSMTKAIDEVIKIRECDIYSYNPDSDGDPVQEKGAIWSF

SEQ ID NO: 32831 - DNA, 679 bp, Panicum virgatum
  misc_feature: Ceres CLONE 1912927
  misc_feature: Encodes the peptide sequence at SEQ ID NO. 32832
agagactagagagagcgctctcctctcgcctatccatttccaatctcgatcggggagagctcgcgccgccattgccgccgccgcgcctggctgttcttgatcagcagcgaatggggaggcagccgtgctgcgacaaggtggggctgaagaagggcccgtggacggcggaggaggaccagaagctcgtcagcttcatcctcggcaacggccagtgctgctggcgcgccgtgcccaagctcgccgggctgctccggtgcgggaagagctgccggctgcggtggacgaactacctgcggccggacctcaagaggggcctgctctccgacgccgaggagaagctcgtcgtcgacctgcacgcccagctcggcaacaggtggtcaaagattgcgtcgcacttgccggggcggacggacaacgagatcaagaaccactggaacacccacatcaagaagaagctcaggaagatggggatcgaccccctcacgcacaagcccctgccgccgccgcagcagcagcaggagcaccaaccgcttccaccgcccgccggcggctcgccggaggcgcagccatcgccacctccggagcggagtcctccagaggagagggcggtgccggcgacggcgacggccggaaatagtagcgaggacggcgacagcgagctgctcctcagcaagtcgcc

SEQ ID NO: 32832 - protein, 189 aa, Panicum virgatum
  misc_feature: Ceres CLONE 1912927
  misc_feature (67)..(112): Pfam Name: Myb_DNA-binding Pfam Description: Myb-like DNA-binding domain
  misc_feature (14)..(61): Pfam Name: Myb_DNA-binding Pfam Description: Myb-like DNA-binding domain
  misc_feature: Useful for making plants with altered cell wall content and/or composition
  misc_feature: The sequence is a functional homolog of SEQ ID NO 442 in the 10/412,699 US patent application
  misc_feature: Useful for making plants with altered alkaloid content
  misc_feature: Useful for making plants with modulated nitrogen use efficiency
  misc_feature: The sequence is a functional homolog of SEQ ID NO 836 in the 10/412,699 US patent application
  misc_feature: The sequence is a functional homolog of SEQ ID NO 1070 in the 10/374,780 US patent application
  misc_feature: The sequence is a functional homolog of SEQ ID NO 992 in the 11/435,388 US patent application
  misc_feature: The sequence is a functional homolog of SEQ ID NO 1064 in the 10/374,780 US patent application
  misc_feature: The sequence is a functional homolog of SEQ ID NO 1306 in the 10/412,699 US patent application
  misc_feature: The sequence is a functional homolog of SEQ ID NO 990 in the 11/435,388 US patent application
  misc_feature: The sequence is a functional homolog of SEQ ID NO 1118 in the 10/225,066 US patent application
  misc_feature: The sequence is a functional homolog of SEQ ID NO 1396 in the 11/479,226 US patent application
  misc_feature: The sequence is a functional homolog of SEQ ID NO 2488 in the 10/374,780 US patent application
  misc_feature: The sequence is a functional homolog of SEQ ID NO 658 in the 10/412,699 US patent application
  misc_feature: The sequence is a functional homolog of SEQ ID NO 1066 in the 10/374,780 US patent application
  misc_feature: The sequence is a functional homolog of SEQ ID NO 1308 in the 10/412,699 US patent application
  misc_feature: The sequence is a functional homolog of SEQ ID NO 1065 in the 10/374,780 US patent application
  misc_feature: The sequence is a functional homolog of SEQ ID NO 1307 in the 10/412,699 US patent application
  misc_feature: The sequence is a functional homolog of SEQ ID NO 986 in the 11/435,388 US patent application
  misc_feature: The sequence is a functional homolog of SEQ ID NO 1002 in the 11/435,388 US patent application
  misc_feature: The sequence is a functional homolog of SEQ ID NO 1067 in the 10/374,780 US patent application
  misc_feature: The sequence is a functional homolog of SEQ ID NO 1309 in the 10/412,699 US patent application
  misc_feature: The sequence is a functional homolog of SEQ ID NO 1071 in the 10/374,780 US patent application
  misc_feature: The sequence is a functional homolog of SEQ ID NO 994 in the 11/435,388 US patent application
  misc_feature: The sequence is a functional homolog of SEQ ID NO 1069 in the 10/374,780 US patent application
  misc_feature: The sequence is a functional homolog of SEQ ID NO 988 in the 11/435,388 US patent application
  misc_feature: Useful for making plants with altered lignin content
  misc_feature: The sequence is a functional homolog of SEQ ID NO 271 in the 11/479,226 US patent application
  misc_feature: The sequence is a functional homolog of SEQ ID NO 122 in the 10/412,699 US patent application
  misc_feature: The sequence is a functional homolog of SEQ ID NO 126 in the 11/375,241 US patent application
  misc_feature: The sequence is a functional homolog of SEQ ID NO 148 in the 10/286,264 US patent application
  misc_feature: The sequence is a functional homolog of SEQ ID NO 34 in the 10/374,780 US patent application
  misc_feature: The sequence is a functional homolog of SEQ ID NO 438 in the 10/225,066 US patent application
  misc_feature: The sequence is a functional homolog of SEQ ID NO 108 in the 10/412,699 US patent application
  misc_feature: The sequence is a functional homolog of SEQ ID NO 1740 in the 10/412,699 US patent application
  misc_feature: The sequence is a functional homolog of SEQ ID NO 1964 in the 10/374,780 US patent application
  misc_feature: The sequence is a functional homolog of SEQ ID NO 255 in the 11/479,226 US patent application
  misc_feature: The sequence is a functional homolog of SEQ ID NO 908 in the 11/435,388 US patent application
  misc_feature: The sequence is a functional homolog of SEQ ID NO 112 in the 10/412,699 US patent application
  misc_feature: The sequence is a functional homolog of SEQ ID NO 267 in the 11/479,226 US patent application
  misc_feature: The sequence is a functional homolog of SEQ ID NO 1411 in the 11/479,226 US patent application
  misc_feature: The sequence is a functional homolog of SEQ ID NO 2492 in the 10/374,780 US patent application
  misc_feature: The sequence is a functional homolog of SEQ ID NO 52 in the 10/225,066 US patent application
  misc_feature: The sequence is a functional homolog of SEQ ID NO 1041 in the 11/479,226 US patent application
  misc_feature: The sequence is a functional homolog of SEQ ID NO 112 in the 10/225,066 US patent application
  misc_feature: The sequence is a functional homolog of SEQ ID NO 20 in the 11/375,241 US patent application
  misc_feature: The sequence is a functional homolog of SEQ ID NO 2052 in the 10/374,780 US patent application
  misc_feature: The sequence is a functional homolog of SEQ ID NO 450 in the 10/412,699 US patent application
  misc_feature: Useful for making plants with modulated biomass
  misc_feature: The sequence is a functional homolog of SEQ ID NO 188 in the 10/412,699 US patent application
  misc_feature: The sequence is a functional homolog of SEQ ID NO 2274 in the 10/374,780 US patent application
  misc_feature: The sequence is a functional homolog of SEQ ID NO 704 in the 10/225,066 US patent application
  misc_feature: The sequence is a functional homolog of SEQ ID NO 126 in the 10/412,699 US patent application
MGRQPCCDKVGLKKGPWTAEEDQKLVSFILGNGQCCWRAVPKLAGLLRCGKSCRLRWTNYLRPDLKRGLLSDAEEKLVVDLHAQLGNRWSKIASHLPGRTDNEIKNHWNTHIKKKLRKMGIDPLTHKPLPPPQQQQEHQPLPPPAGGSPEAQPSPPPERSPPEERAVPATATAGNSSEDGDSELLLSKS

SEQ ID NO: 32833 - DNA, 1298 bp, Panicum virgatum
  misc_feature: Ceres CLONE 1912930
  misc_feature: Encodes the peptide sequence at SEQ ID NO. 32834
atatccggtacacggtgtgataaatccctgggcttaagcgtcgtccctctgcccacaccattgctgccacctgccagcctgccagatcaacgagcgagccagagcggagacgccatggcggccggtggtggcagcaaccgtgccctgctggcgctccgcgcactcctcctctgcgccctcgccgccgccgcggccaccgccctgctccctctcgccacgggcccgtgcgcacggtcgctgtcgaggagtatcctcgccgccacgggcctcgacccgtacctcctctcctgcgccggcgacgcctccgggggcgctccattgctgtcccagccgggcgccaacgggaccggcagcggagccatcgtgaccgaccagcggtgcgtccggggcaagttcccgccggacgcgctcccgcccctgcagtgctacccgccggcgtccgcgtcggcgcccgtcaacttcacgctcccggaccccgcggagccactccggacgcggcggccggtgcacgccgtcggcgcggagtacatggccaagtacgcgcgcgcggtggcgctgatgaaggcgctgccccggtcggacccgcgcagcttctaccagcagtccaacgtccactgcgcctactgcaccggcgcgcaccgccaggcggggcgcccggacctgggcgtgcagatccacttctcctggctcttcttccccttccaccgcgcctacctctacttcttcgagcgcatcgcggccaagctgctgggggagcccggcttcgcgctgcccgtctggacatgggacgtccccgaggggatggggatccccgaggcgttcgccgacgaggtgtcgccgctgtacgaccccattcgggagcccagccacgcgccgcccaaggtcgcggacctcgacttcttccttggagagggaggggagaagaacttgaccgacgagcagcagatcctgcacaactttcgggtcatgtataaacagatgatcagcggcgcgacgttgccctccctcttcctagggcagccgtaccgcgccggcgacccggagatgccaggtccgggccaaggttcaccaaaccggtgggaaccggtccggtttgaccggttaccggtcaaaccggtccggcccggttccggtttggtccggtacccaaccggccaaaattcaaaatttaaatttaaaaaatgaaaaattcccaaaaaattcctaaaaatacttcaaggtgcaatgaatctaatagtatcaaattttctcaaaaattcgttcatttagtatagtttgcggggatttaaagttaaatc

SEQ ID NO: 32834 - protein, 356 aa, Panicum virgatum
  misc_feature: Ceres CLONE 1912930
  misc_feature (97)..(355): Pfam Name: Tyrosinase Pfam Description: Common central domain of tyrosinase
  misc_feature: SWISSPROT Homolog: EC 1.10.3.1 Catechol oxidase
MAAGGGSNRALLALRALLLCALAAAAATALLPLATGPCARSLSRSILAATGLDPYLLSCAGDASGGAPLLSQPGANGTGSGAIVTDQRCVRGKFPPDALPPLQCYPPASASAPVNFTLPDPAEPLRTRRPVHAVGAEYMAKYARAVALMKALPRSDPRSFYQQSNVHCAYCTGAHRQAGRPDLGVQIHFSWLFFPFHRAYLYFFERIAAKLLGEPGFALPVWTWDVPEGMGIPEAFADEVSPLYDPIREPSHAPPKVADLDFFLGEGGEKNLTDEQQILHNFRVMYKQMISGATLPSLFLGQPYRAGDPEMPGPGQGSPNRWEPVRFDRLPVKPVRPGSGLVRYPTGQNSKFKFKK

SEQ ID NO: 32835 - DNA, 732 bp, Panicum virgatum
  misc_feature: Ceres CLONE 1912990
  misc_feature: Encodes the peptide sequence at SEQ ID NO. 32836
gtcccccatcctcacatcccacgccacaccctcccatcccctcgcatccccaacgaccgcgccgcagcagtacgtgtgcgattcgttaggggggcgggcgagcgagcgagcgcgcaaagatgtcaacgtgcgcggcggacctcgcgccgctgctgggcccggcggcggcgaacgccacggactacctctgcagccagttcgcggacacggcgtcggcggtggacgccacgtacctgctcttctcggcgtacctcgtcttcgccatgcagctcggcttcgccatgctctgcgcgggctccgttcgcgccaagaacaccatgaacatcatgctcaccaacgtgctcgacgccgccgcgggggcgctcttctactacctcttcggcttcgccttcgccttcggcacgccctccaacggcttcatcgggaagcagttcttcggcctcaagcacctgcccaggaccggcttcgactacgacttcttcctctaccagtgggccttcgccatcgccgccgcgggcatcacgtcgggctccatcgccgagaggacgcagttcgtcgcctacctcatctactccgccttcctcacgggcttcgtgtacccggtcgtgtcgcactggttctggtccgccgacgggtgggccgccgcgagccgcacgtccggcccgctcctcttcggctccggcgtcatcgactttgccggctccggggtcgtccacatggtcggcggcgtcg

SEQ ID NO: 32836 - protein, 204 aa, Panicum virgatum
  misc_feature: Ceres CLONE 1912990
  misc_feature (36)..(204): Pfam Name: Ammonium_transp Pfam Description: Ammonium Transporter Family
  misc_feature: Useful for making plants with modulated carbon-nitrogen partitioning
  misc_feature: Useful for making plants with altered carbon content
  misc_feature: Useful for making plants with altered nitrogen content
MSTCAADLAPLLGPAAANATDYLCSQFADTASAVDATYLLFSAYLVFAMQLGFAMLCAGSVRAKNTMNIMLTNVLDAAAGALFYYLFGFAFAFGTPSNGFIGKQFFGLKHLPRTGFDYDFFLYQWAFAIAAAGITSGSIAERTQFVAYLIYSAFLTGFVYPVVSHWFWSADGWAAASRTSGPLLFGSGVIDFAGSGVVHMVGGV

SEQ ID NO: 32837 - DNA, 749 bp, Panicum virgatum
  misc_feature: Ceres CLONE 1913020
  misc_feature: Encodes the peptide sequence at SEQ ID NO. 32838
atcgcaacccaatcggcagcagccaagttctccaaccaaaactcagcgatcacctgctgctagctccttcatctgatcgagcgccatggcctgcactcaggaggtggtgttcgacttgaacctgatcgagaacagcgcgctggaggacggcctggccggctgggcgccggtgggctcgtgcacggcgctgtccgtgcacgaggaggagccggccaaggtgccgacggagacgatcaacgacgtcggggaggactaccggccgagcggccgctacatcctcgcgtccggccgcgccgacgaggcggacggcctgcgccaggcgatcaagggcgcgctcaagccccaggtcacgtaccgcgtctccgggtggatcagcctcggcggcggcggcgccgccgagggggccggccacgcggtgcgcgtcaacctccgcgtggacgacgagtgcgtcgtggagggcggcgcggtgtgcgccgaggccggcaagtgggcggagatcaagggcgcgttccggctcaagaagagcccgcgcgccgccgcggtgtacgtgcagggcgcgcccgcgggcgtcgacgtgaaggtgatggacctccaggtcttcgccaccgaccgcaaggcacggttcaggaagctcaggaggaagactgacaaggtgcgcaagcgcgacgtcgtcctcaacttcggcggcgcggcggcgtcgggcatctccggcgcgtccgtccgggtgatgcagatggacagcagcttcc

SEQ ID NO: 32838 - protein, 221 aa, Panicum virgatum
  misc_feature: Ceres CLONE 1913020
  misc_feature (11)..(174): Pfam Name: CBM_4_9 Pfam Description: Carbohydrate binding domain
  misc_feature: Useful for making plants with altered carbohydrate content
MACTQEVVFDLNLIENSALEDGLAGWAPVGSCTALSVHEEEPAKVPTETINDVGEDYRPSGRYILASGRADEADGLRQAIKGALKPQVTYRVSGWISLGGGGAAEGAGHAVRVNLRVDDECVVEGGAVCAEAGKWAEIKGAFRLKKSPRAAAVYVQGAPAGVDVKVMDLQVFATDRKARFRKLRRKTDKVRKRDVVLNFGGAAASGISGASVRVMQMDSSF

SEQ ID NO: 32839 - DNA, 2421 bp, Panicum virgatum
  misc_feature: Ceres CLONE 1913041
  misc_feature: Encodes the peptide sequence at SEQ ID NO. 32840
cttctcgctgcccgccgccaacctccacctccacttccagaagcagagagggccaccgcgagagatctcacgatccccacccaccacctcgtcctcgttatagctgctcgtacccgcgtacggactcccactcgaacccgaaggccgagacccgtagctagccgcgccacccccgcaccgcaccggacggacccaatccggggacgccacgctcgccgcgcgccgccacctcgaatcagttgctgcgtgcgaggtgtgttagcccatgccccggatgaccaagttgctgctccagcttccggcggcggcggcggacaggaggcacggccacggcggcatcggcctcggcccggggcgcggccgccgccccactcccgccgccgggagattctccccggcatgcctcgccctctgcctcctcgccgtcgccgccgcggccaccacgctcgcggtcgcgctcacgctggaccgccaaagccccgtccccggcgcctcgccgcggtaagcgtccattcccgaccgccgaccattcccctgctgctccccgtgctagccactcacgccctccaacccggctgcccgcaggggcttctcggtggtgatcaacacgtggcggcgccacgcgctcctgcggaggtccgtcgcgcactacgccgcctgcgcgggcgtcgaggccgtccacgtcgtgtggagcgagccgcggccgccgccggagcgcctgcgccggggcgtcctcatcaacggcacccgccgcggcaccgtgcggttcgagatcaacgaggccgacagcctcaacaacaggttcaggcccatccgggggctccccacggacgccgtcttctccgtcgacgacgacctcatcgtcccgtgctccacgctgcgcttcgccttcgacgtgtggcagagcgcgccatctgccatggtgggctttgtgccccggatgcactggcttgctgacccgagaggcagtacaaaggaataccgatatggaagctggtggtcagtttggtggacagggacatacagcatggttctttccaaagcgagtttcttccacaggcagtacttggatctgtatacaaacagaatgctaccgtcaattcgcaaatatgtgactgaaaataggtgcacttcctatcttacagcttcatcatttttgataaaaaaattgctttcagctacattatggtgttgtctatgattggattatgtactactcaatggatctaatctttttggtacgctaacacttggcaggaattgtgaggatattgcaatgtcttttcttattgcaaatcatactggagctccaccaatatgggtacaaggtgagtgagcacccttctggataagtgaagttcttgcgcatcatctgtcctattttgagaaactcatacacactaatttagttcaattagttcacttgctgcatcgagaaatttcatgttttgggtatgggtttcactcaatggcagcatgacgacttctgatagcaccaatagtcaaaatatctatagatagtctgtgttcgtctttttgtttgcccctgcagcttgggaccttgtcccttgtttagacgcatagggtgatagggatcataaccttccatgctcttgcacttacaactaggagagctatgcaatttttatgtcgtttggccacatgggtcgttacctggctgttttgaaacctaacaatggatcaaaccactttcagtttaataatttcctgaaccacctagccttctagcgtggactggtaaagcagcaagttgctgtaacttgtctgaaactttcactggagtctttctgctcggccgttactcatagtgttacttgaactgggaagaactttgcataataatctgttgaaagaaaccgaaaaggattggtttggcatcaatatagaaacacaaagtagctagccacagaaacataagaggacatgtgcatactgagatggctcatatgctatcctgcctgttattggtctcatcaggactcaggagcctcttgctcacattcgtgcccttgttattacgacaggaaggatatttgagattggatcgagcggcatcagcagtttgaagggccatggtttgcagagatccagatgcctcaacacatttgctgccatgtatggccatatgcctcttgtagccaccacagtcaaggctgtcgacagccgcaggagctggttctggtgacatgcctcttgtttgaccctgttatctcctttttgtttcatttttaattttccttaggtgctgcctagcaatattacaaggctagcgtgtttgtgcataattcatcagcacctaagaacacaggttggaatgttggattgtacacattgaatgtaaatcatagtgaccatattcaaattcacattatcagttactaatatctagtaatctttgcg

SEQ ID NO: 32840 - protein, 93 aa, Panicum virgatum
  misc_feature: Ceres CLONE 1913041
  misc_feature: SWISSPROT Homolog: EC 2.4.1.223 Glucuronyl-galactosyl-proteoglycan 4-alpha-N-acetylglucosaminyltransferase
MVGFVPRMHWLADPRGSTKEYRYGSWWSVWWTGTYSMVLSKASFFHRQYLDLYTNRMLPSIRKYVTENRCTSYLTASSFLIKKLLSATLWCCL

SEQ ID NO: 32841 - DNA, 680 bp, Panicum virgatum
  misc_feature: Ceres CLONE 1913049
  misc_feature: Encodes the peptide sequence at SEQ ID NO. 32842
agcactctctaccgcacttcctctatatagcaacgacccataaacccatccttcactcatcagtgctcactctccagctctcagcaaacactgcaagcgagagctagctaccaaagacaaggacacaatgccacccttacccaagagacccgggcctctccttgtcctcctcgttgtcgcattcgcggcagtttacggtggcctcaaggggaagcttggcgtcgaggacgcccacgagctgcagctcaaccgcatccgcatcaccctgtcctccaagaacgtcaagaacttggagaaagtttgtgcggatttggtgaagggagccaaggacaagcagctgcgggttaagggacctgtcaggatccctactaaggttctccacatcaccacccgcaagtccccttgtggtgaaggaacaaacacatgggatcgctttgaattccgcatccacaagagggtgattgacctgatcagctcccctgatgtggtgaagcagatcacctccatcaccatcgagcctggtgtcgaggtcgaggtgaccatcgcagacgtgtaatggcatgcagtttagctctgtcatcttatatcttgcgttgctttagttttgtgccccctttgtgtgcttgtatgagacatctgagtgattattagcatccaatactgtttttgcgccgactact

SEQ ID NO: 32842 - protein, 142 aa, Panicum virgatum
  misc_feature: Ceres CLONE 1913049
  misc_feature (42)..(137): Pfam Name: Ribosomal_S10 Pfam Description: Ribosomal protein S10p/S20e
  misc_feature: Useful for making plants with modulated biomass
  misc_feature: Useful for making plants with modulated flowering time
  misc_feature: Useful for making plants with modulated phosphate use efficiency
MPPLPKRPGPLLVLLVVAFAAVYGGLKGKLGVEDAHELQLNRIRITLSSKNVKNLEKVCADLVKGAKDKQLRVKGPVRIPTKVLHITTRKSPCGEGTNTWDRFEFRIHKRVIDLISSPDVVKQITSITIEPGVEVEVTIADV

SEQ ID NO: 32843 - DNA, 1435 bp, Panicum virgatum
  misc_feature: Ceres CLONE 1913053
  misc_feature: Encodes the peptide sequence at SEQ ID NO. 32844
ggttttgagagtgtttatactagagaaaattgatgcgcggccgctgtgtcccgataggactccggctgtgaaggccaatagatgaccattccaaacctcccagttcgtcatcttgacaggccaccgaaacaaaattctctctctaggcgggagagggagagagagggagagagcggtcgcagccgccggccatggcggaggcggcgggagcccaagccccggcgcatggccccgaggaggcgcccctcggcgcgggcgccatcaggagcctgcctcccaattccacctccaagctccgatccatggcgtctcacgatcaccaccaccaccactcccacgaccacgatcaccaccaccatcactcccacggggatggcggtggcaatgcagcggggggatcgtgggtcggggaggacggtcgcgtgtggcactcccacgacggcctcgcgccgcactcccacgagcccatctactcccccggcgacttcaccaagcgcgcgccgccgctcgcctcgcatgccttcaccgaccgcgccttcaccgtcggaattggcggccccgtcggcacggggaaaactgccctgatgttagcactgtgcagattcctacgtgataaatatagtcttgctgcggtcacaaacgacattttcacaaaagaagatggggaattcttagtcaagcatggagcactcccagaagagcgcatacgtgcagtggaaactggagggtgccctcatgcagctatacgtgaagacatcagtataaatcttggtcctctagaggagctatcgaacttgtacaaagctgatttgctactctgtgaatctggaggagataacttggctgctaactttagccgagaattggcagactacataatctacataattgatgtctctggtggagacaagataccaagaaaaggtggccctgggataacccaagctgatcttttggtgataaataagacagaccttgccccggctgttggagctgatctggctgtaatggaacgagatgcgcttcgcatgcgggaaggagggccttttgtgtttgcacaggtgaaacacggagtgggtgtggaggatatcgtgaatcatattctgcaagcgtgggaaattgcaaccgggaataaacgccgataaaagatctcatgacatagctttatatttggcgtgcagctgatgcactttatcattcagcatgcataaaccatccattggttttcgaataaatttcgcatcatttggtgctgatgtactggagacttgtggagtttcaaaatttccttttcatgttggaagagaaggaaaggtagatcatgccctcaaatttggacgagggggtcgagaatgctatgagttggggactccaataacgagcagaactgcaatacgggctcagtgaagtaggaagttgaaaaataatttcgcag

SEQ ID NO: 32844 - protein, 317 aa, Panicum virgatum
  misc_feature: Ceres CLONE 1913053
  misc_feature (116)..(288): Pfam Name: cobW Pfam Description: CobW/HypB/UreG, nucleotide-binding domain
MAEAAGAQAPAHGPEEAPLGAGAIRSLPPNSTSKLRSMASHDHHHHHSHDHDHHHHHSHGDGGGNAAGGSWVGEDGRVWHSHDGLAPHSHEPIYSPGDFTKRAPPLASHAFTDRAFTVGIGGPVGTGKTALMLALCRFLRDKYSLAAVTNDIFTKEDGEFLVKHGALPEERIRAVETGGCPHAAIREDISINLGPLEELSNLYKADLLLCESGGDNLAANFSRELADYIIYIIDVSGGDKIPRKGGPGITQADLLVINKTDLAPAVGADLAVMERDALRMREGGPFVFAQVKHGVGVEDIVNHILQAWEIATGNKRR

SEQ ID NO: 32845 - DNA, 756 bp, Panicum virgatum
  misc_feature: Ceres CLONE 1913058
  misc_feature: Encodes the peptide sequence at SEQ ID NO. 32846
gctcagtttttgccagttcagtttctaggaggggagccatacgttccaacttccaaaccctaacattttcccaaaaaaaaaaaatccaaaccctaacaccggccaccgctggattcaaccttcgcagcctgacgacccgaccggcctcggcgcgatggcgtctccggcggtgctgtggtgaggcttctccttatccggaccatcccccgatttcggggatctgtgagtctgacgctgcggctgcgcccctcgcgcggggcggtcgcgggggattcagagcgtgtggcggcctcgtttgctgcccgtgagacgaatcaatcgccaaaaggtaatcaattagctgcaggggaagagaaagggagatgccgccggcgcgatctacgaagcgtgccagcgcggagagcctctccggcgaccggctgagcgcgctgcccgacggcgtcctccacaccatcctgtccttcctcccggctccggaggcggtgcggaccagcgcgctgtcgcggcggtggaggcacctctggcgcaccgcgccctgtatcaaaatcgacatgcgggagtttgggatcaccctcgtgacctccggcggcgacttgagcgagaaatggcgcaagtttgaggacttcaccaccagcctgctcttgttccgcagtggaaccatatcgctggatagggtccggttagatgctaggccccattgcctttcgtgtgtggatcgatggggttcgccgtggcctcatgtactgcccccaagtg

SEQ ID NO: 32846 - protein, 131 aa, Panicum virgatum
  misc_feature: Ceres CLONE 1913058
  misc_feature (18)..(65): Pfam Name: F-box Pfam Description: F-box domain
MPPARSTKRASAESLSGDRLSALPDGVLHTILSFLPAPEAVRTSALSRRWRHLWRTAPCIKIDMREFGITLVTSGGDLSEKWRKFEDFTTSLLLFRSGTISLDRVRLDARPHCLSCVDRWGSPWPHVLPPS

SEQ ID NO: 32847 - DNA, 1517 bp, Panicum virgatum
  misc_feature: Ceres CLONE 1913069
  misc_feature: Encodes the peptide sequence at SEQ ID NO. 32848
agagccatcactagtcagtctcagtcagctgtgaggagttgaagacaggaaggggcgcagctgcagcagctggtacgagagatggcgatggagaagggctggaaggcgagggacgtcgcgggtgccttgggcatggaggtggtggacgaggaggaggacgacgcggtggcggcgataccgccgccgcagacgccgctggagcccatggagtacctgtccaggtcgtggagcgtgtcggcttcggagatttcgaagatactcgtcggcgggggcaagaagagcggcgttgcggcggcgatgagccgactgccggagatgaccataccggaggactccgtgcttgccacgtccatcgttcctcatctcccgtgtcatcaacagcataggggtgcgagaaggaattccatgagcagcggccactaccaatcgatcggcagatggttccaagtccaccacggggagacatgccgggtgaggcagagaggcaaggagaagcagcgcgcggagaaggcccacgtgcacgccatggtgtccgtggcgcgggtcgccgccgcggtcgccgccgtcgcggcggccacgagctgcgacgcccaggccaccaagatggccgcggccatggcgtcggccaccgagctgctagcttcgcactgcgtcgaggccgctcagcacgcgggggcgcgccacgaccaggtcgccggcgccgtgcaggccgcggttggcgtccggagccccggtgatctgatgacgctcacggcggccgcggccactgctctgcgaggagcttccacactgaagcagagagtgcagcgagaggcgaggagcaatgcgagtgttcttccatacgagaaggggagcgagaagggccattcatggagtacggatatctggtgcaaggagggggagttgctgaaacgcacaagaaaaggggatttacacaagacaagagtatctatctacatcaacaagaggtcacaggtgatgctgaagctgaaaagcaaacacatcggaggtgcactatcgaagaacaacaagagcgttgttcacggcgtatacagcgagcttccgacatgggcggagccagggaaggactccatggaggagacgtgctgcttcggcctgagcacggcgcagggtctcgtggagttcgagtgcgagagcagcgcgagcaaacggaagtgggtagacgatgtgcagaacctgcttcgtcaggtggccctgcaggatcaagtaggaaataaactggggctactaaaactcagctaatgcagtctcgatttgtacacaaccattctccttcctcatggtagcagacggtgtgttacaggaagtgccttgcattagggatgcgaggcgtacagattgatggtactcttgtcactgactttatattgctgtactacatacagaatggtgagatacggaataggttctatgtttttttttgtttaagagtgaatgttgttgtcaactaaatgtatgccaatatgccaatttgtaaaaaaaaaagtttatggcct

SEQ ID NO: 32848 - protein, 393 aa, Panicum virgatum
  misc_feature: Ceres CLONE 1913069
  misc_feature (273)..(381): Pfam Name: PH_2 Pfam Description: Plant pleckstrin homology-like region
MAMEKGWKARDVAGALGMEVVDEEEDDAVAAIPPPQTPLEPMEYLSRSWSVSASEISKILVGGGKKSGVAAAMSRLPEMTIPEDSVLATSIVPHLPCHQQHRGARRNSMSSGHYQSIGRWFQVHHGETCRVRQRGKEKQRAEKAHVHAMVSVARVAAAVAAVAAATSCDAQATKMAAAMASATELLASHCVEAAQHAGARHDQVAGAVQAAVGVRSPGDLMTLTAAAATALRGASTLKQRVQREARSNASVLPYEKGSEKGHSWSTDIWCKEGELLKRTRKGDLHKTRVSIYINKRSQVMLKLKSKHIGGALSKNNKSVVHGVYSELPTWAEPGKDSMEETCCFGLSTAQGLVEFECESSASKRKWVDDVQNLLRQVALQDQVGNKLGLLKLS

SEQ ID NO: 32849 - DNA, 706 bp, Panicum virgatum
  misc_feature: Ceres CLONE 1913072
  misc_feature: Encodes the peptide sequence at SEQ ID NO. 32850
agggcccgccgtcgacgttcacgccgcagtatccgcagtggccaccgtggccgtggacaccgaaggttacgccgccgatgagctttcccccatcgcctgctccggcaccttccaagcctttgccgcagcccgcgcatgatggaaatccttcacacagcattgcactgcccccacagctggccggcaccggtagtaggccggtggttgccggagttgtgcctggagcggggcactctggtcatgttagcaggcctgcctatgtcatcgccgcggcgggggcctccctcctcgcggccgtgtcggtggcgctcttcgtcctgtgctaccggtccagcaaggtggtcaccgtcaggccgtgggcgaccggcctcagcgggcagctacagaaagcattcgtcacaggtgtgccatcgctgaagagatcggagcttgagctcgcctgcgaggagttcagtaacatcatcggctccttgtcggattacatggtgtacaaggggacgctgtcaagcggcgtcgagatcgcggtggtgtcgacgaccaagaactctgccaaagaatggtccaagcaccgcgaaacacagttcaggaagaagataacaagcttgtccagagtcaaccacaagaacttcgtgaacctgctgggctactgccaggaagaacagcccttcaccaggatgatggtgttcgagtacgctcccgacggcac

SEQ ID NO: 32850 - protein, 234 aa, Panicum virgatum
  misc_feature: Ceres CLONE 1913072
  misc_feature: SWISSPROT Homolog: EC 2.7.11.1 Non-specific serine/threonine protein kinase
GPPSTFTPQYPQWPPWPWTPKVTPPMSFPPSPAPAPSKPLPQPAHDGNPSHSIALPPQLAGTGSRPVVAGVVPGAGHSGHVSRPAYVIAAAGASLLAAVSVALFVLCYRSSKVVTVRPWATGLSGQLQKAFVTGVPSLKRSELELACEEFSNIIGSLSDYMVYKGTLSSGVEIAVVSTTKNSAKEWSKHRETQFRKKITSLSRVNHKNFVNLLGYCQEEQPFTRMMVFEYAPDG

SEQ ID NO: 32851 - DNA, 1487 bp, Panicum virgatum
  misc_feature: Ceres CLONE 1913076
  misc_feature: Encodes the peptide sequence at SEQ ID NO. 32852
aagactccagtaatcacacactcacattacagctccacgccctgagcctggcccggacacacggcggctagctagcccagcaccgcaaccgcagaaagcgacgacgggagcgccgccttgaggttcgggcaccatgggctcctcggcgcagctcaagcggctcaagcccctctaccagctggtggtgaacaacatcctcgccattgtcgcggtgccgctcgccgccgtggtggtgctcaaggcggcggagctggggcccggggagatcctggcgcggctgcgcacgcgccggcctgcgcacattttcctggccgcattcctgccggcggcggccgcggtgctgtacctccggctccggccgcgcgcggtgtacctggtggactacgcgtgcttccgcaccaaccccaactgccgcgtcccgttcgcgacgttcctggagcactcccgcgtgtggcccggcttcgacgagcgcagcgtccggttcatgacccgcctgctggagcgctcggggctcggggaggagacctgcctgccgtacgcgcagcactacatcccgccgtcgcgggacctcgcgtcctcccgcgccgaggccgagctagtcatcttctccgccatcgacgacctgctcgccaagaccaagatgtcgccgcaggacatcgacatcctggtcgtcaactgcagcctcttcgcgccgacgccgtccttcaccgacatgatcatgcaccggtacaagctccgcgaggacgtgcgcaacgtgcacctcgccgggatggggtgcagcgcggggctcatctccgtggagctcgcccggaacctgctgcaggtggctccccgcggcgcgcacgcgctggtggtgtcgacggagaccatcacgcccaactactacatggggcaggagcgcgcgatgctgctccccaactgcctgttccgcatgggcggcgcggcggcgctgctgtccaccaacggcgcgaaggcgcggttccggctggcgcgcgtggtgcgcacgctccgcggcgccgcggacagcgcgtaccgctgcgtgtaccaggaggaggacgagcggggcaacgtcgggatcaacctgtccaaggacctgatgaacatcgctggcgacgcgctgaaggcgaacatcacggcgatggggccgctggtgctgccggcgtcggagcagctgctgttcgcgctgtccttcatggcgcgcaaggtgctcagcaaccggatcatgccctacatcccggacttccgcaaggcgttcgagcacttctgcatccacgccggcgggcgcgccgtgatcgacgagctgcagcgcagcctgacgctgccggacgagcaggtggaggcgtcgcggatgacgctgcaccggttcggcaacacctccagcagctcgctctggtacgagctcgcctacatcgaggccaagggccgcatgcgccgcggcgaccgcgtctggatgatcggcttcggctcggggttcaagtgcaacagcg

SEQ ID NO: 32852 - protein, 451 aa, Panicum virgatum
  misc_feature: Ceres CLONE 1913076
  misc_feature (71)..(358): Pfam Name: FAE1_CUT1_RppA Pfam Description: FAE1/Type III polyketide synthase-like protein
  misc_feature (370)..(449): Pfam Name: ACP_syn_III_C Pfam Description: 3-Oxoacyl-[acyl-carrier-protein (ACP)] synthase III C terminal
  misc_feature: SWISSPROT Homolog: EC 2.3.1.119 Icosanoyl-CoA synthase
  misc_feature: The sequence is a functional homolog of SEQ ID NO 2 in US patent 7038112
MGSSAQLKRLKPLYQLVVNNILAIVAVPLAAVVVLKAAELGPGEILARLRTRRPAHIFLAAFLPAAAAVLYLRLRPRAVYLVDYACFRTNPNCRVPFATFLEHSRVWPGFDERSVRFMTRLLERSGLGEETCLPYAQHYIPPSRDLASSRAEAELVIFSAIDDLLAKTKMSPQDIDILVVNCSLFAPTPSFTDMIMHRYKLREDVRNVHLAGMGCSAGLISVELARNLLQVAPRGAHALVVSTETITPNYYMGQERAMLLPNCLFRMGGAAALLSTNGAKARFRLARVVRTLRGAADSAYRCVYQEEDERGNVGINLSKDLMNIAGDALKANITAMGPLVLPASEQLLFALSFMARKVLSNRIMPYIPDFRKAFEHFCIHAGGRAVIDELQRSLTLPDEQVEASRMTLHRFGNTSSSSLWYELAYIEAKGRMRRGDRVWMIGFGSGFKCNS

SEQ ID NO: 32853 - DNA, 501 bp, Panicum virgatum
  misc_feature: Ceres CLONE 1913076-R
ccgcccccgtacgttggcagccattcttgcctcttccgcctagtgtctcgcacctcctctactcttctagctattccctctctccggccgccggttcgttgccattgccacatttggttggggtcgagggctttgtcgtgtcggcctgtcagagcgggcgcgcggggtggtcgtacgtcttaaaggcggcgggtcaggtggctcttcgtgcatgtgtgcgccgccggggcgggcggccggtgtgttgtggtcgaggtggtgatgtagtcgttcgtaatcgcgtcgccgttggctgtgtgacttgttcacgtcgtattctgttcccatttcttcttctctctatgtattttttgcgtattttcttttaacacattcatccagtataaggagagagacaagagctagacaaggaagaagaagaagtggatcttgatgtatctgtgtacctaccaaaactccaaaaatctgtgtacctattctatgaatcgattgtttactagt

SEQ ID NO: 32854 - DNA, 1825 bp, Panicum virgatum
  misc_feature: Ceres CLONE 1913078
  misc_feature: Encodes the peptide sequence at SEQ ID NO. 32855
gcaagcgaagaccggccgttaggaggagacagtggcaccggacacagcaagcgtgtgccgagagccacacccctcacttcatctccgtctcgctctcgccatgtcgaagcaggacgcctccgacggcatccctgccgccgaggcgccggccaaacgccctcccctcaacaagtacgccctcgcctgcgccatcctcgcgtccatgaactccatcctcctcggctacgatgtctcggtgatgagcggggcgcagctgttcatgaagcaggacctcaagatcacggacacgcagatcgagatcctcgccggcatcatcaacatctactcgctggtcggctcgctcgcggcgggccggacgtccgactggatcggccggcgctacaccatggtgctcgcggcggccatcttcttcgcgggcgcgctcatcatgggcctcgccccgagctacgcggtcctcatgctcggccgcttcgtggccggcgtcggcgtcggctacgcgctcatgatcgcgcctgtgtacacggccgaggtcgcgcccacgtcggcgcgcggcctgctcacgtccttcccggaggtgttcatcaacacgggggtcctcctcggctacgtctccaactacgccttccacggcctccccgtgcacctcagctggcgcgtcatgttcctcgtcggcgccgtcccgccggtcttcctcgccctcggggtcctcgccatgccggagtcgccgcggtggctcgtcatgcaggggcgcatcggcgacgcgcgccgcgtgctctccaagacctccgactcgcccgccgaggccgaggagcggctcgctgacatcaagaaggccatcggcatcccggagggcgtcggcgacgacaacgacgacgtggtggtcgtcgccctcaagaacaaggggacccatggcgagggggtgtggcgggacctgctcctccgccccacgccgcccgtccgccgcatactgatcgcctgcctcgggctccagttcttccagcaggcgtccggcatcgactccgtcgtgctctacagcccccgggtattccagaaggccgggcttcagtcggacaacaactcgttgggcgccaccatggcggtgggcgcctgcaagacgctgttcatcctggtggcaaccttcttccttgaccgcgtggggcggaggccgctgctcctgaccagcgcgggcgggatggtggtctcgctggtgacgctggcctcggcgctgcacgcgatcgaccggcagcccgcggggcaggcgacgccgctggcgggcgtgagcatcgcggcggtgctggcgttcgtggcgtcgttctcgatcggcatgggcccgatcgcgtgggtgtacagctcggagatcttcccgctgcggctgcgcgcgcaggggtgcgcgctgggcacggcgatgaaccggatcacgagcggcgccatcaccatgtccttcatctcgctctacaaggccatcaccttcgccgggagcttctacgtctacgccggcatcgccgccgcagggtgggtgttcatgttcttcttcctgccggagacgaggggcaggagcttagaggacacagagaagctctttggcggcggcggcggccaggacagcagcagggaagatgaaggtgatgcgccgaagaagtccacggagttgactagcagtcaacagtgaatagctagctacctgatgagtgacactcaagtgagctgcactgcaagtgtgtactagcacagtaacactctgtagtcaataagacgaaactgatggtgatttgtggtcggatttgtcggtgtgggacggaagacaagctaagtctgtgagctgggc

SEQ ID NO: 32855 - protein, 522 aa, Panicum virgatum
  misc_feature: Ceres CLONE 1913078
  misc_feature (29)..(494): Pfam Name: Sugar_tr Pfam Description: Sugar (and other) transporter
MSKQDASDGIPAAEAPAKRPPLNKYALACAILASMNSILLGYDVSVMSGAQLFMKQDLKITDTQIEILAGIINIYSLVGSLAAGRTSDWIGRRYTMVLAAAIFFAGALIMGLAPSYAVLMLGRFVAGVGVGYALMIAPVYTAEVAPTSARGLLTSFPEVFINTGVLLGYVSNYAFHGLPVHLSWRVMFLVGAVPPVFLALGVLAMPESPRWLVMQGRIGDARRVLSKTSDSPAEAEERLADIKKAIGIPEGVGDDNDDVVVVALKNKGTHGEGVWRDLLLRPTPPVRRILIACLGLQFFQQASGIDSVVLYSPRVFQKAGLQSDNNSLGATMAVGACKTLFILVATFFLDRVGRRPLLLTSAGGMVVSLVTLASALHAIDRQPAGQATPLAGVSIAAVLAFVASFSIGMGPIAWVYSSEIFPLRLRAQGCALGTAMNRITSGAITMSFISLYKAITFAGSFYVYAGIAAAGWVFMFFFLPETRGRSLEDTEKLFGGGGGQDSSREDEGDAPKKSTELTSSQQ

SEQ ID NO: 32856 - DNA, 3090 bp, Panicum virgatum
  misc_feature: Ceres CLONE 1913086
  misc_feature: Encodes the peptide sequence at SEQ ID NO. 32857
cgaaactcggcatcgcgcttcccttctctcctgccccctctccctctctcgcctcaccatcctcgccttcccacctgtccgtcttccttctgcctccccctctccctcgcgccgcgcctctcctccccgtctccgcggagagggagcccgtcctgcgcgcgagcgcccccgcccggagaggtgtcctccgcccgtcccgccgcctcaggcctctctgccgccgccgccgccgccgccacctccgctgccttgtttccgtggtgtcacttctgagaaattttctggggtttctgtgacgaggatcagccgccggcgcaggaccggcctttgccaccgccttccgttttatggaggggttcctactcagccttaacccgttccggttcaagccgctctggccggcgaggaccgcccccaaatccctctgaagccctaggaaatcgtcctctcgtccgggggttccagaaatcccacggccgccgtcccccaacacccttgtttcctggttaatctgaagtttcctctaaaatttgcgtcctccgaggtttcctagaggcaccaggttcgctttacttctccgagaactgagagccctaacgcggcgccttcttccctgccacctctcgacaagggcatgagcttgctgtgggcggcggcgcctccacacacatagtgccgtgccccgggctcggcgtgggcgtccttccttggcggcgctggcgttgcggacgaggatggcgagggaggacggcccggagttcgtgcggtggagggaggagttcgtgtcgcaggagcggggcagccgcgtcgtgcactactacctcgacgacgcggccggcgggtcccacctcgccgtcgtcggcaccgagaggagcctgcgccacatgctctacgtggtctccgaggacttccgcgccgcgtgggggtgcggcggcggcggcgctgatgacgccgtggtgccggcggtgtttgcgctcaagtggaggtcgcgccgcgaggtggtggattggctcgcgtccttcctccaggtgaaggcacttgactcgaaagtctcaaaatgcagatcttatgcagatactgacatcgggttagatggatacagtgaaactgatagcttttcgcaccaaaatctagggaaagactgcagctcagacattacatggtcaggttcattctcgacgtgtagcaagcagcttcggcactatcaagctttttgtcacaatggcaccacaatatcgatccacacttttgtcctggtcttgtcagaggaagaaagtcgctatcttgcatacttggaagacatgtatgaagataagaagggacagaagaaggtcaaagtgcggtggtttcatcaaaaccaggaatttgcctgtgctatacctcctcctccccctcatccttgtgaagttttcatcactccttttacacaagtaatcagtgtggaatgtgttgatgatattgcaacggttttaactcctgatcattatgaaaaatgctccaatgcattgccagcttcttctttggttgggatccgtttctgctttcgccagtatagcaaaaataaattcaagcattttgacttgagtacactgcgtgggtattttagtcaagctgttgttctatccttgaaaattgcacccgagtcagaaaaggatggtgaaatgacacctgggaggaccaagtttccaaagcagtatgagaggctttactcaaaatgtttgggcactaaaatctgtcgaggtccacaagcagactccatactaccttatcagatattaaataaaaagcaatctcctgggaagcgtctctcgatcaagtttatagcaccccagaatcaactaaagcccacatacaatgctggtgacagagtagagatcttgtctcaagacagtggcattattggctgctggttcaggtgcactgttctaaagtcatgtactaatcataacaaactgaaggttcaatatgacgatctccaaaatgctgatgacagtgggagattggaggagacggtgcctgcctctacattggctcttcctgataaactgggactgagaagcccagaccgactaagaattaggccacgtcctcaacaaagtagttctgttaaccgtgctgctttggtacctggaactgctattgacgtctggcaatttagtggctggtgggaaggaattgttgtcagtttggataacactgctgcagatagcctccgagcatattttccaggagagaacttttttcgggtgtgccggctacagaatgtaagaatatcaaaagattggatcaagaaccaatgggttgatattgaagtaaagataaatgtgttgtcacgaataccttcagatggtgttggaacaaggcaacctgataatttgtcatctgttgccgtgctagagtctagcagttctgcagtgccagagcaagagcaggcagctatccaagcaaactccaatggagatgaaccagttcctgagcaaggacttaaagttatcaaggcaagctccaatgaagataaatcagtgcctgagcaagagcctgcagctatccaaacaagccccaatggagataaacgagtgcctgagcaagggcttgcagctatccaagcaagccccaatggagataagccagtgcctgagcaagggcttgcagctattcaagcaacttccaatgcagataaacaaacagaagctagcaagcaaactgaggttagtttgactgataaaacctcctccattctcgcggacgatgagaaacaaacaattctagggaagcgtgctagagatgatgatgctgaacaagactgcaatgggaaagtaggtgtagatgttggcaagacatgaggtttgggacgtccaaactcattagactcgtgtacatagctatagatatggtattaaaacccccagggggaggggtttcactaggttgctgatatcagagagaattgtcgcctctttgtcatacacgagcctctcctagtttttctattttgctggtagttgtggtgtttatgttacgagagacacggatggcaagctgaatgatacccttcccattgtatagcagtctttgaattttgcttgtgac

SEQ ID NO: 32857 - protein, 702 aa, Panicum virgatum
  misc_feature: Ceres CLONE 1913086
  misc_feature (373)..(456): Pfam Name: Agenet Pfam Description: Agenet domain
  misc_feature (165)..(282): Pfam Name: BAH Pfam Description: BAH domain
MAREDGPEFVRWREEFVSQERGSRVVHYYLDDAAGGSHLAVVGTERSLRHMLYVVSEDFRAAWGCGGGGADDAVVPAVFALKWRSRREVVDWLASFLQVKALDSKVSKCRSYADTDIGLDGYSETDSFSHQNLGKDCSSDITWSGSFSTCSKQLRHYQAFCHNGTTISIHTFVLVLSEEESRYLAYLEDMYEDKKGQKKVKVRWFHQNQEFACAIPPPPPHPCEVFITPFTQVISVECVDDIATVLTPDHYEKCSNALPASSLVGIRFCFRQYSKNKFKHFDLSTLRGYFSQAVVLSLKIAPESEKDGEMTPGRTKFPKQYERLYSKCLGTKICRGPQADSILPYQILNKKQSPGKRLSIKFIAPQNQLKPTYNAGDRVEILSQDSGIIGCWFRCTVLKSCTNHNKLKVQYDDLQNADDSGRLEETVPASTLALPDKLGLRSPDRLRIRPRPQQSSSVNRAALVPGTAIDVWQFSGWWEGIVVSLDNTAADSLRAYFPGENFFRVCRLQNVRISKDWIKNQWVDIEVKINVLSRIPSDGVGTRQPDNLSSVAVLESSSSAVPEQEQAAIQANSNGDEPVPEQGLKVIKASSNEDKSVPEQEPAAIQTSPNGDKRVPEQGLAAIQASPNGDKPVPEQGLAAIQATSNADKQTEASKQTEVSLTDKTSSILADDEKQTILGKRARDDDAEQDCNGKVGVDVGKT

SEQ ID NO: 32858 - DNA, 681 bp, Panicum virgatum
  misc_feature: Ceres CLONE 1913088
  misc_feature: Encodes the peptide sequence at SEQ ID NO. 32859
cttctgcagttctgcacactttcctcttcctcgacgcctcaagcaaaccatggcagtcgctgtcctcgcgtctcagcgagagcatagctcgatcgcttccaggatcaccgagctacatcggacgacatgtgctttaggctggacacacagcggatttcctgaaatcgagggtagcgcctatgtctatgagaagttagccttctctgctttaacgattgtgtatggagtgggttgtgttcctgcaaagccccagtggaagtcatctgaagttgtgaaggcctctgaatcccgtatcatggaaggcgttagcgagatcttcgttgttcgtgaaaaaagagttccatctcaagttcatgaaaaaagtgtggagttaactggaggaataactcttgctgacaagacgcataggttactctgttgtacacaaaaagaaaaccttgatgagcatcacggaattgattggcacacacgctacaaaataattcaggggatttgcgagggtttggcatacctccataggcaactggaatattgtatttgtcatggtgatgtaaaaccggacaatatattgctggatgcaattatggtgccaaaaattgcagattttggcctgtcaaggtactacggggaagaaattgtaggaacaagtaaaattgtgaagtgcaaatggaacatacttct

SEQ ID NO: 32859 - protein, 210 aa, Panicum virgatum
  misc_feature: Ceres CLONE 1913088
  misc_feature: SWISSPROT Homolog: EC 2.7.11.1 Non-specific serine/threonine protein kinase
MAVAVLASQREHSSIASRITELHRTTCALGWTHSGFPEIEGSAYVYEKLAFSALTIVYGVGCVPAKPQWKSSEVVKASESRIMEGVSEIFVVREKRVPSQVHEKSVELTGGITLADKTHRLLCCTQKENLDEHHGIDWHTRYKIIQGICEGLAYLHRQLEYCICHGDVKPDNILLDAIMVPKIADFGLSRYYGEEIVGTSKIVKCKWNIL

SEQ ID NO: 32860 - DNA, 743 bp, Panicum virgatum
  misc_feature: Ceres CLONE 1913092
  misc_feature: Encodes the peptide sequence at SEQ ID NO. 32861
gtcaactccactcctcttctacgccgcgtccaccacctcttcggcgcgccgccgccgtcgcagcagtcatctcgcggggcagccatggatgaggagtacgacgtgatcgtgctgggcacggggctcaaggagtgcatcctcagcgggctcctctccgtcgacggcctcaaggtgttgcacatggatagaaatgactactatggaggagattccacctcactcaaccttaaccagctgtggaagaggtttagaggggaagacaagcctccggcacatctaggtgcaagcagagactacaatgtggacatggtcccaaagtttatgatggcaaatgggacattggttcgaaccctcatccacactgacgtgacaaagtacttgtcattcaaagctgttgatgggagctacgttttcagcaaagggaagatttacaaggtccctgcaactgatatggaggctctgaagtcccctttgatgggcctctttgagaagcgcagagcaaggaacttcttcatttatgtccaagattacaatgaagctgatccaaaaacccatcaaggattggaccttactagggtgacaactagggagcttatagccaaatatggtttgagcgaagatacagtggatttcattgggcatgcacttgctcttcatagagatgatcgttatcttgatgaaccggcatttgatacagtgaaaaggatgaaactgtatgcagagtcctgatgaatcccctaatg

SEQ ID NO: 32861 - protein, 214 aa, Panicum virgatum
  misc_feature: Ceres CLONE 1913092
  misc_feature (1)..(214): Pfam Name: GDI Pfam Description: GDP dissociation inhibitor
MDEEYDVIVLGTGLKECILSGLLSVDGLKVLHMDRNDYYGGDSTSLNLNQLWKRFRGEDKPPAHLGASRDYNVDMVPKFMMANGTLVRTLIHTDVTKYLSFKAVDGSYVFSKGKIYKVPATDMEALKSPLMGLFEKRRARNFFIYVQDYNEADPKTHQGLDLTRVTTRELIAKYGLSEDTVDFIGHALALHRDDRYLDEPAFDTVKRMKLYAES

SEQ ID NO: 32862 - DNA, 562 bp, Panicum virgatum
  misc_feature: Ceres CLONE 1913124
  misc_feature: Encodes the peptide sequence at SEQ ID NO. 32863
atccagctccagccagagccagacctcccacccgaatcctcctccccgacgccgggaatggtcccgctattgctctccgagtgctacggcctctcgcacgctgcgcctgcacaccagccggggcgacgttgcggcgcctgcgccccccgacaatgtctacgccacgatcctgcacaacgagggcatccctccggcaccctcaccgtctgatcttctctgggtatccgcttcgaggacggccgcactctatcaactacaacatccaaaaggagaccaccctcctcctggaggaccacctggctggtgctatgcagaacttcgagaacagcctgcctgggaagaccatcaccgtggaaatgcactcttccaacaccatcgacaatgtgaaggcgaacatccaggactacgagggcatctccctcgaccagcactctctgatcttcgcccgcaaccacctggaggatggccgcaccctctcggactactagatccaaaaggagtccaccctcgacttggtactccggctgcgctgcggcatccagatctatgggaagaccctcac

SEQ ID NO: 32863 - protein, 111 aa, Panicum virgatum
  misc_feature: Ceres CLONE 1913124
  misc_feature: Useful for making plants with modulated cold sensitivity
MSTPRSCTTRASLRHPHRLIFSGYPLRGRPHSINYNIQKETTLLLEDHLAGAMQNFENSLPGKTITVEMHSSNTIDNVKANIQDYEGISLDQHSLIFARNHLEDGRTLSDY

SEQ ID NO: 32864 - DNA, 752 bp, Panicum virgatum
  misc_feature: Ceres CLONE 1913133
  misc_feature: Encodes the peptide sequence at SEQ ID NO. 32865
agggacggagaagagaaggctctcggccataggtacagccagagggcagcagcaaccaacacaggcctcacctggaagctccatccgccatggcattctcgcccgccacggcctgctgcaacccctcgctgccggtggcgccccgggcgccgcagcgcggctcgtcggcccgcgcgcaggcgctcctctgcgcgccctccacctccgcgttccgcggcgtactcgtccggccgcccgcggccgccgcgccggccccgcggtggcgccgcgccgccgcgtccacgggcagcgtgccgcccaacttcaccctcaaggaccagaacgggaggcccgtgtcgctgaacaagttcaagggcaagcccgtggtggtctacttctaccccgccgacgagacgcccggatgcaccaaacaggcgtgcgcgttccgcgactcttacgagaagttcaagaaggccggcgcggaggtgctgggcatcagcggcgacgacacggcgtcgcacaaggcgttcgcgcagaagtaccggctgccgttcacgctgctgagcgacgaggggaaccgggtgcgcaaggagtggggcgtgccgggggacctgttcgggacgctcccggggcggcagacctacgtgctggacaagaacggcgtcgtccagtacatctacaacaaccagttccagcccgagaagcacatcggcgagaccctcaagatcctgcagggcctctgagccaggtccgcatccgtcgctgtactgtat

SEQ ID NO: 32865 - protein, 210 aa, Panicum virgatum
  misc_feature: Ceres CLONE 1913133
  misc_feature (65)..(189): Pfam Name: AhpC-TSA Pfam Description: AhpC/TSA family
  misc_feature: SWISSPROT Homolog: EC 1.11.1.15 Peroxiredoxin
MAFSPATACCNPSLPVAPRAPQRGSSARAQALLCAPSTSAFRGVLVRPPAAAAPAPRWRRAAASTGSVPPNFTLKDQNGRPVSLNKFKGKPVVVYFYPADETPGCTKQACAFRDSYEKFKKAGAEVLGISGDDTASHKAFAQKYRLPFTLLSDEGNRVRKEWGVPGDLFGTLPGRQTYVLDKNGVVQYIYNNQFQPEKHIGETLKILQGL

SEQ ID NO: 32866 - DNA, 2829 bp, Panicum virgatum
  misc_feature: Ceres CLONE 1913148
  misc_feature: Encodes the peptide sequence at SEQ ID NO. 32867
ctacccctcctccctcctgcccgtcacatggacacggagcggcggcacttgcgcccgtgctagctgcgacggcgagttcgcagcggtggtggcccggactgctggctgttgcctgaaaggtggtggctttgggggctgggagggacaaggcttcgggaggttccctctagcggactgcgcgggatggcgctgctgccgtggtggtggtcggcggcggcagcggcggcggtgctggttcttgcggcggtggcggcggaagttgaggccggaggaggaggaggcgaaggggatgggcgggcgctgatggcggtgaaggccgggttcgggaacgcggccaacgcgctcgtggactgggacggcggccgcgaccactgcgcctggcgcggggtcgcctgcgacaccgcctccttcgccgtcgtcggcctgaacctgtcaaatctaaacctaggaggggagatctcgccggctataggggagctcaagagcctacagttcgtggatctcaagctgaacaagctcacaggccaaatcccagatgagattggggattgtgtctccttaaaatatctagatttgtctgggaacttgctgtatggagacatccccttctccatctccaagctcaagcagcttgaggacctgattttgaagaataaccaactcacgggacccatcccttccacgctgtcccagattccaaatctcaagaccttggatctagctcagaacaaacttaccggtgacatcccgaggctcatctactggaacgaagtactgcagtacctaggcttgaggggtaactcactgactggaactttgtcacctgatttgtgccaactgactggcctgtggtactttgatgtaagggggaacaatctcacaggaaccattccagagggcatagggaactgcactagctttgagattctggatatttcatacaaccaaatctctggagaaataccttacaacataggataccttcaagtagccacactgtcacttcaaggaaatagactgactgggagaattccagaagtgattggcctcatgcaggctcttgctgtcctagacctgagcgagaatgaactggtagggccgattcctcctatacttggcaacctatcatacactggcaaactctatttacatggcaacaaacttactggacacataccaccagaactggggaacatgagtaaacttagctacttgcagctgaacgataatgaactagaaggcaccattccagctgagcttggcaagctcacagaattatttgaattaaatcttgccaacaacaatcttgagagtcatattcctgcaaacatcagttcttgcagtgcactgaacaaattcaatgtgtgtggcaatagactgaatggctctatccctggtggtttccagaagttggagagcttgacatacctgaacctttcttcaaacaatttcaaaggccagattccctctgaacttggccacatagtcaacttggacacactggatctttcctacaatgaattctctggaccagttcctcccactattggtgatctcgagcatcttcttgaactgaatttgagtaaaaaccatcttattggatctgtgcctgctgaatttggaaacttgagaagcgtccaagtaatcgacatatccagtaacaacttgtccggttatctccctgaagaacttggacagttacagaaccttgatagcttgattcttagcaacaacaatttggttggggagatccctgctcagctggctaactgcttcagcttaattaccttgaatttgtcgtacaacaacttttctggatacgtcccatcagcaaagaatttctcaaaattcccaatggatagctttgtgggtaaccctatgctccacgtgtactgccaagactccatctgtggacattctcatggaacaaaagttaatatttctcggacagcagttgcttgcattattttaggcttcatcatattactctgcattatgctgctggcagtatacaagacaaataaaccacttccacctgagaaaggatctgacaagccagtgcaaggaccaccaaaactagtagtccttcaaatggacatggcttcccatacctatgaagaaattatgaggttgactgagaattttagtgagaaatacatcattggttatggcgcatcaagtactgtgtacaaatgtgatctcaagagcggcaaggctattgctgtcaaacggctttacagtcagtataaccacagcctccgtgagtttgagacagagctggagacaatcggtagcatccgacacaggaatcttgtcagccttcatggcttctcactctctcctcatggaaacctgctcttctatgattacatggaaaatggttccctgtgggatcttcttcatggtccatcaaagaaagtgaagcttgattgggacacaaggctgaagatcgcagtgggtgctgctcaaggactggcctatcttcaccatgactgcaaccctcgcatagtccacagggatgtcaagtcctcaaacatcctgctcgatgagaactttgaagcgcacctctctgatttcggcatcgccaaatgtgttccggctgccaagtcccatgcctccacctacgttctgggaaccattggctacattgatccagagtatgcccggacgtcaaggctcaatgagaaatctgatgtctacagctttagcatagtccttctggagctgctcactgggaaaaaggccgtcgacaatgaatccaacttgcatcaattgatactctcaaaggctgatgacaacacggtgatggaggctgtggactcggaggtt

SEQ ID NO: 32867 - protein, 881 aa, Panicum virgatum
  misc_feature: Ceres CLONE 1913148
  misc_feature (654)..(880): Pfam Name: Pkinase Pfam Description: Protein kinase domain
  misc_feature (33)..(72): Pfam Name: LRRNT_2 Pfam Description: Leucine rich repeat N-terminal domain
  misc_feature (36)..(548): SWISSPROT Homolog: EC 2.7.11.1 Non-specific serine/threonine protein kinase
  misc_feature (659)..(852): SWISSPROT Homolog: EC 2.7.12.2 Mitogen-activated protein kinase kinase
MALLPWWWSAAAAAAVLVLAAVAAEVEAGGGGGEGDGRALMAVKAGFGNAANALVDWDGGRDHCAWRGVACDTASFAVVGLNLSNLNLGGEISPAIGELKSLQFVDLKLNKLTGQIPDEIGDCVSLKYLDLSGNLLYGDIPFSISKLKQLEDLILKNNQLTGPIPSTLSQIPNLKTLDLAQNKLTGDIPRLIYWNEVLQYLGLRGNSLTGTLSPDLCQLTGLWYFDVRGNNLTGTIPEGIGNCTSFEILDISYNQISGEIPYNIGYLQVATLSLQGNRLTGRIPEVIGLMQALAVLDLSENELVGPIPPILGNLSYTGKLYLHGNKLTGHIPPELGNMSKLSYLQLNDNELEGTIPAELGKLTELFELNLANNNLESHIPANISSCSALNKFNVCGNRLNGSIPGGFQKLESLTYLNLSSNNFKGQIPSELGHIVNLDTLDLSYNEFSGPVPPTIGDLEHLLELNLSKNHLIGSVPAEFGNLRSVQVIDISSNNLSGYLPEELGQLQNLDSLILSNNNLVGEIPAQLANCFSLITLNLSYNNFSGYVPSAKNFSKFPMDSFVGNPMLHVYCQDSICGHSHGTKVNISRTAVACIILGFIILLCIMLLAVYKTNKPLPPEKGSDKPVQGPPKLVVLQMDMASHTYEEIMRLTENFSEKYIIGYGASSTVYKCDLKSGKAIAVKRLYSQYNHSLREFETELETIGSIRHRNLVSLHGFSLSPHGNLLFYDYMENGSLWDLLHGPSKKVKLDWDTRLKIAVGAAQGLAYLHHDCNPRIVHRDVKSSNILLDENFEAHLSDFGIAKCVPAAKSHASTYVLGTIGYIDPEYARTSRLNEKSDVYSFSIVLLELLTGKKAVDNESNLHQLILSKADDNTVMEAVDSE

SEQ ID NO: 32868 - DNA, 687 bp, Panicum virgatum
  misc_feature: Ceres CLONE 1913148-R
gccttccagctcgccctgctgtgcaccaagcggcaccccgccgaccgtccgaccatgcacgaggtcgcgagggtgctgctctccctcctgccggcacccgccgtgaagcctcccacgaccaagggcacggccggcgactacacccgcttcctggcgacgaccacggccgacatgaagcacgacgtgtccgacgacatcggcgacaacagctcctccgacgagcagtggttcgtgcggttcggcgaggtcatatccaagcacacaatgtcatgatccccttctctctgtctgtctaacactagggtccccaatttttttttctcccaagtagagatccaagtaagaaggtagtaaaaccacagtagcacagtgcaggaaataggtgtaggattcgcggtagatgatgcccattgttcctcttgatgttcggttcagaagcgtccaaatggaagaagatgatatgggtcaggatggggattgctgcggaggttcttggtgtaatcacgacacgagtggggtgggtggatctgtcagaggtgtcccgtgagcgccatgaatctgaagcattcatgcgctcgcgattcagagctaggccatggagtttcttggatcctggagaaggcattgaattgaaccatgcatccggcattgaacaggccgggctgttgtaaatgaaatgcatcacag

SEQ ID NO: 32869 - DNA, 2055 bp, Panicum virgatum
  misc_feature: Ceres CLONE 1913159
  misc_feature: Encodes the peptide sequence at SEQ ID NO. 32870
accgccacatcccacatgcctcctcgccttctcctcttcctccttcctcgcggcagcctcctgccccctctccgccgcccctcgccggcgctttctcctcttatccggagaatcccctcgaacaagccccccggatacttcttcctctcccccgtgcgcgccttctccgggtactccggcatggcggcggcgggttcgccggagcagcagccgcggagcgtcgtggtgaaggagaccgtggagctcacggagaaggaggagcaaatcttccgacggcttcttgacgtcgtccgccacttcggcctcggcacgcagctccgcgtcgccggcggctgggtccgggacaagctattagggaaagactccgctgacattgacgttgcccttgataatatgacgggccagaatttctgcgagaaagtaaatgagtatttagagttgataggggaagagcagaaaggaatcggtgttatccagtgcaaccctgatcaatcaaagcacttggaaactgctaggatgcttatacttgacatctggattgattttgttaacttgagatctgaaacgtatgctgaaaacagtcgtattcctaccatggaggttggtactgccaaagccgatgcataccgcagggacttgacgattaatagtttgttctttaacatcaacaataactcagttgaagatttaactggaagaggtatcgaggatctcaaaaaaggccttattgttactccactacctgccaaagctaccttccttgatgacccacttagagttcttcgagcaataagatttgctgctagattcaactttacattagctgaagacttgaaggaagccgcgtctgatgaaagggtgaagtcagaacttggtagcaagattagtagagaacgtatcggtcatgagatcgatctcatgatgtcagacaaacaccctgtaaaagcaatgtatgacatccgtgatttggggctattttacgttgtattttctttcccagagaactccaaccctccagtttttgacaaatgtgattggcagtgtgtttcgcatattgaagcagcttggaatcttacatattctattggcagctctgtgttcaacagtggttctgaccccaagttgcaggatgagcagcgaaggctttacctgtatagtgcattatttgttcccctacgaaatatgttctacttggacagaagatctaagaggcaggttcctgtgtctagctatattattaagcactcactaaagttgaaaggtagcgatgctgaaacggttgtcaacatacatgctgctagtgagaagtttgctgaattagttcatctccttgagtcaagttttgatgtgagaactttcaaagagaagctggaagatgaatatcttgagatacctacagacagtgtgaaacgcgtttgtgcaggacttatactacgagaaataaaggacttttggcgactggcacttcttgtatccattctctccaacccagaagctgaaaatgctgctggcatcctcaacaagcaggatgagctgcattggagaaaagagaaatacatcagagttgagcgtgccataactgacttagatcttgatggggtgtggaagctgaagccggtacttgacggaaaatctattatgggagttatgcaggtcaagtcaggaggtccattgataggaaaatggcaacaacgtgccctgaaatggcagcttgcgcatccgaacggaaccatggatgagtgcatagaatggatgaagcagtcgcagtcgaaacgccaaaaagtagaatccagcacctgatacaggatggcattttgagcataggcataagccatagacagtcttcagataggtaaaccagctgcagtagcaacagtttgcgtcagtttagccaccacctgggttgaacactgaaacgcctgctgccaccaatgggaaatgtaagatcgtcatcataggacatagggtcatgtcttggtctcggcggatttgatgccaccagtttacccagagttgtcgattatttttgaaaaagtaatcatcttctggttatcg

SEQ ID NO: 32870 - protein, 594 aa, Panicum virgatum
  misc_feature: Ceres CLONE 1913159
  misc_feature (101)..(239): Pfam Name: PolyA_pol Pfam Description: Poly A polymerase head domain
  misc_feature: SWISSPROT Homolog: EC 2.7.7.25 tRNA adenylyltransferase
MPPRLLLFLLPRGSLLPPLRRPSPALSPLIRRIPSNKPPGYFFLSPVRAFSGYSGMAAAGSPEQQPRSVVVKETVELTEKEEQIFRRLLDVVRHFGLGTQLRVAGGWVRDKLLGKDSADIDVALDNMTGQNFCEKVNEYLELIGEEQKGIGVIQCNPDQSKHLETARMLILDIWIDFVNLRSETYAENSRIPTMEVGTAKADAYRRDLTINSLFFNINNNSVEDLTGRGIEDLKKGLIVTPLPAKATFLDDPLRVLRAIRFAARFNFTLAEDLKEAASDERVKSELGSKISRERIGHEIDLMMSDKHPVKAMYDIRDLGLFYVVFSFPENSNPPVFDKCDWQCVSHIEAAWNLTYSIGSSVFNSGSDPKLQDEQRRLYLYSALFVPLRNMFYLDRRSKRQVPVSSYIIKHSLKLKGSDAETVVNIHAASEKFAELVHLLESSFDVRTFKEKLEDEYLEIPTDSVKRVCAGLILREIKDFWRLALLVSILSNPEAENAAGILNKQDELHWRKEKYIRVERAITDLDLDGVWKLKPVLDGKSIMGVMQVKSGGPLIGKWQQRALKWQLAHPNGTMDECIEWMKQSQSKRQKVESST

SEQ ID NO: 32871 - DNA, 755 bp, Panicum virgatum
  misc_feature: Ceres CLONE 1913164
  misc_feature: Encodes the peptide sequence at SEQ ID NO. 32872
accgatagcacactacgctactctacgctctcgccagctagtcgatcttacactgcgttccgcttccgcagcagcccagcccagcccagtccacccacacacgcacccacaatggcggggcgcatcgccgtggcggcggcgttcctggcgctggcggtggttccggcggcgctggcgcaggcgccgggccccgcggcggcgccgagtgggccccccaacatgacggcgatcctggagaagggcgggcagtacacgaccttcatccggctgatgaaggagacgcagcaggacacgcagctcaacagccagctcaacagctccttcggcaacaacggcggcggctacacggtgttcgcgcccaccgacaacgccttcaacaacctcaagcccggcacgctcaactccctcacccagcagcagcaggtgtcgctggtgcagggccacatcctgcccagtttctacagcatggactccttccagaccgccagcaaccccgtccgcacccaggcctccggccgggacgggccctacacgctcaacatcacctccgacaccaacaaccaggtcaacgtctcctccggcgtcgtcgaggtccgcatcaacaacgcgctctactccgccaagccgctcgccgtctactccgtcgacaaggtgctcctgcccatggagctcttcggggccaaggcccccgccgccgcgcccactgcgtccgagggcaagcccaagaagggcggctcctccgacgcctcgtcacc

SEQ ID NO: 32872 - protein, 214 aa, Panicum virgatum
  misc_feature: Ceres CLONE 1913164
  misc_feature (46)..(184): Pfam Name: Fasciclin Pfam Description: Fasciclin domain
  misc_feature: Useful for making plants with altered carbohydrate content
  misc_feature: Useful for making plants with altered cell wall content and/or composition
MAGRIAVAAAFLALAVVPAALAQAPGPAAAPSGPPNMTAILEKGGQYTTFIRLMKETQQDTQLNSQLNSSFGNNGGGYTVFAPTDNAFNNLKPGTLNSLTQQQQVSLVQGHILPSFYSMDSFQTASNPVRTQASGRDGPYTLNITSDTNNQVNVSSGVVEVRINNALYSAKPLAVYSVDKVLLPMELFGAKAPAAAPTASEGKPKKGGSSDASS

SEQ ID NO: 32873 - DNA, 2192 bp, Panicum virgatum
  misc_feature: Ceres CLONE 1913174
  misc_feature: Encodes the peptide sequence at SEQ ID NO. 32874
catcccccgcctaaatccgccccccgaggggaagggactctcgtcgcctggtcacgcctccgaagcctcccattcttccatcggcgccctcgtcgtcccttgtgcccgcgcgggaggcgcagatccatcccgacccggccggggggtcgattcctcccctcctcctcctcctcctgctgctgctgctgggttggatcatcttcccagtcccacgcgaaagctgtgatcattccgttgcgccgttcaacaagataacgacgacatgttggagtagttgcttctctgagccgcaggcctcccgcccacgctaccctggcaagtgaagtcagggggtgtggggaataacccggcgcgctgaataaccatggacacaagagctggggcaatcctagtgtgcctgctcttcgtcctggtccgggacgtgtcggctgtcgccgagaccgagcccggcaatgcgcggttagtgcaggaggcgccccacaggaagctggatggcgcggggaggcaggatggcggtagggtggggagggtgtccgtgtcaacggtcgcatggtctacgctcgtcatggccgcggcaactgggctgggagcggtgcccttctttttcatggagctggaagctcagtgggcgggcctctgcaatgggatggcggctggggtgatgctggctgcaagctttgaccttgtgcaggaagggcaggtgtatggcagtgggagctgggttgtttttggaattttgagtggaggagtatttatttggctctgcaagaagttgcttgagcaatatggagaagtaagcatgctggatattaaaggtgcagatgcaagtaaagttatccttgttgttggaataatgactctccattcttttggggaaggctctggtgtgggggtatcctttgctggctccaaaggattttctcagggtcttctagttactatagctatagcagtgcacaacataccagaaggcttggctgtaagcatggtactgtcatctaggggtgtgtccccccaaaaggcaatgatatggagtatcataacatctttaccacagccaattgttgctgttcctgctttcctttgtgccgatgcgttccagaaggtgctccccttttgtactggttttgctgcgggatgcatgatatggattgttatagcagaggttcttcctgatgcttttaaggaagcgactccatcacaagttgcttctgctggaacacttgctgttgctttcatggaaacattaagtactgtgcttctgggatttactgatggcaacaacctggaggatgcatcaggtttcttggtatcacttgtatttggactgggtccacttatcggaggaattatacttgtcacattctctcttgccttcagcatgccacaccctctacttactggtgtggcatcaggcattgctttccgtcttgcagcatggagacctgtacagcttctcatgtcctcaaaaatgggtctctttaccacactctttctcctcattggtggttcccttgtctaccatgttgccacatcaagcatccttagggtggttaatcgcaagaaatcctccgtcaatgtcattacatcatcctccggcttctctcttagtgtcctcacagtgcaatcactcctttcatgcggtgccgtattcattcatgcatacacggaaggacttgtacttggtgtcgcggctcgcaaggcttatggccttggccgttatatggttcttccagcctccctccatggtctgccacgaggtgcggctgtcgcaagctgtgtttttggtgccacagatagctggcgcggtgccctggcagcggctgttctgaccggggttgcaggacctagtgccgccatcagcgcgatccttgcgaggatcgactacgatgggctcgaccactggatggtgatcgcgtgtggggctctgatccccagctttggccgtgttttcaggcggtccttgcggttggacatgcggaagagcatcgtgggtttgctgattggcatcgcctttgcctccgtgtgcttgatgtcgaataggttcatttgcttgcacactccttactgcaactcagctccagaagcggtcacataaccggtgttgtacgggggctgctgtgtaaaacacatgtaacaccagtgtaatgacttctgactatacaaggaatggaagaggctagttatattgc

SEQ ID NO: 32874 - protein, 577 aa, Panicum virgatum
  misc_feature: Ceres CLONE 1913174
  misc_feature (58)..(293): Pfam Name: Zip Pfam Description: ZIP Zinc transporter
MDTRAGAILVCLLFVLVRDVSAVAETEPGNARLVQEAPHRKLDGAGRQDGGRVGRVSVSTVAWSTLVMAAATGLGAVPFFFMELEAQWAGLCNGMAAGVMLAASFDLVQEGQVYGSGSWVVFGILSGGVFIWLCKKLLEQYGEVSMLDIKGADASKVILVVGIMTLHSFGEGSGVGVSFAGSKGFSQGLLVTIAIAVHNIPEGLAVSMVLSSRGVSPQKAMIWSIITSLPQPIVAVPAFLCADAFQKVLPFCTGFAAGCMIWIVIAEVLPDAFKEATPSQVASAGTLAVAFMETLSTVLLGFTDGNNLEDASGFLVSLVFGLGPLIGGIILVTFSLAFSMPHPLLTGVASGIAFRLAAWRPVQLLMSSKMGLFTTLFLLIGGSLVYHVATSSILRVVNRKKSSVNVITSSSGFSLSVLTVQSLLSCGAVFIHAYTEGLVLGVAARKAYGLGRYMVLPASLHGLPRGAAVASCVFGATDSWRGALAAAVLTGVAGPSAAISAILARIDYDGLDHWMVIACGALIPSFGRVFRRSLRLDMRKSIVGLLIGIAFASVCLMSNRFICLHTPYCNSAPEAVT

SEQ ID NO: 32875 - DNA, 1809 bp, Panicum virgatum
  misc_feature: Ceres CLONE 1913176
  misc_feature: Encodes the peptide sequence at SEQ ID NO. 32876
gacacttcgacaggctttcttcatcctcttcgtcttccttcccctggcctcccatccacccccacggccccaccccgcccgcaactacaagcaacgccggatccagtccgttccgcttccaggcgaatggtcgccaaccaggaggcatcggcggcagcgcccggggcagggacgccggtggacccgatgcgtctggcgtcgcggtggcggtccccggcggagtgggagtgtgcggcggcagagctggatgctgagccgctcccgtccgagctcaacaccgtcaacagctctggacttttcgccgtcgtctccaccgacaagttgtccgtcaaatacctcggcaaccatcaccatggccacgacgtcggggtcgtgcaagccgaccgccccgcgcccacgcgccgggccgtgtactactttgagatgcgggtcaagaacgccggctacaaggggcagatctcaatcgggttcacaagcgaaagcttcaagatgcggcgacaaccgggttgggagcctaacagttgtggataccacggtgatgatggccatctttaccgaggtcaagggaaaggtgaaccattcggggccaaatttacatctggcgacacaatcggtgctggcatcaactacttgtcacaagaatttttcttgacgaaaaatggatctctggttggagcctttccaaaagaaattaaaggtccactatatcctaccgttgcagttcatagtcagggtgaagaattgactgtgaactttggtaaagaaccattctgttttgacattgagggttatatactcgaagagaaaatgaggcaacaatcgatgacgaacaaattgaagttggaagagaacatcagtcatgtgattgtccgttcatatctgctacattatggttaccaagatacattaaattcttttgatttggcaaatgcaactgatccccctggcagtcgccaaaatggacatagggaacctccagaaacgtatggacttagccacagaaaacttttgcgtcagcttatcatgagtggagatattgactctacattcaaaagactagaggaatggtatccacaagtgataaaggatgataaatcggttatttgcttcttactccattctcagagattcatagaatatatcagggctgaacaactggaggatgctgtgaaatatgctcgtgctaacctggcaagcttcttgacgcacaaagctttcgaggggttgctgaaggagagtgtggccctgcttgcgtatgagaagcctgcagaatcatgcatcggatacctgctggactccccccagcgtgaattcgtggcggatgcagtgaacgcagctgtcctgtctacgaacccagccatgaaggaccccaagagctgtctttactcgtgtcttgagaggttactaaggcagctcacagtatgtagctttgagcgacgcaccttcaacaatgaccaaggagatgcattcttacttcacaaagaagtgcgcaactgtgaaaggtcctggcgttcataggcacatctgagaattctcggatgttagactccaactgctgttgggaggaccaaggatcacctcggatggagttgttgagcatggcacgcgcaagcacagatccttccttttgaaggtctgcagcgtccatgggctttctaattccgataggtgcacttaattgcacagagctctgaaggagtttccttcctgtaatcagaaaacttgttcagaatcggccaacgtgtctgttcccatagtttgatggttggctaatagaccatttgattttgtgaatgctaaaaacgcttc

SEQ ID NO: 32876 - protein, 463 aa, Panicum virgatum
  misc_feature: Ceres CLONE 1913176
  misc_feature (93)..(214): Pfam Name: SPRY Pfam Description: SPRY domain
  misc_feature: SWISSPROT Homolog: EC 2.7.10.2 Non-specific protein-tyrosine kinase
MVANQEASAAAPGAGTPVDPMRLASRWRSPAEWECAAAELDAEPLPSELNTVNSSGLFAVVSTDKLSVKYLGNHHHGHDVGVVQADRPAPTRRAVYYFEMRVKNAGYKGQISIGFTSESFKMRRQPGWEPNSCGYHGDDGHLYRGQGKGEPFGAKFTSGDTIGAGINYLSQEFFLTKNGSLVGAFPKEIKGPLYPTVAVHSQGEELTVNFGKEPFCFDIEGYILEEKMRQQSMTNKLKLEENISHVIVRSYLLHYGYQDTLNSFDLANATDPPGSRQNGHREPPETYGLSHRKLLRQLIMSGDIDSTFKRLEEWYPQVIKDDKSVICFLLHSQRFIEYIRAEQLEDAVKYARANLASFLTHKAFEGLLKESVALLAYEKPAESCIGYLLDSPQREFVADAVNAAVLSTNPAMKDPKSCLYSCLERLLRQLTVCSFERRTFNNDQGDAFLLHKEVRNCERSWRS

SEQ ID NO: 32877 - DNA, 1605 bp, Panicum virgatum
  misc_feature: Ceres CLONE 1913180
  misc_feature: Encodes the peptide sequence at SEQ ID NO. 32878
gtcgccgctgctcgcgatgcgctcgcattcgccgtcgtctgcagactaccgctgctgcccgccgtcggccatctctgacgccttcccagcgattctccccgcccctaccgtccccgcccccgcccccgcgcctttcgagtctcgacgtcgacgatggagggccgcctcctcgacaagtccctgaacccgaacaagctcctcaaggagcaatttgtgagcaacctgacggggtcctccatgtcggagatcgcggcgctctccactatcgtgccggcattggtggttctcaggaagtggagcagcggagataatactaggagggatgcagcgaagaaaaatgatgataaagttcttcctgttcgtaaagattggatgcagtacttctgtacactggttgtagattatctcactgttgtattgccagttcttttggttttcacagtcttagctgaatgggcttatacatgtgctatttctctcataatcctgatatctgtccacatcatgtttaaaaggtctcagtctcatcttaaatctggactcagccaatcgccttcactcagagcagatatatcttcttaccgagtgtcagtggttctggtgacatgtttgtgcatactagcggtggacttcaaaatctttccaagacgctatgccaaggctgaaacatatggtagtggcatcatggatcttggagtaggatcttttgtagtggctaatgcactggtatctagacaagcacgaaacgtaacctcaatgagtttcagggcagcactgagttccattagtccactggtatttcttgggtttgctcgcattatctcaacattgggtgttgattatcaggttcatgtaggagaatatggtgttcattggaacttctttttcacccttgctgctgtttctatccttacatccattgtcaggattcatccaaagcattgtggcctagttggtctgctaatccttgcaggataccagatttggctatcttctggattgaatgagtacctcatttctgataaaagaagtgctgacatactcagccagaataaggaaggcgtttatagcatacttggatactggggtatgtttctaattggtgtttctctgggttactatctattcgctgacactagctcaaaaggcaagagcaggaacactcaagtggtaaaagtctgggttcttgctgcgtctttctggattttggcaatcatccttgatagctatattgagagagtttctcggcgaatgtgcaactttgcttatgttatgcttgttttcggtcagaattttcaggttttatctatcctcacattagcagggttcatttcatatgaaaagaacttgattcttgaagatgcattcaatcaaaatatgcttggttcattccttctggcaaatatcctaacaggtctggtaaatctctcagttgacacactctctgcctcttcgctcactgccttcatgattctgtcagtatacacctttactttatgcatggttactggccttgcccatttttttggtgttagaatgaaattctggtgaatttgtaatctagcatttgaatgttgtatgtattcattaacttgcctgcaaact

SEQ ID NO: 32878 - protein, 465 aa, Panicum virgatum
  misc_feature: Ceres CLONE 1913180
  misc_feature (299)..(424): Pfam Name: GWT1 Pfam Description: GWT1
MEGRLLDKSLNPNKLLKEQFVSNLTGSSMSEIAALSTIVPALVVLRKWSSGDNTRRDAAKKNDDKVLPVRKDWMQYFCTLVVDYLTVVLPVLLVFTVLAEWAYTCAISLIILISVHIMFKRSQSHLKSGLSQSPSLRADISSYRVSVVLVTCLCILAVDFKIFPRRYAKAETYGSGIMDLGVGSFVVANALVSRQARNVTSMSFRAALSSISPLVFLGFARIISTLGVDYQVHVGEYGVHWNFFFTLAAVSILTSIVRIHPKHCGLVGLLILAGYQIWLSSGLNEYLISDKRSADILSQNKEGVYSILGYWGMFLIGVSLGYYLFADTSSKGKSRNTQVVKVWVLAASFWILAIILDSYIERVSRRMCNFAYVMLVFGQNFQVLSILTLAGFISYEKNLILEDAFNQNMLGSFLLANILTGLVNLSVDTLSASSLTAFMILSVYTFTLCMVTGLAHFFGVRMKFW

SEQ ID NO: 32879 - DNA, 1139 bp, Panicum virgatum
  misc_feature: Ceres CLONE 1913199
  misc_feature: Encodes the peptide sequence at SEQ ID NO. 32880
gcgcttacccagtagcccccctctcggcagttggattcgccgccaggaccgcggttcggcgtccggatccggcaatctctcgccgacgcgccgcagatccgaaaaaatcccagccttcccggtgaactgcccccctccagccgcagctccgcggtcgcgctcttcgcctctgttgatactggagcttgcatttgtgtgtggctgtgcaatcaatcaggtgctctagggttaatctgtttcgattttcttcgtcccatcgattcactcgcgctcgcactgtcccagtgtgctcactctggttgcctggacttcacctcgctgcatcattagcattagaattgaactccccgtgtgcttgctcgctctactgtttctggtggtcggtggtcactgacacgcgattcttggcgtgctagacgcccgggaccatcaggagctttggtgtcgctgtgggcatggcgttgctgtgagaaatctcctggggggaagatgtggaaacagctcctgcacaagctgcctaggaagtcctctgcctccgggaagggcgaccacgccgcaggctctagtccggggcgcaatgctgccgggaacgggagcgggatacagcgcacgagcagctgcccgagcgccgggcctgcccgtccggcgcctggcgtgaagcgcatgtcgtccgcggtgttcccgtcgagcgtggtggctggcattgagccgctcgtgccgttcaaggatgtcccgaacggggagaagccaaacctgtttgtcagcaaggtgagcctgtgctgcgttgtctttgatttctcggaccccagcaagaattcggcggagaaggatttcaaaaggcaggcattggtgaatctcgtgaattatgttgaatctgctagctcccgcttcacggagcccatggttgctgcctgctgcaggatgtttgctatcaacttgttcacggtgttccctcccaactgcaggtccagttcatctgggggtggtgagggtgaagaggaggagccaatgtttgactctgcatggtcccatgtgaatcttgttttcgatcccctccacacctccctctcttcgtcttccttaggcgcggaagggcaagaaaaaaatagctactcctccatctttgacagcatcttcgt

SEQ ID NO: 32880 - protein, 216 aa, Panicum virgatum
  misc_feature: Ceres CLONE 1913199
  misc_feature (74)..(215): Pfam Name: B56 Pfam Description: Protein phosphatase 2A regulatory B subunit (B56 family)
MWKQLLHKLPRKSSASGKGDHAAGSSPGRNAAGNGSGIQRTSSCPSAGPARPAPGVKRMSSAVFPSSVVAGIEPLVPFKDVPNGEKPNLFVSKVSLCCVVFDFSDPSKNSAEKDFKRQALVNLVNYVESASSRFTEPMVAACCRMFAINLFTVFPPNCRSSSSGGGEGEEEEPMFDSAWSHVNLVFDPLHTSLSSSSLGAEGQEKNSYSSIFDSIF

SEQ ID NO: 32881 - DNA, 650 bp, Panicum virgatum
  misc_feature: Ceres CLONE 1913199-R
  misc_feature: Encodes the peptide sequence at SEQ ID NO. 32882
gaggtcctggaggcaaccaacatggtcgaattccagaaatgcatggttccgttgttccgacgaattgctcactgcatcaatagttcccacttccaggttgcagagcgagcactcttcatgtggaacaatgatcacatcgtcagcttggtcgcacaaaaccggcaagcgatcatgcccattgtcaccccagcgttggaagagaatatccagaaccactggaatgtgtcagtcctaaacctgacagccaatgtgaagaagatgctgtcagagatggacgaggagctcttctctacctgccttgccatgcataaggaagacggagagagggaggcgtcgctggaacagaaacgaaggctggcctgggagcggctagagtccgcggcggcgatccagccagtgaccggcaacacagctgtcctggtgagccgctagacatcaggtgtcggaggaacgctgcaactccttcctcctgtgttagctttggtgaaaacggtcctagtgctgaacagaacagcactttgtttgtttagtttagtttagtttgttcgaagaagtagaaatataccatgttgtaagctgtaactatttgtgatgggatctctctgtctctctaatatgataaaaggcatcatgcatgcctgtttcatgct

SEQ ID NO: 32882 - protein, 143 aa, Panicum virgatum
  misc_feature: Ceres CLONE 1913199-R
  misc_feature (1)..(129): Pfam Name: B56 Pfam Description: Protein phosphatase 2A regulatory B subunit (B56 family)
EVLEATNMVEFQKCMVPLFRRIAHCINSSHFQVAERALFMWNNDHIVSLVAQNRQAIMPIVTPALEENIQNHWNVSVLNLTANVKKMLSEMDEELFSTCLAMHKEDGEREASLEQKRRLAWERLESAAAIQPVTGNTAVLVSR

SEQ ID NO: 32883 - DNA, 1547 bp, Panicum virgatum
  misc_feature: Ceres CLONE 1913201
  misc_feature: Encodes the peptide sequence at SEQ ID NO. 32884
accgaggaagcacgaggcagcatatttcgccgaggaccagcgtcccacactcctcccgcgtagccgcctccgcgccctccatttccacctcctggtctccagtgagacgtactagaagctagctaaatctcgcgtttttgttttccttttcgtttcgtttcgggggtgtgctcgagcttcctggagcagcttccgtttttggttgccggcttcctttggtctcggatccatcctccccgataaaagggaggcggggagggaggaaggaggagccgcggcgaggaagaaagcgagggagcgaggaatgggaggggtcaagggattcgtcgagggcggcatcgcctccatcgtggccggctgctccacccacccgctcgacctcatcaaggtccgcatgcagctgcagggggaggcggcggcgccgcagccggcgatgcgcccggcgctcgcggtccccgcgggcggccagaccgtcgcgctcccgcaggacgtcccggtggcgccgccgaggaagcccggcccgctcgccgtcggcgcgcagatcctgcgctccgagggcgccgcgggcctcttctccggggtgtccgccaccatgctccgccagacgctctactccaccacgcggatggggctctacgacatcctcaagaccaagtggacccaggacaacggcggcgtgctccccctgcaccaaaagatcgccgcggggctcatcgccggcagcgtcggcgcggccgtcggcaacccggccgacgtggccatggtgcggatgcaggcggacgggcgcctgcccctcgccgagcgccgcaactaccgcagcgtcggggacgccatcggccggatggcgcgcgacgagggcgtccgcagcctgtggcgcggctcgtcgctcacggtgaaccgcgccatgatcgtcacggcgtcgcagctggccacctacgaccaggccaaggaggccatcctcgcgcgccggggccccggcgccgacggcctcgccacgcacgtcgccgccagcttcaccgcgggcctcgtcgccgccgcggcgtccaaccccgtcgacgtggtcaagacgcggatgatgaacatgaaggtggcgccgggggcgcccccgccgtacgccggcgccgtggattgcgcgctcaagaccgtccggtccgaggggcccatggcgctgtacaaggggttcatccccaccgtgatgcgccaggggcccttcaccgtcgtgctcttcgtcacgctcgagcaggtacgcaaggtcttcaagggcgtcgagttctagagagacacgcccgccaccaccaccacgacgatgatgacgacaaccgccgctgccgccgccgccgtgttgttaccggctaccaccgcgtcggctgctacgaattatcgctgctgccgtgcccgccttagcttgcatcccgtgtcagcctagcgctaatcccttcctgcatcctgttgcctgcggatggaaatagggaatattcaattgagtacttgatcagatgtatacaatggaaatttcagataatttatataaaaaatatcgctgctgc

SEQ ID NO: 32884 - protein, 323 aa, Panicum virgatum
  misc_feature: Ceres CLONE 1913201
  misc_feature (228)..(322): Pfam Name: Mito_carr Pfam Description: Mitochondrial carrier protein
  misc_feature (127)..(222): Pfam Name: Mito_carr Pfam Description: Mitochondrial carrier protein
  misc_feature (2)..(122): Pfam Name: Mito_carr Pfam Description: Mitochondrial carrier protein
MGGVKGFVEGGIASIVAGCSTHPLDLIKVRMQLQGEAAAPQPAMRPALAVPAGGQTVALPQDVPVAPPRKPGPLAVGAQILRSEGAAGLFSGVSATMLRQTLYSTTRMGLYDILKTKWTQDNGGVLPLHQKIAAGLIAGSVGAAVGNPADVAMVRMQADGRLPLAERRNYRSVGDAIGRMARDEGVRSLWRGSSLTVNRAMIVTASQLATYDQAKEAILARRGPGADGLATHVAASFTAGLVAAAASNPVDVVKTRMMNMKVAPGAPPPYAGAVDCALKTVRSEGPMALYKGFIPTVMRQGPFTVVLFVTLEQVRKVFKGVEF

SEQ ID NO: 32885 - DNA, 675 bp, Panicum virgatum
  misc_feature: Ceres CLONE 1913205
  misc_feature: Encodes the peptide sequence at SEQ ID NO. 32886
gctcggctcctgctccctctggaaacccaaggtttcctctgcggcggagataaataagatcgacggaggataaaaaaagggttcttgaagcgattgcggcggcggaatagaagggaggccgcggccggcggcgaactcgcctgcgtgttcccggcgatgaagtacgtctccgggccgtacttcgagccggacttcgatccgctcctcgaccgcttcggcacgcccggggtcgtcgtcgacaacgagacacgcgaggactgcacgctcgtcaaggttgacagcgtgaaccgggacggcgtgctgctcgagatggtgcagctgctcaccgatctcgacctcgtcatctccaagtcctacatctcctcagacggcggctggctcatggatgtgttccacgtcacggaccagatcgggcgcaagctgacggacccgtcgctccccgagttcatccagcgggcgctcgtgccgttccaccgggccggcagcggcccgtcgccccggttcacgacgtgcctcggcaacgtggtcggccctggcggccccgacgtgtcgaactgcgccgccctcgagttcacggtgcacgaccgcccggggctcctgtcggccatcacctccgtgctggtggacaacgggtgccacgtcgagtcggggcaggcgtggacgcacaacgggcgc

SEQ ID NO: 32886 - protein, 172 aa, Panicum virgatum
  misc_feature: Ceres CLONE 1913205
  misc_feature: SWISSPROT Homolog: EC 2.7.7.59 [Protein-PII] uridylyltransferase
MKYVSGPYFEPDFDPLLDRFGTPGVVVDNETREDCTLVKVDSVNRDGVLLEMVQLLTDLDLVISKSYISSDGGWLMDVFHVTDQIGRKLTDPSLPEFIQRALVPFHRAGSGPSPRFTTCLGNVVGPGGPDVSNCAALEFTVHDRPGLLSAITSVLVDNGCHVESGQAWTHNG

SEQ ID NO: 32887 - DNA, 745 bp, Panicum virgatum
  misc_feature: Ceres CLONE 1913214
  misc_feature: Encodes the peptide sequence at SEQ ID NO. 32888
tttttgcccaagcacggccggctgccggtggccaccgccaaggactttatgcggcagctcgcggaagggctgaagatgctgaggcagaggaacatcgtccatagggacctcaagccacagaaccttctcctatcaaccaatggtgatgccattatattgaaaatcggcgactttgggtttgccaagcatgaaaatttagctgccacaatatgtggttcaccatattatatggccccagaaatttggcaagggaaggactatgatgcaaagtcagacttgtggagtgttggggtcattctttttcagctagtcactgggaagttgccatatggtgggattacctgtttccagctgcaccaaaacatcctggcttctgatgaacttaacttcccttcagaaattgatatatgtcctgattgcattgacttgtgcagaagactcttgcactgtgatccaaggaagagaataagttttgacgaattcttcaatcataagtttttggcaacaagtaaatgtgagcctatccatgagtcccatcatgctgttgatttaagggatacatgccagaaaatcacctcttctgttgtcctaaaaatgaaacctgaaagcctggaatcaaaaaaatcgaaagtgtttgattcatgggagtggatcgaacgagaatatgtgctcgttcccggtaactgtacttccatggattcactcgagaagttgacaaaggatgatacaggtatacgaaattccc

SEQ ID NO: 32888 - protein, 248 aa, Panicum virgatum
  misc_feature: Ceres CLONE 1913214
  misc_feature (1)..(167): Pfam Name: Pkinase Pfam Description: Protein kinase domain
  misc_feature: SWISSPROT Homolog: EC 2.7.11.1 Non-specific serine/threonine protein kinase
FLPKHGRLPVATAKDFMRQLAEGLKMLRQRNIVHRDLKPQNLLLSTNGDAIILKIGDFGFAKHENLAATICGSPYYMAPEIWQGKDYDAKSDLWSVGVILFQLVTGKLPYGGITCFQLHQNILASDELNFPSEIDICPDCIDLCRRLLHCDPRKRISFDEFFNHKFLATSKCEPIHESHHAVDLRDTCQKITSSVVLKMKPESLESKKSKVFDSWEWIEREYVLVPGNCTSMDSLEKLTKDDTGIRNS

SEQ ID NO: 32889 - DNA, 685 bp, Panicum virgatum
  misc_feature: Ceres CLONE 1913218
  misc_feature: Encodes the peptide sequence at SEQ ID NO. 32890
cacacaagacacaaccacgcgctcgcgccatggacgcagttgtcgtgccgctcctcctcctcctcctggccgtcgccgtccttctccgtctgcgcctccggcggcgccgtgcgtctgcggcaagcgcggggcgccgcaaccactgcccctacccgaaccccgtcctcggcaaccttgtgcccctcatccgcaacttccaccgcttcctcgactgggccaccgacctcctcgccgccgccccagcatccaccatcgaggtgtgcggcgcgctcggcctcgccaacggcgtcgccaccgcggacccgggagtcgtcgaccacttcctgcgcgccaatttccccaactacgtcaagggcgcgcgctacgcggtccccttcgccgacctcctcggccgaggactcttcctcgccgacggccgcctctggagcctccagcgcaagctcgcctcctactccttcacatcccgctcgctgcgccacttctcggggcgcgtgctccgggcccatctgcaccgccggcttctgcctttcctcacggccgccgcggactccggcgagcccgttgacctgctggacgcgctcaagcgcttcaccttcgacagcatctgcagagtcgcgttcggggtcgagagctcgacgctgctcgaggccgcgggggatggacaccggcacgaggcgttcttcag

SEQ ID NO: 32890 - protein, 218 aa, Panicum virgatum
  misc_feature: Ceres CLONE 1913218
  misc_feature: SWISSPROT Homolog: EC 1.14.13.98 Cholesterol 24-hydroxylase
MDAVVVPLLLLLLAVAVLLRLRLRRRRASAASAGRRNHCPYPNPVLGNLVPLIRNFHRFLDWATDLLAAAPASTIEVCGALGLANGVATADPGVVDHFLRANFPNYVKGARYAVPFADLLGRGLFLADGRLWSLQRKLASYSFTSRSLRHFSGRVLRAHLHRRLLPFLTAAADSGEPVDLLDALKRFTFDSICRVAFGVESSTLLEAAGDGHRHEAFF

SEQ ID NO: 32891 - DNA, 644 bp, Panicum virgatum
  misc_feature: Ceres CLONE 1913221
  misc_feature: Encodes the peptide sequence at SEQ ID NO. 32892
accctttcttcttctcctccagcccgtcctgcaagaaacacagctgtgccatggacgccgctgccgccgccgccgccgccacggccgccggcgacgtggtgcaggaccaggcgcggatggacggcatcgccgacagcctacaaacccgagacgcgatgcggctgtacaactggctcacgcagcgttgcttctccgactgcgtcgtctccttctaccgccgggcgctcggcaagcgcgaggaggagtgcgtccgctcctgcgtccgcaagtaccagctcttatccaccgcgtccgccgcgcgcttcgcccacttcgccgaccccaacaactcctctccggcagcattcgacgattgattcaccgctgctcttgcccgtctacgcctctgtacgatcccagttcgttgtcctcttcttgtctgccggcccgctactttgtttgcttcagttcttcagtctagcttagcttttgctttgtgatctcaaggaaactgaaacacgacggcataatacgagagtagcatttactattgttgacgccgaaattttcattaggaattggaaggccaagaccaagagtgactgatttgtaccacacaaaaaaagtttggaattttgatgaatgaatcgatggatggattcttc

SEQ ID NO: 32892 - protein, 101 aa, Panicum virgatum
  misc_feature: Ceres CLONE 1913221
  misc_feature (23)..(84): Pfam Name: zf-Tim10_DDP Pfam Description: Tim10/DDP family zinc finger
MDAAAAAAAATAAGDVVQDQARMDGIADSLQTRDAMRLYNWLTQRCFSDCVVSFYRRALGKREEECVRSCVRKYQLLSTASAARFAHFADPNNSSPAAFDD

SEQ ID NO: 32893 - DNA, 624 bp, Panicum virgatum
  misc_feature: Ceres CLONE 1913223
  misc_feature: Encodes the peptide sequence at SEQ ID NO. 32894
acgcatcggtcgcgggccgtcctcctgctccgtcctcctccgccgccgccgtctcggaagggaaggatccgtccctccgaccgggcttcggttggtctcgccctcgccggggtgagaggtgaccggacggcggtatgaggcagtggttatgttgtgactgccaagttgaagaccaggaacatggccgtggccaggagctttccaaagttcagagcaataagatagaccccaagcagaagtcttctaagcctcctgttaggcgacctgagccagagatttcccctcctaccattgatgtccctgacttatcattggatgacttgaaagaaaatactgataattttggatccactgctctgattggtgaaggatcttatggacgattatatcatgcctctttggatgatgggaggcaagcatctgttaaaaaacttgatgcatctgaaaatgaacctaatgatgagttcttgaaacatgtctcactggtctcacagctaaaacatgataatcttgttgagatgttgggttactgtgtggagggaaattaccgtatactaccatatggatttgctaccatgggttctcttcatgatgttttgcatggaacaataggcgtccagagtg

SEQ ID NO: 32894 - protein, 163 aa, Panicum virgatum
  misc_feature: Ceres CLONE 1913223
  misc_feature: SWISSPROT Homolog: EC 2.7.11.1 Non-specific serine/threonine protein kinase
MRQWLCCDCQVEDQEHGRGQELSKVQSNKIDPKQKSSKPPVRRPEPEISPPTIDVPDLSLDDLKENTDNFGSTALIGEGSYGRLYHASLDDGRQASVKKLDASENEPNDEFLKHVSLVSQLKHDNLVEMLGYCVEGNYRILPYGFATMGSLHDVLHGTIGVQS

SEQ ID NO: 32895 - DNA, 721 bp, Panicum virgatum
  misc_feature: Ceres CLONE 1913229
  misc_feature: Encodes the peptide sequence at SEQ ID NO. 32896
  misc_feature (610)..(610): n is a, c, t, g, unknown, or other
atccggagctcaccgtcacagagaacacccacagtcaccggagaccggacggagaccatgccggagacccacccgccgccgccgaggccggtgatgctcgccgacctcaacttcgagccggcggagagcgacggcgaggatcgcccgccgacccccagacccaaccccgccgccgccatagccgtgcccgttgcccctgctccggcggtcgccgccgactcctccacgaggagtggcaatgaagagggtggtttggcaaaaaatgtgactgcaacgaaggattctgatactgttgaatgtgaagatgcagatcaacactgccaaggggcttctgctccacgtgaggagaaagttagcaacctgaaagctgctttgtttcatgtggcccggaaaatgcctaagaatgctcatgcccattttatgctggggttgatgtatcaaaggcttggtcaggcacagaaggcaatagcatcatatgaaaaatcgactgaaatattgttacaagatgaagaaggagtgcggaggcctgatttactctcatcagtgaggatacaccatgcacagtgcattttgcaagcaagcatgggcgatagttttgatgaagagcttngaactagtgaggtagatgagatcctcgtttagttgaagagttcagttgagtcagatcacaggcaagcagctgtttgggatatcctaggtttagttcttcttcgaggtggtc

SEQ ID NO: 32896 - protein, 194 aa, Panicum virgatum
  misc_feature: Ceres CLONE 1913229
  misc_feature (117)..(150): Pfam Name: TPR_2 Pfam Description: Tetratricopeptide repeat
  misc_feature (185)..(185): Xaa is any aa, unknown, or other
MPETHPPPPRPVMLADLNFEPAESDGEDRPPTPRPNPAAAIAVPVAPAPAVAADSSTRSGNEEGGLAKNVTATKDSDTVECEDADQHCQGASAPREEKVSNLKAALFHVARKMPKNAHAHFMLGLMYQRLGQAQKAIASYEKSTEILLQDEEGVRRPDLLSSVRIHHAQCILQASMGDSFDEELXTSEVDEILV

SEQ ID NO: 32897 - DNA, 2274 bp, Panicum virgatum
  misc_feature: Ceres CLONE 1913234
  misc_feature: Encodes the peptide sequence at SEQ ID NO. 32898
agccgacacagcgagtagacgggacggcacagttccggccaaggcgttgctccgacggccgccgcggcgggcggaagcaccgacgagcgccagccgcctgcctccccccttcccgcggcgggcctggaaggaagggagtccccgagaaggagttgtggggagtgtccggtggaggaagcggggggaagggatggtctgggcgctgacccccgtcgacacagtgcgcgggacgcagaagtattacatcttcgccgccgggacgtacaaggtcggccgcaaagattgtgatgtcgttgttcaagctgacacatctatatcccgagtccatgcggggattgcaattgaaaagatggttgcctgggatccgcattctggtgcacctgccagtccatcctatgttcgtgtagtcgaccgatcgaagtatggcacatttgtcaacaaagtacatggaacccagggcagtcgtctacataaagatgaagatgtaatgcttactgatggggatactgtgacttttggaactgggaatgcaaccttcaggttgtcatttgtccccatagtggccttttttcatggcagaaagtcggcgcgaattgatccatcgttgcatgcagtcatgacatctattggtgcatacgctactcgtaagtggagtgatgaatgtacacatgttcttgctgatgaatcatgttcattgacaccagagctccttgatgcagttatgggaaagaagcagattgtattgggagagtggtttaaggcaatggctgaaaagaacatacacatagaaatcccttcttgtacacaatacattccaaatttgactcttgatgggacagtaatcaagatggtggagatcaacctcattcagaattgtctagcaggctatacttttatcctagggccatcagataagtatcaatttggtgagaaactccatggattactggaagcaactggagcaaaatatctccacattgacgaattttgtgcaaacagccaggactcagtagctggagatactgatcaacaaattcttgtggttcctgcaagatatcctttagagtttagtaagatacatgggctatttccgttgtcgaagatcagtgatgttaagctatttgctgctatattgtctggccgcttggaagcaactgctattgaaccacctgctttcattgttacatcatcgaattcgacggatgaaactattgtggcggattctgatgttgaaatggagaccgcaacttctaatcctagtggtgctgcctacaagtctcaaaatcgcattgagaacatctctgctgatgaaaaggaaaacacaaatataaccaatgaagttgctgtaactgtcagtagaacaaaggctaatgttattcaaccaaatgacacttcgaaagctgaagcttcgaaacctatggaggatgatgttaaggtcaaagacaaaacagcagtatatagatccaaagctagagatgaggatgttcgtgttataatcaaggtgcctaaggatgagaatttggacatcagcagggatggggcttgtgatataatatttagtcaggatctggttgtcaaaagaccccatcggtcagctcctgctgcatcaactgaaggtggtgttaacttcaagcgctttagaaagagggaaacagtgtcgggaaacagcttcaaggaccttgttccatttgcacgagatccatacagagaatctgactatgatgggagcacaatgactgatttcatgcgtgaggagaaacagcggaaacaaatggaagccattgcagaggacctcttcaacaatgcaaagatgagagcctgcaggagaagattaccagtatatgtatatgtgctccgcctgacttttcgttcagaggtgggaggcctagataactgcaagcgcaattgctcatttcctaagcagatgacagttatcctgttgcaccttcggttctccagttccgttgaaggtttctggaagtgtgagaagcccgctccaggactccttttttaccactgcgggagagaccagcttagtgctgtaagcataggaaggttgtgttagatatgaattgtaacctgagggcacgttcgctgctattggcaagggctattagaaatgggtcatgttgtctctgaggcttagtttcctgctgtgattttgacatcacatgttggatacgtcatgcgtctggcatagtcgtccagaattttaccaattctcagttcagtttttgtttgatcacatggaagaactttggtcggatttcgcat

SEQ ID NO: 32898 - protein, 624 aa, Panicum virgatum
  misc_feature: Ceres CLONE 1913234
  misc_feature (25)..(110): Pfam Name: FHA Pfam Description: FHA domain
MVWALTPVDTVRGTQKYYIFAAGTYKVGRKDCDVVVQADTSISRVHAGIAIEKMVAWDPHSGAPASPSYVRVVDRSKYGTFVNKVHGTQGSRLHKDEDVMLTDGDTVTFGTGNATFRLSFVPIVAFFHGRKSARIDPSLHAVMTSIGAYATRKWSDECTHVLADESCSLTPELLDAVMGKKQIVLGEWFKAMAEKNIHIEIPSCTQYIPNLTLDGTVIKMVEINLIQNCLAGYTFILGPSDKYQFGEKLHGLLEATGAKYLHIDEFCANSQDSVAGDTDQQILVVPARYPLEFSKIHGLFPLSKISDVKLFAAILSGRLEATAIEPPAFIVTSSNSTDETIVADSDVEMETATSNPSGAAYKSQNRIENISADEKENTNITNEVAVTVSRTKANVIQPNDTSKAEASKPMEDDVKVKDKTAVYRSKARDEDVRVIIKVPKDENLDISRDGACDIIFSQDLVVKRPHRSAPAASTEGGVNFKRFRKRETVSGNSFKDLVPFARDPYRESDYDGSTMTDFMREEKQRKQMEAIAEDLFNNAKMRACRRRLPVYVYVLRLTFRSEVGGLDNCKRNCSFPKQMTVILLHLRFSSSVEGFWKCEKPAPGLLFYHCGRDQLSAVSIGRLC

SEQ ID NO: 32899 - DNA, 618 bp, Panicum virgatum
  misc_feature: Ceres CLONE 1913242
  misc_feature: Encodes the peptide sequence at SEQ ID NO. 32900
acttgtccatcattccctcctgcgcccgaccgcgcacctgcaacccctgaccggtcaggaacgggcagagccgtcgacgagcagatggtcctgctgcgcctcccctcccccgccgtgcgcggcccagccccgcccaccatctccgcgagcgcgtgcccgccgaaccatctggagggcggccttcaccgaccacatcttcatcgtcgcagcctaccggacggccatttacaacggcaagagaaggggtttcaaggatacgttgcctgaggacctattggttcctgtcttcccggctttaacatataaaactaagctgaagcctaccaaacttggcgacctcgttgttagtactgtcttagctcctgcgtcccagacggcaatccaatgcagaatggccgtcctgtatgctggtattcctgacactgttcctctgaacactgtgaaccggcaacgctcttctggccttcatgcacttgtagacgttgctgctgctattaaagcagggctgtatgatattggtattgctgctggctctccattccacgacactgaacaaagttagtcttgaccgtcaagtgaatcccaaagttgagctattttctcctgctcgtaattgtc

SEQ ID NO: 32900 - protein, 186 aa, Panicum virgatum
  misc_feature: Ceres CLONE 1913242
  misc_feature (62)..(185): Pfam Name: Thiolase_N Pfam Description: Thiolase, N-terminal domain
  misc_feature: SWISSPROT Homolog: EC 2.3.1.16 Acetyl-CoA C-acyltransferase
LVHHSLLRPTAHLQPLTGQERAEPSTSRWSCCASPPPPCAAQPRPPSPRARARRTIWRAAFTDHIFIVAAYRTAIYNGKRRGFKDTLPEDLLVPVFPALTYKTKLKPTKLGDLVVSTVLAPASQTAIQCRMAVLYAGIPDTVPLNTVNRQRSSGLHALVDVAAAIKAGLYDIGIAAGSPFHDTEQS

SEQ ID NO: 32901 - DNA, 644 bp, Panicum virgatum
  misc_feature: Ceres CLONE 1913249
  misc_feature: Encodes the peptide sequence at SEQ ID NO. 32902
tatcctcatacctaaaaaaatgaaagtgcggcttcctaaccttttgagtggccttcacggtaaatctcagatggtgcaagatgaactaacaagactcgaagagtctatgggacagagtcccgaaggaaccacggcagttgctttggagctgtgccgggaatttgaagataaatttcttgctcatataacatctggtgagggatctggttggaaaattgttgcaagtattgaaggcaaggttccacatataattaaacctctaccattggacatgcattttaatctcaacaatgtccaaaggattgacttggaagccgatggttatcaaccatatttgatatctccagataaaggactgatatccttaataaaaatagtactggaaatggcaaaggacccatcactactatgtgttgaagaggttcatcatgtattgttagatataaccaatgcttccaaccatgccacaccaagacttgcaatatatcctccattctagcgcgaggttgatgctaaaacatctgatgcactcgagagcttcaaaaatgactccaataagatggatgtagcacttgttgatctggagcctgcctgtgatcctcctctccatgatatccgcttagtacaaacaagaatggaaaggc

SEQ ID NO: 32902 - protein, 165 aa, Panicum virgatum
  misc_feature: Ceres CLONE 1913249
  misc_feature: SWISSPROT Homolog: EC 3.6.5.5 Dynamin GTPase
ILIPKKMKVRLPNLLSGLHGKSQMVQDELTRLEESMGQSPEGTTAVALELCREFEDKFLAHITSGEGSGWKIVASIEGKVPHIIKPLPLDMHFNLNNVQRIDLEADGYQPYLISPDKGLISLIKIVLEMAKDPSLLCVEEVHHVLLDITNASNHATPRLAIYPPF

SEQ ID NO: 32903 - DNA, 717 bp, Panicum virgatum
  misc_feature: Ceres CLONE 1913250
  misc_feature: Encodes the peptide sequence at SEQ ID NO. 32904
gaccaaaacccccaaacccctcgactcgactcacccgaccccaccccaaccgagccgccaggcccaagccctcccatggcggcgccaaccccgaccaccgccgccgccaccacccaccaccgcatcctcctcccgtccccgtccccgcgcggcgccctcgcgccaggcttcctccgcctgccccaccgcgcgcaggcccacgcccacgcccagcgcgcgcgcctccccgcgcccctcgcggcggcggcgcccgcggcctccaccgcgtcccccgaggcgccggcctcgggggccgtcccggggaagcccacggtgctcgtcgccgagaagctcggcgccgcggggctcgcgctgctgcgcgagttcgccaacgtcgactgctcctacggcctctcccccgaggagctccgcgccaagatctcgctctgcgacgcgctcatcgtcaggtccgggaccaaggtcggccgcgacgtcttcgaggcctccgggggcaggctccgcgtcgtgggccgcgcgggggtcgggatcgacaacgtcgacctcgccgccgccaccgagcacggctgcctcgtcgtcaacgcgcccaccgccaacaccgtcgccgccgcggagcatggcatcgcgctgctcaccgccatggcgaggaacatcgcgcaggccgacgcgtccctcaaggctgataaatggctgcgcaacaagtatgttggggtatctctt

SEQ ID NO: 32904 - protein, 213 aa, Panicum virgatum
  misc_feature: Ceres CLONE 1913250
  misc_feature (80)..(212): Pfam Name: 2-Hacid_dh Pfam Description: D-isomer specific 2-hydroxyacid dehydrogenase, catalytic domain
  misc_feature: SWISSPROT Homolog: EC 1.1.1.95 Phosphoglycerate dehydrogenase
MAAPTPTTAAATTHHRILLPSPSPRGALAPGFLRLPHRAQAHAHAQRARLPAPLAAAAPAASTASPEAPASGAVPGKPTVLVAEKLGAAGLALLREFANVDCSYGLSPEELRAKISLCDALIVRSGTKVGRDVFEASGGRLRVVGRAGVGIDNVDLAAATEHGCLVVNAPTANTVAAAEHGIALLTAMARNIAQADASLKADKWLRNKYVGVS

SEQ ID NO: 32905 - DNA, 667 bp, Panicum virgatum
  misc_feature: Ceres CLONE 1913252
  misc_feature: Encodes the peptide sequence at SEQ ID NO. 32906
attagctcgtttggtctttgaggaggacttcatacgtgggcagcatgaagacgatcagcttcccctcgaggtcaaaacgtgcccttcatctcatgctgcctctggctctcctctgcttcttctcaggcgcgccgcggggtgtcgactccgcccgagtcttcggcatcgtcaacctgtgcgaggagacgatctggccggccgtgacgcccgccagcgagagcttcggcagcggcggcggcttcgcgctccggccggggcagtccgtggcgttcacggcgccggcggggggctggtcgggccgcgtgtgggcccgcacgggctgccgcttcgacgcgtccgggaacgggtcgtgcgcgacgggcgcgtgcggggcggcgctccggtgcggcggcgcgtcgggcgagccgccggccagcctcgccgagttcacgctctcgccggcgcgggacttctacgacgtcagcctggtggacgggttcaacctgccggtggcggtgcggccggtgaacgggcggggcaactgcaccgccgcgggctgcgacggcgacctgcgccggacctgcccgccggagctggccgtgcgggcgggcggccggacggtggcgtgccggagcgcgtgcgacgtgttcgacacggaccgctactgctgccgcggccaggtcggggg

SEQ ID NO: 32906 - protein, 207 aa, Panicum virgatum
  misc_feature: Ceres CLONE 1913252
  misc_feature (43)..(207): Pfam Name: Thaumatin Pfam Description: Thaumatin family
MKTISFPSRSKRALHLMLPLALLCFFSGAPRGVDSARVFGIVNLCEETIWPAVTPASESFGSGGGFALRPGQSVAFTAPAGGWSGRVWARTGCRFDASGNGSCATGACGAALRCGGASGEPPASLAEFTLSPARDFYDVSLVDGFNLPVAVRPVNGRGNCTAAGCDGDLRRTCPPELAVRAGGRTVACRSACDVFDTDRYCCRGQVG

SEQ ID NO: 32907 - DNA, 676 bp, Panicum virgatum
  misc_feature: Ceres CLONE 1913277
  misc_feature: Encodes the peptide sequence at SEQ ID NO. 32908
acctccgtccgggcactccccttcttcccggtcgctaccaactgcccggcgctgcggctgcgcaagcgcaattcccccccaaatccagcgtagccaatcctcagcttctctctcgcgtccgccgcgccccgctccgcgatggccgagcagcgcccgcccgccgggatcgacccgcgcagcggcttctgcgccgcgacgcggaccttccacagcctgcgccagttcgccacgctcccgccggactcgctcccggccaccgccgccgcctacgccttctccctcctcacctcaccgctccccgaccgccccgccctcgtcgacgccgccaacggcattgccgtctcctacccctccttcctcgccgccgtccgctccctcgcgggggggctctggtccgccctcggcgtccgcccgggcgacgttgcgctcgtcgtctccccgtcccgcctcgagatccccgtgctggacttcgcgctcatgtccatcggcgccgccgtctcgcccgtgaacccggcgtccaccgccgaggagttcgcgcacatggtcgcgctctccaggccggccgtcgcgtttgcggtccccgaggtggctgccaagctgccgaggagcctcaggtgcgttgtcatcaggtcggacgagtatgcgaggctgtcgtccgcgggcggtgcgtcgccgc

SEQ ID NO: 32908 - protein, 179 aa, Panicum virgatum
  misc_feature: Ceres CLONE 1913277
  misc_feature: SWISSPROT Homolog: EC 6.2.1.12 4-coumarate--CoA ligase
MAEQRPPAGIDPRSGFCAATRTFHSLRQFATLPPDSLPATAAAYAFSLLTSPLPDRPALVDAANGIAVSYPSFLAAVRSLAGGLWSALGVRPGDVALVVSPSRLEIPVLDFALMSIGAAVSPVNPASTAEEFAHMVALSRPAVAFAVPEVAAKLPRSLRCVVIRSDEYARLSSAGGASP

SEQ ID NO: 32909 - DNA, 1620 bp, Panicum virgatum
  misc_feature: Ceres CLONE 1913278
  misc_feature: Encodes the peptide sequence at SEQ ID NO. 32910
acacagttcacagttcacaccctcgccacgcgcgctcacgtcacccgcaaccgcagcaaacgaaccgaggccaaattccccaatcccccgcctcctcctgcccccgcgaaccctaaccctaccgcgcccgccatggacgaggacgccggcgacgcctcgccgccgcccgcgccccctcccccgcccccggcgcacgcgcacgcgccccctccttccgcgcagccccccaccgccgcggccgccccgcagcgggacgtgtcggcgtccccgaccagctcgcgctccgtgacggagaccgtcaacggctcccaccggttcgtgatccagggctactcgctcgccaagggcatgggcgtgggcaagcacatcgccagcgagaccttttccgtcggcgggttccagtgggcggtctacttctaccccgacgggaagaaccccgaggacaactccgcctacgtctccgtcttcatcgccctcgcctccgagggcaccgacgtccgcgcgctcttcgagctcacgctcctcgaccagagcggcaagggcaagcacaaggtccactcccacttcgaccgctccctcgagtccgggccgtacaccctcaagtaccgcggatccatgtggggttacaaacggttctttaggcgaactgccctcgagacttcagactttcttaaagatgattgcctgaagataaattgcactgtgggtgttgttgtatcaactattgattactccagaccacactctatacaggttccagactcagacatcggctaccattttggttcactgttggacaatcaggagggtgtggatgtcattcttaatatgggaggagagaggtttcatgcccataagttggtgctggctgcacgctctcatgtattcagatctcaattttttgatgacgaatctgagggagagaagaacgaggttgatgaaagtgatgaactgagagagttttctattgatgacatggagccaaaggttttcaaggcgatgcttcatttcatctatagagatacccttgttgatgataatgagttgggcgcatcaagctctgatggttctgtctttgattctctggcagcaaaattgttggctgcagcagacaagtatgacttaggaaggctaagattgctatgcgagtcttacctgtgcaagggtatatcagtggcctcagttgcgagtacactagcattggctgatcgtcaccatgctatggagcttaaagctgtttgcctaaaatttgctgctgaaaatctttcagctgtaatccggactgaggggttcctttacctcagggacaactgcccatctctgaagtcagagatactgaaaactgttgcggggtgcgaggagcagtgcagcagtggtgggaagagccagagcgtctgtgcgcagctctcggacggcggtgccaccagtggacgcagggttagaccaagaatctgaggccaacccacaactctgacatggttagccagctctcgctctgtaaatggcgatgtcaattcgtcctgtatgtgaagaaaaacaattttaaatagctgtatctcaacatgcttcttacatcttaactggcgttttgtttgtaattagttgatgtgtttggtcccg

SEQ ID NO: 32910 - protein, 440 aa, Panicum virgatum
  misc_feature: Ceres CLONE 1913278
  misc_feature (217)..(346): Pfam Name: BTB Pfam Description: BTB/POZ domain
  misc_feature: Useful for making plants with modulated biomass
MDEDAGDASPPPAPPPPPPAHAHAPPPSAQPPTAAAAPQRDVSASPTSSRSVTETVNGSHRFVIQGYSLAKGMGVGKHIASETFSVGGFQWAVYFYPDGKNPEDNSAYVSVFIALASEGTDVRALFELTLLDQSGKGKHKVHSHFDRSLESGPYTLKYRGSMWGYKRFFRRTALETSDFLKDDCLKINCTVGVVVSTIDYSRPHSIQVPDSDIGYHFGSLLDNQEGVDVILNMGGERFHAHKLVLAARSHVFRSQFFDDESEGEKNEVDESDELREFSIDDMEPKVFKAMLHFIYRDTLVDDNELGASSSDGSVFDSLAAKLLAAADKYDLGRLRLLCESYLCKGISVASVASTLALADRHHAMELKAVCLKFAAENLSAVIRTEGFLYLRDNCPSLKSEILKTVAGCEEQCSSGGKSQSVCAQLSDGGATSGRRVRPRI

SEQ ID NO: 32911 - DNA, 1472 bp, Panicum virgatum
  misc_feature: Ceres CLONE 1913279
  misc_feature: Encodes the peptide sequence at SEQ ID NO. 32912
ggcgtgacccgtgatcgaatactccctcctcacaaaaactctcgtagaccagccaagcagaccagctcagcgcctcccaaatccacacggacccgtcacccgtgccgtgcgcggccgccggaggaaggagacgcgaagcctcgcccgccgcgcgtctcgtcacaaccgctcgcgaggcggcggccgcggtagcttcgccgctttcccacacctggtctggtctccgccgccgccgttgccacagccgctgagagcgtcctgcacaaataccccgaacagcggttgcctcttcttcgtactccttcgacgattcaacgcgggatccactagaccgaccgggagcagagccatggggggaagcccatcgaagagcagcccgcgggacgggagcggccacgggcgtggctacggccactcgcgctcctttggccagccggcggggccgccgccgcctcagtatggaggctactacggccaggacccgagcgcggcctactacgccgcgccgcagcagggaggagggtacgccgcaccgtacccggccccggcgtaccagcctcccgccgctgccccgccgccgccggccgccaagccgcggcagctggaccgccggtactcgcggattgccgacgattaccactcggtggatcaggttactgatgccctagctcaagctgggcttgaatcgtcgaatcttattgtcggcattgatttcacaaagagcaatgagtggacagggaaattctccttccatggacgtagtttacatcacattagcagcacaccaaatccttatgaacaagccatctcgatcataggacagacaatgtcaaaatttgatgaagacaatttgatcccatgctttggattcggaaatgcgtcaacacatgatcaagatgtcttctgtttttatcctgatgagagaccttgcaatggtttctcagaagctctgcatcgatatagggaaattgtaccacatttgcgcttagctggaccaacatcctttgcaccaattattgagatggctatgaccattgtggagcaaagtggtggccaataccatgttctattgataattgccgatgggcaggttacacggagtgtagatactgcatctggacagctaagttcgcaagagcagaagactgttgatgccattgtgaaggccagtgaactgcctttgtccatcgtgttagtaggagttggtgatggcccctgggacatgatgaaggaatttgatgacaatattcctgctcgagcttttgacaatttccaatttgtgaatttctcggagataatgtccaagaacatgccacaatcaaggaaagaggctgcatttgctctttctgcattgatggagataccacaacagtataaagcaaccgtggaattaggaattttaggtcgtcgctctttcaagtctcctgacagggttcctctgccgcctcctgctggaattgatgatgcttatt

SEQ ID NO: 32912 - protein, 374 aa, Panicum virgatum
  misc_feature: Ceres CLONE 1913279
  misc_feature (138)..(286): Pfam Name: Copine Pfam Description: Copine
MGGSPSKSSPRDGSGHGRGYGHSRSFGQPAGPPPPQYGGYYGQDPSAAYYAAPQQGGGYAAPYPAPAYQPPAAAPPPPAAKPRQLDRRYSRIADDYHSVDQVTDALAQAGLESSNLIVGIDFTKSNEWTGKFSFHGRSLHHISSTPNPYEQAISIIGQTMSKFDEDNLIPCFGFGNASTHDQDVFCFYPDERPCNGFSEALHRYREIVPHLRLAGPTSFAPIIEMAMTIVEQSGGQYHVLLIIADGQVTRSVDTASGQLSSQEQKTVDAIVKASELPLSIVLVGVGDGPWDMMKEFDDNIPARAFDNFQFVNFSEIMSKNMPQSRKEAAFALSALMEIPQQYKATVELGILGRRSFKSPDRVPLPPPAGIDDAY

SEQ ID NO: 32913 - DNA, 769 bp, Panicum virgatum
  misc_feature: Ceres CLONE 1913279-R
actacgaaaatccacatagcgccaccccagctgcacctacgtccacttacgacaaccaggtctgccctatctgccttgtgaaccccaaagacatggcatttggctgtggacaccagacctgctgtgactgtggacagagtctcgagtcgtgcccgatctgtcgcactcccatcaccacaaggataaagctatactagcaagtggtggtttggatcattgcaatgcaaaatgggtggtatactggagccaccctgcgtcacgctgagaccgggacagcaagacccatttgcaatccgtccagtgaggccccccaccaattcaggccgaggactgcagggccgctgatccagcgctccaagatggagcagggttgtcccagtattgatacccaccaggaatgatccgaacacagtgcaataggcagtgggtttcagaatttatcaagggatatttccaaagcaatgggaaaacacaaaagagaagaaagaggaaatttgcaaaaaagagttggtgtgttttgctagtgcgtgttgggcaatggcactcaactgtgtggttgctcaaccgacgacttgtacttgtagatatggatattcattcgtttctggtcttctgacctcagcatttaggggattctttgtgccagttttttttttgttcgtccgaaatttgttaatttgatttgatgcatgttgtaaaaacctgattgctgtgctgcaacagatcgagagtttgatgctgacatgctcgtcagttggccttttcttgc

SEQ ID NO: 32914 - DNA, 675 bp, Panicum virgatum
  misc_feature: Ceres CLONE 1913280
  misc_feature: Encodes the peptide sequence at SEQ ID NO. 32915
acgctccgtgaccgtgaccaccacggcgtccggatcggatcgggatcggaggaggatctcaatctcactcgccgtgtttcctgctgctcgctgcatttctcacaggttcgagagctgagttgggaggaggactgcagccgcaggcagcatgaaggcgctcattctcgtcggaggcttcggcacccgcctgcggccgctgacgctcagtgtgcccaagccgctcgtcgacttcggcaacaagcccatgatcctgcatcaggtcagcatgaatgcgccgtctctcagatcattttaagtcattaggaaatggtgccaagagaagtcgatttcggcaacaaccccgcgattgaccagcctgagctgttataagctttaaatacagtttttaatcgcctccgtccgtatcatgattgggtggattggatccatgtgagtgaattcctcacggaaatactgaaatagtcgtccacctatatcactgttcgtcgtggcaaataattggtgaagaacaatgatggcttttgatcttttgaagtaaccaaaaagcaagcaaacaaaatcactttcaggcctactgttgctgaattgatacggtatttggttgaatttactggatgctgtgatacacagatcgaagctctgaaggaagtaggggtcacagaggtcgtcctggcc

SEQ ID NO: 32915 - protein, 48 aa, Panicum virgatum
  misc_feature: Ceres CLONE 1913280
  misc_feature: SWISSPROT Homolog: EC 2.7.7.13 Mannose-1-phosphate guanylyltransferase
MKALILVGGFGTRLRPLTLSVPKPLVDFGNKPMILHQVSMNAPSLRSF

SEQ ID NO: 32916 - DNA, 2029 bp, Panicum virgatum
  misc_feature: Ceres CLONE 1913282
  misc_feature: Encodes the peptide sequence at SEQ ID NO. 32917
acctccagctccgtcttcaactcggcggccacctcacctcgcgtggcttcctcccgtcccgagtccctcggcctcaacgactagttgagcgctccgccgccgccgccgccgccgccgccgccggggctctgacgaggggaggaggctcatgacgcaactgtagcctacgttgcagcagccgccgcgggcgctcgggaggggccgcgggcgggagcctgtggttctggacgccccgccgcggcgagatccgagggcgctgcggctgctgtacggggggtttgaggtctcgttgcagctgccgctgctgtgaggtgaggaggagggggcggacatggcggggtccaggttcgggtcgttcaagtcggagaagggcgactcggccgcctccgctgcggcggcggcggccgcgggtggagcggcgcagaggagggacccgtacgaggtgctcggggtgggccgcagcgccaccgaccaggagatcaagagcgccttccgacgcatggcgctcaagtaccatccggacaagaatggggatgaccctgtcgcatctgataggttccaagaagtcacattctcctacaacatcctgtcagatcctgataagaggcgacagtacgatacatcagggtttgaggcaattgaaaacgatagtcaggagttggagctggacttatcgagtctcaatactgtaaacactgtgtttgcagctctttttaataagcttggtgtgccaattaaaacaactgtttcagcaacagttttggaggaggcattgaatggctctgttatggtttctcagctccagctaggaaactcggtgcaaagaaaggtggaaaagcaaacagcccatttctattctgtggacataactgaaaaacaagcgaagatggggcttgtttgtcgtgttcactcaaacgataaaagcaaattcaagttgctttattttgagctcgaagagaatggtgggctgagtcttgcattgcaggaagacagtgtgaaaattgggaaagttactgctgcaggaatgtatttccttggctttcctgtgtaccgttttgaacaaaataacttgggagctgctgcaaaggattctgatggtgcattctttaaaagattggatagctttcaaccgtgtgacatacatgaactgaaacctggaacgcacttttttgctgtctatggtgacaatttcttcaagagtgcaaattatactatagaggtagtgtccgccgaatctttccctgccgaaaaggagatgctacgaaatgtagatgcaaaaatactcacaaaacgagctgagctgtccaaatttgagtcagagtatagggaggttttggcaaagttcaccgaaatgaccagcaaatacacagaagaaatgcaagcgattgaccagcttctgaaggagaggaacgagatccatgcttcctacaccaacaatccacctctgaaacggagttccagcaggaataaagcgaaatcacattcgaaaatgcctaaaaacgatgcagataagcatcatcagaaggaaaagaaagtgaaggatcactgtttggagggatatggaagtaacagtgataattcaagcgaaaagaaaccaaaagagcggtttccaaggaagaagtggctgaacattccattcaaacttgacaggagaaagtcatgctgagcaatgtgattcttctcccctttgttataccactcaattgatatacagatgattgtcactgtgccctctcaaactaagcctccgtccccattgctaatgccactcatattatttcctgtaaagatcatatatgtgagccggagaattgaggcatgatgtaaagtaattcattttagcttatgttctcaagcgtgcactggcaagttgctgcacatcgcttggatctagagcccccccactgaaccctactccatgatgcatgggagtgagattaagaggataaatactctggtgtcttctgtagcttgtgtaagattctatatgttgcgaactgtaggccagctatatatatttgtttgtccc

SEQ ID NO: 32917 - protein, 444 aa, Panicum virgatum
  misc_feature: Ceres CLONE 1913282
  misc_feature (34)..(96): Pfam Name: DnaJ Pfam Description: DnaJ domain
MAGSRFGSFKSEKGDSAASAAAAAAAGGAAQRRDPYEVLGVGRSATDQEIKSAFRRMALKYHPDKNGDDPVASDRFQEVTFSYNILSDPDKRRQYDTSGFEAIENDSQELELDLSSLNTVNTVFAALFNKLGVPIKTTVSATVLEEALNGSVMVSQLQLGNSVQRKVEKQTAHFYSVDITEKQAKMGLVCRVHSNDKSKFKLLYFELEENGGLSLALQEDSVKIGKVTAAGMYFLGFPVYRFEQNNLGAAAKDSDGAFFKRLDSFQPCDIHELKPGTHFFAVYGDNFFKSANYTIEVVSAESFPAEKEMLRNVDAKILTKRAELSKFESEYREVLAKFTEMTSKYTEEMQAIDQLLKERNEIHASYTNNPPLKRSSSRNKAKSHSKMPKNDADKHHQKEKKVKDHCLEGYGSNSDNSSEKKPKERFPRKKWLNIPFKLDRRKSC

SEQ ID NO: 32918 - DNA, 1722 bp, Panicum virgatum
  misc_feature: Ceres CLONE 1913311
  misc_feature: Encodes the peptide sequence at SEQ ID NO. 32919
attgagtacctgctgctcgccacggaaataacctgccgcaatcgagagagagcgccagatctatcaggcgtccatggcaaagagtgccgacttccccactggcaccgacgacggcggatcggcgtcgggcccaaatgagggcggcgagggccacggcgacatcgaggctggcggcacggcgaccgcaccggcgatggcgaggccaaggggtcagcgcctggcctcgctcgacgtcttcaggggcatcaccgtcgtgcttatgatcgttgtggatgatgttggtggccttctccctgccatcagccactcaccgtgggacggcgtgacgcttgcagattttgtgttccccttcttcctcttcattgttggagtctccttggcctttgcatacaagagagtgccggacagagcgctggcaaccaagaaggctgcgatccggacttcaaagctcttccttctaggcctagtactgcaaggtggcttctttcacagcatccacgatcttacttatggagttgatattcgcaagatacggttaatgggcatacttcagagaattgcaataacatacttaacggtagcactttgcgaaatatggctacgaggtggtgcaagtgatgacattggagccggtggctctaagttgataagaagatatcggcatcagctgtttgtgggtttggttctcatggtcacctacacagcgcttttgtatggcatgtatgtgccagactgggaatttgcagtcacatctcaagacaccactttgaagcactttatggtgaaatgtggagtcaggggtgataccagaccaggatgcaatgccgtgggcatgattgatcgacatgtccttggaatccaacatctctacacacgccccgtttacctcaggacagcgcaatgcagcatcaactccccacgaaatgggccgcttccctcaaaccctcccacatggtgtgaagctccctttgatcccgaaggcctcctcagttcgctgatggcaactgtgacctgcttgatcggcctccaaattgggcatgtcattgtgcacttcaaggagcatggcgagagattagtgcagtgttcgattccatctctaagcttgctgattcttggcttcttgcttgacttgtttggcttgcgcttgaacaagtcgttgtatagtctgagctacacctgcgtcaccacgggcaccgcaggtctcttcttcgcaggaatctatttgctggtggatgtttatagttacaagaagctgctttttcttatggagtgggtgggaaagcatgccctcatgatttttgttctagtggcatgcaacattgccccaatcctggtacatggcttctattggagggaaccacagaacaacctcttgaaatttatcggaataggaggctgatgaatgcattccttctcgacgacttttatgattttgggataacaataacacgtcatacagtaacagttttaatttcgaacagcagtcagcgctagccagatgcagatgctacacaacatgcctgtagcaggagcatgtcttagatttgagagccccatgctaagattagaataagcccataccgtcagacctgggatcacaggatacatgacgtggtacggatctatacggaataagggatggagcatgtcctatgccctgacattatgtaaagtactagtatacgagtatgactagtagtactcgggaagaactcttaggct

SEQ ID NO: 32919 - protein, 441 aa, Panicum virgatum
  misc_feature: Ceres CLONE 1913311
  misc_feature: SWISSPROT Homolog: EC 2.3.1.78 Heparan-alpha-glucosaminide N-acetyltransferase
MAKSADFPTGTDDGGSASGPNEGGEGHGDIEAGGTATAPAMARPRGQRLASLDVFRGITVVLMIVVDDVGGLLPAISHSPWDGVTLADFVFPFFLFIVGVSLAFAYKRVPDRALATKKAAIRTSKLFLLGLVLQGGFFHSIHDLTYGVDIRKIRLMGILQRIAITYLTVALCEIWLRGGASDDIGAGGSKLIRRYRHQLFVGLVLMVTYTALLYGMYVPDWEFAVTSQDTTLKHFMVKCGVRGDTRPGCNAVGMIDRHVLGIQHLYTRPVYLRTAQCSINSPRNGPLPSNPPTWCEAPFDPEGLLSSLMATVTCLIGLQIGHVIVHFKEHGERLVQCSIPSLSLLILGFLLDLFGLRLNKSLYSLSYTCVTTGTAGLFFAGIYLLVDVYSYKKLLFLMEWVGKHALMIFVLVACNIAPILVHGFYWREPQNNLLKFIGIGG

SEQ ID NO: 32920 - DNA, 709 bp, Panicum virgatum
  misc_feature: Ceres CLONE 1913316
  misc_feature: Encodes the peptide sequence at SEQ ID NO. 32921
aaatcagacttctcgaaaattgagttcaatttcttctgcggccgcctccacctcgatcagcgcggaccgaggagaccccccgggaaagagagcccatggcttcctctgccccggggagagcaggaagaagggtgatctcacttgcggcggtggcagcggctgttttgctaatggtacttgctggggcggagccggcggcggcgtgctacctgcgcttgttcagcttcggagactcgctggccgacacgggcaacttccccttctactacggcaataactccggcgagcccgcgctccggccgccctacggcgagacattcttccgccgcgccaccgggcgcttctccaacggccgcctcatcctcgacttcatcgcggacacgatgaggctcccgttcgcgcggccgtatctgagcgggcggcgcgcggaggacttcgcgtgcggggccaacttcgcggtgggcggcgccacggcgctcggcccggacttcttccgcgacaagggtttcaacatcggcgacgggagggtgcacctcgacttggagatgaagtggttccgcgacctgctcgacctcctctgccccggaggccgctccggttgctcagacatgatgagccaatcccttttcttggttggagaaattgggggcaatgattacaacctacctcttctctccagagtaccgattgagaagatccgctccttcac

SEQ ID NO: 32921 - protein, 204 aa, Panicum virgatum
  misc_feature: Ceres CLONE 1913316
  misc_feature: SWISSPROT Homolog: EC 3.2.1.51 Alpha-L-fucosidase
MASSAPGRAGRRVISLAAVAAAVLLMVLAGAEPAAACYLRLFSFGDSLADTGNFPFYYGNNSGEPALRPPYGETFFRRATGRFSNGRLILDFIADTMRLPFARPYLSGRRAEDFACGANFAVGGATALGPDFFRDKGFNIGDGRVHLDLEMKWFRDLLDLLCPGGRSGCSDMMSQSLFLVGEIGGNDYNLPLLSRVPIEKIRSF

SEQ ID NO: 32922 - DNA, 730 bp, Panicum virgatum
  misc_feature: Ceres CLONE 1913318
  misc_feature: Encodes the peptide sequence at SEQ ID NO. 32923
atccctccgcaccctcttatctgctccgcctccgcgctcccgctcctcccccacctccaccaccatggccacggccgaccagcgcggccggtacgacgacgaggatgaggacgacgggtacgagggcggccgcggctccgcgttcacgccccccacgcgcccgcgcaccggcaaggccgccctgccgctcaagcgcgaccgcacgcggtcgaaaaggttcctcgagatacagaagctcagggagagcaagaaggagtacgacgtgcccaccgccatctcgctgatgaagcagatggccagcgcgaaatttaaagagtcggccgaggcgcacttccgcatgaacctcgaccccaagtacaacgatcagcagctccgcgccacggtgaatttgcccaagggaacaggccagtcggtgaagattgcagtcctcacacaaggtgagaagatagatgaagctagagctgcaggagctgatatagttggtggagatgacttgatcgaacaaataaaaggagggtttatggactttgacaaattgatttcatcacctgatatgatgcctaaggttgctggcttgggtaagattctaggaccaagaggactgatgcctaacccaaaagctggcactgtttctccgaacattactcaggctatcgaagagttcaagaaggggaaagttgaatacagagttgacaaaacagggattgtccatattctgttcggcaaggtt

SEQ ID NO: 32923 - protein, 221 aa, Panicum virgatum
  misc_feature: Ceres CLONE 1913318
  misc_feature (60)..(221): Pfam Name: Ribosomal_L1 Pfam Description: Ribosomal protein L1p/L10e family
MATADQRGRYDDEDEDDGYEGGRGSAFTPPTRPRTGKAALPLKRDRTRSKRFLEIQKLRESKKEYDVPTAISLMKQMASAKFKESAEAHFRMNLDPKYNDQQLRATVNLPKGTGQSVKIAVLTQGEKIDEARAAGADIVGGDDLIEQIKGGFMDFDKLISSPDMMPKVAGLGKILGPRGLMPNPKAGTVSPNITQAIEEFKKGKVEYRVDKTGIVHILFGK

SEQ ID NO: 32924 - DNA, 1229 bp, Panicum virgatum
  misc_feature: Ceres CLONE 1913345
  misc_feature: Encodes the peptide sequence at SEQ ID NO. 32925
aagtaaaagagttccttctttttaatcccaggtcccaggccaggctctccccaccggcgatagggagagacgacgccacaagaaaacaacaagaaatccgccgcggaattccggattaaaataaggcttcctttttattcttctgcgctgttctcttgtgaggaggagaggagagagggctgcgctgggcagcaaatgcttagctcaggacatcaggtgtgttagattggaagttcaaacgataacttgctttaaggttcaagagcaaacgaagacatggagagggaagtcatggcctcctacgaaaccaagaaaaactgcgaagttagggtatttgagagttcatacgagatggcaacagatctggcagagtttatttcacaaatttctgaaatttctgttaaggaaagaggatactttgttattgctctctccggagggcctcttaccagacatatgcggaagctctgtgaagtaccatacaacaagacccttgattggtctaaatggtacgtcttctgggctgaagaacgtgcagtagcaaagaaccattcagaaagtaactacaaattaacaaaggaagaatttctctccaaggtgcctattcttaatggtcatgtctactccatcaacgacaacgcaacggtggaagaggcagcaactgactatgaatttgtcatcaggcagctggtcaagattcgaacagttggtgtctcggagagcaacgactgtcccaaatttgacctcattcttctgaacattggtcctgatggtcacgtagcctcattgttccccaatcatccagctcttgagctgaaagatgactgggtcacctacgtcaccgactctccagagcctccgcctgagaggattaccttcactcttcccgtgataaactcggcgtcgaacatcgccattgttgccactggagaagacaaggcaaaagctgtgtcttttgccatttccgactgtaacgaaggcctaggtgcgacatcagtacctgctaggatggttcagccaacggacgggaagttggtatggtttctggatgaggcggctgcctcatctcttgaggctgggaatgatgcttacgagcaccagtactgagagtcagacaagcgtcgaagctggacatcctttttttttttttggctgtgaatgaagaactcatgtagttgatgggttactttggacggaagaagttttgggctgggattttctgagaaatc

SEQ ID NO: 32925 - protein, 276 aa, Panicum virgatum
  misc_feature: Ceres CLONE 1913345
  misc_feature (30)..(268): Pfam Name: Glucosamine_iso Pfam Description: Glucosamine-6-phosphate isomerases/6-phosphogluconolactonase
  misc_feature: SWISSPROT Homolog: EC 3.1.1.31 6-phosphogluconolactonase
MEREVMASYETKKNCEVRVFESSYEMATDLAEFISQISEISVKERGYFVIALSGGPLTRHMRKLCEVPYNKTLDWSKWYVFWAEERAVAKNHSESNYKLTKEEFLSKVPILNGHVYSINDNATVEEAATDYEFVIRQLVKIRTVGVSESNDCPKFDLILLNIGPDGHVASLFPNHPALELKDDWVTYVTDSPEPPPERITFTLPVINSASNIAIVATGEDKAKAVSFAISDCNEGLGATSVPARMVQPTDGKLVWFLDEAAASSLEAGNDAYEHQY

SEQ ID NO: 32926 - DNA, 711 bp, Panicum virgatum
  misc_feature: Ceres CLONE 1913358
  misc_feature: Encodes the peptide sequence at SEQ ID NO. 32927
ccaccatcaccgagctctcttcctacctctctgctatctctctcggcacgcgcgcgagctctccttcctcgttgaggtgcattgatggcgaccgaagtggctgaggctccggtgccgctggcggaggcggcccccgacgccgcagcggccgcggccgccggcgacgcgaagccggccaaggccaagaagcccgccgcgccgcggaagcgcgcgaacccgacccacccaccctacgctgagatgatctcggaggcgatcacgtcgctcaaggagaggacggggtcgagccagtacgcgatcgccaagttcgtggaggacaagcagaaggccaagctgcctcccaacttccgcaagctgctgctcgggcagctgaagaagctcgtcgccgccggcaagctcaccaaggtcaagaactcgtacaagctgccggcggggcgcgccccggccgccgacaagcccaaggccaagcccaaggctaagcctgctgccgccaagcccaagtcgaagccgatgcctgccgcgaagaagcccaaggccgccgccaagcccaaggccaaggcgcccgccaaggctaagcccgccgcgaagccgaagccggccgcgaagcccgcggccaagctgaaggcagtcgctgcgaagccgaagccagccgccaagccggctgccaagcccaagcccaagccagccgccaagcctaaggccaaggcggcc

SEQ ID NO: 32927 - protein, 208 aa, Panicum virgatum
  misc_feature: Ceres CLONE 1913358
  misc_feature (46)..(116): Pfam Name: Linker_histone Pfam Description: linker histone H1 and H5 family
  misc_feature: Useful for making plants with modulated nitrogen use efficiency
  misc_feature: Useful for making plants with modulated oxidative stress sensitivity
MATEVAEAPVPLAEAAPDAAAAAAAGDAKPAKAKKPAAPRKRANPTHPPYAEMISEAITSLKERTGSSQYAIAKFVEDKQKAKLPPNFRKLLLGQLKKLVAAGKLTKVKNSYKLPAGRAPAADKPKAKPKAKPAAAKPKSKPMPAAKKPKAAAKPKAKAPAKAKPAAKPKPAAKPAAKLKAVAAKPKPAAKPAAKPKPKPAAKPKAKA

SEQ ID NO: 32928 - DNA, 733 bp, Panicum virgatum
  misc_feature: Ceres CLONE 1913366
  misc_feature: Encodes the peptide sequence at SEQ ID NO. 32929
aaccagagcagcaaacagccttttgtcgttgcaaaaatatagtgtagcggcggcagagacgatggcacgtagaacaattgtgttgagcctcatccttggcttgctggctgctgccaatgccgtgccctttgatttctattaccttatcctcatgtggcctggagcgtactgcgaggacagcgacaacggctgctgcgtgcccaagtacggctacccggcggaggatttcttcgtcgagagcttccagaccttcgacctgtccatcaacaagcccatcgtcaggtgcagcaacggcaaacccttcgacgctaacaagctggacaagatcgagaacagcatcaaccactactggagcaagctcaagtgcccgcccaccgacggcgtgaacaactggaagagcgcgtggaacagctacggcgtctgctcgggcctggagcagctggactacttcaaggccgccctcaacctgcggaagcaggcggacatcctcggcgcgctggccgagcaggacatcaggcccgactacaagctctacgccacggagaagatcaggtgggcggtggaacggaagctgggcgtcgcgccggggctgcagtgccgggacgggcccttcggcaagaagcagctgtacctggtctacctctgcgtggacacggacgccaagaccttcatcgagtgccccaagctgccggcgacgctgagctgccccgcgtcggtcgtcttccaccgttct

SEQ ID NO: 32929 - protein, 223 aa, Panicum virgatum
  misc_feature: Ceres CLONE 1913366
  misc_feature (23)..(212): Pfam Name: Ribonuclease_T2 Pfam Description: Ribonuclease T2 family
  misc_feature: SWISSPROT Homolog: EC 3.1.27.1 Ribonuclease T(2)
MARRTIVLSLILGLLAAANAVPFDFYYLILMWPGAYCEDSDNGCCVPKYGYPAEDFFVESFQTFDLSINKPIVRCSNGKPFDANKLDKIENSINHYWSKLKCPPTDGVNNWKSAWNSYGVCSGLEQLDYFKAALNLRKQADILGALAEQDIRPDYKLYATEKIRWAVERKLGVAPGLQCRDGPFGKKQLYLVYLCVDTDAKTFIECPKLPATLSCPASVVFHR

SEQ ID NO: 32930 - DNA, 743 bp, Panicum virgatum
  misc_feature: Ceres CLONE 1913374
  misc_feature: Encodes the peptide sequence at SEQ ID NO. 32931
gtacccccagcagtagcaaaacccccccacgaagcaaagcgaaagcaaaccgcaggcattcctctcgtctcgtcccccaccagagccagagcatgcgcgtagccgcgacgcgactcgccgccgcccccgctccgcgccccctcctcgtcctgctgctggtcctcctcgtctccgcgcccatcgcgaccggagcagcggccatggccggccacgtcctcggcggcgtgaaggagaaccccgccgccgccaacagcgccgagtccgacgggctcggccgcttcgccgtcgaggagcacaacaaacgccagaacgcgctgctggagttcgtgcgcgtggtggaggccaaggagcaggtggtggccggcacgctgcaccacctcacgctcgaggccattgaggccgggaggaagaaggtctacgaggccaaggtctgggtcaagccgtggctcgacttcaaggagctccaggagttcgtccacaagggggacgctaccaccttcaccagcgccgacctcggcgccaagaaaggtggacatgagcctgattggcgtgaggtgcctgtggaggatcctgctgtcaaagatgctgcacaccttgctgtgaaatcaatccaagagaggtctaactccctgtttccctatgaacttcttgagatcgttcgtgccaaggcacaggttgtggaaggcttcacgaaatttgacattctgatgacgctgaagagaggcagcaaggaggagaagatc

SEQ ID NO: 32931 - protein, 216 aa, Panicum virgatum
  misc_feature: Ceres CLONE 1913374
  misc_feature (43)..(131): Pfam Name: Cystatin Pfam Description: Cystatin domain
MRVAATRLAAAPAPRPLLVLLLVLLVSAPIATGAAAMAGHVLGGVKENPAAANSAESDGLGRFAVEEHNKRQNALLEFVRVVEAKEQVVAGTLHHLTLEAIEAGRKKVYEAKVWVKPWLDFKELQEFVHKGDATTFTSADLGAKKGGHEPDWREVPVEDPAVKDAAHLAVKSIQERSNSLFPYELLEIVRAKAQVVEGFTKFDILMTLKRGSKEEK

SEQ ID NO: 32932 - DNA, 747 bp, Panicum virgatum
  misc_feature: Ceres CLONE 1913392
  misc_feature: Encodes the peptide sequence at SEQ ID NO. 32933
tcttcgattcgcttctcttctctcgtgcgctgtggtttctccccatcgcgagctcttcctcccttccttgagcgcggtttcggccatggcagcggcggcgcaggcggtggcgaaggggagcgtgttgtcgccgagtggccaccgggccgcgccggggctcctgggccggcggaggggcgccgtggcggcgcggatggcgccgtcggcggtgcggatcgggggcccctgggggaagaccgcgttcctcggcgggaggctggcggtcgggcccaggagatccaggtccgcgtcccggactctcgtcgcgtcgccggtgcagatgaacatgaaccttgcgattgggaaatccatgaggtggtgggagaaggggctgcagcccaacatgcgggagatcgaatccgcccaagacctcgtcgattcattggccgacgccggcgacaggcttgtcatcgtggacttcttctcccctggctgcggcggttgccgtgctcttcacccaaagatttgccagtttgcggagcagaacccagatgtgctgttcttgcaagtgaactatgaggagcacaagtctatgtgctacagcctccatgtccatgtcctccctttcttcaggttctacaggggagctcaggggcggctctgcagcttcagttgtaccaacgcaactatcaagaagttcaaggatgcccttgcaaagcacaaaccagatagatgtagcattggcccgactagggggctggaggaatc

SEQ ID NO: 32933 - protein, 220 aa, Panicum virgatum
  misc_feature: Ceres CLONE 1913392
  misc_feature (104)..(205): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MAAAAQAVAKGSVLSPSGHRAAPGLLGRRRGAVAARMAPSAVRIGGPWGKTAFLGGRLAVGPRRSRSASRTLVASPVQMNMNLAIGKSMRWWEKGLQPNMREIESAQDLVDSLADAGDRLVIVDFFSPGCGGCRALHPKICQFAEQNPDVLFLQVNYEEHKSMCYSLHVHVLPFFRFYRGAQGRLCSFSCTNATIKKFKDALAKHKPDRCSIGPTRGLEE

SEQ ID NO: 32934 - DNA, 268 bp, Panicum virgatum
  misc_feature: Ceres CLONE 1913397
  misc_feature: Encodes the peptide sequence at SEQ ID NO. 32935
aagagagggaggggtgagggggcaggtcagagagggggagagggagggagaccacagaccagtagcagccactgctaccccgccaccgcggccactgcaaggtgcgagctgctgccgccggatcgaggggatggacagggacgccaccgcgttctacccgcccgctcagcccgcgcccgccgcacccgctgcggaggtgggaggcgctggtggcgtgggggccgccgcggcgggagggaacgcgcgcggggggggcggaggtccacca

SEQ ID NO: 32935 - protein, 45 aa, Panicum virgatum
  misc_feature: Ceres CLONE 1913397
  misc_feature: Useful for making plants with modulated biomass
MDRDATAFYPPAQPAPAAPAAEVGGAGGVGAAAAGGNARGGGGGP

SEQ ID NO: 32936 - DNA, 562 bp, Panicum virgatum
  misc_feature: Ceres CLONE 1913403
  misc_feature: Encodes the peptide sequence at SEQ ID NO. 32937
gtccaccgctccgcctcctcccccctcctttgatgcgcgaggggccgtgcggtccacggcctcgcgacgtgaacctaccgcccgcgttcctggtgctgatcctctcagtcctgctcgtggggccgtccgcctcatcctgctcctgccgcttagacgaacgcgcgaggacggcggccgcggcacctgcgcacacggggctcgacggccacgggccgccggaccccaccggcagtatcccgacccctgaaaatgcgccctacatttatagagttgcaagttctcctgtgaaaaaaaccttgatggaggacttttatgaagaacggatagaccgacatcatggagagaaagatggaatgcttggcgtatatgatggtcaaggtggagtgagagcagctgagtatgccaatctccaccttttcagaaatctaattaaacacccaaagttcatgactgataccaaggttgcaatcgccaaaacttacaactacgcacattcgcaatttttaaaagcagataggactcagactcgagatgctggctcaactgcctaaaccactattat

SEQ ID NO: 32937 - protein, 172 aa, Panicum virgatum
  misc_feature: Ceres CLONE 1913403
  misc_feature: SWISSPROT Homolog: EC 3.1.3.16 Phosphoprotein phosphatase
MREGPCGPRPRDVNLPPAFLVLILSVLLVGPSASSCSCRLDERARTAAAAPAHTGLDGHGPPDPTGSIPTPENAPYIYRVASSPVKKTLMEDFYEERIDRHHGEKDGMLGVYDGQGGVRAAEYANLHLFRNLIKHPKFMTDTKVAIAKTYNYAHSQFLKADRTQTRDAGSTA

SEQ ID NO: 32938 - DNA, 694 bp, Panicum virgatum
  misc_feature: Ceres CLONE 1913413
  misc_feature: Encodes the peptide sequence at SEQ ID NO. 32939
tttcgccattctcaacttttcccctttggtcgctttcttctttcccctttctacagtgctaaaaggcgattcagaaggcgatctcgttttctctccgtcgatccgccggccccctcccctccggcgcctcctcgggcgacggtgacgggaggggagcccggctcctcggcggatgggccttgtatagctgtaggtgtaggtctactagcttctatctaccggcgatggcgtgtgcgtcgtcgtctagggtttggtctctcctacgcttctccggcggcggcggtggcgacagtatcggcgccatctccggcaagggccgtaggagccttttgctcctccttgtgttctccgctgaagacgttctcgacggcgtcatccccggcgagcaggaagtgagatcaactaccaggattatttgaagttgaagaccagagttgaatttcttcaaactacacaaagaaatattcttggtgaggatctgggtccacttagcatgaaggagcttgagcagcttgagaaccaaatagagatatccctgaaacatatcaggacaagaaagaatcaaatgttacttgatcagctctttgatctgaaaagtaaggagcaagaattacaggacctgaacaaggacctcaggaaaaagttgcaagaaaccaatgcagagaacgtgctgcatgtttcctgggaagaaggg

SEQ ID NO: 32939 - protein, 66 aa, Panicum virgatum
  misc_feature: Ceres CLONE 1913413
  misc_feature (1)..(53): Pfam Name: K-box Pfam Description: K-box region
  misc_feature: The sequence is a functional homolog of SEQ ID NO 4 in US patent 7057087
  misc_feature: The sequence is a functional homolog of SEQ ID NO 6 in US patent 7279615
  misc_feature: The sequence is a functional homolog of SEQ ID NO 28 in the 10/666,642 US patent application
  misc_feature: Useful for biocontainment applications
  misc_feature: Useful for making plants with modulated flowering time
  misc_feature: Useful for making plants with modulated biomass
  misc_feature: The sequence is a functional homolog of SEQ ID NO 730 in the 10/666,642 US patent application
  misc_feature: The sequence is a functional homolog of SEQ ID NO 36 in the 10/666,642 US patent application
  misc_feature: The sequence is a functional homolog of SEQ ID NO 60 in the 10/412,699 US patent application
MKELEQLENQIEISLKHIRTRKNQMLLDQLFDLKSKEQELQDLNKDLRKKLQETNAENVLHVSWEE

SEQ ID NO: 32940 - DNA, 633 bp, Panicum virgatum
  misc_feature: Ceres CLONE 1913415
  misc_feature: Encodes the peptide sequence at SEQ ID NO. 32941
gacacaagagagcggagttcttatccggttcttcgccggccgtgcgcgctctgcagagtgcagagtactgggcagcgagtgcaaggactacctgttttgttcacttgttctagcgcgtcatgatgggcagcgagtgcaaggaccacctgcagctccacgccggcttcggcggcggcggcgggggaggcgcgcaacagcagcatcgccaggaggaggcggtcgccgtcgcgccgttcgtcgccgagacgttccacatggtgagcgacccggcgacggacgccgtcgtgcgctggggcggcgccagcaacaccttcctcgtcctcaaccccgccgccttctcctactacctcctgccctcctacttcaagcaccgcaacttcaccagcttcgtccgccagctcaacacctacgggttcaagaacgcggacaccgaccggtgggagttcgcgcactactcgttcctgcgcgggcaggcgcacctgctgccgctgatcgcgcacaacaacaagaaggccgccggcggcggacggcacctcgacgaggagatggacgacgtgtgcgacaccatccgcaccctcccccccctgcacaagatccgctactgcatgcaggagcagctccaggtcgcgtgcc

SEQ ID NO: 32941 - protein, 170 aa, Panicum virgatum
  misc_feature: Ceres CLONE 1913415
  misc_feature (36)..(166): Pfam Name: HSF_DNA-bind Pfam Description: HSF-type DNA-binding
MGSECKDHLQLHAGFGGGGGGGAQQQHRQEEAVAVAPFVAETFHMVSDPATDAVVRWGGASNTFLVLNPAAFSYYLLPSYFKHRNFTSFVRQLNTYGFKNADTDRWEFAHYSFLRGQAHLLPLIAHNNKKAAGGGRHLDEEMDDVCDTIRTLPPLHKIRYCMQEQLQVAC

SEQ ID NO: 32942 - DNA, 737 bp, Panicum virgatum
  misc_feature: Ceres CLONE 1913426
  misc_feature: Encodes the peptide sequence at SEQ ID NO. 32943
accaaagcctaatggcttcctcctcgtctcatgccgccgcgctgccctagaaccctcggccccccgccgctcctcctcgaattcccctctcgctccgatcggccccgctgacacgcccgcgccggatccctaaccccggaattccgcgcggaattccgggccggatcgaaatcgaactgcctgcctgcctcctctctcgatcaaataacgagcgcctgaggcggttggatccccgggcggggggcgtctcctgatttcggtctcttctccccccgtgccgcgatgggggcgccgaagcagcgctggacgccggaggaggaggccgcgctcaaggccggcgtcgccaagcacgggcccggcaagtggcgcaccatcctcagggacccggacttcagcacgctcctgcgcctccgctccaatgttgacctcaaggacaagtggcgcaacttgagtgtcaccgcgggaggttatgggtctagggagaaggcgagaatggcgttgaagaaaggcaggcgtgtggtgcctaagcttactgctgagccaatggatgtggacgcgaatggtttggacaatgttcatgatgcggtcatcgatgctgagccattggcattgtctgtggagcccttggcactcgagggaagtccggaaaaatcagttgctaggcttgatgacctcatattagaagccataaagaagcttaaggagccttctgggtccaataaggcagccattgctgc

SEQ ID NO: 32943 - protein, 151 aa, Panicum virgatum
  misc_feature: Ceres CLONE 1913426
  misc_feature (5)..(57): Pfam Name: Myb_DNA-binding Pfam Description: Myb-like DNA-binding domain
  misc_feature: The sequence is a functional homolog of SEQ ID NO 1221 in the 10/666,642 US patent application
  misc_feature: The sequence is a functional homolog of SEQ ID NO 1220 in the 10/666,642 US patent application
  misc_feature: Useful for making plants with altered alkaloid content
  misc_feature: The sequence is a functional homolog of SEQ ID NO 1526 in the 10/666,642 US patent application
  misc_feature: The sequence is a functional homolog of SEQ ID NO 1374 in the 10/666,642 US patent application
MGAPKQRWTPEEEAALKAGVAKHGPGKWRTILRDPDFSTLLRLRSNVDLKDKWRNLSVTAGGYGSREKARMALKKGRRVVPKLTAEPMDVDANGLDNVHDAVIDAEPLALSVEPLALEGSPEKSVARLDDLILEAIKKLKEPSGSNKAAIA

SEQ ID NO: 32944 - DNA, 1407 bp, Panicum virgatum
  misc_feature: Ceres CLONE 1913433
  misc_feature: Encodes the peptide sequence at SEQ ID NO. 32945
actcaacagctccaggaggaggacgaggtgatcagggcggatcataacagattcgcagccaacctgaacgaattaaccgtgcttctgttctgacagaccaagaatccgggggagcacgcaaagcgactgaaccagagctcatagccactcctgttggttcagtttcatcacaaaccctcaagctgattcaggcataatccgttgcagcagcgagttagcactagcagcagcagcagcttgccggctttcctatctctccgtcccgacacgccaagagtgtgctttttttatggatgccaagagtgtgctttgaccagcagcagttagttaccgcggttgctccaaccattcctatctctacatatcgacggtcaaaatctgtacttcctcgggaagatttgcttgtacggcagccgcgatcgagccaagaacggtggcgaaatggcagcggatcacgtcgagaaagacgtcgccggcgtccatggcgacgacgaccggagttcgaaggtgagcggcaaggatctagagcagcctcgtgacgaccaggagccggctgccgatcatgtcagcagaggcctagccatcgggcatttcatacgggagctgatggtggagggggtggcgtcgttcctgctggtgttctggtcggccgtggcggcgctgatgcaggagatgcacggcgcgctgtcgttccccatggtgtgcctcgtcgtggcgctcaccgtcgggttcgtgctctggtggctcccctgggccaagctgccgttctacgtggcggtccagctcgccggctccgtgctggcctgcctggcggtgaacggcgtcatgcggccgcgggaggagcacttctacgggacggccccgatggctggccacacccggctgccgttcctgatggagctcctcgcctccgccgtgctcatggtcgtcatcgccaccgcttccagaggctctacggtaggtgggctgaccatcggcgccgccgtgggcaccctgggcctcgtcatcgggccggtctccggggggtcgatgaacccgatcaggaccctgggcccggccatcgtcttcggcaggtgcacctccgtctggatctacctcgtcgcgcccctcgccggcatgctgctcggcgcgctctgcagccggccgtcaggaacgccgacgccatcctcgccttcctctgtggcggcggcggggcgagagcagcggcggcgcgcaaaaacggcaggagggtgccggtgctcacgccgcacgccattggggcagtcgcgtcgcagcagttctaatcgtaacagaggcgagacaaactttaaaactggggaaatacatgtgttcgcagcagctcaaactaaagctctccgctgtatttactacactattctcagcttttaaatttgagttcagttatgg

SEQ ID NO: 32945 - protein, 315 aa, Panicum virgatum
  misc_feature: Ceres CLONE 1913433
  misc_feature (45)..(233): Pfam Name: MIP Pfam Description: Major intrinsic protein
MAADHVEKDVAGVHGDDDRSSKVSGKDLEQPRDDQEPAADHVSRGLAIGHFIRELMVEGVASFLLVFWSAVAALMQEMHGALSFPMVCLVVALTVGFVLWWLPWAKLPFYVAVQLAGSVLACLAVNGVMRPREEHFYGTAPMAGHTRLPFLMELLASAVLMVVIATASRGSTVGGLTIGAAVGTLGLVIGPVSGGSMNPIRTLGPAIVFGRCTSVWIYLVAPLAGMLLGALCSRPSGTPTPSSPSSVAAAGREQRRRAKTAGGCRCSRRTPLGQSRRSSSNRNRGETNFKTGEIHVFAAAQTKALRCIYYTILSF

SEQ ID NO: 32946 - DNA, 722 bp, Panicum virgatum
  misc_feature: Ceres CLONE 1913438
  misc_feature: Encodes the peptide sequence at SEQ ID NO. 32947
acaccaaccaagcaacaagccgagaccatcatggcggcggcgacggcggcgggggcgtcaacggcggtgctcgcctccaggccagggcctaccagcgcgctcctccggcgcacccaggtcacccctctccgccataccgccctgaaatgccgccgcgctgggcccctcaaccccatggcggctgcggccgcagccgctgggggcggcggctccccgtcgtcggccgtcttccacggcgaggtattcgtggtgggcgacaacatcgacaccgaccagatcatccccgcggagcacctcaccctggtgccgtccaagcccgacgagtaccgcaagctcggctccttcgccttcgcggggctcccctccgcggcctacccgacgcccttcgtcgccccgggtgaggagtccacccgttacgccgtcatcatcggcggggccaacttcgggtgcggctcctcccgcgagcacgcgcccgtcgcgctcggggccgccggcgcgcgcgctgtcgtggcggagagctacgcgcgcatcttcttccgcaactccgtggccacaggagaggtctaccctctggagctcaccgacgccggagcctggaaggagtgcaagactggggatgtcgtcaccgtggaccttggcaattccgtctttattaaccacacatccggcaaggagtacaagttgaaacctattggcgatgctggaccggtcattgaggctgg

SEQ ID NO: 32947 - protein, 230 aa, Panicum virgatum
  misc_feature: Ceres CLONE 1913438
  misc_feature (64)..(186): Pfam Name: Aconitase_C Pfam Description: Aconitase C-terminal domain
  misc_feature: SWISSPROT Homolog: EC 4.2.1.33 3-isopropylmalate dehydratase
MAAATAAGASTAVLASRPGPTSALLRRTQVTPLRHTALKCRRAGPLNPMAAAAAAAGGGGSPSSAVFHGEVFVVGDNIDTDQIIPAEHLTLVPSKPDEYRKLGSFAFAGLPSAAYPTPFVAPGEESTRYAVIIGGANFGCGSSREHAPVALGAAGARAVVAESYARIFFRNSVATGEVYPLELTDAGAWKECKTGDVVTVDLGNSVFINHTSGKEYKLKPIGDAGPVIEA

SEQ ID NO: 32948 - DNA, 733 bp, Panicum virgatum
  misc_feature: Ceres CLONE 1913447
  misc_feature: Encodes the peptide sequence at SEQ ID NO. 32949
aatccccaattctttgtgatccggcggcgcacgagccgatcgattcagaagaaccaatccccatcttgactcccttccctctcgtctccaccgaaaagtctgcagccatggcgacgaggacgctggagctgacgctgatctcggccaaggatctcaaggaggtgaacctgctctccaagatggaggtctacgccttcgtctcgctctccggcgacccccgctcgcggcagcggatccaggccgaccgcaccggcggccgcaaccccacctggaacgccacgctccgattcaacgtcccggccagcggcgccgggtccctccacgtcctcctccgcgccgagcgcgccctcggcgaccgcgacgtcggcgaggtccacatcccgctctccgagctcctctccggcgcccccgacggccccgtccccgccaagttcgtcgcctaccaggtccgcaagatctcctccggcaagccacagggagtcctcaacttctcctacaagctcggtgaggtcacccaatcggccgctggctacgcccccgcccccgcccagtccgcctacacccagcctccctccgcctacccgccggcaggcaaggccgacgcgtacccgcctccctccgcctacccgcctgcggccaaggccgacgcgtacccgcctcccaccgcctacccgccggccgccaaggccgacgcataccctcctctaaccgcctatccgcccaccggcaagac

SEQ ID NO: 32949 - protein, 208 aa, Panicum virgatum
  misc_feature: Ceres CLONE 1913447
  misc_feature (6)..(90): Pfam Name: C2 Pfam Description: C2 domain
MATRTLELTLISAKDLKEVNLLSKMEVYAFVSLSGDPRSRQRIQADRTGGRNPTWNATLRFNVPASGAGSLHVLLRAERALGDRDVGEVHIPLSELLSGAPDGPVPAKFVAYQVRKISSGKPQGVLNFSYKLGEVTQSAAGYAPAPAQSAYTQPPSAYPPAGKADAYPPPSAYPPAAKADAYPPPTAYPPAAKADAYPPLTAYPPTGK

SEQ ID NO: 32950 - DNA, 682 bp, Panicum virgatum
  misc_feature: Ceres CLONE 1913457
  misc_feature: Encodes the peptide sequence at SEQ ID NO. 32951
acacaaaccacagcaacctgatcgccatgggcggcctctccatggaccagtccttcgtgcaggcccccgagcaccgccccaatcccaccgtcaccgaggccaccggcatcccgctcatcgacctctcgcccctgacctccggcgacgccgccgccgtggacgcgctggccgccgaggtgggcgcggcgagccgggagtggggcttcttcctggttgtgggccacggcgtgccggcggagaccgtggcgcgcgcggcggaggcacagcgcgccttcttcgcgctcccggcggagcggaaggcggccgtgcgcaggagcgaggcggcgccgctcgggtactacgagtcggagcacaccaagaacgtcagggactggaaggaggtgttcgacctcgtcgcgcgcgagccgccgcctccggcagccgcggccggcggcgaggtcgtgttcgagaacaagtggcccgaggacctgccaggcttcagagaggcgctggaggggtacatggaagcgctggaggagctggcgttgaagctgctggagctgctcggccggagcctggacctgaggcccggccggctgcgcggcttcttcagggagcccaccacgttcttccggctcaaccactacccgccctgcccgagcccggatctcgcgctgggcgtgggccggcacaaggaccccgg

SEQ ID NO: 32951 - protein, 218 aa, Panicum virgatum
  misc_feature: Ceres CLONE 1913457
  misc_feature: SWISSPROT Homolog: EC 1.14.11.9 Flavanone 3-dioxygenase
MGGLSMDQSFVQAPEHRPNPTVTEATGIPLIDLSPLTSGDAAAVDALAAEVGAASREWGFFLVVGHGVPAETVARAAEAQRAFFALPAERKAAVRRSEAAPLGYYESEHTKNVRDWKEVFDLVAREPPPPAAAAGGEVVFENKWPEDLPGFREALEGYMEALEELALKLLELLGRSLDLRPGRLRGFFREPTTFFRLNHYPPCPSPDLALGVGRHKDP

SEQ ID NO: 32952 - DNA, 532 bp, Panicum virgatum
  misc_feature: Ceres CLONE 1913457-R
ccgcgtcaagtttgtcccagggtccttcgtcattcaggtgggcgacaggttgcaggtgcggagcatcccccggtctgagagggcggagcgccggccgtcggtgccccgggacacgccgcggttctccttgccggacttgtttaaccgggggacagacgccgtggcggagccgcgggcggagccgttgtgtgacgcggacccgcccaggtacagatgcccctagttgggcccatttcttccgcaccaagctgagcggtaagcacaagaaggtgggggaggcgaacctccatcatcgcgcatttcaggaagggcctccgagcgtagcaggaaggcaggataccgtgcgtgcccgggggaagcggagtcggccgcccgttccctagactctgttgagagatcggaggttatattgtctcgccggagggtccccatttctagtagggcagagtccaagatattttcggaaccaaccaaaactctcgggcggaaattgtgctggctcagaattaaaatggtgctttttcagttgtgc

SEQ ID NO: 32953 - DNA, 413 bp, Panicum virgatum
  misc_feature: Ceres CLONE 1913473
  misc_feature: Encodes the peptide sequence at SEQ ID NO. 32954
atgtacatcctgaatcctgcgccagcagaagagcaccctgctggtacctagcaataatcaggagatcggggcacatagatacaactaacccggaccatgggggcggcgtcccacctggccgcactgcttctgatgctcgccaccaccgccctgtctacctccccggtggcgcgcggcctggcgggctcggcgccggcgccggcccctgcggcgccgaagacgatcacggccgccctgaacacggccggcaagttcaccgagttcctcccgctgctgccgtcgaccccgaaggcggaggatatgaccgacctggtcaagggcgagtcggaaagcggcgggctcacggtgttcgcgccggcggacaacgacttcccggcactccccttcagggcgctcaactccctctccgacga

SEQ ID NO: 32954 - protein, 105 aa, Panicum virgatum
  misc_feature: Ceres CLONE 1913473
  misc_feature: Useful for making plants with altered carbohydrate content
  misc_feature: Useful for making plants with altered cell wall content and/or composition
MGAASHLAALLLMLATTALSTSPVARGLAGSAPAPAPAAPKTITAALNTAGKFTEFLPLLPSTPKAEDMTDLVKGESESGGLTVFAPADNDFPALPFRALNSLSD

SEQ ID NO: 32955 - DNA, 723 bp, Panicum virgatum
  misc_feature: Ceres CLONE 1913485
  misc_feature: Encodes the peptide sequence at SEQ ID NO. 32956
gtcacgtcaacgcttcctcagtctccccacctctcatcaacccgcgcttccgcaaccgccgggcccgattcttcgccgcctcctcctcctcctcccagatggcggctccagctgatgcccccggcggatcggctgatgccttcgaggtgatccgcgctcaccaggcaaaagctgctcgtctttctccagtggaagaaatacggaccattctggaccgaagtgttagaggtgttcttgccacccattctcaggaacatgctggttatccttctggttccatggttgattttgcatgtgatcaggatggctcccccatattagcagtcagtagtttagcagttcattcaaagaatctctccggaaatccaaaatgctcacttcttgtcgccaaagaccctgaggacagaacagatactgtaatcactatatatggtgatgctgttcctgtttctgatgaacaaaaagattcagtgagaagttcttacctacgaagacatcctgatgccttctgggttgattttggtgacttcagtttcctgcacattaaaccgaaagctgtgtgctatgtatctggtgttgcaactgctctccttggctctggagaattcagtgctgctgagtacaaggaagcaaaagttgacccaatatctcaattctcaactcctatcacaagccacatgaataaggatcatgctgatgatacaaagctcatttgtgcacatt

SEQ ID NO: 32956 - protein, 240 aa, Panicum virgatum
  misc_feature: Ceres CLONE 1913485
  misc_feature (60)..(153): Pfam Name: Pyridox_oxidase Pfam Description: Pyridoxamine 5'-phosphate oxidase
HVNASSVSPPLINPRFRNRRARFFAASSSSSQMAAPADAPGGSADAFEVIRAHQAKAARLSPVEEIRTILDRSVRGVLATHSQEHAGYPSGSMVDFACDQDGSPILAVSSLAVHSKNLSGNPKCSLLVAKDPEDRTDTVITIYGDAVPVSDEQKDSVRSSYLRRHPDAFWVDFGDFSFLHIKPKAVCYVSGVATALLGSGEFSAAEYKEAKVDPISQFSTPITSHMNKDHADDTKLICAH

SEQ ID NO: 32957 - DNA, 729 bp, Panicum virgatum
  misc_feature: Ceres CLONE 1913510
  misc_feature: Encodes the peptide sequence at SEQ ID NO. 32958
gtcatcggcgcccgcagggcctcgtggcggatcatctcctccatcgagcagaaggaggagggccgcgggaacgaggcccacgccgcctccatccgcgcctaccgctccaagatcgaggccgagctcgcccgcatctgcgacggcatcctcgcgctcctcgactcccacctcgtcccctccgccggcgccgccgagtccaaggtcttctacctcaagatgaagggagactaccacaggtaccttgccgagttcaagtcaggcgcggagaggaaggaagctgcagagagcaccatgaatgcttacaaagctgcccaggatattgccctcgcagatctggctccaacccaccccatcaggcttggcctggcgctcaacttctcggtgttctactatgagatccttaactcccctgaccgtgcttgcaaccttgccaagcaggcttttgatgaggctatctctgagctagacagcctgggtgaggagtcctacaaggacagcactctgatcatgcagctcctccgtgacaacttgaccctatggacatctgacaccaatgaggatggcggtgatgagatcaaggaagctgctgccccgaaggaatccggggacggtcagtaagatggatccaagctcttgacctgatgcatccgctgatgttcgggagcaacaagagctaaagttcctggatttcgatagctaccttctagtatacctaccaccaccgtcgtc

SEQ ID NO: 32958 - protein, 205 aa, Panicum virgatum
  misc_feature: Ceres CLONE 1913510
  misc_feature (1)..(188): Pfam Name: 14-3-3 Pfam Description: 14-3-3 protein
  misc_feature: The sequence is a functional homolog of SEQ ID NO 789 in the 11/479,226 US patent application
  misc_feature: Useful for making plants with modulated drought sensitivity
  misc_feature: Useful for making plants with modulated water use efficiency
  misc_feature: The sequence is a functional homolog of SEQ ID NO 786 in the 11/479,226 US patent application
  misc_feature: The sequence is a functional homolog of SEQ ID NO 801 in the 11/479,226 US patent application
  misc_feature: The sequence is a functional homolog of SEQ ID NO 2350 in the 10/374,780 US patent application
  misc_feature: The sequence is a functional homolog of SEQ ID NO 344 in the 10/412,699 US patent application
  misc_feature: The sequence is a functional homolog of SEQ ID NO 790 in the 10/225,066 US patent application
  misc_feature: The sequence is a functional homolog of SEQ ID NO 805 in the 11/479,226 US patent application
  misc_feature: The sequence is a functional homolog of SEQ ID NO 342 in the 10/412,699 US patent application
  misc_feature: The sequence is a functional homolog of SEQ ID NO 782 in the 11/479,226 US patent application
  misc_feature: The sequence is a functional homolog of SEQ ID NO 797 in the 11/479,226 US patent application
  misc_feature: The sequence is a functional homolog of SEQ ID NO 793 in the 11/479,226 US patent application
VIGARRASWRIISSIEQKEEGRGNEAHAASIRAYRSKIEAELARICDGILALLDSHLVPSAGAAESKVFYLKMKGDYHRYLAEFKSGAERKEAAESTMNAYKAAQDIALADLAPTHPIRLGLALNFSVFYYEILNSPDRACNLAKQAFDEAISELDSLGEESYKDSTLIMQLLRDNLTLWTSDTNEDGGDEIKEAAAPKESGDGQ

SEQ ID NO: 32959 - DNA, 753 bp, Panicum virgatum
  misc_feature: Ceres CLONE 1913514
  misc_feature: Encodes the peptide sequence at SEQ ID NO. 32960
caccgcctccaaacacggtgacctcgccgcgaacaaacagcccatctcgctatcgctcagctgaactactcggctttagctacgctccaagtcactccgccacgctcctaccggccgccatggctctgcaggccgctgtcctcccttgcactccctccgtcccccagaagcacaagggcaacctcgccgccgtggtgaaggacacggctttcctcaccgttcaccagaagagcacccagaagccgcgtgttccgtcgctttcggtgcgggcgcaggccgtggcgacggcgcccgtggccaccccgggggccagcaccagcacgtcggccaacaagaagacgctgcggcagggggtggtggtgatcacgggcgcgtcctcggggctgggcctggcggcggccaaggcgctggcggagacgggcaagtggcacgtcgtcatggcgtgccgcgacttcctcaaggcggccaaggcggccaagggcgccggcatggcggagggcagctacaccatcatgcacctggacctggcctccctcgacagcgtccgccagttcgtcgacaacttccgccgcgccggcatgccgctcgacgccctcgtctgcaacgccgccatctaccgccccacggcgcggacgccgacgttctcggcggacgggtacgagatgagcgtgagcgtcaaccacctgggccacttcctcctcgcgcgcctcctcctcgacgacctccgcaagtccgactacccgtcgcggcggc

SEQ ID NO: 32960 - protein, 211 aa, Panicum virgatum
  misc_feature: Ceres CLONE 1913514
  misc_feature (78)..(208): Pfam Name: adh_short Pfam Description: short chain dehydrogenase
  misc_feature: SWISSPROT Homolog: EC 1.3.1.33 Protochlorophyllide reductase
MALQAAVLPCTPSVPQKHKGNLAAVVKDTAFLTVHQKSTQKPRVPSLSVRAQAVATAPVATPGASTSTSANKKTLRQGVVVITGASSGLGLAAAKALAETGKWHVVMACRDFLKAAKAAKGAGMAEGSYTIMHLDLASLDSVRQFVDNFRRAGMPLDALVCNAAIYRPTARTPTFSADGYEMSVSVNHLGHFLLARLLLDDLRKSDYPSRR

SEQ ID NO: 32961 - DNA, 1459 bp, Panicum virgatum
  misc_feature: Ceres CLONE 1913520
  misc_feature: Encodes the peptide sequence at SEQ ID NO. 32962
gagtaaccaaccggaccacgccattgccagtcgcccggccgcctacgagccctgcctcgagcccttgcccggccccggccaccgcgccttcctctccctcccgctgcgggttctctcgcgcagcccgaattcgcggggtggtttctgttctttgaccgcttctgagttctttctcggcgccgcgccatggaggtgagcgtttattggttttcttgttgggcagcgtcggtggcgggcggcggcttatgttggggattggagggggtgttgtcggcgatgaagatggattgcgatggttttgcgcggtcggtttcgcttgcaggagatggggaagagggtggtgaggaccgtgcgggtgcggaacatctcagatctggcgacggagcgggaggtgcgcgagttcttctccttttccggtgaaatcgagcacgtcgacatcagatttgacggaacggggaggacggcctacgtgacattcaaagatcccaaagccctcgagattgcccttctcctatcgggagcaacaattgtggatcaagttgtgaacataaccccagctgaagattacatctacatccctgttactgaacagcaacttttggtcaatgaggtgacaagtacaagttcagcacctaatgcagaattggagtactctccagaggccaatgccagccccaatagtcatatctatgtgagcaaggcccatgatgtcatgacaaatgtgattgcaaggggttcagcaatgagacaagatgctgtgaacaaggctaaagcatttgatgagaaacatcaattaagagctaatgcatcagcaaggatcaattcctttgataagcgtgttggcctttcgcagaagataaacaatgggatatcagttgtcaatgaaaaggtgaaatcggtagaccaaaggctacatgtttctgacaaaacaatggctgctttgctggctgcagagcgcaagcttaatgatacaggctctgctgtgaaaaccaacaggtatgtgtctgctggaacgagctggctgaatggtgcttttagcaaggtcgccaaggctggtcatgttgctggctcaagaactagagagaagttccaattagcggtgtcaaatctaacagccaaaggccctgccgttgttgcttgagcttgctgtgctggttatggaagctcttcttcccgaggaaaatatattagaagtccttgagcaagcatctccctttgattgcgtggacagcgtggaaagtaactgtatttcacttttgtcttgtccttttttccttgggtgcaggctattgaggaaatcttctgaggtttggtatatagaggagctcaaattttggtatttttagaaccctccattcttttagtgttgatgttaaattgattataggtgatagtgatattgtattgactcagtgtggattcagattgtcatcgattcctattcttacgtgattctccc

SEQ ID NO: 32962 - protein, 282 aa, Panicum virgatum
  misc_feature: Ceres CLONE 1913520
  misc_feature (20)..(86): Pfam Name: RRM_1 Pfam Description: RNA recognition motif. (a.k.a. RRM, RBD, or RNP domain)
  misc_feature: Useful for making plants with modulated biomass
MVLRGRFRLQEMGKRVVRTVRVRNISDLATEREVREFFSFSGEIEHVDIRFDGTGRTAYVTFKDPKALEIALLLSGATIVDQVVNITPAEDYIYIPVTEQQLLVNEVTSTSSAPNAELEYSPEANASPNSHIYVSKAHDVMTNVIARGSAMRQDAVNKAKAFDEKHQLRANASARINSFDKRVGLSQKINNGISVVNEKVKSVDQRLHVSDKTMAALLAAERKLNDTGSAVKTNRYVSAGTSWLNGAFSKVAKAGHVAGSRTREKFQLAVSNLTAKGPAVVA

SEQ ID NO: 32963 - DNA, 703 bp, Panicum virgatum
  misc_feature: Ceres CLONE 1913528
  misc_feature: Encodes the peptide sequence at SEQ ID NO. 32964
acacacgatctctctgtcccaaattaaaaaccccgagttgcctcttcttccattgcagctagcgatccatatgggggctgccaataagtggagcgacactgccatgctcgtcatcgacatgcagaaggagttcgtagacccggcaatgagcagcctggcgttcctggccggcggggaggccatcctcccggccgttacccaggccgtcgaacttgcgcgggagcgcggtatcttcgttgtctgggttgtgagagagcatgaccctgatggtagggacgttgagctctttcgccggcgcttctactccgggggaaagggccccgcgatgaaaggttcccaaggcgcagagatggctgatgggcttgtcatcaaagaagaggactacaagctggtgaaaacaaggttcagctctttctttgccacaaacctggattctgtcctcaaaacttcagggatcaagaacctggttgttgttgttccttctcttccagagtacgcaggcagcttgttaaatgccatcgtccatatgcgttactctaataatttgttttgtgcctgacccaatcttattattttgttattctaatttttcctatcaaaaaaataaataatttttgtgcgtgtatgtgttgaattttcaggggttcaaacaccaaattgtgtccggcagactgtctttgatgctgtcgcacttgactatgag

SEQ ID NO: 32964 - protein, 162 aa, Panicum virgatum
  misc_feature: Ceres CLONE 1913528
  misc_feature (8)..(162): Pfam Name: Isochorismatase Pfam Description: Isochorismatase family
MGAANKWSDTAMLVIDMQKEFVDPAMSSLAFLAGGEAILPAVTQAVELARERGIFVVWVVREHDPDGRDVELFRRRFYSGGKGPAMKGSQGAEMADGLVIKEEDYKLVKTRFSSFFATNLDSVLKTSGIKNLVVVVPSLPEYAGSLLNAIVHMRYSNNLFCA

SEQ ID NO: 32965 - DNA, 732 bp, Panicum virgatum
  misc_feature: Ceres CLONE 1913568
  misc_feature: Encodes the peptide sequence at SEQ ID NO. 32966
cccccttccttctcctccgcctctccgattgagtggctcaccttcctcccctcttcccccaaccagctccgaggttgcgagtagcaatcctctcccccgcccgccccctcgattcctccagattttggctcggttctctcgagctcgagcagatcagcctcctccgatcgaagctctggtctcggtttacccgtccaagaactgctgctgttcttggtggaggatctttggcggaagatccaaactcttgtgttggggttctccgggttttcctgcgctggagggaggtttcgttctcgctggccatggtttggctgggaagcagcatcttgatgcccaatctctgagctttatgaagatcgccagccacctgcgccgctcctgcttccaccactccttctcggttgtcttcctctactggttttatgtgatctcataacttgccctcacccggatccgccattccccgtgctctccccgtcccctctctctcctcccttcgttcttgctttcctgaagaatcgcccaataaaagcactagcagcagcagcagcagcggtagagaatttggtggtaagctaggccggccccgcgcggaaagatcctgccttgatgtcgtcgtcgtcgctgtcgccggcggggaggatgtccgggtcggacggcgactcggcggccgacacgcaccggcgcgagaagcggcggctgtcgaaccgcgagtcggcgcggcggtcg

SEQ ID NO: 32966 - protein, 39 aa, Panicum virgatum
  misc_feature: Ceres CLONE 1913568
  misc_feature: The sequence is a functional homolog of SEQ ID NO 1116 in the 11/479,226 US patent application
  misc_feature: The sequence is a functional homolog of SEQ ID NO 2406 in the 10/374,780 US patent application
  misc_feature: The sequence is a functional homolog of SEQ ID NO 42 in the 10/225,066 US patent application
  misc_feature: The sequence is a functional homolog of SEQ ID NO 484 in the 10/412,699 US patent application
MSSSSLSPAGRMSGSDGDSAADTHRREKRRLSNRESARR

SEQ ID NO: 32967 - DNA, 699 bp, Panicum virgatum
  misc_feature: Ceres CLONE 1913613
  misc_feature: Encodes the peptide sequence at SEQ ID NO. 32968
  misc_feature (607)..(607): n is a, c, t, g, unknown, or other
aaaacgctcggctcccccaccactttccatctctcttctttgttcccccagaggacgaggaggaggaagaagaaccaggaggcctctccccccctgcaccggtagcgagagggagggcggaagaggatgagcgcgtccaggttcataaagtgcgtcacggtcggggacggcgccgtcggcaagacctgcatgctcatctcctacacctccaacaccttccccaccgactatgttccaacggtgtttgacaacttcagtgctaacgtcgtggttgatggtaacactgtcaacctcgggctatgggacactgcaggtcaagaggattacaacagactgagaccactgagttatcgtggagctgatgttttccttctggccttctcactgatcagtaaggctagctatgagaatgtttcgaagaagtggatacctgaactgaagcattatgcacctggtgtgccaataattctcgtgggtacaaaacttgatcttcgagatgacaagcagttctttgtggaccaccctggtgctgttccaatcactactgctcagggagaggagctaagaaagcaaataggcgcaccatactacatcgaatgcagctcanagacccaactaaatgtaaagggcgtcttcgatgcggccataaaggttgtgctgcagccacccaaggcgaagaagaagaaaaaggcacagagg

SEQ ID NO: 32968 - protein, 190 aa, Panicum virgatum
  misc_feature: Ceres CLONE 1913613
  misc_feature (8)..(179): Pfam Name: Ras Pfam Description: Ras family
  misc_feature (8)..(121): Pfam Name: Miro Pfam Description: Miro-like protein
  misc_feature: SWISSPROT Homolog: EC 2.7.11.1 Non-specific serine/threonine protein kinase
  misc_feature: Useful for making plants with modulated nitrogen use efficiency
  misc_feature (161)..(161): Xaa is any aa, unknown, or other
MSASRFIKCVTVGDGAVGKTCMLISYTSNTFPTDYVPTVFDNFSANVVVDGNTVNLGLWDTAGQEDYNRLRPLSYRGADVFLLAFSLISKASYENVSKKWIPELKHYAPGVPIILVGTKLDLRDDKQFFVDHPGAVPITTAQGEELRKQIGAPYYIECSSXTQLNVKGVFDAAIKVVLQPPKAKKKKKAQ

SEQ ID NO: 32969 - DNA, 1331 bp, Panicum virgatum
  misc_feature: Ceres CLONE 1913618
  misc_feature: Encodes the peptide sequence at SEQ ID NO. 32970
gtcagcagtctcccctaaaaccctcgccgtcgagctcccggctccgccgccgtcgccatcgccgtccggtaagacaattgagtgatggctttggctcgcctcgggcagtctcttgcccgcctcccccagcgccctctctacctccctccgacgccgccgctcctcctcaaagattaccatgcctccgttgtacgatccttagctgagacccacacaggcgcatgcttaagaggttttgcaagcctgacatacaatgccagcagcatgattggccacaagcttggcgggccatcgccagtccacattgtgaaggctctggatctttttgtccatctggatcatactagactgatgtcaacagcagcagcatcacagcaaaacttgccgtctgctggtgcccgaaaggttagtcggaagattgtcatgatgagtcctggttttgtatatgagccgtacagccctcgggagcgcattcccttctggaaaagatggttcacattaagtggctggagaaggacaaaggaggatgtcattttggagatgaagaacgcatatgctgtatcaaggttgaggaagaaaactgggtataccaaaaagcaattctatgatcaagcattaaacatatacaaggaggttaacactctaatggcacatggagacgcgccggcactccggaaaattctgacagagaggatgcattctactataaaaaatgaactaaagagaaggcaatccaagtggagttctgtacattgggaactggtggagcctgccgtgagtatcagaactttgagggctcgcatgattggcctcgataagaaagacctggataaaggttttgtacagcttacacttgagttcgtcaccaaacagaaatttgaagcctataattcaaagggtgaggttgtgtctggagacaagtcaaaggaggtactcgtgaaagacatatgggtgtttgagagatcactttttcatcctggagcatattggcgtgtatgcggaaggattactctgtaatagtatctgtttggcaaggacatttccgttctgaatgagctgaacggatcattttggttgcacaaatggttctcaataaatttttgccctaagctattatttctctccagtctaactgatgtctaacaggatcgtcagacacagatatagtggtagtctttatattttgttctctttctttatgattttactagcataaaacagtgttgtcttcacgcttttgttagagaactaccttgggtgcgcactgacccctttgaaaggaccatccaatgtagcaacaaagttcgtgcaatatgaggtgacgttgtcac

SEQ ID NO: 32970 - protein, 250 aa, Panicum virgatum
  misc_feature: Ceres CLONE 1913618
  misc_feature (95)..(249): Pfam Name: Tim44 Pfam Description: Tim44-like domain
MIGHKLGGPSPVHIVKALDLFVHLDHTRLMSTAAASQQNLPSAGARKVSRKIVMMSPGFVYEPYSPRERIPFWKRWFTLSGWRRTKEDVILEMKNAYAVSRLRKKTGYTKKQFYDQALNIYKEVNTLMAHGDAPALRKILTERMHSTIKNELKRRQSKWSSVHWELVEPAVSIRTLRARMIGLDKKDLDKGFVQLTLEFVTKQKFEAYNSKGEVVSGDKSKEVLVKDIWVFERSLFHPGAYWRVCGRITL

SEQ ID NO: 32971 - DNA, 609 bp, Panicum virgatum
  misc_feature: Ceres CLONE 1913625
  misc_feature: Encodes the peptide sequence at SEQ ID NO. 32972
aactaggcaccaaaccatcacttcagtcccaccctccccccacgcctctcgatcctcctccccgtccaccacgtaccaccaccacacctagctaccgcccgcgcgcgtcgtctccggccatggccgagaagccgcctctgccgcccaagcccaagccgcccctgccgcccaggccgaggccgccgcccaaggcgccggccgcggcagcgcggtccgcgccagcccccgccaatggggccggccgggcgcgaggaggagcgtgagagtggacgccgcgtccgccaacggaggaccggggtgcgcgcgaggcaggctcggggcgcgcggcgctccctgcacgaaggaggatgaggcggccgcggcggctggatccaagcctcggcggccatgaggttctgatgtttgaggcccttcgtgaagccctgatagaagagatgaatttggacccaacggcgtgtgtcacgcgtgaagatgtcggtcactatggaggttcatacaaggcgaccaagggcttgcctgatatgtttggagatctccgggttcttgatactcctagtgctgagaactcttctcctggcatgagagttggagcagcaatgaaggggctca

SEQ ID NO: 32972 - protein, 87 aa, Panicum virgatum
  misc_feature: Ceres CLONE 1913625
  misc_feature: SWISSPROT Homolog: EC 1.2.4.1 Pyruvate dehydrogenase (acetyl-transferring)
MRRPRRLDPSLGGHEVLMFEALREALIEEMNLDPTACVTREDVGHYGGSYKATKGLPDMFGDLRVLDTPSAENSSPGMRVGAAMKGL

SEQ ID NO: 32973 - DNA, 1129 bp, Panicum virgatum
  misc_feature: Ceres CLONE 1913645
  misc_feature: Encodes the peptide sequence at SEQ ID NO. 32974
gaacagtaacctaatactaacagtagcacgttacacgtaggacggtgtgtcgcatatcatagtttatagagttgtaacatgtctatttatttatatatatgtatgtacaaagatgggatcactcgatcgccctcctccccaggcaaagctgcagctgcaaactagctgatgcgagacaccggtgaccacgcaccgacgggcaacgagtgagacctccgcatcaacgaccaaccgcgagccaagcgacgaccgacacagtcacacaggatggcggcgcaccatatcctcctcttgctcgccgcgctgctcccggcggcggccacggcggaccccgacgccgtgcaggactactgcgtgccggacgccgccgggcgcgggcggcccctggagctggcgctgctgccgtcctacccgtgccggagccccgccaacctgacggcggccgacttcgccttcgccggcgtgcgcgccgcgggcaacttctccgcggacacgggcttcgcgggggtgtccgtcacgcccgcgcagttcccggcgctgcacaccctgggcgtctccttcgcccgcgccgacctctccgcggcgggcggggtgaacccgccgcactaccacccgcgcgccaccgagacggcgctcgtcctggcgggccgcgtctacgcgggcttcgtcgactccggcggccgcatcttcgccaaggtgctcgagaagggggaggtcatggtgttccccagggccatggtgcacttccagatgaacgtcggcgacgagccggccacggtgtacggcacgttcaacagcgagaaccccggcatcgtgcgcatcccggccaccgtgttcgggtccgggatcagcgccggcgtcctcgagagggcgttcgggctctccccggcggagctccgccggctcgagaagaggttcggcccgcccaagaccaagctgtcagagatggacgattaggtagttagttaatcagctggtgaagtggtgatcagatcagccattgtagtggcgcatggttaattactagttttgaattgttaatgtgatgatgttgtagtatgatactccctccttccccgtttataaggcacacacgcatatcaagattcaaacatttatatctttgacc

SEQ ID NO: 32974 - protein, 229 aa, Panicum virgatum
  misc_feature: Ceres CLONE 1913645
  misc_feature (64)..(211): Pfam Name: Cupin_1 Pfam Description: Cupin
  misc_feature: SWISSPROT Homolog: EC 1.2.3.4 Oxalate oxidase
MAAHHILLLLAALLPAAATADPDAVQDYCVPDAAGRGRPLELALLPSYPCRSPANLTAADFAFAGVRAAGNFSADTGFAGVSVTPAQFPALHTLGVSFARADLSAAGGVNPPHYHPRATETALVLAGRVYAGFVDSGGRIFAKVLEKGEVMVFPRAMVHFQMNVGDEPATVYGTFNSENPGIVRIPATVFGSGISAGVLERAFGLSPAELRRLEKRFGPPKTKLSEMDD

SEQ ID NO: 32975 - DNA, 719 bp, Panicum virgatum
  misc_feature: Ceres CLONE 1913646
  misc_feature: Encodes the peptide sequence at SEQ ID NO. 32976
gtagtggaaacatgcccagcagccatggggtttgcctttgcagctggaaccacagatggtcctggagcttttgattttaaacaaggagacgccaagggaaacgctttctggaggttagtacgggatgcaattaggcccccggggccagagcaagtgaaatgtcaggctccgaaaccaatacttctagacacgggtgaaatgaaggttccatacgattgggcacctgcgattcttccaattcagataataagaataggccggctggttatcttgtgtgtccccggagagttcacaacaatggctgggaggcgactacgtgatgcagtcaaaaatatacttacgaatagtggtcaatttgataacaatattcatgttgtccttgcgggtctaacaaacacctattcccagtatattacaacttacgaagaatatcaggtgcaaagatatgagggagcatcaacgttgtacggcccccacaccttaagtgcctacattcaagagtttcagagacttgctacagctatggtctcaaacaaagaggtcccaacaaatttgcagcctcctgatctgctaaacagacaaattgagctgctcccaggtgttatagtcgacaagacacctcctggcgtcacgtttggagatgtcagttcggacgttcctgcaaactccactttcaggaagggcagcactgtgaacgctacattctattcagcctgccc

SEQ ID NO: 32976 - protein, 239 aa, Panicum virgatum
  misc_feature: Ceres CLONE 1913646
  misc_feature (1)..(239): Pfam Name: Ceramidase_alk Pfam Description: Neutral/alkaline non-lysosomal ceramidase
  misc_feature: SWISSPROT Homolog: EC 3.5.1.23 Ceramidase
VVETCPAAMGFAFAAGTTDGPGAFDFKQGDAKGNAFWRLVRDAIRPPGPEQVKCQAPKPILLDTGEMKVPYDWAPAILPIQIIRIGRLVILCVPGEFTTMAGRRLRDAVKNILTNSGQFDNNIHVVLAGLTNTYSQYITTYEEYQVQRYEGASTLYGPHTLSAYIQEFQRLATAMVSNKEVPTNLQPPDLLNRQIELLPGVIVDKTPPGVTFGDVSSDVPANSTFRKGSTVNATFYSAC

SEQ ID NO: 32977 - DNA, 652 bp, Panicum virgatum
  misc_feature: Ceres CLONE 1913648
  misc_feature: Encodes the peptide sequence at SEQ ID NO. 32978
ggtcgtcaaggaaacagctcacgggcaacgaggatttatctagcggctgccagccagccgccgttcgaaaccggacacgaggagggggagacgcggtctcgtctggagcctggttcgagagcgagcgccccatccatccatccatccgtcaatccatcaggctgtttgggggattgattgcttgagtgcgaggagtaggagcaggaggaggaagatggcaatggcggcaggggcggcggcagcggaggggagcgggcactgggacgcggaggcggagctcaacctgccgccggggttccggttcccccccaccgacgagaagctcgtggtgctctacctctgccggaaggtggcgcggcagcaactgcccgtgcccatcatcgcctaggtcgacctctacaaattcgatccctggaatctcgcaagtgcgtggcccctctccttcctctgcattcctctgttagtttttttttcattctctttatttatcaacatggattcagggagaatctgcacttattttctgtcctcggaaaaggggaagtttgattattctccctcttgttgtttgtgggtgattcgtttatccgagtattgggagaatctaagcgaatgacctcggtggtgtgttgctctgctctcttccttcaca

SEQ ID NO: 32978 - protein, 57 aa, Panicum virgatum
  misc_feature: Ceres CLONE 1913648
  misc_feature: The sequence is a functional homolog of SEQ ID NO 853 in the 10/374,780 US patent application
  misc_feature: The sequence is a functional homolog of SEQ ID NO 891 in the 10/374,780 US patent application
  misc_feature: Useful for making plants with altered terpenoid content
  misc_feature: The sequence is a functional homolog of SEQ ID NO 1157 in the 11/479,226 US patent application
  misc_feature: The sequence is a functional homolog of SEQ ID NO 1416 in the 10/666,642 US patent application
  misc_feature: The sequence is a functional homolog of SEQ ID NO 30 in the 10/286,264 US patent application
  misc_feature: The sequence is a functional homolog of SEQ ID NO 430 in the 11/435,388 US patent application
  misc_feature: The sequence is a functional homolog of SEQ ID NO 518 in the 10/412,699 US patent application
  misc_feature: Useful for making plants with modulated water use efficiency
  misc_feature: Useful for making plants with modulated light quality response
  misc_feature: The sequence is a functional homolog of SEQ ID NO 1012 in the 11/435,388 US patent application
  misc_feature: Useful for making plants with altered lignin content
MAMAAGAAAAEGSGHWDAEAELNLPPGFRFPPTDEKLVVLYLCRKVARQQLPVPIIA

SEQ ID NO: 32979 - DNA, 1110 bp, Panicum virgatum
  misc_feature: Ceres CLONE 1913657
  misc_feature: Encodes the peptide sequence at SEQ ID NO. 32980
acttactaaactactccctaatccttaccttctttctctccattgcgaaccgcttcctcttcatcggagtgatctatactaggctaggttgctagcagctaggtcgtctctgtgcagtgaactagctagtctcgattggacaccaccatgtatagcgctagtgccatggaggccgccgagaatttcgggaaatcatggctcggcctagggataggcggcggcgatctgaagcggaggtcgtcggcggcggtgcggctcgacttgctgttcccgcagcagagcgtcaaggaagaagctgcggtgggcaccaaggcagagaagggtgctcggaagaggttgaagatcaccgatgacggcgacggccgccagtctctcgagtcgagcccgagcgacgacggtggcgacggctgcgcaggcacgaggaagaagctccggctcaccaaggagcagtcgaccctgctcgaggacaccttccgcgcccacaacatactttcccacgctcagaagcacgagctcgcgcaccaggtgaatctaagcgcgagacaggtggaagtgtggttccaaaacaggagggcaagaacaaagttgaagcagacggaggtggactgcgagatcctgaagcgatgctgcgagagcctcaccggcgagaaccagcggctgaagcacgagctcttgcagctgcagcggtcggcggcggccgggctctgcgtgcagttcccgcggcgggccccggcgacggctaccatctgcccgtcctgcgagaaggtcaccgtgacgacgagcggcggcgagacaagcaacaagagctccagcagctattcctcctgatgagcgagatcgaggccgaagcgtagtgtgcttcatctatcttggtttagtttgatgagatggttaaatttcgaggtttcatgtgagtttgtgtagataaagtgtgcgtgcatactaataactttggtggcttacacacagtatagtatagctttagggatgcttgtggtctgcaaaattctgcatgcagaacatatatgcatgcaagctttgtgcaatagagaggtgacaaaatatagttgtaatacatgatcatcagtcatgaactgatttgagttttgg

SEQ ID NO: 32980 - protein, 220 aa, Panicum virgatum
  misc_feature: Ceres CLONE 1913657
  misc_feature (87)..(141): Pfam Name: Homeobox Pfam Description: Homeobox domain
  misc_feature (142)..(185): Pfam Name: HALZ Pfam Description: Homeobox associated leucine zipper
  misc_feature: Useful for biocontainment applications
  misc_feature: Useful for making plants with modulated biomass
  misc_feature: Useful for making plants with modulated flowering time
  misc_feature: The sequence is a functional homolog of SEQ ID NO 254 in the 10/412,699 US patent application
  misc_feature: The sequence is a functional homolog of SEQ ID NO 550 in the 11/479,226 US patent application
  misc_feature: The sequence is a functional homolog of SEQ ID NO 568 in the 11/479,226 US patent application
  misc_feature: Useful for making plants with altered lignin content
  misc_feature: The sequence is a functional homolog of SEQ ID NO 542 in the 11/479,226 US patent application
MEAAENFGKSWLGLGIGGGDLKRRSSAAVRLDLLFPQQSVKEEAAVGTKAEKGARKRLKITDDGDGRQSLESSPSDDGGDGCAGTRKKLRLTKEQSTLLEDTFRAHNILSHAQKHELAHQVNLSARQVEVWFQNRRARTKLKQTEVDCEILKRCCESLTGENQRLKHELLQLQRSAAAGLCVQFPRRAPATATICPSCEKVTVTTSGGETSNKSSSSYSS

SEQ ID NO: 32981 - DNA, 732 bp, Panicum virgatum
  misc_feature: Ceres CLONE 1913666
  misc_feature: Encodes the peptide sequence at SEQ ID NO. 32982
aaagcagcagcgcctcgccatcagagacaagcacacgagctcagagaagaacaccacacgcatgaccaaccgcatcttctccgccatggcagggggccaagcgtacatgatccgattcgacggccacttcgacgacccctcgccgagctccgccggcgcggagccgctggcggtgccgcagccgccgccgttcgcggggcgggtgatctcccccgagcaggagcaccaggtcattgtcgccgccctgctgcacgtcgtctccgggtacaccaccgcgccgccggagatcttcccgcccgccgccgcggcgtgccgggtgtgcgggatggagcggtgcctcggctgcgagttcttcggggcagagggcgccgcggcgatcgcattggacggcgcggcgagtaatgtggccggggcgccgggcgcggcggcggcggcggcggcggcggcagggcagaggaggcggcggaagaagaagaacaagtaccgcggcgtgcgccagcggccgtgggggaagtgggcggcggagatccgcgacccgcgccgcgcggtgcgcaagtggctcgggacgttcgacaccgccgaggaggccgccaaggcctacgaccgcgccgccatcgagttccgcggcccgcgcgccaagctcaacttcccgttcccggagccgcccgcgggccacgacgaggccagcaacggcgacgcgagcgcggccgccagtcctcggacaacacgctg

SEQ ID NO: 32982 - protein, 223 aa, Panicum virgatum
  misc_feature: Ceres CLONE 1913666
  misc_feature (139)..(190): Pfam Name: AP2 Pfam Description: AP2 domain
  misc_feature: Useful for making plants with modulated biomass
  misc_feature: Useful for making plants with altered lignin content
  misc_feature: The sequence is a functional homolog of SEQ ID NO 1466 in the 10/666,642 US patent application
  misc_feature: The sequence is a functional homolog of SEQ ID NO 2136 in the 10/374,780 US patent application
  misc_feature: The sequence is a functional homolog of SEQ ID NO 36 in the 10/714,887 US patent application
  misc_feature: The sequence is a functional homolog of SEQ ID NO 36 in the 11/435,388 US patent application
  misc_feature: The sequence is a functional homolog of SEQ ID NO 368 in the 10/225,066 US patent application
  misc_feature: The sequence is a functional homolog of SEQ ID NO 6 in the 10/903,236 US patent application
MTNRIFSAMAGGQAYMIRFDGHFDDPSPSSAGAEPLAVPQPPPFAGRVISPEQEHQVIVAALLHVVSGYTTAPPEIFPPAAAACRVCGMERCLGCEFFGAEGAAAIALDGAASNVAGAPGAAAAAAAAAGQRRRRKKKNKYRGVRQRPWGKWAAEIRDPRRAVRKWLGTFDTAEEAAKAYDRAAIEFRGPRAKLNFPFPEPPAGHDEASNGDASAAASPRTTR

SEQ ID NO: 32983 - DNA, 1164 bp, Panicum virgatum
  misc_feature: Ceres CLONE 1913670
  misc_feature: Encodes the peptide sequence at SEQ ID NO. 32984
atcccctcgtcccaaaccagccgcaacgaccaaacaaagctagaaaaccaacaccagctcgcggcatgggtcgtcgtccatcccgccccggcctcgcccccgccgccgccgcggcgctcaccgcggccgcggtcctgctgctcatcgcggccgcggcgccggctgccagggcgcaggaggagacggaggacgagcacgagttcagctacgacccccgcgacgcgcacgggccggcgcactggggcgccatcaaggcggagtgggccaactgcagcgcggggcggatgcagtcgcccatcgacctcgcccacgagcgcgtcacgctggtgcgcgccctcggctacctcgaccacgcctaccgcgccgccgaggcctccatcgtcaaccgcggccacgacatcatggtgcggttccgcggcgacgccgggagcctggcgatcaacggcacggcgtaccggctgcggcagctgcactggcacgcgcccacggagcacaccgtcggcgggcggcgctacgacatggagctgcacctggtgcacgagagcgccgcgggcaaggcggcggtggtcggcgtcctgtacgaggtcggcgccgcgcccgacccgttcctgagcgcgctggagcccgccatccgccggatcgcggagcggcgggacatggaggaggacgtcggcgtcgtcgacccgcgccgcgcgcgcggccgcgccagcgtctactaccgctacatgggctccctcaccacgccgccctgcaccgagggggtcatctggactgtcgtcaagagggttcgcaccgtgtccaagtaccagctggagctgctcagggaagccgtgcacgacgacatggagaagaacgcgaggccgctgcaggcggtgaacgaccgggacatcagcatcttccggccaaagccacacaagcactactagactagctaggtcctgcagcttactgtcagtgatgcatgagctgacgtggagacagacaccggttgtttcagacttcagagcttgagaataatatacacacatacatacgggaagcattcgattcgttgtacactagaggagatgtgtttacggtagatgatggatatcttttttgttttgttttagtaattctttgtacctttgttatgtgactaaataaattaataatgcatcactt

SEQ ID NO: 32984 - protein, 286 aa, Panicum virgatum
  misc_feature: Ceres CLONE 1913670
  misc_feature (51)..(278): Pfam Name: Carb_anhydrase Pfam Description: Eukaryotic-type carbonic anhydrase
  misc_feature: SWISSPROT Homolog: EC 4.2.1.1 Carbonate dehydratase
MGRRPSRPGLAPAAAAALTAAAVLLLIAAAAPAARAQEETEDEHEFSYDPRDAHGPAHWGAIKAEWANCSAGRMQSPIDLAHERVTLVRALGYLDHAYRAAEASIVNRGHDIMVRFRGDAGSLAINGTAYRLRQLHWHAPTEHTVGGRRYDMELHLVHESAAGKAAVVGVLYEVGAAPDPFLSALEPAIRRIAERRDMEEDVGVVDPRRARGRASVYYRYMGSLTTPPCTEGVIWTVVKRVRTVSKYQLELLREAVHDDMEKNARPLQAVNDRDISIFRPKPHKHY

SEQ ID NO: 32985 - DNA, 667 bp, Panicum virgatum
  misc_feature: Ceres CLONE 1913671
  misc_feature: Encodes the peptide sequence at SEQ ID NO. 32986
ggcctcctttttcacgccgctggtgggaggtggagccttttccatcaccagcatctccatcggaccaaaaccagttaccctgttttggtggaataatcattcagtcacaagttataacagcgagacttgttgaaggcactattcaatctgtgggaaacaacgcggcaacaaaaaaagggatgttctctatcatctgaaagtgtttggaattctcagagctaacatggacgatgactctggcggacataataagcaggagagcatattacacaatcaacatttgaatctacaaagtctgtcattaaaagatttgagagacatcacaaatgatttctctaatgagctgctacttggacaaggtggttttggtagggtgtataagggagttctagcaaatggggttacaattgctgtgaagaagcttacatggacaatgtcaggaattcaggataagcaatatgagaatgaagcatgtcatctcatgaggcttaaacatccaaacatagtgcaacttgtaggatactgttctgaaacagagaaggaacttgtacaactgcccaacgggaaatacgtttatgctgagaagtcagaaaggttgctttgcttggagtacatgcctaatggaagcctctgcaagcatctttccgatgcatcttctggacttgat

SEQ ID NO: 32986 - protein, 147 aa, Panicum virgatum
  misc_feature: Ceres CLONE 1913671
  misc_feature: SWISSPROT Homolog: EC 2.7.11.1 Non-specific serine/threonine protein kinase
MDDDSGGHNKQESILHNQHLNLQSLSLKDLRDITNDFSNELLLGQGGFGRVYKGVLANGVTIAVKKLTWTMSGIQDKQYENEACHLMRLKHPNIVQLVGYCSETEKELVQLPNGKYVYAEKSERLLCLEYMPNGSLCKHLSDASSGL

SEQ ID NO: 32987 - DNA, 1089 bp, Panicum virgatum
  misc_feature: Ceres CLONE 1913678
  misc_feature: Encodes the peptide sequence at SEQ ID NO. 32988
ctccccattattctactcccgggattcctttcctccccctgttgctgcgaccgcgacctgccgtcgcttgcctctgcttctcctcctcgcttcgcttccgaccaagctttcgagccagcggccgccgcagcaggggttcgggagacggggccaggccatggggaagtacatgcggaagggcaaggtgtccggggaggtcgccgtcatggaggtccccggcggcgcgctgctcggcgtccgcacgcgctcccgcacgctcgcgctgcagcgggcgcagaggccgcccgacaagggggaggcaggcgaggccgccggggagtacctcgagctccggagccggaggctcgagaagccgcccaaggagcaggcggcggcgcccgcgcccaagaatggcgccgctacgaaggccgctgccgccgcggcgtcgcccgcgctggccgaggacgaggtcgaggtgtccttcggggagaacgtgctcgacttcgattctatggaaaggaataccagagagacgacgccttgcagtttgattaggaactcagagatgataagcaccccaggatccacaactaaaagcaaaataagcagctcgatgacatcccgtcgcagaatggaaagctcagtctgtcgtttcataccgaattcactcgagatggaagagttcttcgcagcggctgaacagcatgagcagcataccttcagggagaagtataacttctgtcctgtgaacgacagccctcttcctggacggtatgaatggacgaggttaggatgctagattttcagcacaagagcttcattgatctgatatgtctacagcaatgactggtgtcgtggacgtggcgccaaccaactggattgcattagcctccttgtcttttgtaaaaattagattaattagcctgtagctgaatgatcgtgtgtaatgaacaggtccagcgctgacttacacacagatccccaaccttactgtaaccgttaactggtcaacgctcatgctgtaaccgaaccatctcatgtagtgtagtgtaggcctaatcctctgtgcctagtccttgaaccaaattaatgaattagagttatatttgc

SEQ ID NO: 32988 - protein, 206 aa, Panicum virgatum
  misc_feature: Ceres CLONE 1913678
  misc_feature (156)..(205): Pfam Name: CDI Pfam Description: Cyclin-dependent kinase inhibitor
MGKYMRKGKVSGEVAVMEVPGGALLGVRTRSRTLALQRAQRPPDKGEAGEAAGEYLELRSRRLEKPPKEQAAAPAPKNGAATKAAAAAASPALAEDEVEVSFGENVLDFDSMERNTRETTPCSLIRNSEMISTPGSTTKSKISSSMTSRRRMESSVCRFIPNSLEMEEFFAAAEQHEQHTFREKYNFCPVNDSPLPGRYEWTRLGC

SEQ ID NO: 32989 - DNA, 737 bp, Panicum virgatum
  misc_feature: Ceres CLONE 1913686
  misc_feature: Encodes the peptide sequence at SEQ ID NO. 32990
tatgtcagtgccatcaaggaagaaatcagcaaggttgtcaagatccaagaggagcttgacattgatgtgcttgtgcatggagagcctgagagaaatgacatggttgtgtacttcggtgagcaattgtctggttttgcattcactgccaacggatgggtgcaatcttatggatcacgttgtgtgaagccccccattatctatggtgatgtcagccgccccaaccccatgactgtcttctggtccaagatggcacagagcatgacctctcgcccaatgaagggaatgttgactggccctgtcacaatcctcaactggtcatttgtcaggaacgaccagcccaggtttgagacatgctaccaaatagctcttgcaatcaaaaaggaggttgaggatcttgaggctgctggtattcaggtgatccagatcgatgaggcggctctaagggagggcttgcccctgcgcaagtcagagcatgcattttacctggactgggctgtccactctttcagaatcaccaactgtggggtccaggacaccactcagatccacacacacatgtgctactccaacttcaacgatatcatccactccatcatcgacatggatgctgatgttatcaccattgagaactcccgttctgatgagaagctcctctccgtattcggtgagggtgtgaagtacggcgctggcatcggcccaggtgtctatgacatccactctcccaggatcccatctac

SEQ ID NO: 32990 - protein, 245 aa, Panicum virgatum
  misc_feature: Ceres CLONE 1913686
  misc_feature (1)..(245): Pfam Name: Meth_synt_2 Pfam Description: Cobalamin-independent synthase, Catalytic domain
  misc_feature: SWISSPROT Homolog: EC 2.1.1.14 5-methyltetrahydropteroyltriglutamate--homocysteine S-methyltransferase
  misc_feature: Useful for making plants with altered cell wall content and/or composition
YVSAIKEEISKVVKIQEELDIDVLVHGEPERNDMVVYFGEQLSGFAFTANGWVQSYGSRCVKPPIIYGDVSRPNPMTVFWSKMAQSMTSRPMKGMLTGPVTILNWSFVRNDQPRFETCYQIALAIKKEVEDLEAAGIQVIQIDEAALREGLPLRKSEHAFYLDWAVHSFRITNCGVQDTTQIHTHMCYSNFNDIIHSIIDMDADVITIENSRSDEKLLSVFGEGVKYGAGIGPGVYDIHSPRIPS

SEQ ID NO: 32991 - DNA, 680 bp, Panicum virgatum
  misc_feature: Ceres CLONE 1913687
  misc_feature: Encodes the peptide sequence at SEQ ID NO. 32992
ctaacccgaagccccacgccgccgtcgccgccgccgcagtctctttctcgctcgcgcgcgctctccgcctcaatcggagcgctcggttcgaggaagagcctctcggggtcggggtgaaggcgagcgcctcagccatggcggacgaggagcacgcggagaagaaggaggaggtcccggagctttccccctttgatccaaccaagaagaagaaaaagaagaaggttgtcatccaagatccttctgatgaagtggacaagctggctgagaagacagaaagcttgacagtcacagaacctgctgaactcaatttcactgggatgaagaagaagaagaagaagcaggtggatcttgattcatctcttgctgaccttggagatggggaggaagcccaagatgatcaagctgatgaggaacaaggggaaggcattgtgcttggaggtggccctagatacccttgggagggaactgatagggattacaaatatgaagagctcctggacagagtgttcaacatccttcgtgagaacaacccagatcttgctggggacaggcgtagaacagttatgaggccacctcaggttcttagggagggaacaaagaagacagtttttgttaattttatggacttgtgtaaaacgatgcataggcaacctgagcatgtgatgatgtttttgctcgct

SEQ ID NO: 32992 - protein, 181 aa, Panicum virgatum
  misc_feature: Ceres CLONE 1913687
  misc_feature (123)..(181): Pfam Name: eIF-5_eIF-2B Pfam Description: Domain found in IF2B/IF5
MADEEHAEKKEEVPELSPFDPTKKKKKKKVVIQDPSDEVDKLAEKTESLTVTEPAELNFTGMKKKKKKQVDLDSSLADLGDGEEAQDDQADEEQGEGIVLGGGPRYPWEGTDRDYKYEELLDRVFNILRENNPDLAGDRRRTVMRPPQVLREGTKKTVFVNFMDLCKTMHRQPEHVMMFLL

SEQ ID NO: 32993 - DNA, 484 bp, Panicum virgatum
  misc_feature: Ceres CLONE 1913689
  misc_feature: Encodes the peptide sequence at SEQ ID NO. 32994
cgaggtatacctactaccgatcgctttggtcgatcgtgaaaacctcgtcaaagcattgcattgctcgaggcgggcgggcgggcgcgcgcgtaggaccacgccggagcgagcgtgccgggcatggcggcggcgccggcggcgaagcctcacctggtgttcttcccgttccccacgcagggccacgtcaccccggcgttgcagctcgcaaggctcctccaccactgccacggcttcgacgtcaccttcgtccacaccgagcgcaaccggctgcgcctcctccgcgcgcgcggcccgagcgcgctggcgggggcgccggggttccgcttcgccgccgtccccgacggcctgcccccgtccgaccaggacgcggcgcgggacgacactgccacgctgctagcgcgcgcggaggaggcgccggcgttccgcttcgccgccgtccccagacggcctgccccccaccgacgaggacacggcgcggaacgac

SEQ ID NO: 32994 - protein, 121 aa, Panicum virgatum
  misc_feature: Ceres CLONE 1913689
  misc_feature: SWISSPROT Homolog: EC 2.4.1.115 Anthocyanidin 3-O-glucosyltransferase
  misc_feature: Useful for making plants with altered carbohydrate content
MAAAPAAKPHLVFFPFPTQGHVTPALQLARLLHHCHGFDVTFVHTERNRLRLLRARGPSALAGAPGFRFAAVPDGLPPSDQDAARDDTATLLARAEEAPAFRFAAVPRRPAPHRRGHGAER

SEQ ID NO: 32995 - DNA, 1940 bp, Panicum virgatum
  misc_feature: Ceres CLONE 1913719
  misc_feature: Encodes the peptide sequence at SEQ ID NO. 32996
aaagacgacgtgctcgctaccctcccccaactcctccccaagcccaagtcgcctgcccggttagcaaggaagcaggcaggcaggcaggaaactagcagggatatttggtggcgcgggcggtgtgagcccgcagcgagcagccagcgacagcagccgacccggcgccggccagcgacagcgagggcacctgccctccatctggaaccccgcgcgggtttcgccggccgcggcccggtacgacgacgactcggcacgcgccgtttcccgcccgccccccaccatcttgccggcctcgcgcgggagatgatgattcctagggaacctctgcggccggagcccctgtccgactcctgatcccggaccccccgccgatcgtagcggcgtctccgctgcagtgtccagactagaagatggagactcctcaaatcgagatgggtggtttcaaggtcaacaccccgcaagtgcccaatggtgggctacggccgaccatggctgggtcctggaactcgcgggggacagtcgagaggacactcaggagcatcaggatcgtcattttcacctccaagctcaacttgctgatgccattcgggcctgcatccatcattctgcacttcacttctaggaggcatggattggttttccttttcagcatgctaggaataacgccattagcagagcgtttgggatatgcaactgagcagcttgcactgtacactggtccaacagttggtggccttctgaatgctacatttggaaatgcaactgaaatgatcatcgcaatatatgctttgaaaaatggaatgattcgagtagtgcagcagtcactattgggttccatattatcaaatatgctgttagttttgggatgtgctttctttgctggtggtttaattcatcgtaataaagaccaagtcttcagtaaggcaactgcagttgtcaactcaggtttactgttgatggctgtcatgggattgatgtttcctgctgtccttcacttcacacattcagaagtgcgccaaggagcatccgaggttgctctttcaaggttcagtagttgcattatgctcgtggcgtatgcaagctatctctatttccaactaagtggtcggagcaatatttacagtccaattggcagtgaagaggtgcctaatgaggatgcaacagaagaggaggaagaagctgagattggcatgtgggaggctgttacctggcttgcagtgctaacactgtgggtgtcagtcctttctgaatacctagttaacgctattgagggagcatctgattcattgaacctaccggtggcttttatcagcgttattttgcttcctattgtgggcaatgcagctgaacatgctagtgcaataatgtttgccatgaaagataagcttgacataacgctaggtgttgcaattggctcgtcaacacagatatcaatgtttgtgattccattttgtgttgttattggttggatgatggggcaaaagatggacttgaattttcaactttttgagacagcaactctcttcataactgtacttgtggtggcatttatgctacaggatggcactgcaaactacttgaaaggacttatgctgatcttgtgttatctgatcgttgctgccagtttctttgttcatgttgatccgcaatcgagtgatggttgaggtcatagatgctgtaagtaatgtaccaaataccttcgaggatttgctaatcctattctgttgaggtgcaccaccataggtccatagcaatgttcagcctgtctgaagcagcattttggcactggaacatcacccatcgacggctccttcatgaactgctgaagggaattcttggatttatgtggatactgaggggtactaggggtagtcccaatgtatacaaaaacaagaaatgtctgcctgttatatcaattaattgagtgaatgtggcccttt

SEQ ID NO: 32996 - protein, 417 aa, Panicum virgatum
  misc_feature: Ceres CLONE 1913719
  misc_feature (273)..(406): Pfam Name: Na_Ca_ex Pfam Description: Sodium/calcium exchanger protein
  misc_feature (82)..(229): Pfam Name: Na_Ca_ex Pfam Description: Sodium/calcium exchanger protein
METPQIEMGGFKVNTPQVPNGGLRPTMAGSWNSRGTVERTLRSIRIVIFTSKLNLLMPFGPASIILHFTSRRHGLVFLFSMLGITPLAERLGYATEQLALYTGPTVGGLLNATFGNATEMIIAIYALKNGMIRVVQQSLLGSILSNMLLVLGCAFFAGGLIHRNKDQVFSKATAVVNSGLLLMAVMGLMFPAVLHFTHSEVRQGASEVALSRFSSCIMLVAYASYLYFQLSGRSNIYSPIGSEEVPNEDATEEEEEAEIGMWEAVTWLAVLTLWVSVLSEYLVNAIEGASDSLNLPVAFISVILLPIVGNAAEHASAIMFAMKDKLDITLGVAIGSSTQISMFVIPFCVVIGWMMGQKMDLNFQLFETATLFITVLVVAFMLQDGTANYLKGLMLILCYLIVAASFFVHVDPQSSDG

SEQ ID NO: 32997 - DNA, 718 bp, Panicum virgatum
  misc_feature: Ceres CLONE 1913733
  misc_feature: Encodes the peptide sequence at SEQ ID NO. 32998
gctttcccgatcttttctcctccccttcgcaaacccgcggctccgtccccccacccaccgcctgtggtcttccgccaggcgccgcccgccgctccccgccattggctgccgccatggacgccgcagggtacccgcccatgcaggggagcgggtccgcctccgcctccgcgtcatgccgcgccgccgactattccgccgcgtgggacgccgcgcagcagcagaagcgccagcgctgccaggctaggaaagaatgggcgaaaagaatccaacatgaatggagtctcctggaaaaagatttaccagcgttaatatatgttcgtgtatcggaaaatcgaatggaccttctcagggctgtaataattgggcctcaaggaacaccctaccatgatggccttttcttctttgatgctcatttcccggcttcttatcctgctactcccccagtggtatcctaccattcaggagggctaaggctcaatccaaatttatatgcttgtggcaaagtctgtcttagcctgctaggcacctggcaggggctttcttgtgagaaatggaatccagctcagtcaaccatgcttcaggtcctaatctccattcaagctctcgtattgaatgagaagccatactttaatgagccaggctatgaacgttatgccaaaagccctgagggactgtggtctgccttggattatatgatacaacatttctgtactcatgc

SEQ ID NO: 32998 - protein, 201 aa, Panicum virgatum
  misc_feature: Ceres CLONE 1913733
  misc_feature (50)..(192): Pfam Name: UQ_con Pfam Description: Ubiquitin-conjugating enzyme
  misc_feature: SWISSPROT Homolog: EC 6.3.2.19 Ubiquitin--protein ligase
MDAAGYPPMQGSGSASASASCRAADYSAAWDAAQQQKRQRCQARKEWAKRIQHEWSLLEKDLPALIYVRVSENRMDLLRAVIIGPQGTPYHDGLFFFDAHFPASYPATPPVVSYHSGGLRLNPNLYACGKVCLSLLGTWQGLSCEKWNPAQSTMLQVLISIQALVLNEKPYFNEPGYERYAKSPEGLWSALDYMIQHFCTH

SEQ ID NO: 32999 - DNA, 751 bp, Panicum virgatum
  misc_feature: Ceres CLONE 1913737
  misc_feature: Encodes the peptide sequence at SEQ ID NO. 33000
aatctcgatagggagcgcgacgacgaggaggaaaacagaggaggaaaaaaccaagaaaaaaaaatcacgctctcttcctccgttcccctgctcgattccccgcgaggaattcgcccccaaatctatcgatctgctctgcccagtccaccaatccgtggatcgatccgcgcgcgtgtccggtttgccccggggttccgatctggtcttcgccttaggggaggagccggaggaggagatgaacggcgccgggggcagccaccagcaacagcagcagaggctccggcagcagcagcagcagcagcaggcgctcctgatgcagcaggcactgcagcagcagcagcagtaccagtccggcgtcctcgcggcagcgacagcggccgccatgacccagatggaacctatttccaatggcaatcttccacctgggtttgatccttccacttgtcgcagtgtgtatgtggggaatgtgaacccaaacgtcaccgagacccttctgattgaagttttccagagtgctggccttgtggaaagatgcaagctcatcaggaaagagaagtcttcctttgggtttgtggattactatgatcgaagatctgctgctctagcaataatgacccttcatggtcgtcacatatatggacaagcaatcaaggtgaactgggcgtacgccagtacacagagggaggacacatctgggcatttccatatttttgttggtgatttaagttctgaagtgaatgatgcaactctt

SEQ ID NO: 33000 - protein, 171 aa, Panicum virgatum
  misc_feature: Ceres CLONE 1913737
  misc_feature (73)..(140): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with altered lignin content
MNGAGGSHQQQQQRLRQQQQQQQALLMQQALQQQQQYQSGVLAAATAAAMTQMEPISNGNLPPGFDPSTCRSVYVGNVNPNVTETLLIEVFQSAGLVERCKLIRKEKSSFGFVDYYDRRSAALAIMTLHGRHIYGQAIKVNWAYASTQREDTSGHFHIFVGDLSSEVNDAT

SEQ ID NO: 33001 - DNA, 2643 bp, Panicum virgatum
  misc_feature: Ceres CLONE 1913748
  misc_feature: Encodes the peptide sequence at SEQ ID NO. 33002
agcaccagctcaaacggagtgacgaaactgcccctcctcctctccctcggcctcgggtctccccagtctccacattcccccacttccccagtccaccccccgacccaaaccctcgaatcacgccgccgccccacggccccccacccgaccccactccgcggcgaccgacccgctcgcctcgccgccgggagggaccgacgcccacgtccattgtagcggcggggatccgcgcgagcccgagccgccgcctgatccgcggcgagatcgacggcgggctccgttcgggtcgacgacgggctgcttgaggcggggattcggcggcggaacgcggaggttatctcgctgatactactctcctatccctctgggcaccaagcagtcattgtgatttgtgactaactaactctggatggtggaagcattcgggaagtagatgacaccaacaccaagatggctgtgaggcatttctgcgctgcgcttctcacagtactcctctgttctatgctatgtcagctttgctatggctcagtaagtgacattgaatgcctgagaagggtgaaagcatcaattgaccccagcaacaagttagactggacattcaataaccacactgagggatccatatgtggatttagaggcgtggactgctggaatcccaatgaaaacaaggttctgtctcttcaccttggcagcatgggtcttaagggtgggttccctgatggacttgaaaattgtagtagcatgacttcattggatctctcaagcaacagcctttccggcccgatcccggctgatatctcgaagcagctgcaatacattacaagccttgatctgtcatataatagcttctcaggggagataccagaggcgctagctaactgtacctatctcaatgctgtcaatttacagcataacaaattgactggaacgctcccaggtcagcttgctgcccttggtcgcctgacacagtttaatgttgccgacaatcagttgtcagggcagattccttcatccttgagcaaatttccaccctccaattttgcaaatcaagacctttgcgggagacctctgagcaatgattgcactgccacttcaagcggtcgtacgggggtaattgtgggttctgctgttggtggtgcagttataactttaataattgttgctgttattttgtttattctcatacggaaaatgccttccaagaagaaggaaaaggatgtagaagaaaataagtgggccaagaatattaagggagcaaaaggagtgaaggtatcgatgtttgagaaatcggtttcaaaaatgaagttgaatgatcttatgaaagcaacaggcgattttacaaaggaaaacattattggaactggtcgatccggaactatgtacagagcaatactcccagatggttcattccttgccatcaagaggctgcaggacactcagcattcagagagccagttcacatctgaaatgtcaacactgggaagtgtaaggcaacgaaacttagtccctcttttgggatactgcattgccaagaaggagaggctcttggtgtacaaatacatgcccaagggttctctttatgatcatttacaccaacaaagtaatgacacaaaggctttagaatggtcactaaggctaaaaattgccattgggactgctagaggattggcatggcttcatcacagttgtaatccccgcattcttcataggaacattagttccaagtgcatattgatcgatgatgactatgagcctaagatttctgattttgggttggcaaggcttatgaatcccattgatacccacctgagcacatttgtcaatggtgagtttggtgacttggggtatgtagctcctgagtatgcacgcacccttgtggccactccaaaaggggatgtctatagctttggagttgtcttgcttgaacttgttactggtgaagagcccacacatgtgtcaaatgccccagagaacttcaaaggtagtttggtggattggataacttacctatcaaacaactctatacttcaggatgcagttgacaagtccttgattgggaaggacaacgatgctgagctgcttcaatgcatgaaggttgcatgctcttgtgtgctttcttctccgaaggaaaggcctacaatgtttgaagtttaccagcttctgagagctgttggagagaagtatcatttcagcgcagctgatgatgagttgacaatgcaacctcaaactgctgatcctgaagatgagcttattgtggcaaactagttgaacgggcaagtgcttgtgggataccaaaaattgcaggagttgttgtaacttgaataatttggtcagtctgaaagcatcgctctgtatcttttcagcttcctgcactactgaccaaccattagcatccccaggatatgccgtttggttgggacatttgtaccaagttgtgctgttcatgttctgtatatcctttgcctttatcttcaggactgttatgtcttggttgtaacatgtcaaacaattttagttgtatcattgtccaaattttagttatagcgatagctttagtaatgtgaaacaatgttgatcggtcatttgactgtagttttgtggactttcatgtagcatttttattaatgctttcatattccttcc

SEQ ID NO: 33002 - protein, 604 aa, Panicum virgatum
  misc_feature: Ceres CLONE 1913748
  misc_feature (296)..(571): Pfam Name: Pkinase Pfam Description: Protein kinase domain
  misc_feature: SWISSPROT Homolog: EC 2.7.11.1 Non-specific serine/threonine protein kinase
MAVRHFCAALLTVLLCSMLCQLCYGSVSDIECLRRVKASIDPSNKLDWTFNNHTEGSICGFRGVDCWNPNENKVLSLHLGSMGLKGGFPDGLENCSSMTSLDLSSNSLSGPIPADISKQLQYITSLDLSYNSFSGEIPEALANCTYLNAVNLQHNKLTGTLPGQLAALGRLTQFNVADNQLSGQIPSSLSKFPPSNFANQDLCGRPLSNDCTATSSGRTGVIVGSAVGGAVITLIIVAVILFILIRKMPSKKKEKDVEENKWAKNIKGAKGVKVSMFEKSVSKMKLNDLMKATGDFTKENIIGTGRSGTMYRAILPDGSFLAIKRLQDTQHSESQFTSEMSTLGSVRQRNLVPLLGYCIAKKERLLVYKYMPKGSLYDHLHQQSNDTKALEWSLRLKIAIGTARGLAWLHHSCNPRILHRNISSKCILIDDDYEPKISDFGLARLMNPIDTHLSTFVNGEFGDLGYVAPEYARTLVATPKGDVYSFGVVLLELVTGEEPTHVSNAPENFKGSLVDWITYLSNNSILQDAVDKSLIGKDNDAELLQCMKVACSCVLSSPKERPTMFEVYQLLRAVGEKYHFSAADDELTMQPQTADPEDELIVAN

SEQ ID NO: 33003 - DNA, 1379 bp, Panicum virgatum
  misc_feature: Ceres CLONE 1913751
  misc_feature: Encodes the peptide sequence at SEQ ID NO. 33004
aatagcagcacgcgctctcttgcagcgggagatgcggtgctgatccgtgccagcacctgctcggatctcgggagtaggcgccggcgccggctccggctgctgcccagggccaagctcctcgtcggttcttggcgagccgagctcgcgcgccatggagggcggcgcggaggccgtgaagtcggggacgcgcggcggcgggcaggtgtgccagatctgtggcgacggcgtcggcaccaccgcggagggggacgtcttcgccgcctgcgacgtctgcgggttccccgtgtgccgcccctgctacgagtacgagcggaaggacggcacgcaggcgtgcccgcagtgcaagaccaagtacaagcgccacaagggtagcccagcgatccgtggggaggaaggtgatgataccgatgccgatgacaccagtgacttcaactaccctgcttctggcaatgatgaccagaagcagaagattgctgacagaatgcgcagctggcgcatgaatgctgggggcagcggggatgttggccgccccaagtatgacagtggcgagatcgggctctccaagtatgacagtggtgagatccctcgaggctacatcccgtcagtcacaaacagccagatctcgggagaaattcctggagcttcccctgaccatcatatgatgtcccctactgggaacattggcaagcgcgcttcgtttccctatgtgaatcattcgccaaatccatcacgggagttctctggtagcattggaaatgttgcctggaaagagagagttgatggctggaaaatgaagcaggataaaggaacaattcccatgactaatggcaccagcattgctccctctgagggtcggggtgttggtgacattgatgcatctactgattacaacatggaagacgccttactgaacgatgaaactcgacagcctctatccagaaaagtgccaattccttcctccaggatcaatccttacagaatggtcattgtgctgcgattggttgttctaagcatcttcctgcactatcgtatcacaaatcctgtgcgcaatgcatacccgttatggcttctatctgttatatgtgagatttggtctgctctttcctggatattggatcagttcccaaagtggtttccaatcaaccgtgagacttaccttgatagattggcattaaggtatgaccgtgaaggtgagccatctcagttggctgctgttgacatttttgtcagtacagtcgacccaatgaaggagccacctcttgtcactgccaatactgttctatcgattcttgctgtggattaccctgtcgataaggtctcttgctatgtatctgacgatggagctgcaatgctgacatttgatgcactagctgagactt

SEQ ID NO: 33004 - protein, 409 aa, Panicum virgatum
  misc_feature: Ceres CLONE 1913751
  misc_feature: SWISSPROT Homolog: EC 2.4.1.12 Cellulose synthase (UDP-forming)
  misc_feature: Useful for making plants with altered carbohydrate content
  misc_feature: The sequence is a functional homolog of SEQ ID NO 6 in US patent 7285702
  misc_feature: Useful for making plants with modulated biomass
  misc_feature: Useful for making plants with altered cell wall content and/or composition
MEGGAEAVKSGTRGGGQVCQICGDGVGTTAEGDVFAACDVCGFPVCRPCYEYERKDGTQACPQCKTKYKRHKGSPAIRGEEGDDTDADDTSDFNYPASGNDDQKQKIADRMRSWRMNAGGSGDVGRPKYDSGEIGLSKYDSGEIPRGYIPSVTNSQISGEIPGASPDHHMMSPTGNIGKRASFPYVNHSPNPSREFSGSIGNVAWKERVDGWKMKQDKGTIPMTNGTSIAPSEGRGVGDIDASTDYNMEDALLNDETRQPLSRKVPIPSSRINPYRMVIVLRLVVLSIFLHYRITNPVRNAYPLWLLSVICEIWSALSWILDQFPKWFPINRETYLDRLALRYDREGEPSQLAAVDIFVSTVDPMKEPPLVTANTVLSILAVDYPVDKVSCYVSDDGAAMLTFDALAET

SEQ ID NO: 33005 - DNA, 601 bp, Panicum virgatum
  misc_feature: Ceres CLONE 1913751-R
  misc_feature: Encodes the peptide sequence at SEQ ID NO. 33006
tcttcatgttcaagtggacaactcttctcatccctccaacaaccatcttgatcatcaacctggtcggtgttgttgctggtacctcctatgctatcaacagcggttaccaatcatgggggccactctttggcaagctcttcttcgccttctgggtgattgttcacttgtacccattcctgaagggtctcatgggcaggcaaaaccgcaccccaaccatcgtggttgtctgggcgattcttcttgcttcgatcttctccttgctgtgggttcgcatcgatccgttcactacccgtgtcactggcccagatactcaaacatgtggtatcaactgctaggaacgtggaaggttgtagaaacagagaaataccaggaattgtgttttcgagaatatgaaaataccactgccaccaattgtctgttaagttataaggaaggtggcactatttacagctacgtacagaccaaggggatattgtttatcagaaagttacttgtgttgatatgcattcttttgttgataagctatactactttgtggagagtggctgacagaagagttttgtaatgttatgaagaacaagaaaataagatagttttcttt

SEQ ID NO: 33006 - protein, 110 aa, Panicum virgatum
  misc_feature: Ceres CLONE 1913751-R
  misc_feature: SWISSPROT Homolog: EC 2.4.1.12 Cellulose synthase (UDP-forming)
  misc_feature: Useful for making plants with altered carbohydrate content
  misc_feature: The sequence is a functional homolog of SEQ ID NO 6 in US patent 7285702
  misc_feature: Useful for making plants with altered cell wall content and/or composition
  misc_feature: Useful for making plants with modulated biomass
  misc_feature: The sequence is a functional homolog of SEQ ID NO 26 in US patent 7312377
  misc_feature: The sequence is a functional homolog of SEQ ID NO 2 in US patent 7049481
  misc_feature: Useful for making plants with modulated plant growth and development
FMFKWTTLLIPPTTILIINLVGVVAGTSYAINSGYQSWGPLFGKLFFAFWVIVHLYPFLKGLMGRQNRTPTIVVVWAILLASIFSLLWVRIDPFTTRVTGPDTQTCGINC

SEQ ID NO: 33007 - DNA, 766 bp, Panicum virgatum
  misc_feature: Ceres CLONE 1913753
  misc_feature: Encodes the peptide sequence at SEQ ID NO. 33008
gtgtccttgctcgtcccgcttgcctccgctaatcccaccggtgattgggcggttactggctgattaagttggcggcgaggtcgggggcgtcatggcgtcggagccggtggcgcgggcggtggcggaggaggtggtgcagtgggggagcatgaagccgacgggggtcagcctgcgctacatgatggagttcggctccaaccccacccagcgcaacctgctcctctccgcgcagttcctgcaaaaggagctccccatccgcatcgcgcgccgcgcactcgagctcgactcgctgcccttcgggctctccaacaagcccgccatcctcaaggtgagggattggtacttggactcgttccgcgacatcagatacttcccagaagtgaggaatcacaacgacgagcttgctttcacacagatgattaaaatggtcaaggtgcggcacaataatgtggttccaacaatggctttgggagtgcagcagctgaaaaaccaactgtgccgcacaaggaaggttccctttggattcgacgagatccacgagttccttgatcgattctacttgtcaaggattggcatccgcatgctgatagggcagcatgtggctttgcatgatcctgaaccagagcctggtgtcataggcctcattaatacaagattgtcccccatacaggtggctcaagctgctagcgaagatgcccgtgctatttgtttaaggacatacggatcagctcctgatattaacatttatggtgatccaaattttaca

SEQ ID NO: 33008 - protein, 224 aa, Panicum virgatum
  misc_feature: Ceres CLONE 1913753
  misc_feature: SWISSPROT Homolog: EC 2.7.11.2 [Pyruvate dehydrogenase (acetyl-transferring)] kinase
MASEPVARAVAEEVVQWGSMKPTGVSLRYMMEFGSNPTQRNLLLSAQFLQKELPIRIARRALELDSLPFGLSNKPAILKVRDWYLDSFRDIRYFPEVRNHNDELAFTQMIKMVKVRHNNVVPTMALGVQQLKNQLCRTRKVPFGFDEIHEFLDRFYLSRIGIRMLIGQHVALHDPEPEPGVIGLINTRLSPIQVAQAASEDARAICLRTYGSAPDINIYGDPNF

SEQ ID NO: 33009 - DNA, 750 bp, Panicum virgatum
  misc_feature: Ceres CLONE 1913765
  misc_feature: Encodes the peptide sequence at SEQ ID NO. 33010
agctcgtcccaacacacacatattgttcctggccatcttcttcgtccttcgcctctagatcgagctcgatcgcgagcaacttcgggtagctgctcgcgtcgatcgatcggagcctagacgtacgaagtctggccatggccatggcgctctcctcctcttccgctcttccgtgctccctcctcatggcggccctgatgctcctcgcctccatcgcccaagtgcaaggcatcaccagatactacgacttcaatgtgacaatggcgaacgtgacacggctgtgcgccaccaagagcatcgtcacggtgaacgggcagttccccggccccaagctcgtcgccagggaaggcgaccgcgtcgtcatccgcgtcaccaaccacgcccagcacaacatctcgctgcactggcacggcatccggcagctgcggacggggtgggcggacggcccggcgtacatcacgcagtgcccgatccagacggggcagagctacgtgtacaacttcaccgtcaccgggcagcgcggcacgctgtggtggcacgcgcacatctcctggctgcgcgccaccgtctacgggcccctcgtcatcctccccaagctcggcgtgccctacccgttcccggcgccctacaaggaggtccccgtcatcttcggtgagtggtggcaggcggacacggaggtggtggtcaagcaggcgctccagaccgggcgcgggccgaatgtctccgacgcccacatcatcaacggcctcccag

SEQ ID NO: 33010 - protein, 205 aa, Panicum virgatum
  misc_feature: Ceres CLONE 1913765
  misc_feature (39)..(155): Pfam Name: Cu-oxidase_3 Pfam Description: Multicopper oxidase
  misc_feature: SWISSPROT Homolog: EC 1.10.3.2 Laccase
  misc_feature: Useful for making plants with altered carbohydrate content
  misc_feature: Useful for making plants with altered cell wall content and/or composition
  misc_feature: Useful for biocontainment applications
  misc_feature: Useful for making plants with modulated biomass
  misc_feature: Useful for making plants with modulated flowering time
  misc_feature: Useful for making plants with modulated low light sensitivity
MAMALSSSSALPCSLLMAALMLLASIAQVQGITRYYDFNVTMANVTRLCATKSIVTVNGQFPGPKLVAREGDRVVIRVTNHAQHNISLHWHGIRQLRTGWADGPAYITQCPIQTGQSYVYNFTVTGQRGTLWWHAHISWLRATVYGPLVILPKLGVPYPFPAPYKEVPVIFGEWWQADTEVVVKQALQTGRGPNVSDAHIINGLP

SEQ ID NO: 33011 - DNA, 1970 bp, Panicum virgatum
  misc_feature: Ceres CLONE 1913766
  misc_feature: Encodes the peptide sequence at SEQ ID NO. 33012
agtggccgccgcggcagcaggaggtggaggagccagggaatctggagggagcgagagtggtgggggggagaagaagaaaggtggagagacttgctcctgacaaaagcgagggcgactgctgcggcggcggcaggagcaggagggaccatttcttgggctgcgatcatgaggtcgtctcggagagggaggagcggcggtagggccctgggcttgcggaggtgagagggagaagggggccttggcgacgtagagagggaatcggggtgattgggaaagagagggagggagacggagcgagggagaagatgagcttcaacaagagcaggggagcggggatcggcggcggcggaggggacgagctcgtgctcagaggctccgtctccaagaagtggaccttcctcctctgcctcggcagcttctgcgtcggcctcctcttcaccaacaggatgtggacaatgccggagccgaaagagatcatccggaggtccacactcgaagtggacaagatgaatcttgtcgccggtgactgtgctccgaaaagtatcggcgatgcaaaagacattcctggggaggttccaagaacccaagatgttatacagacactcgacaaaacgatatcaaacctagaaatggagctagcatctgcgaaggcgactcaggaatccatgctcagtgtcgccccagcatccgaatcaatagggaaacggaaatacttcatggtcattggcataaacaccgcgttcagcagccggaaaagaagagattcagtccgcgctacatggatgcctcaaggtgagaaaagaagaaagatggaggaagagaagggcattatcattcgatttgtcatcggtcatagtgcgacttccggtggtatacttgatcgagcaattgatgcagaggacaggaaacatggggacttcatgaggctggaccatgttgaagggtacctggagctggcagcaaagaccaaagcgtacttcgtcgctgccgtgtccatgtgggatgcagagtactacatcaaggtcgacgacgacgtccatgtaaatatagcaactcttggaaacacgttagctagacatcgttccaagcctcgagtttatgttggctgcatgaaatctggcccagtgctggctcagaagggtgtaaagtaccacgagcctgaatactggaaatttggcgaatgggggaacaagtacttccgacacgcgaccggtcagctctacgccatctccaaggatctggcctcctacatagcactcaaccagcatgttctgcacaaatacgccaatgaggacgtatccctgggagcctggttcatcggactagacgtcgaacacgtcgacgatcgccggctctgctgtggcacgccaccggattgcgagtggaaggcgcaggcaggcaacgtgtgcgttgcatcgttcgactggagctgcagcggcatctgcaaatctgccgaccggatcaaggaagtccatcaggcgctgcggsgagagtgagaasgcaatctggaatgcaaagttctgracacaagattttccagagaaactacactcgtttacaaggaatgcacatatacagacatatagaaagccatgggtgaacagagtgtgacaccgaagatggtgaccagacagttcactgttttgcatgttgacaaccagatgaggagtgcttgagattgagagaagaatgtacaatcaagtgtgcatgcattgtggagggcagaggggtaattcttttctgggcttctttttgggtgttttggcttcttaggaattggattattgtagggaacttttctgttttgatgcgtgaaaagatcccgggtttactcacaaagagaaggtaggagagaggggaggacaggatggggatgagactgaaaggagagggagacagggcttctccccccaccattcttggaaagatcctcatcgctgttactgtttgcttcggaatacacatattaa

SEQ ID NO: 33012 - protein, 396 aa, Panicum virgatum
  misc_feature: Ceres CLONE 1913766
  misc_feature (150)..(348): Pfam Name: Galactosyl_T Pfam Description: Galactosyltransferase
  misc_feature: SWISSPROT Homolog: EC 2.4.1.134 Galactosylxylosylprotein 3-beta-galactosyltransferase
  misc_feature: Useful for making plants with altered carbohydrate content
  misc_feature (395)..(395): Xaa is any aa, unknown, or other
MSFNKSRGAGIGGGGGDELVLRGSVSKKWTFLLCLGSFCVGLLFTNRMWTMPEPKEIIRRSTLEVDKMNLVAGDCAPKSIGDAKDIPGEVPRTQDVIQTLDKTISNLEMELASAKATQESMLSVAPASESIGKRKYFMVIGINTAFSSRKRRDSVRATWMPQGEKRRKMEEEKGIIIRFVIGHSATSGGILDRAIDAEDRKHGDFMRLDHVEGYLELAAKTKAYFVAAVSMWDAEYYIKVDDDVHVNIATLGNTLARHRSKPRVYVGCMKSGPVLAQKGVKYHEPEYWKFGEWGNKYFRHATGQLYAISKDLASYIALNQHVLHKYANEDVSLGAWFIGLDVEHVDDRRLCCGTPPDCEWKAQAGNVCVASFDWSCSGICKSADRIKEVHQALRXE

SEQ ID NO: 33013 - DNA, 1400 bp, Panicum virgatum
  misc_feature: Ceres CLONE 1913772
  misc_feature: Encodes the peptide sequence at SEQ ID NO. 33014
cttttctcgggccatcggtggactgacgggacgggagggaggaagaagaagaaggccactccctccgcaggcggggagaggagccctcgccattggctctccccgatcttcttactccaatcacaggttgagcaaccagagctgagatggaaggccatgtagggatgcaggaggggaaggatcctgatccaggcccattatccttgatgcggggcttccagaccgaagcatttctaccagacaccgaggttgccaatgccggatttgagaaggatggcttgtcggtcgccataaggtcacctcaggaggaaggtccgtcgctgccaatgaccccgcagtttggccagaagtccagtccaggcagcaccctcgctgagaggatgcaggcaagagctgggttcagggtgccaaagctcagcatgccgtccagtacagcagttgcagctgataacaaagtgccaggagctccatcgccctacctcacgatcccgcctggtttgagcccggcaacgctgctggactcaccagtcttcatttccaatgccatgggccaagcctcaccgaccacagggaagttattcatgcttggtagcacaaatgacaatgatcctattagatatggaggccctctacttggagatggccctgattcattttctttcaagcctttagatctgaaatcctcgcactacactgctgaaggaaagaaggaatctttatgcaacaatcagcctccactaccaagcacgcatgtttctgtcaagactgaaactaagattcagacagtacaagaggccaatttgctgggccaactgaacaagcagaataacagcgggcagaccaatatgaagaggagttctcatgaccccaactccaagctcagccgtcttgcaactgccggtgcaggcaatgaagacgtatcatcgctgcgcagccagcctacagaggaaggtgacacgaggggagactatccggcaatggccaccaccacaccggcagaggacggatacagctggaggaagtacgggcagaagcaggtgaagcacagcgagtacccaagaagctacttcaagtgcacgcacccgaactgccaggtcaagaagaaggttgagcgatcccacgaagggcacatcacagagatcatctacaagggcacgcacaaccacccgaagcccgcgcagagccgccggccgggcgccccgcccgtgcacccgtttgtcgagggcgcgcaagcagacacacccgacaacccaaggtcgcatacaaacacggcggaagcgaggcaggcgtggcataacaatgcggttgttaaggacctgcacggcgacggcatggacgcgacatcacccccctctgctcccggtgagctctgtgactcgtcagcgtcgatgcagatccat

SEQ ID NO: 33014 - protein, 417 aa, Panicum virgatum
  misc_feature: Ceres CLONE 1913772
  misc_feature (284)..(342): Pfam Name: WRKY Pfam Description: WRKY DNA -binding domain
  misc_feature: The sequence is a functional homolog of SEQ ID NO 1388 in the 10/412,699 US patent application
  misc_feature: The sequence is a functional homolog of SEQ ID NO 512 in the 10/374,780 US patent application
MEGHVGMQEGKDPDPGPLSLMRGFQTEAFLPDTEVANAGFEKDGLSVAIRSPQEEGPSLPMTPQFGQKSSPGSTLAERMQARAGFRVPKLSMPSSTAVAADNKVPGAPSPYLTIPPGLSPATLLDSPVFISNAMGQASPTTGKLFMLGSTNDNDPIRYGGPLLGDGPDSFSFKPLDLKSSHYTAEGKKESLCNNQPPLPSTHVSVKTETKIQTVQEANLLGQLNKQNNSGQTNMKRSSHDPNSKLSRLATAGAGNEDVSSLRSQPTEEGDTRGDYPAMATTTPAEDGYSWRKYGQKQVKHSEYPRSYFKCTHPNCQVKKKVERSHEGHITEIIYKGTHNHPKPAQSRRPGAPPVHPFVEGAQADTPDNPRSHTNTAEARQAWHNNAVVKDLHGDGMDATSPPSAPGELCDSSASMQI

SEQ ID NO: 33015 - DNA, 710 bp, Panicum virgatum
  misc_feature: Ceres CLONE 1913772-R
agcggccacccgagcacggcgacgggcgcggcggccgcgcgcaggccagagcacccctcggtgcacgacggcctgatgaggcacctgggcggctgcggcgcgctgttcggcctggcgccgccgccgtcccgggacccgctggcgccgatggtgaactacccgacgtacgccgccgccggcctcggcggtggcggcattggccccgcgtcgctgccgagcctgccgatgcccgggcaccccatggggccggtggaggggctgaagctgcccatgctggcgccgtcgccgctgcaccagcaccggctgctgaggcaccggcaggcgatgcaggccgccggcctcgtgccgcccaaggcggacgtgaaggtcgagggcagcggcgcgccgccgccgtcggtgtaccagctgatgcgcagcgggctgccgctgggccaccagatgtagataataaagagagaagagggttagagagcatggacgtgattctcaagttagctgcttaccagtcgagttaggattaattcgtgataagtattacagcgtggaaacaagcaccatcgccgcttcttgcttacgttgtttttagtttttttttttgtttcaatcaacgtttttaccttttctgttcatttgatcttcagtcaagtttttatttagtgataaaagcccttaggcaagctttattgaaaatagttacatcatttggtgcc

SEQ ID NO: 33016 - DNA, 718 bp, Panicum virgatum
  misc_feature: Ceres CLONE 1913787
  misc_feature: Encodes the peptide sequence at SEQ ID NO. 33017
cgataccgcaaggagggtggtaaggtccgtgatgcacttttccaaattcttgagaatgaggaagatgtaaccataaaacatggagctcaatcaagagagagtcgccgtgcagctacacgaggaatgcactcatcaaaattttgtctccatcctgctggagacactccctcagcctgcagattgtttgatgctcttgtcagtttatgtgttcctgttatagtgagtgattacattgaactaccattcgaagatgttatagactacagtagcatatcaatttttgtcgggacaagcaaggcagtacaacctggatacttaacttcaatgcttcgaagagtaagttcagagcggattctggagtaccagagagaaataaacaaggtaaaacgtttctttgagtatgaagatccaaatggaccagtgaatgagatatggcgccaagtatccctaaaagcaccattggtaaaattgttgattaaccgcaacaaacgcctggttgaaagaggcaccaatggaacagattgctcgtgcatatgctctacaacccctactgacatgatcacagctgggtgaagaagatggggaacccctatgaaactttttgccccatttccaagtgatcacattgcctgaatttttgacgctgtgcagctcctacgtacagcgacattaccagtaactactttcaacacaaaattactaactgctgtaatccttc

SEQ ID NO: 33017 - protein, 190 aa, Panicum virgatum
  misc_feature: Ceres CLONE 1913787
  misc_feature (1)..(125): Pfam Name: Exostosin Pfam Description: Exostosin family
  misc_feature: Useful for making plants with altered cell wall content and/or composition
RYRKEGGKVRDALFQILENEEDVTIKHGAQSRESRRAATRGMHSSKFCLHPAGDTPSACRLFDALVSLCVPVIVSDYIELPFEDVIDYSSISIFVGTSKAVQPGYLTSMLRRVSSERILEYQREINKVKRFFEYEDPNGPVNEIWRQVSLKAPLVKLLINRNKRLVERGTNGTDCSCICSTTPTDMITAG

SEQ ID NO: 33018 - DNA, 739 bp, Panicum virgatum
  misc_feature: Ceres CLONE 1913800
  misc_feature: Encodes the peptide sequence at SEQ ID NO. 33019
accacagaaatcccgccgctggtcagtgatatctccctccggcctccgcacccgccgcctgctcctcctcctcgcctcctcttcctcgccgcgaaaacaagaacccgcgcctttgcctgcttcggaatttttcgcaggtagaagaggctcgtcctgtttatcatgtcaggaggatcagctggatcttcaccatcatcaaggcgggccagctttaattctttatctagagacctagaccttccttcagaacaagggtgtctatctattgttgtacttggggcttctggtgaccttgccaagaagaaaactttcccagcactctaccaccttttcgatcagggatttatacagtctggagaagtgcatatatttggttatgctagatcaaatctttctgatgatgggttaagagaacgcattcgtggatatctcaaaggagccacggaggaagatctttcagaatttttgcagttgataaaatatgtcagtggttcttatgacaatggggagggatttgagaaattgaacaaggcaatatcagagtatgaggcgtcaagcaaatcagaaagctatcgcaggctcttttatttggcattgcctccatctgtctacccttcagtgtgcaaaatgatcagaacatactgcatgaatccatcttctcaccctggatggactagagtcattgttgagaaaccctttggaaaggacttggattctgcagaagaattaagtgcccaac

SEQ ID NO: 33019 - protein, 192 aa, Panicum virgatum
  misc_feature: Ceres CLONE 1913800
  misc_feature (36)..(192): Pfam Name: G6PD_N Pfam Description: Glucose-6-phosphate dehydrogenase, NAD binding domain
  misc_feature: SWISSPROT Homolog: EC 1.1.1.49 Glucose-6-phosphate 1-dehydrogenase
MSGGSAGSSPSSRRASFNSLSRDLDLPSEQGCLSIVVLGASGDLAKKKTFPALYHLFDQGFIQSGEVHIFGYARSNLSDDGLRERIRGYLKGATEEDLSEFLQLIKYVSGSYDNGEGFEKLNKAISEYEASSKSESYRRLFYLALPPSVYPSVCKMIRTYCMNPSSHPGWTRVIVEKPFGKDLDSAEELSAQ

SEQ ID NO: 33020 - DNA, 1695 bp, Panicum virgatum
  misc_feature: Ceres CLONE 1913822
  misc_feature: Encodes the peptide sequence at SEQ ID NO. 33021
gatcacaagcagacgctaccaccccacacttccgtcttctttcctcagctgctgctccagtggcccacccactcgcggtcaaaatgccccccgccagcgccggcgcagccgtcctgaggcgggcccacctcgccggcgtccactcgttggccggccgccggcagccgggggtggaccgcgtctcgatgcttccagcggcggccccgccgctgccgccgctcgtctcatggcagcagggatctggagtggttgctaggaggcgcctctcggcgaatgcgagtggttccttcgagcagaataacacctgggaggaatcggtattgccttcacaggtagtggaggagagtaaagtagatttcctgaagatcctgaagagtgccaacaccgttattccccatatagtgctagggagcacaattctggctctggtgtacccgccttcttttacatggttcacaaccaggtattatgcaccagctttgggattcttgatgtttgctgttggtgtgaactcaagcgtcgaggattttatcgaagcaataaaaaggcctgatgccattgctgtcggttatatcggacagttcatcatcaagcctttgtttggatatcttttcggcactcttgcagttacagttcttaatcttccaactgctctaggtgctggtatcatgttagtttcatgtgtgagcggagcacagctttcaaactatgcaactttcctgacagatccacatatggctcctctcagcattgttatgacatcactgtcaacagcaactgcagtttttgtcaccccaacattatcttactttctcattggccagaaattacctgtagatgtcaaagggatgatgtccagcattcttcaaattgttgttgctccaattgcagctggattgctactgaatagattccttccaaagctctgtgcagctattcagccatttctccctccgttggcagtatttatcactgctttgtgtgttggctcaccattggctataaatattagggctgttttgtctccatttggattatccatcgtgctgctcctttttgccttccatacctcatcttttgtagctggttatcagcttgctggtacttggtttcgcaagtcagccgatgtgaaggcacttcaaagaacagtatcttttgagacaggaatgcaaagtagccttcttgctcttgctttagcaaacaagtttttcccagatccactagtgggtgtgcctccagccgtatcggttgtgctgatgtccttaatgggttttgctctcgtgatggtatggtccaagaaaacaaaaacgtagcaagccatgaactgaatcaacacagccttgtaatcagacatcgccataccccttgtcaaaaattttagccaggctaacttgagccaagaagacactttgggccactgttcatcggaggtcagaattgctgccaaatgatcatcatggcacaggatccagctcaccctttttttttctcccatttccatattcatatctgatattggttctgtgaaccaaagatttcaagtgtcccgaactcttctagaattgcaaaaaactcatgtgaaagattctcggtaactcatggtgggataggatcataggatgggatgcctcttcgacaagaaacaaatggccttgctcttgactctggtggttgactagttttccggagttcatc

SEQ ID NO: 33021 - protein, 409 aa, Panicum virgatum
  misc_feature: Ceres CLONE 1913822
  misc_feature (130)..(315): Pfam Name: SBF Pfam Description: Sodium Bile acid symporter family
MPPASAGAAVLRRAHLAGVHSLAGRRQPGVDRVSMLPAAAPPLPPLVSWQQGSGVVARRRLSANASGSFEQNNTWEESVLPSQVVEESKVDFLKILKSANTVIPHIVLGSTILALVYPPSFTWFTTRYYAPALGFLMFAVGVNSSVEDFIEAIKRPDAIAVGYIGQFIIKPLFGYLFGTLAVTVLNLPTALGAGIMLVSCVSGAQLSNYATFLTDPHMAPLSIVMTSLSTATAVFVTPTLSYFLIGQKLPVDVKGMMSSILQIVVAPIAAGLLLNRFLPKLCAAIQPFLPPLAVFITALCVGSPLAINIRAVLSPFGLSIVLLLFAFHTSSFVAGYQLAGTWFRKSADVKALQRTVSFETGMQSSLLALALANKFFPDPLVGVPPAVSVVLMSLMGFALVMVWSKKTKT

SEQ ID NO: 33022 - DNA, 694 bp, Panicum virgatum
  misc_feature: Ceres CLONE 1913839
  misc_feature: Encodes the peptide sequence at SEQ ID NO. 33023
accccccactccttctccacggcccccgccgccggcgccagcgccgccgtctccatcgccaccgccgtttcctgcgcctccccgaccccgaccgtctccgcgggctcctcctccccctcctccgcggggccgctcgacttcgccgcgcaccacaccgcggaggggatggaggcggaggccgcgccgcgccagcgcgcctacgaggcctgccccgccaagtactccgagtacacgccctgcgaggacgtggaccgctccctccgcttctcgcgcgaccgcctcgtctaccgggagcgccactgcccgtcctccgacgccgagcgcctccgctgcctcgtgccggcgcccaggggctaccgcaacccgttcccgtggcccgccagccgcgacgtcgcctggttcgccaacgtcccgcacaaggagctcaccgtcgagaaggcggtgcagaactggatccgcgtcgacggcgacaagttccgcttccccgggggaggcaccatgttcccgcgcggcgccgacgcctacatcgacgacatcgggaggatcatcccgctccgcgacggatccatccgcaccgccctcgacaccggctgcggggttgcgagttggggagcctacttgctgtcgcgcaacatcctggccatgtccttcgcaccgcgagattcacatgaggcacaggtgcagtttgcactgg

SEQ ID NO: 33023 - protein, 231 aa, Panicum virgatum
  misc_feature: Ceres CLONE 1913839
  misc_feature: The sequence is a functional homolog of SEQ ID NO 2432 in the 10/374,780 US patent application
  misc_feature: The sequence is a functional homolog of SEQ ID NO 558 in the 10/412,699 US patent application
  misc_feature: The sequence is a functional homolog of SEQ ID NO 730 in the 10/225,066 US patent application
  misc_feature: The sequence is a functional homolog of SEQ ID NO 2740 in the 10/374,780 US patent application
  misc_feature: The sequence is a functional homolog of SEQ ID NO 388 in the 10/225,066 US patent application
  misc_feature: The sequence is a functional homolog of SEQ ID NO 758 in the 10/412,699 US patent application
  misc_feature: The sequence is a functional homolog of SEQ ID NO 1593 in the 11/479,226 US patent application
  misc_feature: Useful for making plants with altered cell wall content and/or composition
  misc_feature: The sequence is a functional homolog of SEQ ID NO 560 in the 10/412,699 US patent application
  misc_feature: The sequence is a functional homolog of SEQ ID NO 354 in the 10/374,780 US patent application
  misc_feature: The sequence is a functional homolog of SEQ ID NO 72 in the 10/225,068 US patent application
  misc_feature: The sequence is a functional homolog of SEQ ID NO 910 in the 10/225,066 US patent application
  misc_feature: The sequence is a functional homolog of SEQ ID NO 64 in the 10/666,642 US patent application
  misc_feature: The sequence is a functional homolog of SEQ ID NO 556 in the 10/412,699 US patent application
TPHSFSTAPAAGASAAVSIATAVSCASPTPTVSAGSSSPSSAGPLDFAAHHTAEGMEAEAAPRQRAYEACPAKYSEYTPCEDVDRSLRFSRDRLVYRERHCPSSDAERLRCLVPAPRGYRNPFPWPASRDVAWFANVPHKELTVEKAVQNWIRVDGDKFRFPGGGTMFPRGADAYIDDIGRIIPLRDGSIRTALDTGCGVASWGAYLLSRNILAMSFAPRDSHEAQVQFAL

SEQ ID NO: 33024 - DNA, 1382 bp, Panicum virgatum
  misc_feature: Ceres CLONE 1913845
  misc_feature: Encodes the peptide sequence at SEQ ID NO. 33025
atattattcctcccgtccccggcttgtgggctgcctgccttgccttgtcccttcttccacggttccacctccccccaacggcacgagcccgacccctccagcgcacgcgctctccaaatagcggagcggaaggggacagaagccacgagtccaccacctctcccccgtcgcgtcgcgtcgcgtcgcgtcgcgcgagcgcactccgagagccgaatcggagcgcgaggcagcacccccggggcggatcgagcctagggctaggacatgggcggaggggacgccgacgccgccggcgagcccgcggccgctcaggcgacgctgcacatccggtgcaccaacggctccaagttcgccgtgcgggccgacctgggcgccaccgtcggcgccttcaaggcgatcgtcgccgagagctgcgacgtgccggccccgcagcagcggctgatctacaagggccggatcttgaaggacgagcaaaccctagccagctacggtgtagagacagatcatacgattcacatggtacgaggtgctgtgccaccaccagcatcaactgcacctgcagctaaccaagaaacttccactactgctcctgccagttccccagcagcaggattgggtggcttgttgccaggtcttggtgctacaggggctgctaataatcgagggttggatttgtttggatctggcctcccagaattagaccagatgcaacaacagctagccgacaaccccaatttgatgagggaaataatgaatatgccactcatgcagaatttattgaatagtcctgatctcatacgcaatataataatgaataatcctcaaatgcgtgagctcattgatcgcaatccagatcttgcccatgtcctcaatgatccaagcatcctgcgccagactgttgaagcagctaggaatcctgaacttatgagggagatgatgcggaacacagatagagccatgagcaacattgaatcttctccagaaggtttcaacatgctccgtcgcatgtatgaaactgtccaagagccttttctgaatgcaacaacaatgggtggtgagggtgatcgaaatgcaaacccatttgcagctcttctaggaaatcaggggactaaccaaccaagggacccagccgcaaatgcaccaactacagcttcagaccctgcagcagggtctccagctccagctccaaatactaatccacttccgaatccctggggctcaaatgctggctctgcccaaggagcagcaaggccccctcctgctagcaacaccaacacaaggactgctacagcaggtggtctaggagggttgggttcagcagatctgggaggtgtgcttggtggtggtgctgatgcttccttcttgagtcaggttttgcaaaa

SEQ ID NO: 33025 - protein, 372 aa, Panicum virgatum
  misc_feature: Ceres CLONE 1913845
  misc_feature (22)..(90): Pfam Name: ubiquitin Pfam Description: Ubiquitin family
MGGGDADAAGEPAAAQATLHIRCTNGSKFAVRADLGATVGAFKAIVAESCDVPAPQQRLIYKGRILKDEQTLASYGVETDHTIHMVRGAVPPPASTAPAANQETSTTAPASSPAAGLGGLLPGLGATGAANNRGLDLFGSGLPELDQMQQQLADNPNLMREIMNMPLMQNLLNSPDLIRNIIMNNPQMRELIDRNPDLAHVLNDPSILRQTVEAARNPELMREMMRNTDRAMSNIESSPEGFNMLRRMYETVQEPFLNATTMGGEGDRNANPFAALLGNQGTNQPRDPAANAPTTASDPAAGSPAPAPNTNPLPNPWGSNAGSAQGAARPPPASNTNTRTATAGGLGGLGSADLGGVLGGGADASFLSQVLQ

SEQ ID NO: 33026 - DNA, 688 bp, Panicum virgatum
  misc_feature: Ceres CLONE 1913845-R
  misc_feature: Encodes the peptide sequence at SEQ ID NO. 33027
tgtacgtaatatgatggaatcgaatactcaactaagagaaatgtttcagaatccagaatttcttcgccagttgacatctcctgaaacattgcagcaattaatttcattccagcagtccttgatgtcacaacttggccaacaacaaactggacaggagcatacacgatcaggcactagtgcaggcaatgtcaacctcaacaccttgatgaacatgttcaccgggcttggtgctggtggtggcctaggtgttccaaatgcccctaatgtgcctccagaagagctgtatgcaacacagctagctcagctccaagaaatgggtttctttgacacacaggagaacctccgagccttgattgcttccgctggaaatgttcatgctgcagtggagcgacttctcgggaatttgggccaatagaatgtgataactgtactcccatcctatgacctgtaattggcattgtaagatcctgtttggtccattggttttacacccggtgagatttgagaggcggcatctatattctgtgttctaagacgaataaacgagtgtgccagtggaaccttgcatataaatgggctctggtgtcattgttaaaattggtgttgttgatacccttgggttgttgtacatacatactattgaattaccgggtctcactgcaatgcacatggccgatgtcttgtagcc

SEQ ID NO: 33027 - protein, 137 aa, Panicum virgatum
  misc_feature: Ceres CLONE 1913845-R
  misc_feature (94)..(131): Pfam Name: UBA Pfam Description: UBA/TS-N domain
VRNMMESNTQLREMFQNPEFLRQLTSPETLQQLISFQQSLMSQLGQQQTGQEHTRSGTSAGNVNLNTLMNMFTGLGAGGGLGVPNAPNVPPEELYATQLAQLQEMGFFDTQENLRALIASAGNVHAAVERLLGNLGQ

SEQ ID NO: 33028 - DNA, 728 bp, Panicum virgatum
  misc_feature: Ceres CLONE 1913861
  misc_feature: Encodes the peptide sequence at SEQ ID NO. 33029
agggagagggtggggaggagaggccgccaccaggccaactaccaagtgggggaggaccgggccggaggtggggggatttctcgggggaggagtgcccgggaggacctgattgggggctccgggccgccatctctgagcgcagatttggtgcctgcgatctgccatggattcgatttagtcgtagaagaagaggagcaaataaagcaacaggaggaagaatttctcggggtgggcaaagggagaaggcatgatgctggaagggcagtcctacctcgtctcgcgctccctgccgagctcctgcgagccggagacggagtgggcgtacctcgcagaccaagtcctcagcggcaagcgccccgctccggaagatgtcgaggaagctgacggcggcggcaagcgcagcaagccgccgtctccgcagccgcacacgccggacatcaccgagggccacggctccagccgccatgcctccggtggtggggagccgcagggcactgggagcaaccccattaattctatcggccgtgacctgaccatcaattgcctcctccggctatcccggtcggactacggctcggtggcctccctcagccgcgacttccgctccctggtccgcagtggggagatctaccgcctgcggcgccggaatggggtggcggaacattgggtctacttctcctgcaatgttcttgaatgggatgcatatgacccctatcgagatcgctgga

SEQ ID NO: 33029 - protein, 160 aa, Panicum virgatum
  misc_feature: Ceres CLONE 1913861
  misc_feature (86)..(133): Pfam Name: F-box Pfam Description: F-box domain
MMLEGQSYLVSRSLPSSCEPETEWAYLADQVLSGKRPAPEDVEEADGGGKRSKPPSPQPHTPDITEGHGSSRHASGGGEPQGTGSNPINSIGRDLTINCLLRLSRSDYGSVASLSRDFRSLVRSGEIYRLRRRNGVAEHWVYFSCNVLEWDAYDPYRDRW

SEQ ID NO: 33030 - DNA, 713 bp, Panicum virgatum
  misc_feature: Ceres CLONE 1913888
  misc_feature: Encodes the peptide sequence at SEQ ID NO. 33031
gtgctctctcagaggtgggttggcttctcctccccctccggttcgcggttcggttcggtccgggttcgtgaggttcttgggggtgagaggaagagatggcggcgtcggatgttgagtaccgctgcttcgtcggcggccttgcctgggccaccgacgacaactcgctccacaacgccttcagccccttcggcgaggtcctcgagtccaagatcatcctcgatcgtgagacccagaggtcccgcggcttcggcttcgtcaccttctcgagcgagcaggcgatgcgcgatgccatcgaggggatgaacggcaaggagctggacggccgcagcatcaccgtcgccatggccaccgaggaagccgccaagccgtccccgctcccgccctacccggaggtaaccactaccctcggcccgtcgctgtccgcttcttgcgctgcccttttattttgtgcttcttttttgttggggctgttgtttccggcgaggatttgttgcttggatccggatttgggatgcgggcgttcttgatgcgtgtttcttgggtttttttgtcggaaaacattgcgtctccctgggcagaaaattgttttttttttggttttgggtgtcgagaaatgggatggagtgagatctccgtgagctgacggcgcggcgtggttgttggggcagatgatcctggcggcgatcgaggggctgggcgacaagaacgggtcc

SEQ ID NO: 33031 - protein, 143 aa, Panicum virgatum
  misc_feature: Ceres CLONE 1913888
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with altered lignin content
MAASDVEYRCFVGGLAWATDDNSLHNAFSPFGEVLESKIILDRETQRSRGFGFVTFSSEQAMRDAIEGMNGKELDGRSITVAMATEEAAKPSPLPPYPEVTTTLGPSLSASCAALLFCASFLLGLLFPARICCLDPDLGCGRS

SEQ ID NO: 33032 - DNA, 688 bp, Panicum virgatum
  misc_feature: Ceres CLONE 1913891
  misc_feature: Encodes the peptide sequence at SEQ ID NO. 33033
aggcatgcaaatggaagagcagcagggcagcagcatggccgccgatccggcgaccgcagtcctagtggcgctgatcgcggccgccgccaccgccgtggccttgcaccacctcctctcctggtggcgcctgcaggccccccggctgcccccgggcccgacgagcctcccggtgttcgggcacctccacctgctccggccgccggtccaccgcaccttccaggagctggcgtcccgcgtgggcccgctgatccacatccgcctgggctccacgcactgcgtggtggccagcaccgccgaggtggccggcgagctgatccgctcccacgagggcagcatctcggagcggccgctcacggcggtggcgcggcagttcgcctacggctcggcgggcttcgccttcgcgccctacaacgcgcactggcgcttcatgaagcgcctctgcatgtcggagctcctcggcccgcgcaccgtcgagcagctgcgccccgtccgccgcgccggcgccgtggtgctgctgcgcgccgcgctggcggcgtcggcgcgcggcgaggcggtggacctcacccgcgagctcatccgcctcgccaacacctacgtcatccggatggtcgccagcaacgtgcccgggagcgtcgccgacgaggcgcacgagctcgtcaaggccgtcgccgagctcctcggcgccttt

SEQ ID NO: 33033 - protein, 217 aa, Panicum virgatum
  misc_feature: Ceres CLONE 1913891
  misc_feature: SWISSPROT Homolog: EC 1.14.13.87 Licodione synthase
MAADPATAVLVALIAAAATAVALHHLLSWWRLQAPRLPPGPTSLPVFGHLHLLRPPVHRTFQELASRVGPLIHIRLGSTHCVVASTAEVAGELIRSHEGSISERPLTAVARQFAYGSAGFAFAPYNAHWRFMKRLCMSELLGPRTVEQLRPVRRAGAVVLLRAALAASARGEAVDLTRELIRLANTYVIRMVASNVPGSVADEAHELVKAVAELLGA

SEQ ID NO: 33034 - DNA, 1797 bp, Panicum virgatum
  misc_feature: Ceres CLONE 1913906
  misc_feature: Encodes the peptide sequence at SEQ ID NO. 33035
gtgagtgcgaagcaacaataatgaagctacaatcagagcgtttaaaaacaaattgccctctagagaagatgaataggtaagtcttaaagtctccccaggttcctcatagtatagaaagatcttccgtccctaaagttttgccatggcagaggctttcatatctgcagtcatcagtgacatggttagcagggcaatctctattcttattggtcgttctactggacaagaaagcatcaatgcaaagttaacaaggatacatcatatgctgatcaagattggaagtgcggtcgaggaggccaaggggaagcagatcactaatcatggaactcttgagtggctctcagagctcatcagtggtatgtaccaaggtcgttacttccttgacatatcaaagggtggatcacaaaaccttgtagatgtcaatgataacaagggtgtaccctatcctttcttattgtcatctttcaatcctgcgaagcgcttacgcatttctgcaagtagtatcaagaccctattttcaaatgatgatagcattcttgagatcaacaacgttttagcaaatttgcagaacttatcagttggcataagagagtttgtcatgctgttagacaactgcccaccaatccttaaacctcttaggactaacctttatgtggattgtgagatgtttggccggcatgttgaaagagagagggtcatcaactttttattacacaaaggcaatccctcagaaaggaagttagatattcttcctattattggcaatgttggtgttggaaagacaacccttgtgcagcatgtttgtgaagatgtgagggtacgcagccacttctcatcaatcttgttgtctgatttcttcactttgacagttatggaaaatagtgagacaaggatagtccttaattctaagtacagcacaggtgacttcggaaatttcaatggtttgctgcaaacattcaagcgcaagttgaacaataaaaggttcctgatggtatttgagaatgttgattcggagaagaaacaaatgttgcaagtgctcttgtcgaacctaggatcctgtaaacaagggagcaaggtcattgtaaccagtcctcacaaccacactgccagcatcggaactgtgcaaccgatcaaacttagcatcctaccatgtgaaaagttctggttctacttcaaggcgcttgcatttccagatgcagattttgaggagaatttcccaaggatggcagcaataggtatggcgatggcaaagaagctgaacgggtcattttttggagctaagattattggagctctactaaaggttcatcctaatatccagttctggagtgaggctttgagaagtagtatttgggatctcccagttcttggcagtagcctcccctatatttcggatgtggccaattacttcctccccagacaggtaacaatgtgtcatgtcaacatgcacacaagcaaaacaaatttcgagaacagagcactctctacgttacaagatgtttgtatccagagtagtccacccattgggaagaagaaaatattggatgataagggtaatgcgctcaacttgcacgtcttgttgtgcaaatcagtattgccgttccattgtgtgtactatgtcgctcactgtcatgtaagggcggctagggatggatgtggattatctgaattattccactgccgaaacgtattggatgcagacatggtctcttgtaacattcctgctttgattctttcttctccaggtggttcaagctcctatgtataattttatcagtaataaagcatgaacaactg

SEQ ID NO: 33035 - protein, 541 aa, Panicum virgatum
  misc_feature: Ceres CLONE 1913906
  misc_feature (161)..(455): Pfam Name: NB-ARC Pfam Description: NB-ARC domain
MAEAFISAVISDMVSRAISILIGRSTGQESINAKLTRIHHMLIKIGSAVEEAKGKQITNHGTLEWLSELISGMYQGRYFLDISKGGSQNLVDVNDNKGVPYPFLLSSFNPAKRLRISASSIKTLFSNDDSILEINNVLANLQNLSVGIREFVMLLDNCPPILKPLRTNLYVDCEMFGRHVERERVINFLLHKGNPSERKLDILPIIGNVGVGKTTLVQHVCEDVRVRSHFSSILLSDFFTLTVMENSETRIVLNSKYSTGDFGNFNGLLQTFKRKLNNKRFLMVFENVDSEKKQMLQVLLSNLGSCKQGSKVIVTSPHNHTASIGTVQPIKLSILPCEKFWFYFKALAFPDADFEENFPRMAAIGMAMAKKLNGSFFGAKIIGALLKVHPNIQFWSEALRSSIWDLPVLGSSLPYISDVANYFLPRQVTMCHVNMHTSKTNFENRALSTLQDVCIQSSPPIGKKKILDDKGNALNLHVLLCKSVLPFHCVYYVAHCHVRAARDGCGLSELFHCRNVLDADMVSCNIPALILSSPGGSSSYV

SEQ ID NO: 33036 - DNA, 520 bp, Panicum virgatum
  misc_feature: Ceres CLONE 1913916
  misc_feature: Encodes the peptide sequence at SEQ ID NO. 33037
agagccgctctcaccatcctaactaagaaaggactgaaacactccgtcgagatctcatgtgtaaccggatccgagtgggagagcccgggctagggcctgcctccaggtggtagcgaggctagccgagcaagtagaggaggacgacatgaagagcagtcgatggcctcgggtggtaccctggtcacgtccacgatccttcccaagaagtccgaatggggcgcgagcagggttgcagggcgtcccaggccggtcaccgtgtccctggtgggcctccgcgacagcgccggccgccacgagctcgtcaagactgcgaaatgggtggcgtcgccggtgcggggcatccttggcatggacaagcccaaggcgacgtgcgggatgcggctggcggccatcgggctggagaacgccgatgcgagccggctggggtactgcacgctactggggacgcgcgccggggctggggccgtgcatcacctgcggaggcgtctacgaggacacgctctgcgagaccgccgacgac

SEQ ID NO: 33037 - protein, 120 aa, Panicum virgatum
  misc_feature: Ceres CLONE 1913916
  misc_feature: SWISSPROT Homolog: EC 4.1.2.13 Fructose-bisphosphate aldolase
MASGGTLVTSTILPKKSEWGASRVAGRPRPVTVSLVGLRDSAGRHELVKTAKWVASPVRGILGMDKPKATCGMRLAAIGLENADASRLGYCTLLGTRAGAGAVHHLRRRLRGHALRDRRR

SEQ ID NO: 33038 - DNA, 1425 bp, Panicum virgatum
  misc_feature: Ceres CLONE 1913942
  misc_feature: Encodes the peptide sequence at SEQ ID NO. 33039
gcaacccctcccaaagcccgcggcggcagcagagcaggccaggccagcgcctcccacccatctcccccgcctccgcccccgccgccgccgcgcccgggtccgttccgagatggggcaggaggcccaccaccaccacgcgctccccacgtccgccgccgccgcggacgccgccggcgcctccccggccgcggcggcctccaggctcttcacggcggggctggtggcgacgtggtacgcctccaacatcggggtgctcctcctcaacaagtacctcctctccgtctacggcttccgataccccgtcttcctcaccgcctgccacatgtccgcctgcgccctcctctccagcctcgcccacgcctacgccggggccgcccccgcccgccgccgctcgcgggggcagctcgccagggtcgccgtgctcggcgccgtcttctgcgcctccgtcgtcgccgggaacgtctccctccgctacctccccgtctccttcaaccaggccgtcggcgccaccacgcccttcttcaccgccatcctcgcctacgccgtcgccgcgcgccgggaggcatgcgccacctacgccgcgctcatccccgtcgtcgccggcgtcgtcatcgccacggggggcgagccgagcttccacctctttggtttcatcatgtgcgtcggagccacggccggaagggcgctcaagaccgtgctgcaggggatcttgctatcatcagaagaggagaagatgaactccatggacctcctccgttacatggcacccgtggccgtcatcctgctggttccagcaacattgatcatggagcgtgaagcatttggtgtggtggtcaccctcgcacgggaggaccccaatttcatctggatcctgctctgcaactcctcgatggcctactttgtgaacctgacgaacttcctggtcaccaagcacaccagcccactcactcttcaggttcttgggaatgcaaagggcgctgtcgctgttgtggtctccatcctgatattcaggaacccggtaacattcatggggatgctaggctatgggattacagtcgccggggttgttctgtatggcgaggccaagaaaaggagcaagtgagggcccagcctggtgagaagctgctgcctcttctgtgtcagctccttcacgcctggagatgctaagtggtctgagctgctctgatggaatcatggtgatggtatgtggaagacaagcacatcggtccctttttttcgcatggtctggagttgcaatttgagctgctaaactgtaggaatctgggatgtccaacttggcgtttggcttcatgtcattgagatgtatttatccttgtaacaatatttatgtagattccagatgtacaaccagctgtttgtacagcttattggtgcttaccagagaatacaaacatcatgatgatc

SEQ ID NO: 33039 - protein, 330 aa, Panicum virgatum
  misc_feature: Ceres CLONE 1913942
  misc_feature (180)..(324): Pfam Name: TPT Pfam Description: Triose-phosphate Transporter family
  misc_feature: Useful for making plants with altered cell wall content and/or composition
MGQEAHHHHALPTSAAAADAAGASPAAAASRLFTAGLVATWYASNIGVLLLNKYLLSVYGFRYPVFLTACHMSACALLSSLAHAYAGAAPARRRSRGQLARVAVLGAVFCASVVAGNVSLRYLPVSFNQAVGATTPFFTAILAYAVAARREACATYAALIPVVAGVVIATGGEPSFHLFGFIMCVGATAGRALKTVLQGILLSSEEEKMNSMDLLRYMAPVAVILLVPATLIMEREAFGVVVTLAREDPNFIWILLCNSSMAYFVNLTNFLVTKHTSPLTLQVLGNAKGAVAVVVSILIFRNPVTFMGMLGYGITVAGVVLYGEAKKRSK

SEQ ID NO: 33040 - DNA, 1466 bp, Panicum virgatum
  misc_feature: Ceres CLONE 1913947
  misc_feature: Encodes the peptide sequence at SEQ ID NO. 33041
  misc_feature (1403)..(1403): n is a, c, t, g, unknown, or other
gtcgctcgctcgctcgggtataattgcagcgcaaaatccccgaaaggctcccacgaatgaattgatcatcgccgctctccattccgagaaggaaaaatcattcatttgaccccgcagattcgctgctcatacatactactactctcgcggacgcggcggccggcggcgctcgatccccgcgcgcccggcgggacccggcggcgtcctcggcctcgggccaaatgcggcggccccggtgggacgcttgagcggccggcgctccgtttactcgcagggcgcgcgcccaagggctccccgtctccctcccccgaatcgcccggcagttattttattacccaaagatggttcatcaaaagcgagatgaggcgacagcagatgaaaccagcatctcgacacagcctccctcctataatctatctcaagcgccacctgtgtacaaagtcgggtatcctcctcagaagaacctcaccacagagtttacgaacacactgagggagacattcttccatgacaatccactaaagcagtataaggaccaatctggatcgacaaagtttaaaatgggcttgcagttcttgttcccagtctttgattggggtaggacttacaacttgagcaagttcaaaggtgatctgattgccggattgacaatcgcaagtctctgcatccctcaggatattggctactcaaagcttgcttatctggatccacagtatgggctttactccagctttgtccccccattgatatatgctgcaatgggtagctcaagggatatagcaattgggccagttgcagtggtatctcttctaataggttcactcctacaaaatgaagttgatcatgaaaagaacaaggaagaatacttgtgtcttgcttttacagcaaccttctttgctggtattactcaagcagccctgggatttctaaggttaggattcctcatagagttcttgtcgcatgctgcaattgtcggattcatgggaggagcagcaatcactattgccctgcagcagctcaaatatgtgttgggaatcaggaacttcacaaaggaaactgatataatttctgttatgaagtctgtttggggctcggttcatcatgggtggaactggcagacagttgtgattggcttctctttcctcgcttttcttcttcttgcaaagtacattgggaaaagaaataagaagtatttctgggtgccagctattgctcctataacttctgtcattcttgctaccctttttgtataccttttccgtgctgacaaacatggtgttcaaattgtgaataatatcaagaagggcatcaacccatcatctctgcacaagatttatttcaccggtccatttgttgcaaaaggtttcaagatcggtgttgtctgcggcatgatcggtttgacngaagccgtggcgatcggaaggacatttgctgctgtgaagggctaccagttagatggaaacaag

SEQ ID NO: 33041 - protein, 374 aa, Panicum virgatum
  misc_feature: Ceres CLONE 1913947
  misc_feature (193)..(374): Pfam Name: Sulfate_transp Pfam Description: Sulfate transporter family
MVHQKRDEATADETSISTQPPSYNLSQAPPVYKVGYPPQKNLTTEFTNTLRETFFHDNPLKQYKDQSGSTKFKMGLQFLFPVFDWGRTYNLSKFKGDLIAGLTIASLCIPQDIGYSKLAYLDPQYGLYSSFVPPLIYAAMGSSRDIAIGPVAVVSLLIGSLLQNEVDHEKNKEEYLCLAFTATFFAGITQAALGFLRLGFLIEFLSHAAIVGFMGGAAITIALQQLKYVLGIRNFTKETDIISVMKSVWGSVHHGWNWQTVVIGFSFLAFLLLAKYIGKRNKKYFWVPAIAPITSVILATLFVYLFRADKHGVQIVNNIKKGINPSSLHKIYFTGPFVAKGFKIGVVCGMIGLTEAVAIGRTFAAVKGYQLDGN

SEQ ID NO: 33042 - DNA, 724 bp, Panicum virgatum
  misc_feature: Ceres CLONE 1913947-R
  misc_feature: Encodes the peptide sequence at SEQ ID NO. 33043
tacaggaacacggatcagtatccagatgcaaggcatgttcctggggtggtaatagtgagggttgattccgctatctatttctccaactccaattatatccgggagagaattcttaggtggttaacagctgaagaagagagagtcaaggcagagggactgtctagaatcaatttcttgatagtggagatgtcacctgttatagatattgacacaagtggtatacatgcccttgaagatctgcacaagaatcttcagaagagaagcattcagctcctcctatcaaatcctggctccatcgtcattgagaagctccagtcgtcgaaactaactgagcacatcggaagcaatcacattttcctgacagttgctgacgccgtgcgtttctgcacttcaaagtcgatgcaagagccctgaactgaaatggatttacgtcaggcatcttgctgatgtttgtgccaaatttggttatctacacatctgcattctagtatataaatcatgtaatgacgttacaagatcacaaatcataggatattttcgaaggtggtgccggctgttgcttaacgcgagagtgggcgataacatttcaaacagatgtaattctgttgttttgacttttgaacactgcttacagacacgtggatagggttaatgtatagctaaatgctgtgatctgagtccctcattcgtttccgaaatgaatgaaagaaagaaaaattaccag

SEQ ID NO: 33043 - protein, 137 aa, Panicum virgatum
  misc_feature: Ceres CLONE 1913947-R
  misc_feature (7)..(125): Pfam Name: STAS Pfam Description: STAS domain
YRNTDQYPDARHVPGVVIVRVDSAIYFSNSNYIRERILRWLTAEEERVKAEGLSRINFLIVEMSPVIDIDTSGIHALEDLHKNLQKRSIQLLLSNPGSIVIEKLQSSKLTEHIGSNHIFLTVADAVRFCTSKSMQEP

SEQ ID NO: 33044 - DNA, 755 bp, Panicum virgatum
  misc_feature: Ceres CLONE 1913969
  misc_feature: Encodes the peptide sequence at SEQ ID NO. 33045
gagatcttcagctccgggccccgtgcccccgtgtggattagtcgctgtcacgttcgacgaggggcgccaattgcggtggccaccacctccaatccactccccgcagccgccgcgccgagctgttcttgctctgtcctcctaacgtcctccctaccatccccaagatttgatctttagacccagttcctgcgcccagttcttcctaaggcggaggggtggttgcttctccgggctctgaggttggaatcttgtcccgctcacaaggtttagtcttgattggtctcatctgctcagctgtctggttgcaagcttagaactggaaggaataatttgactagagaaatgggacagtgttgcagcagagctacggccccagattctggacggggaggtgccaatgggtatggctattctaaccaggcaaagccagcacaaacacttcccagttacaatgctcctcagccacaggccgaggtacggtacacgccgccggcgatgaaccctccggtagtcccacctgtaattgtcccaccgaagcccactgcagacacaattcttggcaagccgtatgaggatgtgcgcacagtctactccctcgggaaggagcttggccgcggccagttcggggtgacgtacctctgcacagagattgctactggtaggcagtacgcgtgcaaatccatctctaaacgcaagctcaccagcaaggcagacagggaggacattcgcagggagatccagatcatacagcactg

SEQ ID NO: 33045 - protein, 137 aa, Panicum virgatum
  misc_feature: Ceres CLONE 1913969
  misc_feature: SWISSPROT Homolog: EC 2.7.11.1 Non-specific serine/threonine protein kinase
MGQCCSRATAPDSGRGGANGYGYSNQAKPAQTLPSYNAPQPQAEVRYTPPAMNPPVVPPVIVPPKPTADTILGKPYEDVRTVYSLGKELGRGQFGVTYLCTEIATGRQYACKSISKRKLTSKADREDIRREIQIIQH

SEQ ID NO: 33046 - DNA, 596 bp, Panicum virgatum
  misc_feature: Ceres CLONE 1913974
  misc_feature: Encodes the peptide sequence at SEQ ID NO. 33047
gcaaaccattcccctcccccttctagatggagagatagagaagaaaagataagctcagctcagctcgcaagcaagaggtggagatgcggagcccacgaggaggagggcgcgcccatgagcacgtcgacctgatcccgggcatccccgacgacgtcgccgtcgactgcctggcgcgcgtgccccacgcgtcccaccgcgcgctgcgccgtgtctgccgcggctggcggagcgccgccgccgcgccggccttcgccgcggcgcgcgccgccgcgggtgccaacgaggacctcgtctacatgctgcaggtcaggaacccctccgccgccgccgactccgactacggcaggcccaaggactgcggcgcgccgcccagcgcgaccgcctacggcgtccctgtctacaacgtgaccacgggcgagtggcgccgggagcgcggcgcgccccccgtgctgcccgggttcgcgcagtgcggcgcgttgggcacccgcgtcgcgatgctcgggggctgggacccgcgtccttcgagcccgtcgccgacgggaagatactcaaggccgtctggggcgcgtggcgccgcgccgcgcctacgcgctcgg

SEQ ID NO: 33047 - protein, 170 aa, Panicum virgatum
  misc_feature: Ceres CLONE 1913974
  misc_feature (15)..(62): Pfam Name: F-box Pfam Description: F-box domain
  misc_feature: SWISSPROT Homolog: EC 2.7.11.1 Non-specific serine/threonine protein kinase
MRSPRGGGRAHEHVDLIPGIPDDVAVDCLARVPHASHRALRRVCRGWRSAAAAPAFAAARAAAGANEDLVYMLQVRNPSAAADSDYGRPKDCGAPPSATAYGVPVYNVTTGEWRRERGAPPVLPGFAQCGALGTRVAMLGGWDPRPSSPSPTGRYSRPSGARGAAPRLRA

SEQ ID NO: 33048 - DNA, 748 bp, Panicum virgatum
  misc_feature: Ceres CLONE 1913978
  misc_feature: Encodes the peptide sequence at SEQ ID NO. 33049
atctctctccgcaatggcggccgccacagcagccgcggccgcagccctcctctccggcggcagcggcccaatccccagcacaacccttcaaatccagccctttgtttctccccttccctttcgccgccgtggtcgcaccgtacacgtctccaacgcctcgtcgtccccgtcttccccaccgacgccggagaaggaggcggtggccgaagcggttccgttgcctaccgcggaatcctgcgtcaacctcggcctcgagctcttctccaagggcagggtgagggatgctcttgaccaatttgagaatgccttggagctgaatccaacacctattgaagcccaggcagccctgtataacaaggcatgctgccatgcatatagagaagaaagcaaaaaggcagcagaatgtttaaggacagctttgcgggactacaatctcaaatttggtaccatacttaatgatccagacttggcgccgttcagagcatcgccagaatttaaggaacttcaagaagaggctttgcgtggtggagaagatattggttctgggttccgaagagacctgaaactcattagtgaagtacaagcaccattccgtggcgtcagaagattcttctatgtagctttaacagcagcagctggaatttcaacattctttaccattccccgacttatactagcagtccaaggaggtgatggtgctcctgatcttctggaaactgctggggatgctgccatcaatattggaggt

SEQ ID NO: 33049 - protein, 244 aa, Panicum virgatum
  misc_feature: Ceres CLONE 1913978
  misc_feature (72)..(105): Pfam Name: TPR_2 Pfam Description: Tetratricopeptide repeat
MAAATAAAAAALLSGGSGPIPSTTLQIQPFVSPLPFRRRGRTVHVSNASSSPSSPPTPEKEAVAEAVPLPTAESCVNLGLELFSKGRVRDALDQFENALELNPTPIEAQAALYNKACCHAYREESKKAAECLRTALRDYNLKFGTILNDPDLAPFRASPEFKELQEEALRGGEDIGSGFRRDLKLISEVQAPFRGVRRFFYVALTAAAGISTFFTIPRLILAVQGGDGAPDLLETAGDAAINIG

SEQ ID NO: 33050 - DNA, 732 bp, Panicum virgatum
  misc_feature: Ceres CLONE 1913980
  misc_feature: Encodes the peptide sequence at SEQ ID NO. 33051
gccgttcttctcctcccttcgccgtcacctcccctccctcccagatccattctttcccgtgctcacgcctcccccgcggcgaggcgggacagagcagagccggggagggcaaagaaccatggcttctcgtgttgtcgccgtgattcttgccgtccttgtgggagcaagcgccgccgcccctggctcggagccgtggtggaacgagacgcaggtgtacggcaccgacgccaactccggcggcagcaccggcgtcttcgttggccttacactcatccagtcggcggccgccaagggagccgtgtgcttggatggaagcttaccgggttaccacctgcaccgaggatttggatcaggagcaaacagttggcttgtcaacctggagggtggaggctggtgcaatgatgttagcagctgtgtgctccgcaagggcaatcgccgtgggtcgtcaaatcatatggagaggcagctccagtttactgggataatgagtaacagacctgaagagaatcctgatttctacaactggaacagagtgaaggtccggtactgtgatggtggatccttcactggcgacggttctaattcggctgcaggcctttatttccgaggtcagcgcatttggcaggctgctatggatgacctgatggcccaaggaatgcgttatgctaatcaggcccttcttgctggatgctctgctggtggtgtttctaccatacttcactgtgatgaatt

SEQ ID NO: 33051 - protein, 204 aa, Panicum virgatum
  misc_feature: Ceres CLONE 1913980
  misc_feature (31)..(204): Pfam Name: PAE Pfam Description: Pectinacetylesterase
  misc_feature: Useful for making plants with altered carbohydrate content
  misc_feature: Useful for making plants with altered cell wall content and/or composition
MASRVVAVILAVLVGASAAAPGSEPWWNETQVYGTDANSGGSTGVFVGLTLIQSAAAKGAVCLDGSLPGYHLHRGFGSGANSWLVNLEGGGWCNDVSSCVLRKGNRRGSSNHMERQLQFTGIMSNRPEENPDFYNWNRVKVRYCDGGSFTGDGSNSAAGLYFRGQRIWQAAMDDLMAQGMRYANQALLAGCSAGGVSTILHCDE

SEQ ID NO: 33052 - DNA, 716 bp, Panicum virgatum
  misc_feature: Ceres CLONE 1913991
  misc_feature: Encodes the peptide sequence at SEQ ID NO. 33053
gtcgttgaatcttgagagttgagagacaaatatccgtcgaggaggcgagagctcgaaggggaggcgagacgaccgccatggcaggcgccaccaacggcggaggcaacggcgcgaacggcggcgggaaggtgatcagcctgccgctgcagtacttctgcgtgctggcggcggttgtggtggccgtgatggtgctgtcgctggccttcatgtcgccggcggccatggtggctgtccgccagaacctcggctccgtggccgccgcctccgccggcagcagcagcaacagcagcggcgccggagcgggaggagcaccgccggtggcccggaaggagaaggagcaggcgccgcagcggccgccggtggtgctgttcaacttcggcgactcgaactcggacaccggcggcgtggcggcggccggaggcatccggatcatgccgccggagggccgcacctacttccggcgccccaccgggcggctctccgacggccgcgtcatcattgacttcttctgtgagagcctgggcacacatgagctgaatccattcctcaagggaattggttcagactacagcaacggcgtcaacttcgccatggccggctcgacagcgagtcacggtgtctctacctactccttgaacgtccatatcgaccagttcgtgtacttcaggcacagatccctcgagatgttcgaacgaggactgaaaagcccggtgagc

SEQ ID NO: 33053 - protein, 212 aa, Panicum virgatum
  misc_feature: Ceres CLONE 1913991
  misc_feature: SWISSPROT Homolog: EC 3.2.1.51 Alpha-L-fucosidase
MAGATNGGGNGANGGGKVISLPLQYFCVLAAVVVAVMVLSLAFMSPAAMVAVRQNLGSVAAASAGSSSNSSGAGAGGAPPVARKEKEQAPQRPPVVLFNFGDSNSDTGGVAAAGGIRIMPPEGRTYFRRPTGRLSDGRVIIDFFCESLGTHELNPFLKGIGSDYSNGVNFAMAGSTASHGVSTYSLNVHIDQFVYFRHRSLEMFERGLKSPV

SEQ ID NO: 33054 - DNA, 2037 bp, Panicum virgatum
  misc_feature: Ceres CLONE 1913995
  misc_feature: Encodes the peptide sequence at SEQ ID NO. 33055
ccaaattcccatccggccacagccgcacccgcgatcgcagattctgccacgctctctcgtcaatcaggggagtgcagaaccaaattgaagcagagtggtgcaagcaaagctaaccgatcctttttcccaccagatcagcaacggcgcgagcaaattcggagctcgcagcccgcgaatcgtcagtagttctcggattatcgccggcctccagacccgcccgccgcccgccgccgagcctatccaatcggcgcgggcggtcccccgccaccacttttttggagggcgcggccgccgccgggtttggtgcggcggattccgggggcacgccgcgcgcaagtggcagcgcggcgcctcgtcgcgtgtgccccgcacgcaggcccgcgccgcgcctccgtcgctcccgcccgcggctacatatctagcggcttgctgaaggtgggtgtccgtcctcggttgcggtgcgcgttggagtctctagctgagtgcgccggctgctggagttcggtctgagtttggatgggccagatggtttcggatgataaattcgaagaacaggcagctcgcaatggtgggatcatcaagaatggaagggaaatcttattccaggcttttaactgggaatccaataagcataactggtggagtaagttagaggaaaaagtaactgatctggcagaatctgggtttacatcagcatggcttcctccaccaactcagtcattatctcgagaaggctatctaccacagaacctgtactgccttgactcttgttatggttccctgtcagagctgaaatcattgcttcataaaatgaatgagcataatctaagggctatggcagatgttgttatcaaccaccgaattgggactactcaaggatccaatggcatgtataatcgctatgatggcatcccaatatcatgggatgaacatgctgttacatcttgttctggtgggaagggaaacaagagcactggggataactttgatggggttcccaacatagatcatacacagacatttgtacggaaagatattattgaatggctgatctggctccggagatctgttagctttcaggatttccgctttgatttcacgaaaggttatgcagcaaagtttgtgaaagaatacattgaggaatcaaaacctctttttgcggttggagaatactgggatagctgtgaatatagcccccctgattaccgattgaactacaatcaggataaccacaggcagaggatcattaattggatagatagcactggaggactttgtgctgcatttgatttcacaacaaagggtattcttcaggaagctgtcaaaggagagttgtggcggttgcgagatccggaaggaaagccacctggtgtgatgggatggtggccttcaagatcagttacatttgttgaaaatcatgacacagggtcaactcagggtcattggccttttccatctgatcatattatggagggatatgcctatatactcactcaccctggcatccctgcggtgttttataatcacttctatgaccagggatcgtcactccatgaagaaattgccaaactgatgcaaatcagaaaatgccaagacatacaaagccgttcctccgtccaaatattggaggcgaagtcagacctgtactctgcaatcatcgatgagaagttgtgcatgaagatcggagatgggtcatggtgcccaagcgagccagagtggaggctggcggcctctggagacagatatgctgtgtggcacaagtaaagcattcctctcctaaacaggagttatcaccctgttaactgaagaacaccacgggaaacatgtctaaaatgaaggcttgtagattaacctgctcataaatacagtggctcacgtgtactgtagagggcaaacatgtaatgtaaattagaaataattgagatgatgcggctaacataagtgaattgctgctagtgggattacctgtataagaatatatatgtggggtgcatattgtctgtggattatttgattctgaaactagaaatttgaatt

SEQ ID NO: 33055 - protein, 415 aa, Panicum virgatum
  misc_feature: Ceres CLONE 1913995
  misc_feature (26)..(356): Pfam Name: Alpha-amylase Pfam Description: Alpha amylase, catalytic domain
  misc_feature (357)..(415): Pfam Name: Alpha-amyl_C2 Pfam Description: Alpha-amylase C-terminal beta-sheet domain
  misc_feature: SWISSPROT Homolog: EC 3.2.1.1 Alpha-amylase
MGQMVSDDKFEEQAARNGGIIKNGREILFQAFNWESNKHNWWSKLEEKVTDLAESGFTSAWLPPPTQSLSREGYLPQNLYCLDSCYGSLSELKSLLHKMNEHNLRAMADVVINHRIGTTQGSNGMYNRYDGIPISWDEHAVTSCSGGKGNKSTGDNFDGVPNIDHTQTFVRKDIIEWLIWLRRSVSFQDFRFDFTKGYAAKFVKEYIEESKPLFAVGEYWDSCEYSPPDYRLNYNQDNHRQRIINWIDSTGGLCAAFDFTTKGILQEAVKGELWRLRDPEGKPPGVMGWWPSRSVTFVENHDTGSTQGHWPFPSDHIMEGYAYILTHPGIPAVFYNHFYDQGSSLHEEIAKLMQIRKCQDIQSRSSVQILEAKSDLYSAIIDEKLCMKIGDGSWCPSEPEWRLAASGDRYAVWHK

SEQ ID NO: 33056 - DNA, 597 bp, Panicum virgatum
  misc_feature: Ceres CLONE 1914010
  misc_feature: Encodes the peptide sequence at SEQ ID NO. 33057
aagtcaaaggccccccccattgttttccctatcttcttcctcctagagaatgacccagaggaaccagccctggagctgtcgatcgagctcgccaacgatgctcgctactctctagctggtgctggaggcctgcgccttcctcatcttctggatgatcttcttggtcggcttggcccgtaaaaactttaaggtgctctaccccaccatgtacaccgccgagtctgacaacaaggacgccaagctcttctactgcgggcagagggggcatcagaactcgctggagatgatgcccatgttcttcgtcatgctgctgctcggacgtctgtacgccccgactatctccacccgactggctgccttctacaagtcctgtaggttcttctacttccacggatacgccaccggcgtcccgcataaccgtcttaagatagcggggctcaacttcctggctgtgtttgggctgatcctctgctccgcatctttcggcatcaaccttcgcatcaaggacacgctctgaagttcagtgcttactcgtcatctgcatactgtattaaccccactaattacttcttgtggcctgcgtagtgaaactttgcc

SEQ ID NO: 33057 - protein, 121 aa, Panicum virgatum
  misc_feature: Ceres CLONE 1914010
  misc_feature (1)..(113): Pfam Name: MAPEG Pfam Description: MAPEG family
  misc_feature: SWISSPROT Homolog: EC 2.5.1.18 Glutathione transferase
MIFLVGLARKNFKVLYPTMYTAESDNKDAKLFYCGQRGHQNSLEMMPMFFVMLLLGRLYAPTISTRLAAFYKSCRFFYFHGYATGVPHNRLKIAGLNFLAVFGLILCSASFGINLRIKDTL

SEQ ID NO: 33058 - DNA, 750 bp, Panicum virgatum
  misc_feature: Ceres CLONE 1914025
  misc_feature: Encodes the peptide sequence at SEQ ID NO. 33059
cctctcctccgcctccgcccttcccttcgtcgcctcgcctccacaaaccaccaccccacccccaccaccgtcgaccgaccgaccgccaagatgagggagatcctgcacatccagggcggccagtgcggcaaccagatcggcgccaagttctgggaggtgacctgcggggagcacggcgtcgacgccacgggccgctacgtgccccgcgccgtgctcatggacctcgagcccggcaccatggaatccatccgcgccggccccttcggcggcatcttccgccccgacaacttcgtctacggccagtccggcgccggcaacaactgggccaagggccactacaccgagggcgccgagctcatcgactccgtcctcgacgtcgtgcgcaaggaggccgagaactgcgactgcctccaagggttccaagtatgccactccctgggcggaggcacgggttccggcatgggcaccctgctcatctccaagatccgcgaggagtaccccgatcgcatgatgctcaccttctccgtgttcccgtcgcccaaggtgtccgacactgtggtggagccctacaacgcgacgctgtccgtgcaccagctcgtggagaacgcggacgagtgcatggtcctcgacaacgaggcgctctacgacatctgcttccgcaccctcaagctcaccaacccttcatttggtgacctgaaccatctgatctcggcgacgatgagcggcgtgacgtgctggccttcggttccc

SEQ ID NO: 33059 - protein, 219 aa, Panicum virgatum
  misc_feature: Ceres CLONE 1914025
  misc_feature (22)..(218): Pfam Name: Tubulin Pfam Description: Tubulin/FtsZ family, GTPase domain
  misc_feature: Useful for making plants with modulated flowering time
MREILHIQGGQCGNQIGAKFWEVTCGEHGVDATGRYVPRAVLMDLEPGTMESIRAGPFGGIFRPDNFVYGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTNPSFGDLNHLISATMSGVTCWPSV

SEQ ID NO: 33060 - DNA, 2234 bp, Panicum virgatum
  misc_feature: Ceres CLONE 1914086
  misc_feature: Encodes the peptide sequence at SEQ ID NO. 33061
gcgtgggcggacctcgtgcagccgccagccgtgtccaattgcctaaacgaaaacgagaagagacaagagaggaggattcggcaaacagcaagactccgcctcatctgctgctagcctcgcgactatcggatcttgccaaggcatcgtcgtctccctccctcgtcgtccaatcttataatcgcattcccaatccccaagtcgaggcctcgccactctccacagcttccgctcgaagaggggtaattttctacggtggtggtggtgtgcgatcgcaggaacagtcaccgtcgttaagaagaggatgatgcgctgcgctctcaagggcggcgggtgcgtcacctcgtggagcggcgatcggaggtcgccggcggccgtcaacccccgcggcgtgcggatgccgacgggcaacggcgggtgctgctccggcctgcggtcgcgggccgcggatctcgccggcctcgagatggccaccctgcgcggcggcgtcgggggcctcttccgctccagcccgcgctacgggcgcttgcaagccacggccgcagttgatcctgaagatcttccgttggagaaggttcaagttaaatcctcgggacatgttctgccatatgttggtgttgcttgcttgggtgctattttgtttggttaccatcttggcgtggtcaatggcgcgcttgaacatcttgccaaggatcttgggatcgctgaaaatgctgtcctacaaggatgggtggtcagcacatccctggctggtgcaacaataggttctttcaccggagggtctttggctgataaatttggtcgaacaagaacctttatcctggatgcagtcccacttgctttaggtgcattcttgagtgcaacagctcaagacatccgggcaatgattattggtcgattgcttgctggaatcggtattgggatctcatctgctcttgttcccctgtacatatctgagatatcaccaactgaaatccgtggaacacttggcactgttaatcaactatttatctgcattggaattcttgcagctttgttggctggattgcctttagcaggaaatcctgcctggtggaggacaatgtttggagttgctgtagttccgtccattttactggctgtaggaatggccttttcacctgaaagtcctcgttggcttttccagcaaggaaaggttacccaagctgaatcagctgtaaaaaaactgtatggaaaagaaaaggttacggaagttatgtatgatctgagagctagtggccaaagttcttcggagccagaagctggctggtttgatctcttcagcaaccgctattggaaagttgtgagcgtgggcgcggcactgtttttgttccaacagcttgctggtataaatgctgttgtatattactctacatcggtattccgcagtgcaggaattgcatctgatgttgctgctagtgcccttgtkggggctgccaatgtttttggcactatgattgcatcttctctaatggacaagcaaggcaggaaaagccttctgataacaagcttttctggaatgggtgcttcaatgttacttctagctttgtccttcacctggaaagctctggcgccttattctgggactcttgctgttgttggcactgttctgtatgtgctgtcttttgctctcggagctggtcctgttccagctttacttcttcctgaaatatttgcctccagaataagggctaaggctgtcgcattatctctaggcatgcactgggtatccaacttctttatcggcctgtacttcttgagtgttgtcaacaagtttggcatcagcaccgtttacctggggttcgcatcagtgtgtgctcttgcagttctttacatagctgggaacgtggtggaaaccaaggggcgatccctggaggagattgaacgggaactaagtgtagtagattgatatgctgaccattttggtgatcgagaatgcaaccaagcacacaaccgagcatccttgacctagagaccctgtttctagttccattttgattcagaaataagcgagtggcaagagcgccaatcatcggtgacttggtgtgtgcagtgagggctttgtgttcaagcactaagtttagctgcccatcgtgtcatctgttagaatcattgaacccgtcgatgtttccggagataagtagtgttcttagatttttcgtttttctggtgtatagatgaactctgtctcctgaaaataaagacaactattttcaatc

SEQ ID NO: 33061 - protein, 540 aa, Panicum virgatum
  misc_feature: Ceres CLONE 1914086
  misc_feature (102)..(536): Pfam Name: Sugar_tr Pfam Description: Sugar (and other) transporter
MMRCALKGGGCVTSWSGDRRSPAAVNPRGVRMPTGNGGCCSGLRSRAADLAGLEMATLRGGVGGLFRSSPRYGRLQATAAVDPEDLPLEKVQVKSSGHVLPYVGVACLGAILFGYHLGVVNGALEHLAKDLGIAENAVLQGWVVSTSLAGATIGSFTGGSLADKFGRTRTFILDAVPLALGAFLSATAQDIRAMIIGRLLAGIGIGISSALVPLYISEISPTEIRGTLGTVNQLFICIGILAALLAGLPLAGNPAWWRTMFGVAVVPSILLAVGMAFSPESPRWLFQQGKVTQAESAVKKLYGKEKVTEVMYDLRASGQSSSEPEAGWFDLFSNRYWKVVSVGAALFLFQQLAGINAVVYYSTSVFRSAGIASDVAASALVGAANVFGTMIASSLMDKQGRKSLLITSFSGMGASMLLLALSFTWKALAPYSGTLAVVGTVLYVLSFALGAGPVPALLLPEIFASRIRAKAVALSLGMHWVSNFFIGLYFLSVVNKFGISTVYLGFASVCALAVLYIAGNVVETKGRSLEEIERELSVVD

SEQ ID NO: 33062 - DNA, 693 bp, Panicum virgatum
  misc_feature: Ceres CLONE 1914090
  misc_feature: Encodes the peptide sequence at SEQ ID NO. 33063
agcgaagagatctgttgcatagcttacggcgagtaaactctcattcttatctgagcttaggaggatggccggaggagggcggcttgcgctggtggcggcgctgctgtgcgcggcggcggccatggccgcggcgcagcaggcgtccggcgtgcgcgccacctacaactactaccgcccccagaacatcaactgggacctgaacgccgccagcgtgtactgcgccacctgggacgccggcaagtcgtaccagtggcgcagcaggtacggctggaccgccttctgcgggcccgccggccccaccggccaggcctcgtgcgggcagtgcctccgggtgacgaactcggcgacgggcgcgtcgacgacggtgaggatcgtggaccagtgcagcaacggcgggctggacctggactacgacacggcgttcagcaagatcgacaccgacggttcaggcgtccgggacgggcacctcaccgtcagctaccagttcgtcaactgcggcgacaactgaaaactgatgatgactccatcaccaggagcagcagcagctgctgctgcacgtatatagaattatatatgtaaccccacatggtgaaattaaacttgaggatgaataagtgggcgtccagtgaaaataaattgaagctttgttgttgttattgttgaacaatgtggaataataaaaagttacatatc

SEQ ID NO: 33063 - protein, 147 aa, Panicum virgatum
  misc_feature: Ceres CLONE 1914090
  misc_feature (25)..(144): Pfam Name: Barwin Pfam Description: Barwin family
MAGGGRLALVAALLCAAAAMAAAQQASGVRATYNYYRPQNINWDLNAASVYCATWDAGKSYQWRSRYGWTAFCGPAGPTGQASCGQCLRVTNSATGASTTVRIVDQCSNGGLDLDYDTAFSKIDTDGSGVRDGHLTVSYQFVNCGDN

SEQ ID NO: 33064 - DNA, 699 bp, Panicum virgatum
  misc_feature: Ceres CLONE 1914092
  misc_feature: Encodes the peptide sequence at SEQ ID NO. 33065
aagtgtactttctcctagctagtgttctagcaacccgcttcatcttgccttgaatctctggactgggacaagaacagctttcaaccttctctcagcttcattatttgtgttcctcggagcgtttcttcctggatttttttcagacttttactcactatcttaatcgccaaaacagtgccccgggatctgactcctgatgtagcactattcaatctgtgggaaacaacgcggcaacaaaaaaagggatgttctctatcatctgaaagtgtttggaattctcagagctaacatggacgatgactctggcggacataataagcaggagagcatattacacaatcaacatttgaatctacaaagtctgtcattaaaagatttgagagacatcacaaatgatttctctaatgagctgctacttggacaaggtggttttggtagggtgtataagggagttctagcaaatggggttacaattgctgtgaagaagcttacatggacaatgtcaggaattcaggataagcaatatgagaatgaagcatgtcatctcatgaggcttaaacatccaaacatagtgcaacttgtaggatactgttctgaaacagagaaggaacttgtacaactgcccaacgggaaatacgtttatgctgagaagtcagaaaggttgctttgcttggagtacatgcctaatggaagcctctg

SEQ ID NO: 33065 - protein, 136 aa, Panicum virgatum
  misc_feature: Ceres CLONE 1914092
  misc_feature: SWISSPROT Homolog: EC 2.7.11.1 Non-specific serine/threonine protein kinase
MDDDSGGHNKQESILHNQHLNLQSLSLKDLRDITNDFSNELLLGQGGFGRVYKGVLANGVTIAVKKLTWTMSGIQDKQYENEACHLMRLKHPNIVQLVGYCSETEKELVQLPNGKYVYAEKSERLLCLEYMPNGSL

SEQ ID NO: 33066 - DNA, 1326 bp, Panicum virgatum
  misc_feature: Ceres CLONE 1914106
  misc_feature: Encodes the peptide sequence at SEQ ID NO. 33067
actgagtttggatttggattccgactttctgagctccgccgattccttattccgccttctccccctcccccgcccctcatcgcccacccccactccgccccgcccccggtgatcgtcgatggcggcgccggcgctatggcagccgcaggagcaggggttccgcgagatctgcaccctcctcgaggcgcacatctcccccaactccgaccaagcccgcatctggcagcagctccagcactacagccagttccccgacttcaacaactacctcgtcttcctcctcgcccgcggagaggggaaatccattgaagttagacaggctgctggtctgcttctgaaaaataatctgcgagcgactttcagttccatgccacttccatcccagcagtatattaaatctgagttgttaccatgtatcggagcaaccaatagggcaattagatccacagttggaacagtgatcagtgtacttttccaaattgttcgagtttctgggtggattgagttgtttcaggccctgcacaagtgtttggacagtaacgacttggatcatatggaaggtgctatggatgctatatacaagatctgtgaggatgtacccgaagagcttgacattgatgttcctggtttgcctgaacggccgatcaatgtattcatgccaaggatactgcagttttttcaatcaccacatgcaagtcttagaaaactagctttgggctgcatcaaccagtacattgtggtgatgccatcggcactgtacatgtccatggatcagtatcttcagggattattcaaccttgcaaaggacccttcagcagatgtccggaaactggtttgttcagcctgggttcagctcattgaagtgcggccatcaattctggagccacatctaaaaaatgttaccgaattgatcctacaagccaataaagattcagatgatgatgttgctcttgaggcttgtgaattctggtctgcatactgtgatgtcagcatgcctccagaaggtttacaggaattcttgccacgattaatcccgacattattgtcgaacatggtttatgctgatgatgatgagtcacttgctgatgctgaggaagatgaatcctttccagacagggaccaggatttgaagccccgcttccatgcctctcggttgcatggatcggaaactggagaagacgatgatgatgatgatgctgtaaatgtctggaacttaaggaagtgtagtgctgctggattggatgtcctctctaacgtgtttggcgacagcatccttccaactttaatgccgttgattgagcaaaatttggctcgaacagatgatga

SEQ ID NO: 33067 - protein, 402 aa, Panicum virgatum
  misc_feature: Ceres CLONE 1914106
  misc_feature (34)..(102): Pfam Name: IBN_N Pfam Description: Importin-beta N-terminal domain
MAAPALWQPQEQGFREICTLLEAHISPNSDQARIWQQLQHYSQFPDFNNYLVFLLARGEGKSIEVRQAAGLLLKNNLRATFSSMPLPSQQYIKSELLPCIGATNRAIRSTVGTVISVLFQIVRVSGWIELFQALHKCLDSNDLDHMEGAMDAIYKICEDVPEELDIDVPGLPERPINVFMPRILQFFQSPHASLRKLALGCINQYIVVMPSALYMSMDQYLQGLFNLAKDPSADVRKLVCSAWVQLIEVRPSILEPHLKNVTELILQANKDSDDDVALEACEFWSAYCDVSMPPEGLQEFLPRLIPTLLSNMVYADDDESLADAEEDESFPDRDQDLKPRFHASRLHGSETGEDDDDDDAVNVWNLRKCSAAGLDVLSNVFGDSILPTLMPLIEQNLARTDD

SEQ ID NO: 33068 - DNA, 683 bp, Panicum virgatum
  misc_feature: Ceres CLONE 1914106-R
tggttcactagcttacatctgccaggcctgtgcaagttggactgagatcaaaagtgaaggtcttcacagcgaggtgtgccagattatgaatggctacaagcagttgcttgggaacagtgggtgggagcagtgcatggccaccctagaaccatcagttgtgcagagattagctcggtacggagtataagggatggcgagaattgaggtcttgtgatttattcaccgcattccagaattatcccagcattattgtggagacaggagcgggaagagccatgagcctggatttgggcaagcctgtctgtctggggtcatcgagtgtgtgaggatgcattttacatgtattcgcttcttgtgcgcggttggctggttggggactcccgttgtatactggttattactccactaattggtgcacagcacagcattaccacagacgagcgagctagatggacgggaatactagtggtaaaagaatatttacctaccacgacaggatgttgagatttgtattggttggttggtagagtcagtggacttggttttgttttgtcattccactggcaaaagcgtgtaattgccttattcttcctttttggtcggtgtagaattgtgtttttggtcttttgacaggaaggattgtataatgatccattcatttgccccataataaatgattcatc

SEQ ID NO: 33069 - DNA, 727 bp, Panicum virgatum
  misc_feature: Ceres CLONE 1914116
  misc_feature: Encodes the peptide sequence at SEQ ID NO. 33070
atcagctctttctcacctcgcttccaagcgacaccaaaagcggcagcgagcggcaagaaccaccaccaccaccacttgagcctccccttggcttccactccaccgaaccagaccggaaaggcggaggcggggcaggccagaggccatggcgagcaacggcgacgggaagggccgcgtggcggcggcagccgggggagggtacgggtacggcgggtacgaggggcccgaggagcgcaagtggtggccgtggctcgtgcccaccgtcatcgtcgcctgcatcgcggtcttcgtcgtcgagatgtacgagaacaactgccccaagcacgggagccagctcggggactgcgtcgccggctttctgcgccgcttctccttccagccgttccgggagaacccgctcctcgggccctcgtcctccactttggagaaaatgggagcccttgactggaacaaaattgttcatcagcaccaaggctggcgccttattagctgcatctggctccatgctggcctaatccatttggttgtgaacctgctgagtttgctgtttattggaatccgccttgaacagcaatttggatttgttcgcattggtgccatatacctactatccggttttggtggcagcgtgttgtctgcactcttcctacggaacaactacatctctgttggtgcatctggagctttatttggcctgcttggatccatgctctcagagctactcatg

SEQ ID NO: 33070 - protein, 193 aa, Panicum virgatum
  misc_feature: Ceres CLONE 1914116
  misc_feature (104)..(193): Pfam Name: Rhomboid Pfam Description: Rhomboid family
  misc_feature: SWISSPROT Homolog: EC 3.4.21.105 Rhomboid protease
  misc_feature: Useful for making plants with altered cell wall content and/or composition
MASNGDGKGRVAAAAGGGYGYGGYEGPEERKWWPWLVPTVIVACIAVFVVEMYENNCPKHGSQLGDCVAGFLRRFSFQPFRENPLLGPSSSTLEKMGALDWNKIVHQHQGWRLISCIWLHAGLIHLVVNLLSLLFIGIRLEQQFGFVRIGAIYLLSGFGGSVLSALFLRNNYISVGASGALFGLLGSMLSELL

SEQ ID NO: 33071 - DNA, 721 bp, Panicum virgatum
  misc_feature: Ceres CLONE 1914117
  misc_feature: Encodes the peptide sequence at SEQ ID NO. 33072
accggacgcatccatctccttccttccttcctcggttcctcccctctcccgcatcgtgacgtcagcagccatggtgaaggcctaccccacggtgagcgaggactacctcaaggcggtcgagaaggccaagcgcaagctccgcggcctcatcgccgagaagaactgcgccccgctcatgctccgcctcgcctggcactccgccggcaccttcgatgtctccaccaagaccggggggcccttcggcactatgaagaaccccgctgagcaggtgcacggagccaacgccggtctcgacatcgccgtcaggctgctcgaacctatcaaggagcagttctccatcctatcctacgctgatttctaccagcttgctggggtcgtggccgtggaggtcaccggcggccctgaggtccccttccacccagggaggcaggtaagacagatccattcttcttgttaacatcaaatcatgccccaacccaacccgacacaatcctgagattttgctagggtttaagcaagcaaatcctatcctctgcctaccaattgctcctgcagcacacctgcctatcaattgctcctacagcacacctagaattgaaatcttcctattggcttatgtggacacatacagatgtgcggaaatactgtattagcaccctgtggggtccttcgactttgctggaatactttcgagtgattaactctatatattgtctgtctt

SEQ ID NO: 33072 - protein, 128 aa, Panicum virgatum
  misc_feature: Ceres CLONE 1914117
  misc_feature: SWISSPROT Homolog: EC 1.11.1.11 L-ascorbate peroxidase
  misc_feature: Useful for making plants with modulated heat sensitivity
  misc_feature: Useful for making plants with modulated water use efficiency
  misc_feature: Useful for making plants with altered carbohydrate content
  misc_feature: Useful for making plants with altered cell wall content and/or composition
MVKAYPTVSEDYLKAVEKAKRKLRGLIAEKNCAPLMLRLAWHSAGTFDVSTKTGGPFGTMKNPAEQVHGANAGLDIAVRLLEPIKEQFSILSYADFYQLAGVVAVEVTGGPEVPFHPGRQVRQIHSSC

SEQ ID NO: 33073 - DNA, 644 bp, Panicum virgatum
  misc_feature: Ceres CLONE 1914166
  misc_feature: Encodes the peptide sequence at SEQ ID NO. 33074
aattcactccggaggagaaacgcatcctacgctcgcgagcccacaatggcgaccacaagaattccgcgtcctgcggccgtggcggtggcgctgtgcgcggcggcgctgctggcggcgtgcgccggcgcgtcccgggcggggtgccggacgcacgtggcgaagatcacggattaccgcgccgtcggggacgggaagacgcccaacacggcggcgttcgccaaggcggtggcggacctgtcggcgcgcgcgcggcgcggcggcgcggcgctggtggtgcccccggggaaatggctcacggggcccttcaacctcaccagccacttcaccctctacctcgacgagggcgccgagatcctcgcgtcccaggacatgaaagattggcccctcatagctcccctgccgtcttacgggagaggaagggacgaccctggcccaacatacagcaatttgattgctggatccaatcttactgacatcgtattcactggtaagattggcactatctccgggcaggggcaagtctggtgggacaagtaccatgccaaggagctccagttcacccatggctacctcctcgagctcctctactctgacaacatcatcatctccaatgtcaccttcgtcgagtcgccgtcatggaacct

SEQ ID NO: 33074 - protein, 199 aa, Panicum virgatum
  misc_feature: Ceres CLONE 1914166
  misc_feature: SWISSPROT Homolog: EC 3.2.1.82 Exo-poly-alpha-galacturonosidase
  misc_feature: Useful for making plants with altered carbohydrate content
  misc_feature: Useful for making plants with altered cell wall content and/or composition
MATTRIPRPAAVAVALCAAALLAACAGASRAGCRTHVAKITDYRAVGDGKTPNTAAFAKAVADLSARARRGGAALVVPPGKWLTGPFNLTSHFTLYLDEGAEILASQDMKDWPLIAPLPSYGRGRDDPGPTYSNLIAGSNLTDIVFTGKIGTISGQGQVWWDKYHAKELQFTHGYLLELLYSDNIIISNVTFVESPSWN

SEQ ID NO: 33075 - DNA, 650 bp, Panicum virgatum
  misc_feature: Ceres CLONE 1914180
  misc_feature: Encodes the peptide sequence at SEQ ID NO. 33076
cggttgccgtccgtacttcccgctcgggagcccggatggcgtcggataagatccagatcctggtcggcccgctgctccgcgtacctgtgccggcgcctcttcgcggcgagcgcgcggctgggccacccgaccttcccgctcgccagggacgcggcgccgtctcactcggccagggcggcgctgctcattacctcccacgacgcctgcgtgacgctcgtcaagggcgacctctactaccagttctgcctggtgagcgcggtcttcctcgcggactgggccatctccacgggcggtgcgccgcctctcgccgacccgaccaggctcgtctacgccatccaggaggccggctccgtcgaggtacctcggcctgccgatcaccgatctgcgcgtcgatcagttttattttctgaagctgccaatcgctgattatctagctgctcgcatattcagggctcgaaatttcacgaatttcggtactgaatggatggaagatatcgttcatccctcgagatttccccctgatctctgctgaaatttttcgaaatttggcagtgaagaaaaaccaacctaagccaatatcatagctttgtcgatgcttcgcacactgctatgcatactattactcgcagatgttcatcccgtctgagttc

SEQ ID NO: 33076 - protein, 141 aa, Panicum virgatum
  misc_feature: Ceres CLONE 1914180
  misc_feature: SWISSPROT Homolog: EC 1.3.1.45 2'-hydroxyisoflavone reductase
RLPSVLPAREPGWRRIRSRSWSARCSAYLCRRLFAASARLGHPTFPLARDAAPSHSARAALLITSHDACVTLVKGDLYYQFCLVSAVFLADWAISTGGAPPLADPTRLVYAIQEAGSVEVPRPADHRSARRSVLFSEAANR

SEQ ID NO: 33077 - DNA, 558 bp, Panicum virgatum
  misc_feature: Ceres CLONE 1914182
  misc_feature: Encodes the peptide sequence at SEQ ID NO. 33078
gtgctctcttcagaggtgggttggcttctcctccccctccggttcggttcggttcgggttcgtgaggttcttggggttccgttcgggggcgagaggaagagatggaggcgtcggatgttgagtaccgctgcttcgtcggcggccttgcctgggccaccgacgacaactcgctccacaacgccttcagcccctacggcgaggtcctcgagtccaagatcatcctcgatcgtgagacccagaggtcccgcggcttcggcttcgtcaccttctcgagcgagcaggcgatgcgcgacgccgtcgaggggatgaacggcaaggagctggacggccgcagcatcaccgtcaacgaggcccagtcccgcggcggcccgcgctccggcggcggcggcggctacgggcgccgcgagggcggcggtggctacggcggcggcggcggctgctacggtcgccgcgagggcggcggtccgctaccagtggcggctgcggcggctacagtggccgcggaggctaccgccgcggcggctacagtcgagaccgccgcagcggctcccgcaactc

SEQ ID NO: 33078 - protein, 152 aa, Panicum virgatum
  misc_feature: Ceres CLONE 1914182
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with altered lignin content
  misc_feature: Useful for making plants with modulated nitrogen use efficiency
  misc_feature: Useful for making plants with altered alkaloid content
  misc_feature: Useful for making plants with modulated flowering time
  misc_feature: Useful for making plants with modulated biomass
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
  misc_feature: The sequence is a functional homolog of SEQ ID NO 1042 in the 10/374,780 US patent application
  misc_feature: The sequence is a functional homolog of SEQ ID NO 852 in the 10/666,642 US patent application
MEASDVEYRCFVGGLAWATDDNSLHNAFSPYGEVLESKIILDRETQRSRGFGFVTFSSEQAMRDAVEGMNGKELDGRSITVNEAQSRGGPRSGGGGGYGRREGGGGYGGGGGCYGRREGGGPLPVAAAAATVAAEATAAAATVETAAAAPAT

SEQ ID NO: 33079 - DNA, 1559 bp, Panicum virgatum
  misc_feature: Ceres CLONE 1914194
  misc_feature: Encodes the peptide sequence at SEQ ID NO. 33080
acgttcagcgctgccaaacaatccttcctcaacgaacccctctgccccgctgccgctgccgccgcctcaggccacccctatgcccgcatctgcgccggcgagcccttcagcgccggtgagccctttcggaccgaacccctctatcccccgccgccacatcaccctacgatgccttgactgttttcctcacccaactctgctcggggatttcgggaaggtggatttcggggagaagcatggcgggaaccttggcgcacggcagccttggcgcatcagatccgcatcgccggcgccgacgggagcgactggtacaacgccaacgccgagtcgtcgcttcgcgtgggagaacgggctcgtgccgtagatgaatcaggcgccggctctgttctctctccgtattgaatcgcctgatggaaggcgtattttgcttcgtttgaggcgaagagacggcatcggctggccgttgtacatgccctagcctcgctcctgggcagccacgatgggagaagggttccgcggcggagcaacaggagcaccagcaccagcatgcccatatcgatgtgctgcaacattggggcgggtgacgaccaggcctccccccatggcggcctagcactagcagacacgagctaaaatcagttatttacgtcaaggaatccataaaattcccattctcggaaattcaagctgcaacttatgatttctcaaaagagaacttgttgggtgagcgtggttttgggcatgtgtacaggggccatctgaacaatggtgagctcacattgcagccaagctgcgcaaggagatcagtccgcaagctcactagagtggcacaagaggcatgcaattgccataggtatagcaaaaggcctgcgcttcctacatgaggagtgccacgctggtccaatcatccatctggatttgcaaccaagcaatgcactgttgacacatgacttgtacttatgcttggggacttttggttttgcaaaatggaaggcttgcgatgattccacaaagacaatgattctggggcaaccaggatactgtgggcgcctgagttatgctgaatatggtcgtaaggtgcttgatgaacacaaaggacgctgcacacatatattgcaatggcttggggacttttggttttgcaaaatggaaggtttgcgatgattccacaaagacaatgattctggggcaaccaggatactgtgggcgcctgagttatgctgaatatggtcgtaaggtgcttgatgaacacaaaggacgctgcacacatatattgcaatgggcagagccgttgtttgagagccttgcacttatgaactagtagatgaccgcatcaaagatacatatgatacttttgggttgtatcatctagccagagctgcgtatatttgtgtcaggacaattccagagcaacgtccttctttctatgggagaggatggtttggtaaactcaacacatgtaatagcaataataagtttataatcaccgtatctctttctctctatgtggacaggttgtccgtcttattgagttagaaaatgagcacatcaaacttttc

SEQ ID NO: 33080 - protein, 132 aa, Panicum virgatum
  misc_feature: Ceres CLONE 1914194
  misc_feature: SWISSPROT Homolog: EC 2.7.11.1 Non-specific serine/threonine protein kinase
MVSSHCSQAAQGDQSASSLEWHKRHAIAIGIAKGLRFLHEECHAGPIIHLDLQPSNALLTHDLYLCLGTFGFAKWKACDDSTKTMILGQPGYCGRLSYAEYGRKVLDEHKGRCTHILQWLGDFWFCKMEGLR

SEQ ID NO: 33081 - DNA, 405 bp, Panicum virgatum
  misc_feature: Ceres CLONE 1914206
  misc_feature: Encodes the peptide sequence at SEQ ID NO. 33082
gtgctctcttctgaggtgggttggcttctcctccccctccggttcggttcggttcgggttcgtgaggttcttggggttccgttcgggggcgagaggaagagatggaggcgtcggatgttgagtaccgctgcttcgtcggcggccttgcctgggccaccgacgactactcgctccactacgccttcagcccctacggcgaggtcctcgagtccatcatcatcctcgatcgtgagacccagaggtcccgcggcttcggcttcttcaccttctcgagcgagcacgcgatgcgcgacgccatcgaggggatgaacgagcgcgacctggacggccgcttcatcacctgtctctaggcccagcccagcggccgcccgcgctgcggcggcggcgccggctagggccacgcct

SEQ ID NO: 33082 - protein, 82 aa, Panicum virgatum
  misc_feature: Ceres CLONE 1914206
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with altered lignin content
  misc_feature: Useful for making plants with modulated nitrogen use efficiency
  misc_feature: Useful for making plants with modulated flowering time
  misc_feature: Useful for making plants with altered alkaloid content
  misc_feature: Useful for making plants with modulated biomass
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
  misc_feature: The sequence is a functional homolog of SEQ ID NO 1042 in the 10/374,780 US patent application
  misc_feature: The sequence is a functional homolog of SEQ ID NO 852 in the 10/666,642 US patent application
MEASDVEYRCFVGGLAWATDDYSLHYAFSPYGEVLESIIILDRETQRSRGFGFFTFSSEHAMRDAIEGMNERDLDGRFITCL

SEQ ID NO: 33083 - DNA, 1474 bp, Panicum virgatum
  misc_feature: Ceres CLONE 1914215
  misc_feature: Encodes the peptide sequence at SEQ ID NO. 33084
aaaaatctcgccagaaattagaattccttccacctttctggctcgcaccccccactgtcttctctccgagtccgctccaatgcccccgttgcctctctcctccacctcatcataaacgcctccggctccgacggcctcttcccggacccaaaccctagccgcgcactcgccgaccacgccgagctcgccggaacccgcccgacccgagcacaattccgctcgggtcgcagccgatccggcgactcccctcccggacagcccggggccgtgcccccccgcggatgctagcctgatcgcgtccccacggtcgatgggttcgccggggtccgccaatggcagacgcggcgagtacgtgaggatcccgaaggaggtggaggtggcggccaagggggaggccgacgccgcgacggccctcaaggcggccgccgcggcggagtgcccgagggtgctccgctggcgcgcgatccggtggtgggccaaggtcgccgtgctcgggatcttcctcgcgggggccggagcggcggccgtcgtattcctcggcccgctcgtcattaagaaggttgttgcacctattctttactgggaatcaacaactttcagcagaccagctattgctctaatatgttttggcgcaattgccttgttcccaagtgttttgttaccttcttcaccattcatgtggattgcggggatgacttttggatatctttatgggtttttaataatccaagcggggataagcataggcatgtcattgccttattttataggctctgcattccactgtaggatacatagatggttggagaagtggccaaagaaagcagcttttgtaaggcttgctggcgaaggagattggcatcatcaatttagggctgttgctttgctcaggatttctccatttccatatatagtttttaactatgcttctgtggctacaaatgtcaaatattgcccatacatagctggttcaatggctggaaccatacatgaaactttccttgcaatatacagtgggaaacttcttcaaagcttggctgtagcaactagcgaggggtccttcttgtcagtggatcagattatctacaatggaatcggcttcacaatcgctgcagcttccactgctgcaatcactatctatgcaaagaaagcgcttcaaaagctccaagcagaggatgagatattctgagcgcaagaggcctgtgctccggaccaaactagtttccagtcagatgtactatatataaacatttgctactaatctggtttcctgtgtcgactacctgactacaaccatctgaggggatgagagtgctgcagcaactgtaaagaaaatagagatccagagaacacttatgttttctgttttttttttcttgttttgttttctgtagagagaaccatcaacttcatcattgtattgcgttacgcgatgtaaattcctatggaaaaacttacttcccttcctttcacc

SEQ ID NO: 33084 - protein, 292 aa, Panicum virgatum
  misc_feature: Ceres CLONE 1914215
  misc_feature (117)..(238): Pfam Name: SNARE_assoc Pfam Description: SNARE associated Golgi protein
MGSPGSANGRRGEYVRIPKEVEVAAKGEADAATALKAAAAAECPRVLRWRAIRWWAKVAVLGIFLAGAGAAAVVFLGPLVIKKVVAPILYWESTTFSRPAIALICFGAIALFPSVLLPSSPFMWIAGMTFGYLYGFLIIQAGISIGMSLPYFIGSAFHCRIHRWLEKWPKKAAFVRLAGEGDWHHQFRAVALLRISPFPYIVFNYASVATNVKYCPYIAGSMAGTIHETFLAIYSGKLLQSLAVATSEGSFLSVDQIIYNGIGFTIAAASTAAITIYAKKALQKLQAEDEIF

SEQ ID NO: 33085 - DNA, 1608 bp, Panicum virgatum
  misc_feature: Ceres CLONE 1914226
  misc_feature: Encodes the peptide sequence at SEQ ID NO. 33086
aatgacgaggacgagaaaaagctaacactagcaggggggtcgtgctgtcagtttgcccttcgcagccgatctttctctgcggttctcccctcccatcatcacccgcagggcgctacctttgagcgtgtggaccggcggctggtgcggatcggatctccacagcaacaacttttcgtgtgatagtcaagaggcaatgcggccgttggacaagaagtgctacagctacatcaccaatggggcggcggcgagcgggaggccgcagcgcacgaatccagagccgacccggcccaagccgacgccgtccaagtgggacgacgcgcagaagtggctcgtcggcatgtccagcggtcgcgccgacggggtccgcggtttcgccggcgcggccagggccaggaactccaacgccgacgaccgccgcctcctcagctcgtcctcgcagaacggacgggtgtcgtgcagcagcgtggacggcgcgctggggtacagcatggtggtgaccgcgcccccgacgccgccgctgcagggcgagggcgccgacgacgtgggggagaccaagaagatcgactgcatggtgcagcagcacggctcgcccgtcgcggagatccggtccgtgtgcctgcgggacatggggacggagatgacgcccatcgctagcaaagagccgtccaggacagccacgcccctgcgtgcctccacccctgtagcgcggagcccaatctcctcgaggtcgtccaccccagcgaggagacgccaggaaaggcctatggccgttaccaccgccgttgtagggacgacgaccgagccggtgccgccacgcccggtcggttgtgccggcgaggaggggcccatggacgctcatgtgcccagcagcgcgaactcgctggagtcgcgcgcggcagcctgggatgaggcggagcgggccaagtacacggcgaggtataagcgtgaagaggtgaagatacaggcctgggagaaccatgagaagagaaaagctgagatggagatgaagaaaatgcagatgaagaccgaccagatgaaagcacgggctcaagagaagctggccaaccggctggccgcgacgcggcggatagccgaggagaagcgagcaagcgcagaggcgaagctcaacgagcgtgcggcgaggacgtcagagaaggccaactacatcaggaggacagggcacctgccatcctccttcaaaatgccgtgcttgtgcggctgaagcttgagcagagctagaagaaattgactgtgacaccatgcctcgtcattttttctggcactgtttgagaccacccagccgacggccaatcgtagctccaaagtcgagttcagacaatgagcccgtgcttttctgtgctaatgcattgtcagaatcaatctggctgcctggcttcttataacaaggtaaccggctgttcgggccatgatttgaaatgggaaaaaaaaacttcatgggataatatacaccctccgaacccaaacaggtcatttaggacataagcatagttttcaaacgacagtttgacttgtaatttttagatgtttacttttttttaatagagaaagctcaatattttaaaagtatttttcacgagggctcttttg

SEQ ID NO: 33086 - protein, 342 aa, Panicum virgatum
  misc_feature: Ceres CLONE 1914226
  misc_feature (225)..(336): Pfam Name: Remorin_C Pfam Description: Remorin, C-terminal region
MRPLDKKCYSYITNGAAASGRPQRTNPEPTRPKPTPSKWDDAQKWLVGMSSGRADGVRGFAGAARARNSNADDRRLLSSSSQNGRVSCSSVDGALGYSMVVTAPPTPPLQGEGADDVGETKKIDCMVQQHGSPVAEIRSVCLRDMGTEMTPIASKEPSRTATPLRASTPVARSPISSRSSTPARRRQERPMAVTTAVVGTTTEPVPPRPVGCAGEEGPMDAHVPSSANSLESRAAAWDEAERAKYTARYKREEVKIQAWENHEKRKAEMEMKKMQMKTDQMKARAQEKLANRLAATRRIAEEKRASAEAKLNERAARTSEKANYIRRTGHLPSSFKMPCLCG

SEQ ID NO: 33087 - DNA, 724 bp, Panicum virgatum
  misc_feature: Ceres CLONE 1914240
  misc_feature: Encodes the peptide sequence at SEQ ID NO. 33088
aaaacagaagggtgaaatggtgactaaacccaccccaccgccatggccatccatctccgcgcccacgccttcgcggcaaacccgctgcgtggcgtctccgcctccaccaccgccgtctcgccctccgcggccgccgaggccctgcgctccctcctcgaccccagctccgccgccgcgggcgccgccagtccccacccgccgcacctgtccaagatcctccctttccgccggggccgcccgctcgcgcgctccccggaccctcctgcctccgctccccctcccgcggcgccggcctggcgcctcgcgtggctcccgccctcccgcgtccccggggtggccccggacgccttcgtcttcctgggcgcgcacgccgagggggacggcaaggaggccgcggcgtactgggccgtcgatgtcagcgacggcgagggcccgagggtcgacggcggctccggggacggggatgggtcggcgtttgtggacctgaggacgctcatggtggccacggacaggagcgacaaggacgccatgggggacctcgccatcgccggacatgctcgggcactgctggagtggcacaatacggcaaaattttgtggagtttgtggagcgaaggctgttcctacagaagccggaaggcgtaagcagtgcagcaacgagtcctgcaagaagaggatataccctcgagttgacccagttgtgatcatgctggtcatcgataaag

SEQ ID NO: 33088 - protein, 227 aa, Panicum virgatum
  misc_feature: Ceres CLONE 1914240
  misc_feature (55)..(178): Pfam Name: NUDIX-like Pfam Description: NADH pyrophosphatase-like rudimentary NUDIX domain
  misc_feature (180)..(213): Pfam Name: zf-NADH-PPase Pfam Description: NADH pyrophosphatase zinc ribbon domain
  misc_feature: SWISSPROT Homolog: EC 3.6.1.22 NAD(+) diphosphatase
MAIHLRAHAFAANPLRGVSASTTAVSPSAAAEALRSLLDPSSAAAGAASPHPPHLSKILPFRRGRPLARSPDPPASAPPPAAPAWRLAWLPPSRVPGVAPDAFVFLGAHAEGDGKEAAAYWAVDVSDGEGPRVDGGSGDGDGSAFVDLRTLMVATDRSDKDAMGDLAIAGHARALLEWHNTAKFCGVCGAKAVPTEAGRRKQCSNESCKKRIYPRVDPVVIMLVIDK

SEQ ID NO: 33089 - DNA, 1511 bp, Panicum virgatum
  misc_feature: Ceres CLONE 1914250
  misc_feature: Encodes the peptide sequence at SEQ ID NO. 33090
cttctctgtctcgctcctttgggattccagaagtgtctgcttgactcgccggcggcggcgccgcagccttttccggccaaaaccctaccctgccccgcgccgcggccatctccggccagtaacctaccctgctccgcgaagcggtcgaaggtaggtaggagtgtaccgagaagggaagccgtggtcggagcagcggaggtttcaggatggtcttcgggcaggtggtgatcggcccgccgggctgcggcaagaccacctactgcaacggcatgtcgcagttcctctccctccttggcaggaaagttgcagttgtgaatcttgaccctgccaatgatgcattgccatatgaatgtgctataaacatcgaggaccttataaaactcagtgatgtcatggctgagcattcacttggcccaaatggaggacttgtttattgcatggattacttggagaagaatattgactggcttgagggaaaattgaagcctcttattgaagatcactatctgttatttgattttccgggacaagttgaacttttcttccttcactcaaatgcaagaagtgttattaataaactcatcaaaaagctaaacttgaggctgactgctgtgcacctcattgatgctcatttatgctgtgatcctgggaagtatgtgagtgctttgcttctttcgctgtcaacgatgctacatttggaattgccacatatcaatgtcttgtcaaagattgacctcattgagaactatggaaatttagcattcaaccttgacttctacactgatgtccaagatctttcttacctgcaacatcatcttgagcaggatcctcgttctgccaagtacaggaaactgactaaagagctctgtgatgtgattgacgattttggtttagtcaatttttcaactttggacatccaggacaaggaaagtgttggcaatcttgtgaagttgattgacaagagcaatggttatatattttcttctattgacagtagtgctgttgagttcagcaaaattgcggcggcgcctcttgattgggactactacagaacagcagcagtgcaggagaagtacatgaaagatgatgagttcgtgcaacagacaagcaggatgcaatgaggctggcggtggcatccccacttttgtagcactacggttgaaacatgtcagtgtggcataccaactacggttgctagagaaccgtgaacttgcatgaacccatgtagctcagctgtagatgttctctgaagctccttagtagttgcctgatgtgttgtagcttgctgtcatcaccttctggagtgaatgcgaaacacctgggaagaaatgtattcccaacgaaggactgttctctggagcaacgtttctttttgccatgaaggtctgttctctgttgattccacggttgatcttacacccctgcctttgtaactcacaaaaagtgttgctctgtcacactagggagaatatttttggggagtataaaaatacgttagaccttagctaacc

SEQ ID NO: 33090 - protein, 304 aa, Panicum virgatum
  misc_feature: Ceres CLONE 1914250
  misc_feature (7)..(256): Pfam Name: ATP_bind_1 Pfam Description: Conserved hypothetical ATP binding protein
MVFGQVVIGPPGCGKTTYCNGMSQFLSLLGRKVAVVNLDPANDALPYECAINIEDLIKLSDVMAEHSLGPNGGLVYCMDYLEKNIDWLEGKLKPLIEDHYLLFDFPGQVELFFLHSNARSVINKLIKKLNLRLTAVHLIDAHLCCDPGKYVSALLLSLSTMLHLELPHINVLSKIDLIENYGNLAFNLDFYTDVQDLSYLQHHLEQDPRSAKYRKLTKELCDVIDDFGLVNFSTLDIQDKESVGNLVKLIDKSNGYIFSSIDSSAVEFSKIAAAPLDWDYYRTAAVQEKYMKDDEFVQQTSRMQ

SEQ ID NO: 33091 - DNA, 728 bp, Panicum virgatum
  misc_feature: Ceres CLONE 1914287
  misc_feature: Encodes the peptide sequence at SEQ ID NO. 33092
aagataatattttctgtttcctcactaagatgaggatcgatgcttacctgacacaccttatcttcttgcttctggtctctctggctgtgttgcacgctcatgcgtcacagcaagctcagctcgagaaattcatcttgtccagaagagctagaactagcagcagtgaggctagtctaaatgggtggtctggtgtcagtgtcaggagcagcctccaagtccaagcagggtactcgggctccgaccagagtgccctgaaggcggccgataagatcccggcgctgccaggccagccggagggcgtcgacttcgaccagtacggcggatacgtgaccgtcgacgacaagaacggccgcgcgctcttctactacttcgtggaagcgccgcaggatgcgtcgtcgaagccactcctcctgtggcttaatggagggcctggatgttcgtcccttggatttggagcgatgctagaactgggcccgttccgggtgaacaacgacaacaaaacgctcagcaggaacaggcatgcatggaacgaagaggctaatgtgatatttttggagtcgcctgctggtgttggattctcctactcaaacacatcctctgattacgataagagcggggactcaaaaacagcagaggacgcctacatctttctcgtcaactggctcgagagattccccgagtacaagacccgtgccttctacatctccggtgagagctacgccggtcac

SEQ ID NO: 33092 - protein, 232 aa, Panicum virgatum
  misc_feature: Ceres CLONE 1914287
  misc_feature (85)..(232): Pfam Name: Peptidase_S10 Pfam Description: Serine carboxypeptidase
  misc_feature: SWISSPROT Homolog: EC 3.4.16.6 Carboxypeptidase D
MRIDAYLTHLIFLLLVSLAVLHAHASQQAQLEKFILSRRARTSSSEASLNGWSGVSVRSSLQVQAGYSGSDQSALKAADKIPALPGQPEGVDFDQYGGYVTVDDKNGRALFYYFVEAPQDASSKPLLLWLNGGPGCSSLGFGAMLELGPFRVNNDNKTLSRNRHAWNEEANVIFLESPAGVGFSYSNTSSDYDKSGDSKTAEDAYIFLVNWLERFPEYKTRAFYISGESYAG

SEQ ID NO: 33093 - DNA, 668 bp, Panicum virgatum
  misc_feature: Ceres CLONE 1914339
  misc_feature: Encodes the peptide sequence at SEQ ID NO. 33094
agctatctatagctagtctctcacacaacacaacacaacacaacaccgcgcctcaagcagagagccgcagcagcagcagaggtgatgatgctggatgccatggacgcggcgagcatcatagggtacttcaagggcaagagcatcctcgtcaccggcgcaactgggtttcttggaaagatccttgtggagaagataatgcgcgtgcagcctgatgtccacaagatctaccttcttgtgcgagcgatcgatgagccatctgcaaagcaacgcgtccagcaagaggtgatagacgcggagctgtttgacctcctgagagagaaacatggcaagggcttccagcagttcgtggaggagaaggtggttgcattggccggagacatcatctacgagaacctgggcctggagacacccatgctggaggcgcttgccaaggagatcgacgtcatcgtcaacattgcagcaaccaccaacttctacggaaggtctagcagctcatcgatcatcagctatatatgacacaattgtatttattacttgtatctatttgtataatggttattacttgcatgtactaattaatttaatttttctgatatatgatgcatgcatggcttgtaggtatgatgtttccttggatgtgaacgtgatgggggtgaagcacctgtgcc

SEQ ID NO: 33094 - protein, 143 aa, Panicum virgatum
  misc_feature: Ceres CLONE 1914339
  misc_feature (22)..(143): Pfam Name: NAD_binding_4 Pfam Description: Male sterility protein
  misc_feature: SWISSPROT Homolog: EC 1.2.1.31 L-aminoadipate-semialdehyde dehydrogenase
MMLDAMDAASIIGYFKGKSILVTGATGFLGKILVEKIMRVQPDVHKIYLLVRAIDEPSAKQRVQQEVIDAELFDLLREKHGKGFQQFVEEKVVALAGDIIYENLGLETPMLEALAKEIDVIVNIAATTNFYGRSSSSSIISYI

SEQ ID NO: 33095 - DNA, 707 bp, Panicum virgatum
  misc_feature: Ceres CLONE 1914341
  misc_feature: Encodes the peptide sequence at SEQ ID NO. 33096
acagggggagtgaacaaatccatcgccaggagggagctagtacaaggcaacaagagaagaagacggccgggaatcggagctagcgaatcgagatctccaagactccaactaaccaagaggccggcaacaataatggaggaggaggggcagtcgtcggcgccgttgctggaggagaagcagcagaccgcctgggtggaagggtgccccgggtgcgccgtggacaggaggaaggcggccaacccgggcatcccctacggcagcttcatatacgtctggatcgtcaccctctgcacagctttgccaatatcatcattgttccccttcttgtattttatgataagagacttgaatgttgctaaaagaacagaagatatcggcttctatgccggttttgtaggtgcttcatttatgtttggtagatgcttgacttcaacagcttggggaatagcggcggaccgtattgggaggaaaccagttgtcatgtttggcattttctccgtggttgtgttcaatactttgtttgggcttagtgtcagctattggatggcaattgttacacgatttttgctgggtgctttaaatggtctacttggaccaattaaggcttatgccattgaagtttgccgatcagaacatgaagccctagcattgtcacttgtcagcacggcatgaggaataggtctcatcattggtcctgctttaggagg

SEQ ID NO: 33096 - protein, 179 aa, Panicum virgatum
  misc_feature: Ceres CLONE 1914341
  misc_feature: Useful for making plants with modulated flowering time
MEEEGQSSAPLLEEKQQTAWVEGCPGCAVDRRKAANPGIPYGSFIYVWIVTLCTALPISSLFPFLYFMIRDLNVAKRTEDIGFYAGFVGASFMFGRCLTSTAWGIAADRIGRKPVVMFGIFSVVVFNTLFGLSVSYWMAIVTRFLLGALNGLLGPIKAYAIEVCRSEHEALALSLVSTA

SEQ ID NO: 33097 - DNA, 682 bp, Panicum virgatum
  misc_feature: Ceres CLONE 1914418-R
  misc_feature: Encodes the peptide sequence at SEQ ID NO. 33098
cccatcgccacccctcccactcacctgctgccaatcaaccaagaagcacgcgcagccacaccaagtcagggagaaggccatggccggcgtgaactcaaccagcgtcgtcgggctcaagcccaccgcggcggtgccgcaggccgccacctcctcgccggcggcgaagcgggtccaggtcgcgcccaaggaccaggcggccgagggccggcgcgcggcgctcctcggcctggcggccgtcttcgccgtcacggccaccaccgggtcggccaaggccgggatcatcgacgagtacctcgagaagagcaaggccaacaaggagctgaacgacaagaagaggctggctaccagcggcgccaacttctcccgcgcctacaccgtcgagttcggcagctgccagttcccctacaacttcaccggctgccaggacctcgccaagcagaagaaagttcccttcatcactgacgacctcgagatcgagtgcgaggggaaagagaagtacaagtgcggctccaacgtcttctggaagtggtgaagcgcacgcttgattggcttggaactggagggggcgctggcggtgtaacgtgtgtacctagatgcccaaactgcaggaaaaatttggatgtgtaatttaccgtcactgtatctgtgccatctcatcatcgtctgaacatgaacctcttgt

SEQ ID NO: 33098 - protein, 150 aa, Panicum virgatum
  misc_feature: Ceres CLONE 1914418-R
  misc_feature (9)..(150): Pfam Name: PsaN Pfam Description: Photosystem I reaction centre subunit N (PSAN or PSI-N)
MAGVNSTSVVGLKPTAAVPQAATSSPAAKRVQVAPKDQAAEGRRAALLGLAAVFAVTATTGSAKAGIIDEYLEKSKANKELNDKKRLATSGANFSRAYTVEFGSCQFPYNFTGCQDLAKQKKVPFITDDLEIECEGKEKYKCGSNVFWKW

SEQ ID NO: 33099 - DNA, 1502 bp, Panicum virgatum
  misc_feature: Ceres CLONE 1914418
actatgccgcccctcctccgcccgacctcaccctggcgctcctcagctagatcccaggcgtcgacacctaggatctcctgcactgcctcgagcttggatgtcgttggagcacgattcggctgatgccggtgcttgggcgggcacaaaactctctctctctctccctctccctctctctctctccacctcccctccccttcttcctccccgccagcctccatcgcccctccccaccgccgttgcgcaccgatgtcgtccccatcgaagaaggcgctcgcggctggcaatagtaggtcaacaacactgcaactccttcggatccattcgttgttctcgtaggtgttgatcgattagtgccatgcgcaagaaattggtgagtgattccccccagtccccacctctcagttaatttggtagacattggatgcaaatctcgtgagatttattggtacttggccatgggtgcttgattgcagatgtacttttgcagatagcaagtgatttcccccaaattcccagcccgcaatattattttgcccatatcacttttcatctgaaatgtgcaatatattctaggcctagatccgtgcactgctccattcctcatccctgaatttgttgtgttgctactgcagtaacgagaaatgatccccttaatctccttactccgatccatatattatgttctttggtgctctgattgcaaaagaagaggatccaaggcagaggtgagaacaataaaaggaacaagtccttttacgaggaattgcgggtgttattattagttatctttgtttttggactttcttgcctttcattataagctggctgaagcctcaaaaacaatcaggtcatacacgcatgccgaagttacatgccgcgtctccagaacatgggaggctaaaacctgcttagctagaaaataagctaccttattaaaatttttgctaacaaaagagatcaaaaactcttgaaagacaatcctgagatcactgatctctcgaagaacagggtcaatgatcgttgctaggtctcccaacttattccagagttgcaacacctgtaggcgatcggtctgaaccaccactcgctggaaccctagttgcagggcaagtttgagaccttctatgcgtatgccatagcttccatgaagcatgcgtcaaagcacctgtcctaccagatggcctgtgctgcttgaaaaacaccttcatggtccctgatatagaagttgcccatcacttgctgtcatcagaaaacactacatctatgttaatcttgaaacacccaggcaccggtttcttccatctcagatggtctgactctactgcctactgatcgagctgatgtcccagctgccacaaatcatgagccatgtcgctagcccataccacagcttgttgaattgtcattgttagctcaccatgtcgacttttattctgttgcatccacatagcccacatgccacacatgttattattattagttatctgacatgaagcatt

SEQ ID NO: 33100 - DNA, 649 bp, Panicum virgatum
  misc_feature: Ceres CLONE 1914427
  misc_feature: Encodes the peptide sequence at SEQ ID NO. 33101
aagttgcgcctcttcgcctcacgctgtcccgcgggcccgcacgtcagcgacagccgcccgaggtttagctgttccgcctcaatcccttccgcgccgccggcgagcaagggcgaagagatctgcttcgcgggagcgggaccatggcggcggcggagcagggggcggacgccgtgaaggagaaggaggagcaggagcaggtggtgagcccgtgggaggtgtcggcggggaagggcggcatcgactacgacaagctcgtggaccagttcgggtgccagcgcctcgacgccgcgctcgtcgaccgcgtcgcgcgcctcaccggccgcccgccgcacgtcttcctccgccggggcctcttcttcgcccaccgggattttaacgagatactggatctgtatgagaagggggagaaattctacctgtacacggggagggggccctcgtcggaggcgctgcacctcggccacctcatccctttcatgttcaccaagtaagcattggtcccggtccaaaactctggcagatatctgcaggaggctttcaaggtgcccttagttatacagctaactgacgatgagaagttctactggaagaacttgactgttgaggaaagcaaaaggcttgctcgtgaaaatgctaaagacattatagc

SEQ ID NO: 33101 - protein, 116 aa, Panicum virgatum
  misc_feature: Ceres CLONE 1914427
  misc_feature: SWISSPROT Homolog: EC 6.1.1.2 Tryptophan--tRNA ligase
MAAAEQGADAVKEKEEQEQVVSPWEVSAGKGGIDYDKLVDQFGCQRLDAALVDRVARLTGRPPHVFLRRGLFFAHRDFNEILDLYEKGEKFYLYTGRGPSSEALHLGHLIPFMFTK

SEQ ID NO: 33102 - DNA, 2057 bp, Panicum virgatum
  misc_feature: Ceres CLONE 1914455
  misc_feature: Encodes the peptide sequence at SEQ ID NO. 33103
acttttagttgcagcttaagccatggccgtctccctggtgctcccgtttaccctccttctcgccggcagtttcctcctccctaggccctccttggccgaagcagaggctgctgtggagctgggagaggcggtcctgacgctggacgccagcaacttctcggagttttcctctgtctcaactcccccatagtggctgactggcaagtgtcaacgccccgcaggtgtggccactgcaagcaactcgctccagagtacgagaaggcagccgctgttctgaggaagcatgacccgccagtggtgcttgcgaaggtggacgcgtacgacgaaaggaacaaggagatcaaggacaagtaccaggtacatgcgtaccccaccatcaagatcatagagaatggtgggaacaatgtgcgtggctatggtggtccgagggatgcagctggcatcgtggagtacatcaagaagcaggtcggcccggcttccatcgagctcagatcggcggaggaggccacccaagccattggtgacaagggattcgttcttgtaggagttttccccaagtttgccggtgtggattatgagaattttatggccgtggcagagaagaaacggtcagattatgatttctttcacacgtcagatgctggtattctgccacgtggtgatcaggccatcaagggccctgttgttcgtctctttaaaccatttgacgagctctttgttgattctcaggattttgataaggatgctcttgaaaaattcattgaggtgtctggtttccctactttagttacattcgatgctgatccaaccaaccataagtttcttgagagatactacagcactcctagtgccaaagcgatgcttttcttgaacttcagtgatgacagaatcgaggccttcaagagtcaaattcaagatgcagccaagaaattcagtgcaaataacataagttttctaattggtgatgttgaagctgctgaccgtgccttccagtactttgggctcaaagagaacgatgtccccctcctttttgttatcgcacaaggtgggaaatatctcaatccaactattgaccctgatcaagttataccctggttaaagcagtacatatatggaaatttgacgccttatgttaagtcagagccaatccccaaggtgaatgaccaacctgttaaggtcgtcgtggctgacagcatcgacgacattgttttcaactctggaaaaaatgattagttcttctcacttccacagttgtctgagcaatatataccccatagctcaatatgattgtattagtggttacaatcagttttcagttaagtttgcattgaacttgttttaggacttcatgcttgacataaccttttcttcacagtactgatcgaattttatgctccttggtgtggccattgccggaagctggccccgatcttggaggaagttgcagtctcaatgcaagacgacgaagatgttgtcattgcaaagatggatggcactgcaaacgatatccctaccgactttgcagtcgaggggtaccccacgatctacttctactcgaccacgggggacctctactcatacaacggcgggaggacggctgaggacatcatcagtttcatcaagaagcacaagggcccaaaagctggtgcagcggaggaagtgacacagacggatgccggtggtgtagaagagggcatcacaccttcatcgccgtcagaacttctgaaagacgagctctaaccaagacaccgtacctatccttttgtcgctcagtaactcctcgttcgagttcaaaaaaaaaaaaactcctcgatctggtctacgtcttttgctcagaggcatctcgggtgcagttaacccgaaactactctgcagaccacagattacacggagccaatgtgcgaggcagttgttcggatcagtttgtgttatcgtgtagtgaaactcatacgaggtacagagcaaagagtttcagttattagttggcataaatttttctggaaactatttgtcacagattgtcattgctagtgctaaatgtattaaggtcattagtt

SEQ ID NO: 33103 - protein, 215 aa, Panicum virgatum
  misc_feature: Ceres CLONE 1914455
  misc_feature: SWISSPROT Homolog: EC 5.3.4.1 Protein disulfide-isomerase
MAVAEKKRSDYDFFHTSDAGILPRGDQAIKGPVVRLFKPFDELFVDSQDFDKDALEKFIEVSGFPTLVTFDADPTNHKFLERYYSTPSAKAMLFLNFSDDRIEAFKSQIQDAAKKFSANNISFLIGDVEAADRAFQYFGLKENDVPLLFVIAQGGKYLNPTIDPDQVIPWLKQYIYGNLTPYVKSEPIPKVNDQPVKVVVADSIDDIVFNSGKND

SEQ ID NO: 33104 - DNA, 1290 bp, Panicum virgatum
  misc_feature: Ceres CLONE 1914485
  misc_feature: Encodes the peptide sequence at SEQ ID NO. 33105
cttccccgttgcgctcccttcctcttccggcggcggcggaccacccatggaggccgacgtcggctccaggtacgagattccccggaccgcggagttcctccgcgcgcgcgcctacaccagggtcgccctccagttccccgacgagatgctcaaggacgccgcggcgatgtcaagggcgctgcggcgggagctcgccacctccggcggcggcggggtcagggtgttcgtgatggccgacacggcgtacaattcctgctgcgtcgacgaggtgggcgcgtcacacatcgacgcgcagtgcgtcgtccactacggtcacgcctgcatgagcccaacatcacatttaccagctttcttcgtattcgggaaggcaccattggatatccatgcctgtgccacctcaatgctggagtgctcgagaaaaggcaataagtgtattctggttttatatgaactagagtatgcatatgcactggatgaccttagacgaacttttgaagagtcatgtaaatcaaattcttgcaatcctgaagtccagtatgcagacgttctgtgttcagttatgagcccattgtcaaatactgcagaggaaagttatcatcctcaatcgagtggaacctcttgccacgaagaattgtcgataaagagtgatgtgccaacatttctgaatattcgttgtagcatggaatgttctagttccacacagaagtacaatcttagtggtgttacatggaatatttcagctcaggagaaaatggaggactacttaatattttggattggacaagataattcggcatttgccaacattgtgctgaccttcaataaatgtgaaatagttagatatgacgcaataaaaaatcaactctcaacagatgtctctcatcttatgaaagttcttaggagaagatattaccttgtggagaaggcaaaggatgcaaacattattggcattttagtgggaactctgggtgttgctggttatcttcatatagttgagcaactgaaagaagtgatcagggccgctggaaagaaatcttatacattggtcatgggccggcctaattctgcaaaacttgcaaattttcctgagtgcgaagtttttgtttatgtttcttgtgcccaaactgctctgctggatagcaaagattttttagctccagttattacaccttttgaagctgtattagcttttagcaggggaagagagtggactggcgaatatcttatggatttcaaggatttgatcacttcggagaaacaggaagttacaagtgcgtctgaagaagcacg

SEQ ID NO: 33105 - protein, 414 aa, Panicum virgatum
  misc_feature: Ceres CLONE 1914485
  misc_feature (30)..(397): Pfam Name: Diphthamide_syn Pfam Description: Putative diphthamide synthesis protein
MEADVGSRYEIPRTAEFLRARAYTRVALQFPDEMLKDAAAMSRALRRELATSGGGGVRVFVMADTAYNSCCVDEVGASHIDAQCVVHYGHACMSPTSHLPAFFVFGKAPLDIHACATSMLECSRKGNKCILVLYELEYAYALDDLRRTFEESCKSNSCNPEVQYADVLCSVMSPLSNTAEESYHPQSSGTSCHEELSIKSDVPTFLNIRCSMECSSSTQKYNLSGVTWNISAQEKMEDYLIFWIGQDNSAFANIVLTFNKCEIVRYDAIKNQLSTDVSHLMKVLRRRYYLVEKAKDANIIGILVGTLGVAGYLHIVEQLKEVIRAAGKKSYTLVMGRPNSAKLANFPECEVFVYVSCAQTALLDSKDFLAPVITPFEAVLAFSRGREWTGEYLMDFKDLITSEKQEVTSASEEA

SEQ ID NO: 33106 - DNA, 632 bp, Panicum virgatum
  misc_feature: Ceres CLONE 1914485-R
ataactgcatcaaagaaagtatggaactgtcagaaacctcacttacattggctgaagtaacagaaaaggcactaagcatccaaaaccagaacaacgacgctgtccttcaccaaggaagagcaatgtcctcaatcgactacctcaaggcacgttcataccgtggtttaactggagattatgagggtccagcacctaattcaatcttggtgggcagaaaggggagggcagctggttacaatgatgagaaaacgcaaagttcacaatgatggcaattggcagttaatcagttactaaaggtctctggcgaggaaaacacagagttcacttgcacaatgaaaggttcaccattctgtgcaatacctgttatattttggctgggatagatagatttacagacgaccatggatttatcgttggtgtgcaatacctttggggaacaaacctttggggatgcacttctgttagaaactattgcattcggagagttagttttgatagtcacacgagctttgcagattccagaaactggcatgatttcagaagttgagaagctttgcgtggtttgccatttgttctgtaattgtccactatgtacaagacacaatttgccccatatattcttacttattggt

SEQ ID NO: 33107 - DNA, 1672 bp, Panicum virgatum
  misc_feature: Ceres CLONE 1914525
  misc_feature: Encodes the peptide sequence at SEQ ID NO. 33108
aaggaaggtgagatctcatctccctcatccgcctcccccgtccccctcctcgtcgtcgtcgtcttcctccacctgcccatctccatctggattccttttccgctcctgctcgctgcagtacaagtaagcaattctcgcctcccaataacaataggtggtgtggtatggtgtcgtcgattgattgatcgattggttggttgattttgtttgccgcaggatgcgcgcccctttcccccggtaggtaggtggacgagaaacctgatgatgatgatgatgatggccgccgccgccaaatctcccccgttcactctcgcctcttcccgcccgcagccccgcgccgccttcctctcccccagcctcgccttcagaccccgccgcgcctcgctgctcgccacacccgccccggacgccacgcccgccccggacgccgccaccaaccccttcgccgcgctcctccaggtgccccgcacgctctggcgccgcaccctccagcccctcggggactacggcttcggcacccgcagcgtctgggagggcggcgtcggcctcttcatggtctccggggccgcgctcctcgccctcgccctcgcctggctcaggggcttccagctccgctccagattccgcaagtacaacaccgtctttgagttcacgcaggcatgtgggatctgcgtcggcacgcccgtccggatacgaggggtcaccgtcggatccgtcgtccgcgtcgactcatccctcaggagcatcgatgcgctcgtcgaggttgaagatgataaaatcatcataccacgtaattcagtggttgaggtgaaccagtctggtcttctaatggagacactcattgatatcacaccaaaagatccactccctgcaccttcactaggaccactacaccctgattgtaccaaagaaggtttgattctctgtgacaaagagaggatgaaaggacagcaaggagtaagcttagatgcattggttggaatatttacccgtctaggaagagacatggaggaaattggtgttaccaaaagctataagttggctgaaaaggttgcatctataatggaagaagcacaacctcttcttacacggattgaagccttagcagaggaaattcagcctatgctctctgaggttcgtgatagcgatctactcaaggatgtagagactatagctaaaggcctggctgatgcgtctggtgacttgagaaggctcaagtcatccatgcttacccctgagaacacggatctcattaagcagtctattttcacccttatatttacgcttaagaacattgagagtatcagctcggacatctctggcttcacgggtgatgagacgacacggcggaacatcaagcttctgatcaagtctcttagcaggctgttgtgattggttgtcgatgatgatcgctggggactgggaattgatcttggtagagtagggcggctgtctgtcttgttgacactgaggtaggatgagaaggaatagctaattattgttccgcaaggttttggttgtttttgttgcaagttttccgaacagtctaaattcgatcggtcttccaaccgaacaaaagaaaaagagagcaagcatgaggagtaattactccctacttgccgagctgttatcttcagtcagtcgtataatataataggcccatgtttttggt

SEQ ID NO: 33108 - protein, 279 aa, Panicum virgatum
  misc_feature: Ceres CLONE 1914525
  misc_feature (25)..(102): Pfam Name: MCE Pfam Description: mce related protein
MVSGAALLALALAWLRGFQLRSRFRKYNTVFEFTQACGICVGTPVRIRGVTVGSVVRVDSSLRSIDALVEVEDDKIIIPRNSVVEVNQSGLLMETLIDITPKDPLPAPSLGPLHPDCTKEGLILCDKERMKGQQGVSLDALVGIFTRLGRDMEEIGVTKSYKLAEKVASIMEEAQPLLTRIEALAEEIQPMLSEVRDSDLLKDVETIAKGLADASGDLRRLKSSMLTPENTDLIKQSIFTLIFTLKNIESISSDISGFTGDETTRRNIKLLIKSLSRLL

SEQ ID NO: 33109 - DNA, 723 bp, Panicum virgatum
  misc_feature: Ceres CLONE 1914594
  misc_feature: Encodes the peptide sequence at SEQ ID NO. 33110
agcgaccaaccactctcagtctcagtcacccaccgcacccctgagctagggtttccgcaccccgatcgatccaagctgcctccatgtccaccgcggcggcgcagggcggcgacaagccggcgctccgcaagcccgtcttcaccaaggtcgaccagctcaggccgggcaccaacggccacaccctcaccgtcaaggtcgtcagcgccacccccgtccctggacgcgcgcgcccaggagccaccaccaccaccaccaccgcgtccccccgcgcgccacgcatcgccgagtgcctcgtcggggatgagaccggcgccatagtcttcacggcccgcaacgaccaagttgatttgctgaagcctgatgccacagtgatcttgcgcaatgctaaaattgacatgttcaaaggatcaatgaggcttgcagttgataaatgggggcggattgaggctacagaacctgccagcttcacagtgaaggagaacaataacctgtcactagtagagtatgaattggttaatgtggctgagtaattggccaagcttttctaccccttttccgcgccataagaaggaagtaccatgaatgaacatcataaagcctctcaaagcgagtttatttgttacagtggtacagtagtagataattaaggtgaaggttgtatcgctcctgttagaactttggattgagtaagctgagttgaccttgcatcgacgagattgtatt

SEQ ID NO: 33110 - protein, 148 aa, Panicum virgatum
  misc_feature: Ceres CLONE 1914594
  misc_feature: Useful for making plants with modulated drought sensitivity
  misc_feature: Useful for making plants with modulated water use efficiency
MSTAAAQGGDKPALRKPVFTKVDQLRPGTNGHTLTVKVVSATPVPGRARPGATTTTTTASPRAPRIAECLVGDETGAIVFTARNDQVDLLKPDATVILRNAKIDMFKGSMRLAVDKWGRIEATEPASFTVKENNNLSLVEYELVNVAE

SEQ ID NO: 33111 - DNA, 722 bp, Panicum virgatum
  misc_feature: Ceres CLONE 1917166
  misc_feature: Encodes the peptide sequence at SEQ ID NO. 33112
aaaaccaattcggcgctcctcttatctcgccgcgccgccgctccatttccttcctcctcccaaaacctcgaaaccctacccgcgggattcctccgcgggctcgcctgccctagggttcactccgcagtctccgctccggcccgcagccatggccgtggcggaagcgagtagcagcggcggcggcggcgaggaggggtccggggcgtggacccgcgagcaggagaaggcgttcgagaacgccatcgcgaccatggcggaggaggcggacggggacgcgcggtgggagaagatagcggaggccgtcgaggggaagacggcggacgaggtcaggcggcactacgagctgctcgtggaggacgtcgagggcatcgatgcgggccgcgtgcccctcccgacgtacgcggccgacggcggtgccgaggaagggggcggcggcggcaagaaggggggcgggggaggcgggtcccacggggagaaggggtcggccaagtcggccgagcaggagcgcaggaaggggatcgcgtggacagaagacgagcacagattgttccttcttggacttgaaaagtacggcaaaggtgactggcggagcatctctcggaactttgtgatctcaaggacgccaactcaagtagctagtcatgcgcagaagtattttatccgtctgaactcaatgaatagagagaggcggcgatcaagtatacatgatatcactagtgtga

SEQ ID NO: 33112 - protein, 191 aa, Panicum virgatum
  misc_feature: Ceres CLONE 1917166
  misc_feature (123)..(170): Pfam Name: Myb_DNA-binding Pfam Description: Myb-like DNA-binding domain
  misc_feature (17)..(68): Pfam Name: Myb_DNA-binding Pfam Description: Myb-like DNA-binding domain
  misc_feature: The sequence is a functional homolog of SEQ ID NO 36 in the 10/286,264 US patent application
  misc_feature: The sequence is a functional homolog of SEQ ID NO 864 in the 10/412,699 US patent application
  misc_feature: The sequence is a functional homolog of SEQ ID NO 1897 in the 11/479,226 US patent application
  misc_feature: The sequence is a functional homolog of SEQ ID NO 120 in the 11/375,241 US patent application
  misc_feature: The sequence is a functional homolog of SEQ ID NO 2680 in the 10/374,780 US patent application
  misc_feature: The sequence is a functional homolog of SEQ ID NO 654 in the 10/225,066 US patent application
  misc_feature: The sequence is a functional homolog of SEQ ID NO 1893 in the 11/479,226 US patent application
  misc_feature: The sequence is a functional homolog of SEQ ID NO 2678 in the 10/374,780 US patent application
  misc_feature: The sequence is a functional homolog of SEQ ID NO 340 in the 10/225,066 US patent application
  misc_feature: The sequence is a functional homolog of SEQ ID NO 1930 in the 10/412,699 US patent application
  misc_feature: The sequence is a functional homolog of SEQ ID NO 246 in the 10/714,887 US patent application
  misc_feature: The sequence is a functional homolog of SEQ ID NO 246 in the 11/435,388 US patent application
  misc_feature: The sequence is a functional homolog of SEQ ID NO 452 in the 10/374,780 US patent application
  misc_feature: The sequence is a functional homolog of SEQ ID NO 88 in the 10/225,068 US patent application
  misc_feature: The sequence is a functional homolog of SEQ ID NO 984 in the 10/225,066 US patent application
  misc_feature: Useful for making plants with modulated nitrogen use efficiency
  misc_feature: Useful for making plants with altered lignin content
  misc_feature: Useful for making plants with modulated low light sensitivity
MAVAEASSSGGGGEEGSGAWTREQEKAFENAIATMAEEADGDARWEKIAEAVEGKTADEVRRHYELLVEDVEGIDAGRVPLPTYAADGGAEEGGGGGKKGGGGGGSHGEKGSAKSAEQERRKGIAWTEDEHRLFLLGLEKYGKGDWRSISRNFVISRTPTQVASHAQKYFIRLNSMNRERRRSSIHDITSV

SEQ ID NO: 33113 - DNA, 660 bp, Panicum virgatum
  misc_feature: Ceres CLONE 1917203
  misc_feature: Encodes the peptide sequence at SEQ ID NO. 33114
gttgttttctcgttctggcttaaccgtgatcctgatgcatctgctggaggtgaacttgtctttggcggtgttgacccaaagcactacaagggaagccacacatatgtccctgttactcgcaaaggctactggcagtttgacatgggggatcttctgatcggcggccactcaacaggttactgtgctggtggttgtgctgctattgtggactcagggacttcacttcttgctggcccaactaccatagtggctcaagtcaatcatgcaattggagctgagggagtcatcagtacagaatgcaaagaagtggtgagagagtatggagagatgatccttgagttgctcatagcgcaaactagtccacaaaaggtctgcactcagatcggtctctgtgtatttgatggtactcattctgtcagcaacccaattgaatcagttgtcgagaaacaaaagcaaggttctgatcttttctgtactgcttgtgagatggctgttgtctggatacagaatcaactccgagaaaacaagacgaaagagctcattttgaactatgcgaatcagctctgtgagcgcctccccagccccaatggtgaatcaactgtcgactgccatcagatctcaaagatgccaaaccttgcattcaccataacaaacaagacc

SEQ ID NO: 33114 - protein, 219 aa, Panicum virgatum
  misc_feature: Ceres CLONE 1917203
  misc_feature (155)..(193): Pfam Name: SapB_1 Pfam Description: Saposin-like type B, region 1
  misc_feature (97)..(131): Pfam Name: SapB_2 Pfam Description: Saposin-like type B, region 2
  misc_feature: SWISSPROT Homolog: EC 3.4.23.40 Phytepsin
VVFSFWLNRDPDASAGGELVFGGVDPKHYKGSHTYVPVTRKGYWQFDMGDLLIGGHSTGYCAGGCAAIVDSGTSLLAGPTTIVAQVNHAIGAEGVISTECKEVVREYGEMILELLIAQTSPQKVCTQIGLCVFDGTHSVSNPIESVVEKQKQGSDLFCTACEMAVVWIQNQLRENKTKELILNYANQLCERLPSPNGESTVDCHQISKMPNLAFTITNK

SEQ ID NO: 33115 - DNA, 690 bp, Panicum virgatum
  misc_feature: Ceres CLONE 1917212
  misc_feature: Encodes the peptide sequence at SEQ ID NO. 33116
aacgccaccatatcccttcccttccgcgaccccttctcgccgtcgccgccggctccgtccagatccagatatgcctcgctatgatgatcgctatggaggaacgcgcttgtatgttggcagattggcctcccgtactcgttcccgcgacctagaatatctgttcagcagatatggaagaatacgagaagtggagttgaagcgcgactatgcattcattgagttcagtgatcctcgtgatgctgatgatgcgcgatacaacctagatggcagggatgttgatgggagtcgcattattgttgagtttgctaaaggcgttccacgcggaccaggtggctcacgtgaatccatgggaagaggccctcccccgggaacaggtcgttgtttcaactgtggaattgatggtcactgggcgagagactgtaaggctggtgactggaaaaataaatgctaccgatgtggagaaaggggacatatagaaagaaattgccagaacagccctaggagtatcaggcgtgagagaagctactcacggtccccatctccacgccatggacggggccgcagtcggagctacagcagaagtcggagccggagccgtagcaatagccgctcaagatccctatctggatctcctaggggaggccgccgtgaccgtggtgagaggagatcaaggagccttagctacagcag

SEQ ID NO: 33116 - protein, 206 aa, Panicum virgatum
  misc_feature: Ceres CLONE 1917212
  misc_feature (13)..(76): Pfam Name: RRM_1 Pfam Description: RNA recognition motif. (a.k.a. RRM, RBD, or RNP domain)
  misc_feature (102)..(119): Pfam Name: zf-CCHC Pfam Description: Zinc knuckle
  misc_feature (124)..(141): Pfam Name: zf-CCHC Pfam Description: Zinc knuckle
  misc_feature: SWISSPROT Homolog: EC 5.2.1.8 Peptidylprolyl isomerase
MPRYDDRYGGTRLYVGRLASRTRSRDLEYLFSRYGRIREVELKRDYAFIEFSDPRDADDARYNLDGRDVDGSRIIVEFAKGVPRGPGGSRESMGRGPPPGTGRCFNCGIDGHWARDCKAGDWKNKCYRCGERGHIERNCQNSPRSIRRERSYSRSPSPRHGRGRSRSYSRSRSRSRSNSRSRSLSGSPRGGRRDRGERRSRSLSYS

SEQ ID NO: 33117 - DNA, 518 bp, Panicum virgatum
  misc_feature: Ceres CLONE 1917218
  misc_feature: Encodes the peptide sequence at SEQ ID NO. 33118
atctctcccccccactcctcccatcatggcagcggcaccggcggcgcgtcccaccctcgcgctcctcacctccgcctcggcgtcgctcggggccgggcgccgcgcgtgggctcgcctggccgtctcctcctctatggcggggccggctctccccaggatccgcggccggcgcgcgttccccgccggagacgggagcgtagtgatgggaaaggccggaccccgcgccgtcgaacccgaagcggggatggaccccccccagcggcgactcatgctcgaggaagagtgcattctatttgatgaactcgacaacgtcataggacacaactccaaatatagctgccgtctcatggaaaataaaaaaactggacatgccctgcacagagctatcagtgttttcctttgctactccaaatatgagttgctactctcagcgaaggtctgctgcaaaatcgacatttataattgtatggacgatcgcttgctgtaaccatctctctctacagtgagtcagagtagat

SEQ ID NO: 33118 - protein, 153 aa, Panicum virgatum
  misc_feature: Ceres CLONE 1917218
  misc_feature: SWISSPROT Homolog: EC 5.3.3.2 Isopentenyl-diphosphate Delta-isomerase
MAAAPAARPTLALLTSASASLGAGRRAWARLAVSSSMAGPALPRIRGRRAFPAGDGSVVMGKAGPRAVEPEAGMDPPQRRLMLEEECILFDELDNVIGHNSKYSCRLMENKKTGHALHRAISVFLCYSKYELLLSAKVCCKIDIYNCMDDRLL

SEQ ID NO: 33119 - DNA, 666 bp, Panicum virgatum
  misc_feature: Ceres CLONE 1917219
  misc_feature: Encodes the peptide sequence at SEQ ID NO. 33120
tccttgctgcttgctggtgttgctgccggaggagtgaactgaaaggaggaaggagatcagtagaggagagtgtgtgggagtgcgagaccgagccgtgtcaccttcccttgttaggttgctggtggccatggcggcagcggcggcgccgtacgcgcaggtgatggaggacatgcgcagggggcgagacctcgccacgcagctgcaggcgctgctgcgggactcgcccgaggccggccgcctcgtcgaccggatcctccacgccatgtcccgcaccatcgagacggccagggcggccgccgcggcggaggagggctccgaggggcacagcgaggtcacctgcgccggcagcggcgccggcaagaggaacgccgccggaggaggcggggacaagagggccgcctgccggaggagagcccacaattcatccactgtcacggtgaccatcaaggatattgaggatgggcacgcctggcgcaagtacgggcagaaggagatacaaaactccaagcacccaaaggcctacttccggtgcacgcacaagtacgaccagcagtgcacggcgcagcggcaggtgcatcgctgcgacgacgacccggatgccttcagggtcacctacatcgccgtgcacacctgccgggaccccgccgccatcgcgccggtcgtgct

SEQ ID NO: 33120 - protein, 179 aa, Panicum virgatum
  misc_feature: Ceres CLONE 1917219
  misc_feature (109)..(171): Pfam Name: WRKY Pfam Description: WRKY DNA -binding domain
MAAAAAPYAQVMEDMRRGRDLATQLQALLRDSPEAGRLVDRILHAMSRTIETARAAAAAEEGSEGHSEVTCAGSGAGKRNAAGGGGDKRAACRRRAHNSSTVTVTIKDIEDGHAWRKYGQKEIQNSKHPKAYFRCTHKYDQQCTAQRQVHRCDDDPDAFRVTYIAVHTCRDPAAIAPVV

SEQ ID NO: 33121 - DNA, 1568 bp, Panicum virgatum
  misc_feature: Ceres CLONE 1917242
  misc_feature: Encodes the peptide sequence at SEQ ID NO. 33122
agttccatttggacctccgcctccttcctcccctcctcttcactctctcccttgcatcaccaacaagaaggctaacgcacaccaacccaagaacaaggaggggaagagaaggaaagggaaaaaaaaaaggaattttgatcgcccagagtgtggtagtagaatagcaatttgatctctcctcgttcgaggtcagtgcgcgaggcaataatggtggccgtggaggctgcggcggcggcggcggcggcggcggcggtggagggctcgatccgggcggaggccaaggtggcgccggagccggaggccgaggtggaggtgaagggcgatgccccggccgcgggggaaggccgaggaggaggaggagaaggagtacaagagcgacatgaggaagctggaggagctcatgtccaagctcaacccctgcgcgcaggagttcgtgccgtcgtcgcgccgcgccgcggcgccggcggcgaagccggcggggggaggcgtgctctccgccgacgcgccggtgttcgtctccgccgccgagtactacggcgctgccggagggcacctgcaggtggccggcggcgggagccgggactccagcagcgacggatccagcaacggcagcggccaccctctgaatcgccggagaaggagtagcttcaaccaggggaggcggaggatggggggccgaccccgacgggctgatagggaggatagtgtgcagcgaaccgtctacgtctctgacattgatcagcatgtgactgagcagaagcttgctgaagtgttttctaattgtgggcaagtggtagattgccgtatctgtggtgacccacattctgtcctgcgttttgcgttcatcgagtttgctgatgatgctggtgcaagagcagcactaacacttgggggaaccatgcttggttattaccctgttagagttttaccttctaaaacagcaattctacctgtgaaccctaaatttcttcctcgaactgaagacgagaaagaaatggtctcaaggactgtatattgtactaacatagataagaaggttaccgaggaggatgtaaagattttctttcagggtacatgtgggaaggtttcacgcctgaggctccttggtgactatgtacactccacgtgcattgcttttgttgagtttgctcaggcagaaagtgcaattatggccctgaacttcagtggcatggtccttggctcccttcctattagggtgagcccctccaagacaccagtccgtccgcggtctcctcgcgtgatgtccaactgagcctgtcccgctccaagccgccatcgcccttgaggctgccaccagtggcagatcatccccaggcagagcttcctctagttgtgatcatgctagagccgtcgcatcgcgaatcagtaacccgtggtgttttcctagtacctagtcgtcataggaaagtcaacttgctgctaatgttctctcggaggcccatgcatctcttgttgtcggaggcaccgttttcctttagtttctgttcgttgccgccgttatgttaattatggatgaattcttatataacagccttttcaggccccag

SEQ ID NO: 33122 - protein, 316 aa, Panicum virgatum
  misc_feature: Ceres CLONE 1917242
  misc_feature (133)..(201): Pfam Name: RRM_1 Pfam Description: RNA recognition motif. (a.k.a. RRM, RBD, or RNP domain)
  misc_feature (230)..(299): Pfam Name: RRM_1 Pfam Description: RNA recognition motif. (a.k.a. RRM, RBD, or RNP domain)
  misc_feature (25)..(42): Pfam Name: PAM2 Pfam Description: Ataxin-2 C-terminal region
  misc_feature: The sequence is a functional homolog of SEQ ID NO 1301 in the 10/666,642 US patent application
MPRPRGKAEEEEEKEYKSDMRKLEELMSKLNPCAQEFVPSSRRAAAPAAKPAGGGVLSADAPVFVSAAEYYGAAGGHLQVAGGGSRDSSSDGSSNGSGHPLNRRRRSSFNQGRRRMGGRPRRADREDSVQRTVYVSDIDQHVTEQKLAEVFSNCGQVVDCRICGDPHSVLRFAFIEFADDAGARAALTLGGTMLGYYPVRVLPSKTAILPVNPKFLPRTEDEKEMVSRTVYCTNIDKKVTEEDVKIFFQGTCGKVSRLRLLGDYVHSTCIAFVEFAQAESAIMALNFSGMVLGSLPIRVSPSKTPVRPRSPRVMSN

SEQ ID NO: 33123 - DNA, 706 bp, Panicum virgatum
  misc_feature: Ceres CLONE 1917264
  misc_feature: Encodes the peptide sequence at SEQ ID NO. 33124
gaccaacctcagctcactatcctcatcttgccgcctctgcacgtctctccacctcatggctcgctctcgctccaaccgctaccgccaggacctgttcgtcgccgtcgccgtcgccgtcgccgtcgcggcgtgtcttgccgtcggggaggcggcgtccttcgtcggcttcgacctccaccaccgcacctccccggtggtccggcgctgggcggaggcgcggggccaccacgccctcgccgcggagtggccggctaaaggctcgccggagtactactccgagctctcccgccatgaccgcgcccgccgcggcctcgccggcgccggcgaccaactcctgaccttcggtgatggcaacgcaaccgtccaatacctcggattcttgtactacgcgttggtggcgctgggcacgccgaacgcgacgttcctggtggcgctggacaccggcagcgacctcttctgggtgccctgcgactgcaagcagtgcgcgccgctgcccaacaacggcacggcggagggcgtgccgccgctccgcgagtacagcccgaggcggtcgtcgacgagcacgccggtgacgtgcgagagcccgctctgcgaccggcccaacgcctgcggcgccgccaccaacggcagctgcccgtacggcgtccgctacgtgtccgccaacacctcctcctccggggtgctcgtccaggacgtgctccacctc

SEQ ID NO: 33124 - protein, 216 aa, Panicum virgatum
  misc_feature: Ceres CLONE 1917264
  misc_feature: SWISSPROT Homolog: EC 3.4.23.12 Nepenthesin
MARSRSNRYRQDLFVAVAVAVAVAACLAVGEAASFVGFDLHHRTSPVVRRWAEARGHHALAAEWPAKGSPEYYSELSRHDRARRGLAGAGDQLLTFGDGNATVQYLGFLYYALVALGTPNATFLVALDTGSDLFWVPCDCKQCAPLPNNGTAEGVPPLREYSPRRSSTSTPVTCESPLCDRPNACGAATNGSCPYGVRYVSANTSSSGVLVQDVLH

SEQ ID NO: 33125 - DNA, 732 bp, Panicum virgatum
  misc_feature: Ceres CLONE 1917268
  misc_feature: Encodes the peptide sequence at SEQ ID NO. 33126
agatagcctcgcaagttaaggccaagggaaaaaaaatcgccagccgtgtgcccgtgtaccaggatcgagccagcaccatggtgcatcaggctcaggggcagatggtgcaggaggtggccgccggcagcctccccgcgccgccgagccggtacgtgctgaaggaggaggaccggcctaccggcggcgtcgcggcgcccgtgctggccttccccaccgtggacctgcagcgcctggccgagcccggcgacgtcgaagaggccgccaagctccggtcggcgctcgagtcctggggcctcttcacggtgaccggccacggcatgccggagtcgctcctcgccggcgtccgcgacgccggtttggagttcttccacctgccgccggaggagaagctgcggcacgccaaccggacggacgacggcgagttccagccggaggggtacggcatcgaccgcgtggacaccgacgagcaagtcctcgactggtgcgatcggctgtacctcgccgtgcagccggaggagcggcggcaggcgcggttctggcccgcgcgcccgccgtcgctcgcggggctcctgaacgagtatgcccagggcagcgagcgggtggcccggcgcgtgctcgcggccatggcggcggcgctgggcctcgacgaggacttcttcctccgccgcgtcggcgacaagccccccgcggacgcgcgcttcacctactacccgccgtgcccgctgccggagc

SEQ ID NO: 33126 - protein, 218 aa, Panicum virgatum
  misc_feature: Ceres CLONE 1917268
  misc_feature: SWISSPROT Homolog: EC 1.14.11.19 Leucocyanidin oxygenase
MVHQAQGQMVQEVAAGSLPAPPSRYVLKEEDRPTGGVAAPVLAFPTVDLQRLAEPGDVEEAAKLRSALESWGLFTVTGHGMPESLLAGVRDAGLEFFHLPPEEKLRHANRTDDGEFQPEGYGIDRVDTDEQVLDWCDRLYLAVQPEERRQARFWPARPPSLAGLLNEYAQGSERVARRVLAAMAAALGLDEDFFLRRVGDKPPADARFTYYPPCPLPE

SEQ ID NO: 33127 - DNA, 757 bp, Panicum virgatum
  misc_feature: Ceres CLONE 1917286
  misc_feature: Encodes the peptide sequence at SEQ ID NO. 33128
gatgcgcaaacaccggatcgccggactcgtggctgccctgctcgccctctccctctcgtccctccgcaccgcgcaagaggagccgcccatggcggacagcgggcctctggcgggcggcgtcacggacgtgccgcagaacgaaaacgacatccacctacaggagctcgcccgcttcgccgtcgacgagcacaacaagaaggccaatgctctcctgtggttcgagaagcttgtgaaggcgaagacgcaagtggttgctggaaccatgtactatctcactgttgaggtgaaggatggggaagccaagaagctctatgaagctaaggtctgggagaagccatgggagaacttcaaggagctgcaggaattcaagcctgttgaagagagtgctagcgcttaaggtagagttttgcatgctttacatgggtttcaaccaaagaaatttcgtttacttcatgcagcaaagtattatctttctctttggtcaaagtagaacatgctgtagataactatgcttatttttcatcccgagttataacacgatgaatggttattgccgtcctggtcaagtttgctatatacacatggaatctgaatagttgccatagaagtataaaacccgttttttgcttagttcgttatacttctctactgatcgtcggtactgttcagtgttcattgctgaataatgtctgttagactgttacattcattcccagagtttagcttttatgacataattcttcgatcaatacctatc

SEQ ID NO: 33128 - protein, 131 aa, Panicum virgatum
  misc_feature: Ceres CLONE 1917286
  misc_feature (38)..(126): Pfam Name: Cystatin Pfam Description: Cystatin domain
MRKHRIAGLVAALLALSLSSLRTAQEEPPMADSGPLAGGVTDVPQNENDIHLQELARFAVDEHNKKANALLWFEKLVKAKTQVVAGTMYYLTVEVKDGEAKKLYEAKVWEKPWENFKELQEFKPVEESASA

SEQ ID NO: 33129 - DNA, 718 bp, Panicum virgatum
  misc_feature: Ceres CLONE 1917294
  misc_feature: Encodes the peptide sequence at SEQ ID NO. 33130
aggcacagctctatctgactgcaacgcgggcacgcagctgcgcgccaccgccgtgccgtgtctccgagttgggcccttcgccatggccgggtgccgggtgccggcgtgcttcgtggcgctcctcgtcgtcgcgggggcgctcgcggcgccgggcgcggcgcgggagtacgcggccatcttcaacttcggggactccctggtggacgccggcaacctcgtggtggacggcatcccggactacctcgccacggcgcggctgccctacggcatgacctacttcggctaccccaccgggcggtgctccgacggccgcctcgtcgtcgacttcatcgcccaggagcttggtctgccgctgcttccgccgtccaaggcgaagaacgcgacgttccaccgcggcgccaacttcgccatcacgggcgcgacgtcgctggacacgcccttcttcgtggcgcgcgggctcgggaagacggtctggaactcggggtccctgcacacccagatcaagtggttccaggacctcaagcccaagatctgcggcggcggctccccggaggagtgccggtcgctgttccggcggtcgctcttcatcgtgggcgagttcggcggcaacgactacaactcgccgctgttcgcgttccggccgctgtcggaggcgcacgacttcgtcccgcacgtcgtggactccatcgccgagggcgtcgagaagctcatcgcggag

SEQ ID NO: 33130 - protein, 211 aa, Panicum virgatum
  misc_feature: Ceres CLONE 1917294
  misc_feature (32)..(211): Pfam Name: Lipase_GDSL Pfam Description: GDSL-like Lipase/Acylhydrolase
  misc_feature: SWISSPROT Homolog: EC 3.2.1.51 Alpha-L-fucosidase
MAGCRVPACFVALLVVAGALAAPGAAREYAAIFNFGDSLVDAGNLVVDGIPDYLATARLPYGMTYFGYPTGRCSDGRLVVDFIAQELGLPLLPPSKAKNATFHRGANFAITGATSLDTPFFVARGLGKTVWNSGSLHTQIKWFQDLKPKICGGGSPEECRSLFRRSLFIVGEFGGNDYNSPLFAFRPLSEAHDFVPHVVDSIAEGVEKLIA

SEQ ID NO: 33131 - DNA, 738 bp, Panicum virgatum
  misc_feature: Ceres CLONE 1917312
  misc_feature: Encodes the peptide sequence at SEQ ID NO. 33132
acaccaagcgcagcaggaccaccagcaggcggcagcagcagctcgccaccacctccgctcagatcagtgagcagcagtgcgtcgttgcgctgtgcaccaacaagagcaattgaggcaaggaaaatggcggcggcgtcgctcaagttcacggtgcggaggaagccggcggtgctggtggccccggcggcgccgacgccgcgggagctgaagcggctctcggacatcgacgaccaggacggcctacggttccacatccccgtcatccagttctaccgccggagcgcgatggccggggcgcgggaccccgcgccggtgatccgggccgccgtctcccgggcgctcgtgcactactacccgttcgccggcaggctccgggagctcgagggccgcaagctcgccgtggactgcaccggtgagggcgtgctgttcatcgaggccgacgcggacgtccgcctcgagcacttcggggacgcgctgcagccgccgttcccgtgcctcgacgagctcatcttcgacgtccccggctcgtccgaggtcctcggctcgccgctcctcctcttccaggtgacgcggctggcgtgcgggggcttcatcctgggggtgcgcctgcaccacacgatggcggacgcgcagggcctggtgcagttcctgggcgcggtggcggagctggcgcggggtgcggcggcgccgacggtgcgcccggtgtgggggcgcgagctggtggaggcgcgcgacccg

SEQ ID NO: 33132 - protein, 204 aa, Panicum virgatum
  misc_feature: Ceres CLONE 1917312
  misc_feature (8)..(204): Pfam Name: Transferase Pfam Description: Transferase family
  misc_feature: SWISSPROT Homolog: EC 2.3.1.162 Taxadien-5-alpha-ol O-acetyltransferase
MAAASLKFTVRRKPAVLVAPAAPTPRELKRLSDIDDQDGLRFHIPVIQFYRRSAMAGARDPAPVIRAAVSRALVHYYPFAGRLRELEGRKLAVDCTGEGVLFIEADADVRLEHFGDALQPPFPCLDELIFDVPGSSEVLGSPLLLFQVTRLACGGFILGVRLHHTMADAQGLVQFLGAVAELARGAAAPTVRPVWGRELVEARD

SEQ ID NO: 33133 - DNA, 707 bp, Panicum virgatum
  misc_feature: Ceres CLONE 1917331
  misc_feature: Encodes the peptide sequence at SEQ ID NO. 33134
accccgagccgccttccaaccagattcctcgcggccccctcgcttccgcccgcccaatccccgagcccgccgccgcgcttccgccggcgccgaatccggtattttgagtttcggtcgcgagcgcagctatgtccatgttcaacaggatcttcgggaagcccaaggagcaggctaactccaatgcgctggccactctggacaagttaaatgagactcttgatatgctggagaagaaagaaaaggtgctggagaaaaaagcggctgctgagcttgagagggcgaaggagttctcaagagcaaagaataaaagagcggctatccagtccttgaagaggaaaaaactttatgaacaacaaatcgagcagcttggaaatttccagttgagaatccatgatcagatgatcatgttagaagcagctaaagcgacaacagagactgtcgatgcattgaggactggagctgcagctatgaaagcaatgcaaaaagcaacaaatattgatgatgtcgacaagactatggatgaaattaacgaacagactgaaaacatgaaacaaattcaagatgctttatcagctcctcttggagcttctgctgatttcgatgaggatgaactggaagcggaacttgaagaactggagggagcagagttggaatctcagcttctggagcctgttgcagctcctccagtgcatccagtgcatgtccca

SEQ ID NO: 33134 - protein, 192 aa, Panicum virgatum
  misc_feature: Ceres CLONE 1917331
  misc_feature (21)..(189): Pfam Name: Snf7 Pfam Description: Snf7
MSMFNRIFGKPKEQANSNALATLDKLNETLDMLEKKEKVLEKKAAAELERAKEFSRAKNKRAAIQSLKRKKLYEQQIEQLGNFQLRIHDQMIMLEAAKATTETVDALRTGAAAMKAMQKATNIDDVDKTMDEINEQTENMKQIQDALSAPLGASADFDEDELEAELEELEGAELESQLLEPVAAPPVHPVHV

SEQ ID NO: 33135 - DNA, 1494 bp, Panicum virgatum
  misc_feature: Ceres CLONE 1917356
  misc_feature: Encodes the peptide sequence at SEQ ID NO. 33136
gagcgccgagcgccgagcgcaactgggaagcggcagagtgggaagaggagaaaggggaagcgagatcgccgccgccggtgaaggcgccggcaccgacgtcaccgatcgccgcctgcttcctagagactttgacatcatgcagaacaccagcaaaatatcgagcaccacaatcatgtcgctcagcgacgacgtgctcaccgagatcctcttccgcctcccgtccctggcctcgcttgcccgcgccgccctcacctgcccgcggtggcgccgcctggccgcctcctgcgatttcctcgccggcttcggcgcgcgccacgcctcgctcccgcttctcggctgcttcttctacgccgacgacggctactttgaggtccccgtcttccagcgcgcaaggaacctccctgacatggacctggccgctgtggtccgcggcggcgacttcctgctatccagcttcttcgaagatgacctgtggacgttcaaagacatttgtcagggcctcctcctcttcgccagcgacgacgagctcgccgtgttcaacccggtgtcgcgccgccgcacgtgcgtacccttgccgaacggtgagcatgacagggagacctcggtcgactgcttgctccctgccgccgacgcggcattccgcgtggtttccctagagcgcgatgagcaggagcgggtgcgcgtccacgagtacaactcccgcatgggcgagtggcgtccccagccgtggacgccgcacggcatcatcaactggagtccggacgattcgttgcgggcgatgcatgctgccgggcgtatctactggaagcacagcaacaagctgctctgtctcgagacggcccctagcgggtcggtgcaggtaagccacgttgccctcccaccggtgccaggcttagcagaggcggcggcgtcgtacgtggtcggggacatggaggacggcacctgctgcctcgcctgcgtcgcaatgtctcgacgtctccggagccgtacgctgcaggtgtggcttcgcagggaggatggcggcgggtcctgggagtttggatgggagaccaagttcctctcaggatattcactctgcgcggtgaatgccggcgttgtgctgttcgaggactacagggcctatcgcctcaacgagctcgacgagttacgttttggaggctatcctcagacggaggcatccttcttcgccagccgtggatcggaggcgtacccgtatgtggcatgctccaccgtgctgctgggcaggctcatacaagacgacggagatgaggcacgcgcgccgcctgggtgatcaactgccgaggccgaacatcatcaattttctgatcggacgtgatagagtcactgtagcaatcgccgaacatcatcaatgcactcctcaccgtcctacttgtaatcaaacactacttgtaatttccggcgaggaaataggctaatgacaaaactacctgcaggaatcgcaagacgaatctaatgagatatattaatttatgg

SEQ ID NO: 33136 - protein, 384 aa, Panicum virgatum
  misc_feature: Ceres CLONE 1917356
  misc_feature (10)..(58): Pfam Name: F-box Pfam Description: F-box domain
MQNTSKISSTTIMSLSDDVLTEILFRLPSLASLARAALTCPRWRRLAASCDFLAGFGARHASLPLLGCFFYADDGYFEVPVFQRARNLPDMDLAAVVRGGDFLLSSFFEDDLWTFKDICQGLLLFASDDELAVFNPVSRRRTCVPLPNGEHDRETSVDCLLPAADAAFRVVSLERDEQERVRVHEYNSRMGEWRPQPWTPHGIINWSPDDSLRAMHAAGRIYWKHSNKLLCLETAPSGSVQVSHVALPPVPGLAEAAASYVVGDMEDGTCCLACVAMSRRLRSRTLQVWLRREDGGGSWEFGWETKFLSGYSLCAVNAGVVLFEDYRAYRLNELDELRFGGYPQTEASFFASRGSEAYPYVACSTVLLGRLIQDDGDEARAPPG

SEQ ID NO: 33137 - DNA, 750 bp, Panicum virgatum
  misc_feature: Ceres CLONE 1917358
  misc_feature: Encodes the peptide sequence at SEQ ID NO. 33138
aactcgtcgcttcgctcccgaccgcatcgcgatcagtcacctcctcctctacgcctcgccggagatcagacgaggcgccgccgggagatggacgcctcctaccgccgcgccggctccgggggcggctctgcgccgcgctccgtcgaggacatcttcaaggactaccgcgcccgccgctccgccatccagcgcgccctcacccacgacgtcgaggagttctacgcgcagtgcgatccagagaaggagaacctgtgcctgtacgggtacgcgaacgaggcgtggggggtggcgctgccggcggaggaggtgcccacggagctgccggagccggcgctcgggatcaacttcgcgcgcgacggaatgaaccgccgcgactggctcgcgctcgtcgccgtccactccgactcgtggctcgtctccgtcgcgttctactacgccgcgcggctcaaccgcaacgaacggaagcgtttgtttagcatgatgaacgagctgcccactgtttttgaagttgtctctggtggcgggaaacagactagggagagggacagatccgcttctgataacagtggtagaaataaactgttattgaagcaaacaagcgagccacgcatagaagagccacgcatagaaaatgacgccagggagcccaacgagggctacgatgaagacgacggtgaccacagcgaaacgctgtgtgggacttgcggcgggatatacagcgcagacgagttctggatcgggtgcgacatt

SEQ ID NO: 33138 - protein, 220 aa, Panicum virgatum
  misc_feature: Ceres CLONE 1917358
  misc_feature: Useful for making plants with altered lignin content
  misc_feature: Useful for making plants with modulated flowering time
  misc_feature: Useful for making plants with altered alkaloid content
  misc_feature: The sequence is a functional homolog of SEQ ID NO 1645 in the 11/479,226 US patent application
  misc_feature: The sequence is a functional homolog of SEQ ID NO 782 in the 10/412,699 US patent application
  misc_feature: The sequence is a functional homolog of SEQ ID NO 816 in the 10/412,699 US patent application
  misc_feature: The sequence is a functional homolog of SEQ ID NO 1052 in the 10/225,066 US patent application
  misc_feature: The sequence is a functional homolog of SEQ ID NO 2552 in the 10/374,780 US patent application
  misc_feature: The sequence is a functional homolog of SEQ ID NO 1981 in the 11/479,226 US patent application
MDASYRRAGSGGGSAPRSVEDIFKDYRARRSAIQRALTHDVEEFYAQCDPEKENLCLYGYANEAWGVALPAEEVPTELPEPALGINFARDGMNRRDWLALVAVHSDSWLVSVAFYYAARLNRNERKRLFSMMNELPTVFEVVSGGGKQTRERDRSASDNSGRNKLLLKQTSEPRIEEPRIENDAREPNEGYDEDDGDHSETLCGTCGGIYSADEFWIGCD

SEQ ID NO: 33139 - DNA, 176 bp, Panicum virgatum
  misc_feature: Ceres CLONE 1917369
  misc_feature: Encodes the peptide sequence at SEQ ID NO. 33140
agagctcgctcagaggccgttggaggagagcgcgcgtagggggcgagacgacgatggaccacgcggcggaggcgcagcggacggacctgatgacgatcacgcggcacgtgctcaacgagcagggccgccacccggagtcccgcggcgagatttcaccctcctcctccccccccttg

SEQ ID NO: 33140 - protein, 40 aa, Panicum virgatum
  misc_feature: Ceres CLONE 1917369
  misc_feature: SWISSPROT Homolog: EC 3.1.3.11 Fructose-bisphosphatase
  misc_feature: Useful for making plants with modulated biomass
MDHAAEAQRTDLMTITRHVLNEQGRHPESRGEISPSSSPP

SEQ ID NO: 33141 - DNA, 749 bp, Panicum virgatum
  misc_feature: Ceres CLONE 1917378
  misc_feature: Encodes the peptide sequence at SEQ ID NO. 33142
tgtggtggttgatgtggacggcttggcgaaatccaaggctgatggggtcgccgagaagccgtctgagggtactcccactccaaccacagcagcagctagcgaccggtctcactctcagcaatcgcctcacgcaatggccgcctccaccatggcgatctcctccccggcgatggccggcacccccatcaaggtgggctccttcggcgagggccgcatcaccatgcgcaagaccgcggccaagcccaaggtggcggcgtccggcagcccatggtacggccccgaccgcgtcaagtacctcggccccttctccggcgagcccccgagctacctcaccggcgagttccccggcgactacggctgggacaccgcggggctgtccgctgaccccgagaccttcgccaagaaccgcgagctggaggtcatccactcccggtgggccatgctcggcgcgctcggctgcgtcttccccgagctgctcgctcgcaacggcgtcaagttcggcgaggccgtctggttcaaggccggctcccagatcttcagcgagggcggcctcgactacctcggcaaccccagcctcatccacgcccagagcatcctcgccatctgggccgtccaggtcgtgctcatgggcgccgtcgagggctaccgcattgccggcggcccgctcggcgaggtcgtcgacccgctctaccccggcggcagcttcgacccccctcggctggctgacgaccccgaggcctcgccgagct

SEQ ID NO: 33142 - protein, 205 aa, Panicum virgatum
  misc_feature: Ceres CLONE 1917378
  misc_feature (61)..(205): Pfam Name: Chloroa_b-bind Pfam Description: Chlorophyll A-B binding protein
MAASTMAISSPAMAGTPIKVGSFGEGRITMRKTAAKPKVAASGSPWYGPDRVKYLGPFSGEPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWAVQVVLMGAVEGYRIAGGPLGEVVDPLYPGGSFDPPRLADDPEASPS

SEQ ID NO: 33143 - DNA, 679 bp, Panicum virgatum
  misc_feature: Ceres CLONE 1917390
  misc_feature: Encodes the peptide sequence at SEQ ID NO. 33144
attctgaaatcagggtcgtcgtggtctccgaccttgcggccgccgggtcctcgtcctcgccgtccgccgcctccttcgccgataccagggtcatctgccgcgtgtgccagaagcagttcgcgcagtacacctgcccccgctgcaactcccggtactgctcgctcccgtgctacaaggggcatagccttcaatgcattgaatccttcatgcgtgagaatgttatggatgagcttaagcagacgcaacctgaagatgagtcaaagaaaaagatgctagatatccataagcggctccacttggaacaagagatggagtccgatggtgaagatgagtcaatgttatcggaggagcttattcaaaaagtcatgtctggggaagaaataaagatcgaagatctctctgatgatgaagtcaaacgatttcgacaagctctggcctcaggtgaactcagcaagatgattgaaccatggacaccatggtggaaaaagccgtctgctagaatgaaaacccttagccctgatggaagccagtttgtcagacaagtgagggaagaagacactgccacatcaggtccaatgactgaccaagagcctagcatcaatgaaatgccagaagggccagaatctcctctcccagcgctgaaacagctaacaagggcagagccatcgcctctgctttg

SEQ ID NO: 33144 - protein, 225 aa, Panicum virgatum
  misc_feature: Ceres CLONE 1917390
  misc_feature (28)..(58): Pfam Name: zf-HIT Pfam Description: HIT zinc finger
SEIRVVVVSDLAAAGSSSSPSAASFADTRVICRVCQKQFAQYTCPRCNSRYCSLPCYKGHSLQCIESFMRENVMDELKQTQPEDESKKKMLDIHKRLHLEQEMESDGEDESMLSEELIQKVMSGEEIKIEDLSDDEVKRFRQALASGELSKMIEPWTPWWKKPSARMKTLSPDGSQFVRQVREEDTATSGPMTDQEPSINEMPEGPESPLPALKQLTRAEPSPLL

SEQ ID NO: 33145 - DNA, 1378 bp, Panicum virgatum
  misc_feature: Ceres CLONE 1917402
  misc_feature: Encodes the peptide sequence at SEQ ID NO. 33146
cgcctcgcgtgttcctgtggctccaaagctccgggctttgcagacctggtgcggaattccggtgggagttggggagaggagggtgctgcgtgccagggcggtgatggagatgccgggagggagcggcgcgggcccggcgctggcgcggcagggctcgatctactcgctcacgttcgacgagttccagagcgcgctcggcggccccagcaaggacttcgggtccatgaacatggacgagctgctgcgcaacatctggacggccgaggagtccaacgccatggccgccgccgcgccgaccacggccgcggccgcgtccgtggacgcgcacgcccagcagcagccgggggcgcccatccagcgccagggctccttcacgctgccccgcacgctcagccagaagacggtcgacgaggtctggcgcgagatcgtcggcctcaccgaaggggaggacgtccagccggtcccgccggcccccgcgcccgccgccgccgccgcggcccccgcgccgatgccggcgcaggcgcagcggcagccgacgctggggtccatgacgctggaggagttcctggtgcgcgccggcgtcgtgcgggaggatatggcgcagcagaccctcgtgctgccgccgcacgcgcaggtgctcttctcccagggcaatgcggtcgcgccgcagaccttgcagctggggaacggcatggtcaccggggtcgtcgggcaggggctcgggggagggatgacggtggccgcgccgacgacgcccgtcgtgctcaacgggatggggaaggtggaggccggggatctgtcctcgctctcgccggtgccgtaccccttcgacaccgcgctcagggtgaggaagggaccgaccgtcgagaaggtggtcgagaggaggcagaggcgcatgatcaagaacagggagtcggccgcccggtcgcgtaccaggaagcaggcttacataatggagttggaggctgaggtggcaaaacttaaggagcagaatgatgaattgcagaaaaagcaggttgaaatgctcaagaagcaaaaagatgaggtcctggagcgtatcaacaaccaacttggaccaaaggcaaagaaactttgcttgcgtcgtaccctgaccggtccgtggtagcctgctgaagctcgcatatcattgaccaaagttaagatcgtcaacttctttagatgtgacccgtgtgtatatatcagatgaagtcaaaatctccagtttccctttagacttacgctgcttcagcttcagagctactgttcaccttgttatgtgatcgttcggtcccgtgggtagactgcccgtgacagtcactgcttaggttcagttgcgcaatcctcagatgaacaatgaagcataccatctaatctgttt

SEQ ID NO: 33146 - protein, 340 aa, Panicum virgatum
  misc_feature: Ceres CLONE 1917402
  misc_feature (256)..(311): Pfam Name: bZIP_2 Pfam Description: Basic region leucine zipper
  misc_feature: The sequence is a functional homolog of SEQ ID NO 1481 in the 11/479,226 US patent application
  misc_feature: The sequence is a functional homolog of SEQ ID NO 710 in the 10/412,699 US patent application
MEMPGGSGAGPALARQGSIYSLTFDEFQSALGGPSKDFGSMNMDELLRNIWTAEESNAMAAAAPTTAAAASVDAHAQQQPGAPIQRQGSFTLPRTLSQKTVDEVWREIVGLTEGEDVQPVPPAPAPAAAAAAPAPMPAQAQRQPTLGSMTLEEFLVRAGVVREDMAQQTLVLPPHAQVLFSQGNAVAPQTLQLGNGMVTGVVGQGLGGGMTVAAPTTPVVLNGMGKVEAGDLSSLSPVPYPFDTALRVRKGPTVEKVVERRQRRMIKNRESAARSRTRKQAYIMELEAEVAKLKEQNDELQKKQVEMLKKQKDEVLERINNQLGPKAKKLCLRRTLTGPW

SEQ ID NO: 33147 - DNA, 744 bp, Panicum virgatum
  misc_feature: Ceres CLONE 1917407
  misc_feature: Encodes the peptide sequence at SEQ ID NO. 33148
gtaagtgagctgaagccatggccgtggatccaagcatcgcggcggacgccgaggccgcggcgcgccggagcgaggaggcggcggagtccttcttccgcggcgcgccgccgctccgcgagcgcgaccgcgtcgccgccagcgtggccaacttcgtcgtccgccgctccgcaggcgggcctgccggaggctccagggtgatttgcatcacctccggcggcaccacggtgcccctggagcagcgctgcgtgcgctacatcgacaacttcgcctctggccagcggggggcggccgccaccgagtattttctcaaggcgggctatgctgtcatcttcatctatcgccgtgggagcaagcagccttactgtagatttcttccagaggattcgtttctcgatctttttgagcttggtgaagactcagagatccaagttccccaatctcattccactgtggtcaaggcagctattagcaattatcacaaggcgattggtgaaggcctgcttctgaaacttcccttcgctacaattttcgaataccttcagttactacagatggtagccacttctatgaattgcttgcggcaccatggaatgttctttcttgctgctgcagtttctgacttctatgttccatgggaaagtatgacactttgaacctggacagatacatgcacgaagaggactattctccgacaagcacaccccacactagctggagcagtcatgatggcagatttatgtgcct

SEQ ID NO: 33148 - protein, 211 aa, Panicum virgatum
  misc_feature: Ceres CLONE 1917407
  misc_feature (55)..(210): Pfam Name: DFP Pfam Description: DNA / pantothenate metabolism flavoprotein
  misc_feature: SWISSPROT Homolog: EC 6.3.2.5 Phosphopantothenate--cysteine ligase
MAVDPSIAADAEAAARRSEEAAESFFRGAPPLRERDRVAASVANFVVRRSAGGPAGGSRVICITSGGTTVPLEQRCVRYIDNFASGQRGAAATEYFLKAGYAVIFIYRRGSKQPYCRFLPEDSFLDLFELGEDSEIQVPQSHSTVVKAAISNYHKAIGEGLLLKLPFATIFEYLQLLQMVATSMNCLRHHGMFFLAAAVSDFYVPWESMTL

SEQ ID NO: 33149 - DNA, 711 bp, Panicum virgatum
  misc_feature: Ceres CLONE 1917415
  misc_feature: Encodes the peptide sequence at SEQ ID NO. 33150
acgacacacacgcaccagaggcgaggtccgaggagagctcaggcgcagcgacggcaatggcagcgtcactccaagcagcggccaccctgatgcagccggccaagatcggcggccgcgcctccgcctcgctgctgtcccgccagccgtcccacgtcgccagggcgttcggcgtcgacaccggcgcggccaggatcacgtgctctctgcagtccgacatcagggaggtcgcgagcaagtgcgtcgacgccgccaagctcgccggcttcgcgctcgccacctcggcgctccttgtctcgggcgcgaccatcgacggcggcgtcgagtccttcccgttcaagcccggcaagtaccagatgaagaagttctgcctggagccgacgtccttcaccgtcaaggccgagggcatcgccaagaacgcgccgcccgagttccagaagaccaagctcatgacccgcctcacctacaccctcgacgagatcgagggcccgctcgaggtcggctccgacggcaccctcaagttcgaggagaaggacggcatcgactacgccgccgtcaccgtgcagctcccgggaggcgagcgcgtgcccttcctcttcaccgtcaagcagctcgtcgccaccggcaagcccgagagcttcggcgggcccttcctcgtgccgagctaccgtggctcctccttcctcgaccccaagggccgtggtggctccaccc

SEQ ID NO: 33150 - protein, 218 aa, Panicum virgatum
  misc_feature: Ceres CLONE 1917415
  misc_feature (63)..(218): Pfam Name: MSP Pfam Description: Manganese-stabilising protein / photosystem II polypeptide
MAASLQAAATLMQPAKIGGRASASLLSRQPSHVARAFGVDTGAARITCSLQSDIREVASKCVDAAKLAGFALATSALLVSGATIDGGVESFPFKPGKYQMKKFCLEPTSFTVKAEGIAKNAPPEFQKTKLMTRLTYTLDEIEGPLEVGSDGTLKFEEKDGIDYAAVTVQLPGGERVPFLFTVKQLVATGKPESFGGPFLVPSYRGSSFLDPKGRGGST

SEQ ID NO: 33151 - DNA, 712 bp, Panicum virgatum
  misc_feature: Ceres CLONE 1917422
  misc_feature: Encodes the peptide sequence at SEQ ID NO. 33152
ggaaggagcagattccttcctcctctcccccccccttccccacctcgtcgaaaccctagcccccgcctcgccgccggcggtggtggccgcctgtccagcgcccagccccgccagcccgctgtacacactctccccgccgcgcgctccctcccggagccgtcgcgccccaccgatcgatcggcctcgcccgaccgccgccggatcccgatcggccggccgccatgtcgaaggccagggtctacaccgacgtcaacgtgctgcgccccaaggagtactgggactacgaggcgctcaccgtccaatggggtgagcaggatgactatgaagttgtcaggaaagttggtagaggaaagtacagcgaagtctttgagggcatcaatgttaacaacaatgagaaatgcatcatcaagatcctgaagcctgtgaagaaaaagaagatcaaaagagaaattaaaatccttcagaatctttgtggaggccctaatattgtgaagctgcttgatattgttagggatcagcactcaaaaactcccagcttgatctttgaatatgtcaacaacacagatttcaaagtgctttacccaacattgacagattatgacattcgctattacatctatgagttactcaaggcattagattactgccattcacaaggtatcatgcaccgagatgtgaagcctcacaatgttatgatagatcatgagctttc

SEQ ID NO: 33152 - protein, 163 aa, Panicum virgatum
  misc_feature: Ceres CLONE 1917422
  misc_feature (34)..(163): Pfam Name: Pkinase Pfam Description: Protein kinase domain
  misc_feature: SWISSPROT Homolog: EC 2.7.11.1 Non-specific serine/threonine protein kinase
  misc_feature: The sequence is a functional homolog of SEQ ID NO 1 in US patent 7038110
  misc_feature: Useful for making plants with modulated flowering time
MSKARVYTDVNVLRPKEYWDYEALTVQWGEQDDYEVVRKVGRGKYSEVFEGINVNNNEKCIIKILKPVKKKKIKREIKILQNLCGGPNIVKLLDIVRDQHSKTPSLIFEYVNNTDFKVLYPTLTDYDIRYYIYELLKALDYCHSQGIMHRDVKPHNVMIDHEL

SEQ ID NO: 33153 - DNA, 636 bp, Panicum virgatum
  misc_feature: Ceres CLONE 1917432
  misc_feature: Encodes the peptide sequence at SEQ ID NO. 33154
gtgctctctcagaggtgggttggcttctccccctcttaccaagtcctcggttctagggttttagttggaaggggagatggcggcggcggatgtggagtaccgctgcttcgtcggcggcctcgcctgggccaccgacaacgcgtccctccagcaggccttcgcctcctacggcgacgtcctcgactccaaggtcatcaccgaccgtgagacggggaggtcccgcgggttcggcttcgtcaccttctcaaccgagcagtcgatgctcgacgccatcgaagcccgatccggcaaaggcccgaccttccatggccatcgcctcccgcgtctcgaagcgcgcgctgtccaccttcgccgccgccaagctcccggaggcggtcgccgccgcggaaccgctgccgccggccgcgccggcgccgtgcgagagggccgccggcagggtgctggggttcgaggacaccgggcggctgttcgccggggagcccacgtcggcgctcgtgcgcacgctcgccgcgctgcaggcgctctccgtggggccgcttgtcgacgccgcgaccgccgcgctgcggtcgccggcggtggccggcagcgcgctcggccgcgccgccgccggggccacggcgtaccgcctcttctgcg

SEQ ID NO: 33154 - protein, 186 aa, Panicum virgatum
  misc_feature: Ceres CLONE 1917432
  misc_feature (10)..(83): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with modulated flowering time
  misc_feature: Useful for making plants with altered lignin content
  misc_feature: Useful for making plants with modulated nitrogen use efficiency
MAAADVEYRCFVGGLAWATDNASLQQAFASYGDVLDSKVITDRETGRSRGFGFVTFSTEQSMLDAIEARSGKGPTFHGHRLPRLEARAVHLRRRQAPGGGRRRGTAAAGRAGAVREGRRQGAGVRGHRAAVRRGAHVGARAHARRAAGALRGAACRRRDRRAAVAGGGRQRARPRRRRGHGVPPLL

SEQ ID NO: 33155 - DNA, 1908 bp, Panicum virgatum
  misc_feature: Ceres CLONE 1917453
  misc_feature: Encodes the peptide sequence at SEQ ID NO. 33156
acccagccggcagcccggcatcccagcagcacgcagcacaatttttgtaagcagtcttgtcaggacgcacagccagagacacgtccagtccaagtccaatgaagccggcagctggtggtgatggcggagggcagcaggcaagccgccgacgacctgccgatctcggcctcctcgcgctcctcggctcgtcgctgctcctcaacgccgtcttcctcgcgcgccacttcctgccgccgccggcgcggctgctggatggtgtcgacgcggccggcggcggcggctgcgggctcagctgggccctgcaggcggccagggaggccgaggcggtggccgccgtcgactgctcgggccacgggcaggcgttcctcgacggcgtcgtcggcgaggacggcgggcggcccgggtgcgagtgcaacgcctgcttcagcgggccggactgctccctccggacgcccggctgcaccgccgacgccgacagcgggaacccgctgttcctggagccgtactggcggcggcacgcggctgccagcgccgtggtggtctccgggtggcaccgcttgagctacagcaccaccgacggcatgttccagtccgtggagctcgagcgacagatccggcgcttgcacagggccgtcggcaacgccatcgccgacggcaagcgcatcgtcttcgccgccggctccatgcagctcatcaacgcgctcgtgtacgcgctctcccccgacgacgccaacgccgcctcgagctcgccgccggcccgcgtggtcgccaccgcgccctattacccagcgtataaagcacagacgaagatgttcgacggccgcgagtacaggtggggcggaaccacggctctatgggccaacgcatcacggaactccactactgacgacggcgacggcggcttcatcgagttcgtcacgtcgcccaacaacccggacgcccagctcgagaaggccgtcctcggcggctcgtcggccgcggccatcttcgaccacgcctactactggccgcacttcacgcacatcccggcgccgtccgacgaggacgtcatgatgttcactatgtccaagccctccggccacgccggcagcagattcgggtgggcgctgatcagggacgagaaggtggccaagaaggcgtacgagtacgtgaagatgagcgtgatgggcgcgtcccgggacacccagctgcggatgctggggatcgtcaaggccatgctggccaacctgcacggcgaggaggacatcttcgccttcgggtacgacgtgatgaggagcaggtggcgccgcctgagcaccgccgtgtcgcggtcccgccgcatctcgctgcagaagatggctcccgagtactgcacctacttcaagcgcgtcagagagccgtcgccagcctacgcgtgggtgaagtgcgagagggaggaagacgaagactgctacgacgtgctgctcaaggccaagatcatcacgcgcacgggcgtcgcgaacgaggccggcagccgctacacgaggatcagtctgctcaagggggacgatgacttcgaagtgctcatggagagggtcaccgatcttgtcaatgccgagaagtacgacgacgctcccggttccagctccatgtgatggtaagaaccgcaggagtttaactggctccggacgggacgggcaaggtaaaattacggttaattaataccggaaatgatcagctaggcgctgattaattttccacgaaattaattaaattacacgaacggtcaactagaaattgattgttcatttcccgggatgagccggcggggatagctgggcacgacgggtaataaaaatacaagagatgatcagctactggctgattgttctcgttctcagatcatttgctagtgtaagtacaggaaagaaaaaaaaattgtatgttgtg

SEQ ID NO: 33156 - protein, 504 aa, Panicum virgatum
  misc_feature: Ceres CLONE 1917453
  misc_feature (123)..(490): Pfam Name: Alliinase_C Pfam Description: Allinase
  misc_feature (64)..(121): Pfam Name: EGF_alliinase Pfam Description: Alliinase EGF-like domain
  misc_feature: SWISSPROT Homolog: EC 4.4.1.4 Alliin lyase
MKPAAGGDGGGQQASRRRPADLGLLALLGSSLLLNAVFLARHFLPPPARLLDGVDAAGGGGCGLSWALQAAREAEAVAAVDCSGHGQAFLDGVVGEDGGRPGCECNACFSGPDCSLRTPGCTADADSGNPLFLEPYWRRHAAASAVVVSGWHRLSYSTTDGMFQSVELERQIRRLHRAVGNAIADGKRIVFAAGSMQLINALVYALSPDDANAASSSPPARVVATAPYYPAYKAQTKMFDGREYRWGGTTALWANASRNSTTDDGDGGFIEFVTSPNNPDAQLEKAVLGGSSAAAIFDHAYYWPHFTHIPAPSDEDVMMFTMSKPSGHAGSRFGWALIRDEKVAKKAYEYVKMSVMGASRDTQLRMLGIVKAMLANLHGEEDIFAFGYDVMRSRWRRLSTAVSRSRRISLQKMAPEYCTYFKRVREPSPAYAWVKCEREEDEDCYDVLLKAKIITRTGVANEAGSRYTRISLLKGDDDFEVLMERVTDLVNAEKYDDAPGSSSM

SEQ ID NO: 33157 - DNA, 423 bp, Panicum virgatum
  misc_feature: Ceres CLONE 1917465
  misc_feature: Encodes the peptide sequence at SEQ ID NO. 33158
acaccacccccgctgcctgctgggggttccggcgacgacttggctagcggcggcgccctccgcgacgtcttcgccggggctttcgccggtgcccgtcgaccaacacccaccagaagggaatggactactacaacatctcctcggggagaatcgaagtgcaaccgtggaagacctcaagaagtcgtatcggcggcttgcgaggacatggcatccggacaagaacccaactggaggcaccgaggctgaggcaaagttcaagcagataactgaggcctatgaggtactaagtgatccagagaagcgtgcaatttatgaccaatatggtgaggaaggcttaaaggggatgcctccgcctggttcacagagccggtcctccacagctgctggcccaagcggtccaagtaatttccggtacaatcctcc

SEQ ID NO: 33158 - protein, 140 aa, Panicum virgatum
  misc_feature: Ceres CLONE 1917465
  misc_feature (45)..(105): Pfam Name: DnaJ Pfam Description: DnaJ domain
HHPRCLLGVPATTWLAAAPSATSSPGLSPVPVDQHPPEGNGLLQHLLGENRSATVEDLKKSYRRLARTWHPDKNPTGGTEAEAKFKQITEAYEVLSDPEKRAIYDQYGEEGLKGMPPPGSQSRSSTAAGPSGPSNFRYNP

SEQ ID NO: 33159 - DNA, 958 bp, Panicum virgatum
  misc_feature: Ceres CLONE 1917473
  misc_feature: Encodes the peptide sequence at SEQ ID NO. 33160
gtccgcggcggaggaaccagccggactgccggagcggcctccgctctccagtctcctcgcctcgtcgcgtcggaggcgcccgcggccactggggactcttcggcgcgtggaggatgcacctgaggcccgccttccctcccctgtctctccgcggtgagctgcatgcttgggatgaggccgaacccgcaacctctgtccccacctcctcgtgggtcttggtgacctgcaaagagggatgcagtggcctccatcccatcgtgccgcagcagcatccccattgtaggtggggaaacgttggcgccggcgcgtgaggctgtccttgatgagtggagcacagggcttgcctccagcacatgccagggacgagcgcggcagcgccattttgtttccaggatttcccaatggtgtggacggggacaacackgggactcttgyctggctgcagcargatgatgttcctgggacagatgcttgcttatatcataggggcaaaagaccacactatcaacgtggatggctccggaggtgttacatcatgaaccttcggatgaaaagtctggtttctactgctatggggttattatgttcccacttgttactcggaagataccctgggataatgtccataaaatgctggttattggagctgtgagtttcttgcatcaaaggccggacattccaagtgacaccgatccctaatgcgcaattggacatccatgatcaagagttgtttggatagtgacccagggaaacacccttcgtttctagagctgctggacaggcttaggggcggttcggtgcggctccagctccagctgcaccgccagctccgggaggagcctcatctccattggcggctccagcgggtggtttttgtgagaactgtggctccgccagctccagctccagctccacccttccaaagatcccttccaaacgggatcttaaaggtgtacaa

SEQ ID NO: 33160 - protein, 61 aa, Panicum virgatum
  misc_feature: Ceres CLONE 1917473
  misc_feature: SWISSPROT Homolog: EC 2.7.11.1 Non-specific serine/threonine protein kinase
MAPEVLHHEPSDEKSGFYCYGVIMFPLVTRKIPWDNVHKMLVIGAVSFLHQRPDIPSDTDP

SEQ ID NO: 33161 - DNA, 745 bp, Panicum virgatum
  misc_feature: Ceres CLONE 1917473-R
cgttagttgacttctccagagatggagaaatagaggccattctgaaagacatatcagaaaggcccaagggtacgggaaacttcagctacagtcggttctttgcagttggcttgttccgtttgcttgagcttgcaaatgcaacggagccaacagttctagacaagctttgcgctgcattaaacgtcaataaaagaagtgtggatagggacctcgatgtttaccgcaatatactctcgaagttggttcaagctaaggaacttctcaaggaatacatcgatagggaaaagaagaagagagaagaaagatcagaagctccaaagccgaacgaagctgttacgaaatttgatggaaacctttattccatgaggcattaggtcagcctttcgcagaggagggtcaccacggataacagaattaacagtaacatctggactgtatcgagaaatatcaatcctttcaccacagagacatctttggctgctcgtcgtgtggtgtagcattctgccgtacaaaaggatgcagattattcttactattggacagatattttgtatttatctcatgtgtcttcaaatgtattcattctcttcgcttggtcgaaagtatatgaagaggtatgtggggatcaatgttactcataagctgagaaatatagctttcctctttttgtatctcggtggcgataactcgaggctgtgtgtgttcactagtatattgtgatgatcagttgatgtgttgtttatct

SEQ ID NO: 33162 - DNA, 613 bp, Panicum virgatum
  misc_feature: Ceres CLONE 1917482
  misc_feature: Encodes the peptide sequence at SEQ ID NO. 33163
ataagcgcaccatcagcttgcgatttttctatcggcttagctgtgccgttcggtccaatcaccgggcgccacgtcgcgcggccacggtctatataacctcctctccccccggagtgcgagggcgcaaaccattcccctcccccttctagatggagagatagagaagaaaagataagctcagctcagctcgcaagcaagaggtggagatgcggagcccacgaggaggagggcgcgcccatgagcacgtcgacctgatcccgggcatccccgacgacgtcgccgtcgactgcctggcgcgcgtgccccacgcgtcacaccgcgcgctgcgccgtgtctgccgcggctggcggagcgcctccgccgcgccggccttcgccgcggcgcgcgccgccgcgggagccaacgaggacctcgtatacatgctgcagatcgggaacccctcagccaccgccgacaccgacgacggcgggccaaaggactgcggcgcgcctgccagcgcgcccgcctacggcgtcgctgtctacaacgtgaatacaggcgagtggctccgggagctcgacgcgcccccggtgctgcccgtgttcgagctttgagccgcggtgggagctctgat

SEQ ID NO: 33163 - protein, 128 aa, Panicum virgatum
  misc_feature: Ceres CLONE 1917482
  misc_feature (15)..(62): Pfam Name: F-box Pfam Description: F-box domain
MRSPRGGGRAHEHVDLIPGIPDDVAVDCLARVPHASHRALRRVCRGWRSASAAPAFAAARAAAGANEDLVYMLQIGNPSATADTDDGGPKDCGAPASAPAYGVAVYNVNTGEWLRELDAPPVLPVFEL

SEQ ID NO: 33164 - DNA, 738 bp, Panicum virgatum
  misc_feature: Ceres CLONE 1917484
  misc_feature: Encodes the peptide sequence at SEQ ID NO. 33165
gttccgacgggcgactcgtccatctcccgtgcgcctcctcctcggcctcgcagacggcgacagcgcccgcgccgcctccctctcgccagcagcggcgacggcggctgcctctccaagcccccaggcagaccactgtcttttggttcctccattcttcacccggcacttcggctcgtagtttcagtagtcaagatgtcacaaacgaaggaagtgagatacactgcacggtctattacacctcctgcagatagaaatggaacttcaagctcacctcctccaaagagacgcagcccttcaaggtcgcctcctccaaagagtacctcaagatctccacgtccaagaagtcctaagcggcggagcacctcaaggtcacctcctcctaggagacgtggtagatcgaggtcaaggtcaagggataggagtcgatccaggagcgaagatgatagaaatccaggaaataacctttatgtgactggattgtctactcgtgtaactgaagatgagcttgagaagttttttagtaaagaaggaaaggttaaaaactgtcatgttgttcttgatcctcgtacaaaagaatcccgtggctttgcctttgtgactatggatactgttgaagatgcaagacgctgcatcaagtacctgcaccgcactgtacttgaaggtcgtctggtcactgtagagaaggcgaaaaggactcgagaaaggacccctactcctggaaaatactgtggtcgaaga

SEQ ID NO: 33165 - protein, 181 aa, Panicum virgatum
  misc_feature: Ceres CLONE 1917484
  misc_feature (91)..(162): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with altered lignin content
MSQTKEVRYTARSITPPADRNGTSSSPPPKRRSPSRSPPPKSTSRSPRPRSPKRRSTSRSPPPRRRGRSRSRSRDRSRSRSEDDRNPGNNLYVTGLSTRVTEDELEKFFSKEGKVKNCHVVLDPRTKESRGFAFVTMDTVEDARRCIKYLHRTVLEGRLVTVEKAKRTRERTPTPGKYCGR

SEQ ID NO: 33166 - DNA, 597 bp, Panicum virgatum
  misc_feature: Ceres CLONE 1917516
  misc_feature: Encodes the peptide sequence at SEQ ID NO. 33167
aacggcaagtgaaggaaaccacgaacaatgaagatttacaccttatcctgcttgctcatcagcacgcttgcactggcactggcggcacggcctgacgcaggcagcctcgatgcggccacaatagccgtgcaagagctcgaccgtgttcggtcactgccagggcaaccgaggtactcgccagcattcaagcagtactccgggtacgtcactaccgatgagtacttaggcaaggcactgttctactggttcttcgaggccacggacaagcctgacgagaagccactggtcctgtggctcagtggagggcctggctgttcttccgttgagtttggacagtcgcaggaacttgggccattcctggtgaagaaagatgtgcctgagcttgagctaaacccgtatgcttggaatcaagctgcaaatttgctgttcctggactccccagcgggcgttggattttcgtacacgaacacgcccttcgaaaaagatccaccgggagacaattccacagcacacggatcatacactttcctcctcaggtggttccagaagttcccccagcacaaagcgaaggagttctacatagccggagacagctac

SEQ ID NO: 33167 - protein, 189 aa, Panicum virgatum
  misc_feature: Ceres CLONE 1917516
  misc_feature (44)..(189): Pfam Name: Peptidase_S10 Pfam Description: Serine carboxypeptidase
  misc_feature: SWISSPROT Homolog: EC 3.4.16.6 Carboxypeptidase D
MKIYTLSCLLISTLALALAARPDAGSLDAATIAVQELDRVRSLPGQPRYSPAFKQYSGYVTTDEYLGKALFYWFFEATDKPDEKPLVLWLSGGPGCSSVEFGQSQELGPFLVKKDVPELELNPYAWNQAANLLFLDSPAGVGFSYTNTPFEKDPPGDNSTAHGSYTFLLRWFQKFPQHKAKEFYIAGDS

SEQ ID NO: 33168 - DNA, 1201 bp, Panicum virgatum
  misc_feature: Ceres CLONE 1949426
  misc_feature: Encodes the peptide sequence at SEQ ID NO. 33169
tactctcgagcttcctcggtttgtccagcagaaggtagaacaaacagaaaacctgagttttcaaagaaacagaagagaaaaaacaagcaggcaccgcagtccaatactccctctgcgaaaagtgaatctgggcaacaaatccctattaaggacatcaaagaagtcctaccaaccaatgtctctgcagaaaaggaggcatgtggtgctgatccaatcaaacacacagaggaagccgctttgagcgacactaaaggcattgcttcttccttagagaagaaacctgcccaaccaacttcgtcaaagaagaagaataggaaaggtggcttgtcgttatttctgagtggtgctcttgatgacaccccaaaaccaagcctccctgcccctgttgtgcccgtcacaccaaagcatgaaggacctgcctggggtggtgcaaagataacaaagggaccagcttcccttcgtgatatccaaagcgagcagagaaaaacaaatgagcccgtcatggccaaagcaaaagactgctttgagaactcatctgacagtgctgggcgtgtgcgcctttcttcattcatcccagacgcacgttcaaacccaatagctgtcacgcctgctcgttcagtaccttcttctgaaggtgacaagagcacaccaccttggtcgtcttccgctacctcgcccaatgtgtcacggccttcgctcagggacatacagatgcagcaggagaagcgtcaccatagcatctcccacagcccgaaaacacggacatcaggcttcgctataccatcccagggaggatcaccagatgttggtggcgcaaaggacaacgtacccaaccgctggttcaagccagaagctgatgccccgtcctccatccgctcaatccagattgaggaacaggcgatgaaggacttcaagcgcttctacagcagcgtgaggatcgtcaagccgcaggcccagtgatggccagggcctcaccgaagagctactgatcccttttaggctcacctctcattttaccggttcattgtacattggaatgtacagtcagtttcattcaccataggttcctttagctgaataaaaggccaaagcaacctttgctttcgttttcgctgaagtgatctcattcagctataacagatgattgtataggtcatgtgagatcacccggcttggttaacttcagccaatgtcttttttc

SEQ ID NO: 33169 - protein, 319 aa, Panicum virgatum
  misc_feature: Ceres CLONE 1949426
  misc_feature: SWISSPROT Homolog: EC 3.1.3.56 Inositol-polyphosphate 5-phosphatase
YSRASSVCPAEGRTNRKPEFSKKQKRKNKQAPQSNTPSAKSESGQQIPIKDIKEVLPTNVSAEKEACGADPIKHTEEAALSDTKGIASSLEKKPAQPTSSKKKNRKGGLSLFLSGALDDTPKPSLPAPVVPVTPKHEGPAWGGAKITKGPASLRDIQSEQRKTNEPVMAKAKDCFENSSDSAGRVRLSSFIPDARSNPIAVTPARSVPSSEGDKSTPPWSSSATSPNVSRPSLRDIQMQQEKRHHSISHSPKTRTSGFAIPSQGGSPDVGGAKDNVPNRWFKPEADAPSSIRSIQIEEQAMKDFKRFYSSVRIVKPQAQ

SEQ ID NO: 33170 - DNA, 700 bp, Panicum virgatum
  misc_feature: Ceres CLONE 1949452
  misc_feature: Encodes the peptide sequence at SEQ ID NO. 33171
ctctctctccgtctctccctccgcgagttcgattccaaccggcggcggcgagatgaaggtcacggtgatgaccgccgacgagcagattctctccctcgacgtagaccccgacgaatccgtggagaatctaaaggcgcttctcgaggtggagactcgtgtcccattgcggcagcagcagcttcacttcaatgggaaggagatgcagaactcagagaagctcagctccattggggtccaggatggtgatcttgtcatgatgctcccctcaaatgaaagggcctctcaggatgttgtaaagttaaatcctgatggaactgctgctaatcctcaagcttttcaacagcatgttcgaggtgattcacaacttatggcacagctccttcagagtgatccgcaactagcacaagctattcttggagacagaatcaatgaactacagaatatactacgctcccgccaccaacagagaatggaattgaaacgcaaacaagaagaagagcttgctttattgtatgccgatccttttgatgtcgaagctcagaagaaaattgaagctgcaattcggcagagaggcatcgatgaaaattgggaggctgccctagagcacaatcctgaagcatttgctcgagtggtaatgctgtatgtggatatggaggtcaatggggtccccttgaaggcctttgtcgacggtggagcacag

SEQ ID NO: 33171 - protein, 215 aa, Panicum virgatum
  misc_feature: Ceres CLONE 1949452
  misc_feature (6)..(75): Pfam Name: ubiquitin Pfam Description: Ubiquitin family
MKVTVMTADEQILSLDVDPDESVENLKALLEVETRVPLRQQQLHFNGKEMQNSEKLSSIGVQDGDLVMMLPSNERASQDVVKLNPDGTAANPQAFQQHVRGDSQLMAQLLQSDPQLAQAILGDRINELQNILRSRHQQRMELKRKQEEELALLYADPFDVEAQKKIEAAIRQRGIDENWEAALEHNPEAFARVVMLYVDMEVNGVPLKAFVDGGA

SEQ ID NO: 33172 - DNA, 643 bp, Panicum virgatum
  misc_feature: Ceres CLONE 1949452-R
  misc_feature: Encodes the peptide sequence at SEQ ID NO. 33173
cccaataggaaattcctatttgggcttgatatgctgcgaaaacatcagtgcatgattgacctaaaggacaatgttcttagagtgggaggtggtgaggtttcagtgcccttcttacaagagaaagacatccctgcacatatacgagatgaagagaaattatctaagttagcatcttctcccggccaagcaactggagaatcatcaaaggcacgtgaggggactcctgatttaccgcaacgaactcctactgcaggagctccagttgcgaatcctccacagggaggagatttcgaagcaaaagtcacgaagctcgtagaacttggatttgaccgagcatctgtagtacaagcactcaagctgtttaacgggaatgaggatcaggctgctgcgttcctctttggtggttagaatcctaggaacagccattctcgctttctgtttgctcaaccctttcccagggttgaatattgactgatacaaaagtgatttaggagatggtttccctttggaaaattgcttggccaatgcaaaggcttgcatttatagacgctccatattttctcttgtttctgtgaacaagcgttctttctttctgtacctgatacatagactgatagacacctgaatgcaaacagatttgtgc

SEQ ID NO: 33173 - protein, 135 aa, Panicum virgatum
  misc_feature: Ceres CLONE 1949452-R
  misc_feature (96)..(132): Pfam Name: UBA Pfam Description: UBA/TS-N domain
PNRKFLFGLDMLRKHQCMIDLKDNVLRVGGGEVSVPFLQEKDIPAHIRDEEKLSKLASSPGQATGESSKAREGTPDLPQRTPTAGAPVANPPQGGDFEAKVTKLVELGFDRASVVQALKLFNGNEDQAAAFLFGG

SEQ ID NO: 33174 - DNA, 726 bp, Panicum virgatum
  misc_feature: Ceres CLONE 1949466
  misc_feature: Encodes the peptide sequence at SEQ ID NO. 33175
gattatggtcaataattaaagaaaatatagggaaagatctctcaggtgtttgtctacccgtttatttcaatgagcctctctcttctttacaaaaatgttttgaagatttggagtactcttacttggttgaccatgcactacagtggggaaaacagggtgacagcttgatgagaatacttcatgtagcagcatttgcagtatcaggttatgcttcaactgaaggccggcaatgcaaacccttcaatcctctactgggggaaacatacgaagctgactatccagataaaggacttcgctttttctctgaaaaggtgagccatcatccaatggttgttgcatgccactgtgaaggtagaggttggagattctggggtgattccaatctgaaagggaagttctggggtcggtccattcagcttgatccaataggagttcttaccctccaatttgatgacggagaaacatttcagtggagtaaagtgactacctccatatacaatatcataattggcaaaatttattgtgatcactatggcacaatgtgtatcaatgggagtggacagtactcctgcaagcttaaattcaaagaacagtcgataattgatcgcaatccacaccaggtgcatggatttgtgcaagataatagaacagggcaaaaagtagccatgctaattggtaaatgggatgaagctatgtactatgttcttggggatccaagtgtgaaac

SEQ ID NO: 33175 - protein, 241 aa, Panicum virgatum
  misc_feature: Ceres CLONE 1949466
  misc_feature (1)..(241): Pfam Name: Oxysterol_BP Pfam Description: Oxysterol-binding protein
LWSIIKENIGKDLSGVCLPVYFNEPLSSLQKCFEDLEYSYLVDHALQWGKQGDSLMRILHVAAFAVSGYASTEGRQCKPFNPLLGETYEADYPDKGLRFFSEKVSHHPMVVACHCEGRGWRFWGDSNLKGKFWGRSIQLDPIGVLTLQFDDGETFQWSKVTTSIYNIIIGKIYCDHYGTMCINGSGQYSCKLKFKEQSIIDRNPHQVHGFVQDNRTGQKVAMLIGKWDEAMYYVLGDPSVK

SEQ ID NO: 33176 - DNA, 264 bp, Panicum virgatum
  misc_feature: Ceres CLONE 1949466-R
tggaaaccagggtggtttaagagggaagatgacgacagctcccgctatgggggggggtagggggaagcaggggagagggggaagtgggagggcatccgggccattttggcccggaccagggcttttccggggttccggaggttggtggttccccggttggtgttatactagtagcacgcatccgagggtttcgatgcagagaatattttgcgggctacatatacatggtaaaagaatgtcaatattgccaatttccttggtcgc

SEQ ID NO: 33177 - DNA, 649 bp, Panicum virgatum
  misc_feature: Ceres CLONE 1949467
  misc_feature: Encodes the peptide sequence at SEQ ID NO. 33178
accgccgctgcactctctcacttcacttgctgcctctccggcccttctcgctccattctcccgcttcctcgccggccatggccgccgccgccgtcgccgccgccaccttccgctccctgaagcagcccgtgtccaacggcgtccccgtcccgctccccagcgtccggctccagggcctccagcgccaccgcgtcggcctcggcctccgcctcttcgcgtccccccgcggccgccccgtcctgctcccgccccccgcggcggccgccggcgaggcgttctcgtcggacggagaggagttcagcggggaagaggagtactttgacgagggagagagcgaggcggaggaggagcaggaggtcgaggccccgcgcgcgtactcgtcgccacgaagccggccgccgcgcggcgaggatcccggccggctcttcgtgggcaacctgccctacaccttcacctccgaggagctctccgaggccttcgccgaggccggcagggtcgacgacgcgcagataatctacgacaaggtcaccaaccggagccgcggcttcgccttcgtcaccatggccaccgctgaggaggccaccaaggccatccagatgttcgatggcgccctgctgggagggaggacggcgagggtgaactacccgga

SEQ ID NO: 33178 - protein, 190 aa, Panicum virgatum
  misc_feature: Ceres CLONE 1949467
  misc_feature (116)..(187): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAAAAVAAATFRSLKQPVSNGVPVPLPSVRLQGLQRHRVGLGLRLFASPRGRPVLLPPPAAAAGEAFSSDGEEFSGEEEYFDEGESEAEEEQEVEAPRAYSSPRSRPPRGEDPGRLFVGNLPYTFTSEELSEAFAEAGRVDDAQIIYDKVTNRSRGFAFVTMATAEEATKAIQMFDGALLGGRTARVNYP

SEQ ID NO: 33179 - DNA, 656 bp, Panicum virgatum
  misc_feature: Ceres CLONE 1949467-R
  misc_feature: Encodes the peptide sequence at SEQ ID NO. 33180
ggggagtgcgagcagactcgctgaggtcagtgttcgagggccaggccggcttgcttgatgccagggtcatcttcgagcgtgacaccgggcggtcgagagggtttgggttcgtctccttcaggaccgcagaggatgcacaggctgcattggaggctttggatggagtggagttggaagggagacctctgcggcttagcctggcagaacagaacccaccacctggttctccgcctagcgcggcgcaggcacagcaggaagaaaccacttcagacatatctgatgcaaagacggaagcaaccagttcttcagaactatctgaagcagaattggacgagagcaacttacagacatctgcgacttattaataactacaaaccaagggttataagaagtgttgtaattgtaacgacttccaaattctgccattcaaatccaagttgtacctatttgagcgaaaattttgacaccattaaagctgtagtgaggattcagcatttcagctatagatactagaatgtgttaggtatctagatgctgctgttgttcttgtaatgtattatgcaaaatatattgttctaaagtgcaacagtgtagctctttcgcttcctgtaaaatgatccaattcacatgttataatgttttgctcagtgttggat

SEQ ID NO: 33180 - protein, 120 aa, Panicum virgatum
  misc_feature: Ceres CLONE 1949467-R
  misc_feature (1)..(64): Pfam Name: RRM_1 Pfam Description: RNA recognition motif. (a.k.a. RRM, RBD, or RNP domain)
GVRADSLRSVFEGQAGLLDARVIFERDTGRSRGFGFVSFRTAEDAQAALEALDGVELEGRPLRLSLAEQNPPPGSPPSAAQAQQEETTSDISDAKTEATSSSELSEAELDESNLQTSATY

SEQ ID NO: 33181 - DNA, 708 bp, Panicum virgatum
  misc_feature: Ceres CLONE 1949475
  misc_feature: Encodes the peptide sequence at SEQ ID NO. 33182
acggttaccaccataccgcaactccacccaaagccataaaaaccagtgcagcaacaatgagagctaaagtttccaggctctgaattttcagcatgttggcgcccgcatcagcccaggtgcctcacaccatacgacctgttgcaaactgctttgggcttcatcgacgatctgaccgatatcacagatggcgagggactggaaagaagatgattctttccactcgtggtgtgctcgaatccagcaatggtgcaccatccggtggccttgtgaaaaaaagaaagattgtggagcacattattctgcttcgagccaagccaaacatctcagatgctgaagagaaagatatgctggattatctatatacatcacaataccagatgagagggatactcacaatctcgttgggccgcatagaggagccaaatagcgagaactttacgcacgctgtcttcatgcgttttcagcagaaagaagacattgtgaagttccacagtagtgcctactattccaaaattcttgatgaccacgtaaaacctgtttcctatggctcagtttctgtagatttcgagtctgaggtggaagatgacattattcccctctttcgtaggggagaggattttaactacggtgttgagtttatgttgctgatatctttcgtggaaactgcatctcgagaggcaatggaggatgcatcatcttctctgcaga

SEQ ID NO: 33182 - protein, 205 aa, Panicum virgatum
  misc_feature: Ceres CLONE 1949475
  misc_feature (65)..(160): Pfam Name: Dabb Pfam Description: Stress responsive A/B Barrel Domain
MLAPASAQVPHTIRPVANCFGLHRRSDRYHRWRGTGKKMILSTRGVLESSNGAPSGGLVKKRKIVEHIILLRAKPNISDAEEKDMLDYLYTSQYQMRGILTISLGRIEEPNSENFTHAVFMRFQQKEDIVKFHSSAYYSKILDDHVKPVSYGSVSVDFESEVEDDIIPLFRRGEDFNYGVEFMLLISFVETASREAMEDASSSLQ

SEQ ID NO: 33183 - DNA, 337 bp, Panicum virgatum
  misc_feature: Ceres CLONE 1949475-R
agtgatccggtttccatcatttgatgacttcaagttgttcagggagagcatggagtacaaggatatgtgggcatcaaagttccatcctattgtggagaaatccctccagctacatttcaccgtcgaccccgtggggaaccagctgatgtagaccagccatgcctctgcactcttcagatgaacacagaccttgctgggagttgcacaacatctctgctcatatgggaatgttttactgtcgtgtgcactctgtcccaaagtgtgcctgcaaattgtgctccacaacaacttcttgtagtatactcaatataaagaagagaatgaacactgtttttat

SEQ ID NO: 33184 - DNA, 973 bp, Panicum virgatum
  misc_feature: Ceres CLONE 1949482
  misc_feature: Encodes the peptide sequence at SEQ ID NO. 33185
agcaaccaccgcgggagcgaggcaaatgctcctctgatttctcgctcgctgcgggcggcggcgagattgcttaatacaatgagctggagatttccgctcttcggctctcagcagcagcaaacggatccaaatttccaggaaatccctacacagtcttggtaccctccctcggtggtaggctcgtcttcacgcccatccacgcctacctcttctagtgccagtccacatcaaagagctccagatcatcctcagtcttcatcctgtgggcaaccatctcctgctgaagctgcaggggtaattgctcgtttgaaggataagagtatcgaggagttacagaggctattgaaagacaaagaggcatataatgcattctttaattcacttgatcaagtgaaaacccagaacaatgtacgtgatgagcttagaaaggagacattgcaacttgcaagagggaatttagaaaaggagcagcggattttggagcttaggaatcagtgcacaataataagaaccacggaactagctgctgcccaaggcagattgtctgatttggagaggcagaaagatgatattatgaggtcctgttcccctgctgcgctgcttgataagctccaatcatcaatggcaaagctggacgaagagtctgaggagctgcaccagaagttcctgaagaaggacatcgacccgcctacctttgtgcaaaagtacaagaagctccgcacggcgtatcacaagcaggccttgctccatctcgccggtcagacatcactccgctgatgtcgtgttggagagacgatcggtgctaactttgttgtatacttgctcgttcattcttgttctataccctggttggccctgttctttatgtgcagcttattgtagggcttaccaaacatcaaacggagaatgcatgtatagttatgttgtttgaaatgattttttcctttggaatcattgttcgagatattttagc

SEQ ID NO: 33185 - protein, 232 aa, Panicum virgatum
  misc_feature: Ceres CLONE 1949482
  misc_feature (77)..(222): Pfam Name: Mod_r Pfam Description: Modifier of rudimentary (Mod(r)) protein
MSWRFPLFGSQQQQTDPNFQEIPTQSWYPPSVVGSSSRPSTPTSSSASPHQRAPDHPQSSSCGQPSPAEAAGVIARLKDKSIEELQRLLKDKEAYNAFFNSLDQVKTQNNVRDELRKETLQLARGNLEKEQRILELRNQCTIIRTTELAAAQGRLSDLERQKDDIMRSCSPAALLDKLQSSMAKLDEESEELHQKFLKKDIDPPTFVQKYKKLRTAYHKQALLHLAGQTSLR

SEQ ID NO: 33186 - DNA, 963 bp, Panicum virgatum
  misc_feature: Ceres CLONE 1949484
  misc_feature: Encodes the peptide sequence at SEQ ID NO. 33187
agtggttggcctcccgaccgagtcctatctgcatctgctattcctcctcctccacgccgtcctctccgtcgccgccgccgccgcatcctccggctatgccaagatgaatgtggataagctcaagaagatggcgggcgctgtgcgcaccggaggaaagggcagcatgcgcaagaagaagaaggcagttcacaagaccacaaccaccgatgacaagaggcttcaaagtactttaaaaagaattggagtgaacactattcctggtattgaggaggtcaacattttcaaggatgatgttgtgatccaatttcagaaccctaaagtgcaagcatccattcctgcaaatacatgggtggtcagtggagtaccacagacgaaaagtctgcaggacctgctgccaactattatcaaccaattgggccctgataacctggacaaccttcggaggcttgctgagcagttccaaaagcaggtacctggtgctgagactggtgccggtgcagctgcacagggtgatgatgatgtccctgagcttgtcccaggagagacatttgaagaggcggctgaggagaagaaggaaccggagcctgaagagaagaaagaatcataattttgttacacatctcatccattgttgtgaagggtagttggtccagtgttgccatctaccatctatcattcgtctccatgtgctccagttttcagttttacaaggatttggtggaatcccagtcaaattgagagttgcaacaagtgtgtgtttcacgttttcaattgattttttgtttacgagaaatgtgtagagctgtaatctagtggaggcttaagcttctaatggtgggtggcgattatggatgggagctcttaagcacttgagtttttcaaagttctcaatggctgcctgttgtaaacagagctcttaagcactgagtttttcaaggttctcaatggctgcctgttgtaagt

SEQ ID NO: 33187 - protein, 167 aa, Panicum virgatum
  misc_feature: Ceres CLONE 1949484
  misc_feature (34)..(92): Pfam Name: NAC Pfam Description: NAC domain
  misc_feature: Useful for making plants with modulated biomass
  misc_feature: The sequence is a functional homolog of SEQ ID NO 1614 in the 11/479,226 US patent application
  misc_feature: The sequence is a functional homolog of SEQ ID NO 784 in the 10/412,699 US patent application
  misc_feature: The sequence is a functional homolog of SEQ ID NO 1617 in the 11/479,226 US patent application
  misc_feature: The sequence is a functional homolog of SEQ ID NO 786 in the 10/412,699 US patent application
MNVDKLKKMAGAVRTGGKGSMRKKKKAVHKTTTTDDKRLQSTLKRIGVNTIPGIEEVNIFKDDVVIQFQNPKVQASIPANTWVVSGVPQTKSLQDLLPTIINQLGPDNLDNLRRLAEQFQKQVPGAETGAGAAAQGDDDVPELVPGETFEEAAEEKKEPEPEEKKES

SEQ ID NO: 33188 - DNA, 1104 bp, Panicum virgatum
  misc_feature: Ceres CLONE 1949486
  misc_feature: Encodes the peptide sequence at SEQ ID NO. 33189
aaacactcggacttggcaaactaggacctttcttccctgctgcattcggctctgctctatccactctgctcacaaagggggctaggagtagactggagatttggggcttcacctactactgtatctcatcgtcatctgttagttcaattaccctgctactgctgattgaggaggacgaggaagcagcgtccatggagacagcgaggcccatcctgtacaacgcctggatcagctcctgctcccaccgtgtccgcatcgctctcaacctcaaaggtgtggactatgagtacaagtcagtaaatcccaggacagatccagattttgaaaaaatcaacccaataaaatatattcctgcactagtagatggggacatagtcgtttccgactctcttgccatctcattgtatttggaagacaaatatcctgcacatcctctccagcctaaagatccgaagaggaaagctcttaatcttcagattgctagcatagtttgttcaagcattcaacctcttcaaggctatgccgttattggtttgcatgagggaagcatgagccctgatgagagccttcaaattgttcagcgttatactgacaagggattcagagcgattgaaaagcttttggatggatgcgagagtaaatatgctactggagatgatgtccaattgggtgatgtgtttctagagccgcagatccatgccggcataaatcgcttccaaattgatatgtcaaagtacccgattttggcaagacttcatgatgcatacatggaaatccccgcatttcaagctgcgcttcctaaatatcagccagatgcaccatcgtcgtaaagaatcaagattaccatgctacatcgaaatgcatgcttttcattttcaataataagttggaagagtttgtttaaacaataataatttggaaggatggtaactgcttcagcactgggttggatgttagcttacccattcatgaagactccgtcatatgtttaagttgtttcttctcttcattgataggttgtgtgcttttctagcagagggcagtaatttattcaagtatcacctcgatgtaacactacttgatattaataagatttctcttttg

SEQ ID NO: 33189 - protein, 212 aa, Panicum virgatum
  misc_feature: Ceres CLONE 1949486
  misc_feature (4)..(75): Pfam Name: GST_N Pfam Description: Glutathione S-transferase, N-terminal domain
  misc_feature: SWISSPROT Homolog: EC 2.5.1.18 Glutathione transferase
  misc_feature: Useful for biocontainment applications
METARPILYNAWISSCSHRVRIALNLKGVDYEYKSVNPRTDPDFEKINPIKYIPALVDGDIVVSDSLAISLYLEDKYPAHPLQPKDPKRKALNLQIASIVCSSIQPLQGYAVIGLHEGSMSPDESLQIVQRYTDKGFRAIEKLLDGCESKYATGDDVQLGDVFLEPQIHAGINRFQIDMSKYPILARLHDAYMEIPAFQAALPKYQPDAPSS

SEQ ID NO: 33190 - DNA, 717 bp, Panicum virgatum
  misc_feature: Ceres CLONE 1949496
  misc_feature: Encodes the peptide sequence at SEQ ID NO. 33191
gctttcaggagggttcgagaaggcgaaggcgaaggcgaggagcaagctgtactgcgtacagacttcggatatggaggaccagttccaggatggcaaggaggaggtcatccaagcatggtacatggatgacagcgaagaggaccagaggcttcctcatcatcgcgagcccaaagagttcattcctctagacaaactctcagagctaggaatattaagctggcgcctaaatgctgatgactgggagaatgacgagaacctcaagaaaattcgtgaagccaggggttactcttacatggacatctgtgatgtgtgtccagagaagttgccaaactacgaggctaagataaagaatttctttgaagaacacttgcatactgatgaagagatacgctattgtcttgagggtagtggctacttcgacgtgagggaccaaaatgataagtggatccgtatagcagtgaagaaagggggcatgattgtgttgcctgcaggaatgtatcaccactttacattggatacagacaactacatcaaagcaatgcgtctctttgtgggagagcctgtctggacgccatacaatcgtccccatgaccatctccctgctaggagggagtatgtcgagagaatcatcaaccgaggtggaagccaagctgttgaagctcgctgagtgtataccagcatctctgtatgtttgctgtccagtctgcctgtttcgct

SEQ ID NO: 33191 - protein, 198 aa, Panicum virgatum
  misc_feature: Ceres CLONE 1949496
  misc_feature (14)..(168): Pfam Name: ARD Pfam Description: ARD/ARD' family
MEDQFQDGKEEVIQAWYMDDSEEDQRLPHHREPKEFIPLDKLSELGILSWRLNADDWENDENLKKIREARGYSYMDICDVCPEKLPNYEAKIKNFFEEHLHTDEEIRYCLEGSGYFDVRDQNDKWIRIAVKKGGMIVLPAGMYHHFTLDTDNYIKAMRLFVGEPVWTPYNRPHDHLPARREYVERIINRGGSQAVEAR

SEQ ID NO: 33192 - DNA, 1206 bp, Panicum virgatum
  misc_feature: Ceres CLONE 1949498
  misc_feature: Encodes the peptide sequence at SEQ ID NO. 33193
acacgcacaccaccaccggacctgagcacaccagcaaggacaagccatggcttcgtcggtggccgccgcggcgagcacattcctgggcacccggttggcggacccggcgccgcagaacgggcgcatcgtggcccggttcccgttcggcaagaagccggctgccccgaagaaggcggccaagacgtcgaccagctccgaccggccgctctggttccccggcgcggtggcgcccgactacctggacgggtcgctggtcggcgactacgggttcgacccgttcgggctcggcaagcccgtggagtacctgcagttcgacctggactcgttggaccagaacctggccaagaacgaggccggcggcatcatcggcacccggttcgagtcctcggaggtgaagtccaccccgttccagccctacagcgaggtgttcggcctccagcggttccgcgagtgcgagctcatccacggccgctgggccatgctcgccaccctcggcgccctctccgtcgagtggctcaccggcgtcacctggcaggacgccggcaaggtggagctggtggacgggtcgtcctacctggggcagccgctgcccttctccatctcgacgctcatctggatcgaggtgctcgtgatcggctacatcgagttccagcgcaacgcggagctcgacccggagaagaggctctaccccgggggctcctacttcgacccgctcggcctggcggccgacccggagaagaaggagcggctgcagctggcggagatcaagcacgcgcgcctcgccatggtcgccttccttggcttcgccgtgcaagccgccgccaccggcaagggcccgctcaacaactgggccacccacctcagcgacccgctgcacaccaccatcttcgacacgttcggagcaggatcctcttaagcccgcccgccattgctagctccgtccgcccatcgatcgaagccttcaatcaactgtgatctcggctatcatacgttggagacgatggatgtgaatccgtccgtggtatcattttgtgatgagtgagagggtatgggaagatccatccgatccgatcctttgttaatgcaggactcgttgattaggagtaccgctgctagctgctgggacttgtgatttgtaatatatgaaccagtgatgatgaattaatgcattcacttgtacatcttgaggtgatgtatacttgtagc

SEQ ID NO: 33193 - protein, 289 aa, Panicum virgatum
  misc_feature: Ceres CLONE 1949498
  misc_feature (60)..(258): Pfam Name: Chloroa_b-bind Pfam Description: Chlorophyll A-B binding protein
  misc_feature: Useful for making plants with modulated water use efficiency
  misc_feature: Useful for making plants with modulated biomass
  misc_feature: Useful for making plants with modulated drought sensitivity
  misc_feature: Useful for making plants with modulated phosphate use efficiency
MASSVAAAASTFLGTRLADPAPQNGRIVARFPFGKKPAAPKKAAKTSTSSDRPLWFPGAVAPDYLDGSLVGDYGFDPFGLGKPVEYLQFDLDSLDQNLAKNEAGGIIGTRFESSEVKSTPFQPYSEVFGLQRFRECELIHGRWAMLATLGALSVEWLTGVTWQDAGKVELVDGSSYLGQPLPFSISTLIWIEVLVIGYIEFQRNAELDPEKRLYPGGSYFDPLGLAADPEKKERLQLAEIKHARLAMVAFLGFAVQAAATGKGPLNNWATHLSDPLHTTIFDTFGAGSS

SEQ ID NO: 33194 - DNA, 1678 bp, Panicum virgatum
  misc_feature: Ceres CLONE 1949510
  misc_feature: Encodes the peptide sequence at SEQ ID NO. 33195
actcggccttcttctccatcggccagctcgaaatcgtccgcccgtcctccggctatccgcctcaccattctcggccgcctcgtaaaccctccgctctccgccccgcacgaaccggggcggaaccaatccaaaaccctacctacgtgaccccgcatcccgtacccctcgcgcaagccgcgccatgttccgcgtcgcgaggtcgcgcctcctccccaggatctccgcgctctccttctgcactgcctcccctgcagccgccgccgcctcctcctcctccactcctccggtggctgctgctgccgccgccgccgcctccgcctccgaggcttcgtccacctctggagacccatcatcccagcagcccccggtggcccgaaagccatggggcacgctcaaggtcgcagccttcgcggccgtgttcgccgcggtcggtgccacaggctacgccagctacgcttattctctagaggaattggatcagatgacacgggagttccggaagaaatcgaagcatcccattcctgaagactcgtccggcttcgagaagtttcaggctatggcttattcagcagctatgaaagctcctgttgccgctattgagctatacctggatgtcaggagccaaattgaagatcaaattcgggtcagtaataaatgtgaaccagtatcagacaaactccttccagatcgtcctcctcaagaacagcatgtattgaccctagttctggatctcaacgagactcttgtatactcagattggaagcgtgagagaggatggaggacttttaagaggccaggagtggacgcctttttggaacatcttgggaagttttatgaaattgttgtgtattctgatcagcttagtatgtatgttgatcctgtcgttgataggctggatccgaagggaaatattcggcacaggctatcaagagttgcaactaaatacgaaaatggaaaacattatcgggatttatcgaagctgaacagaaatcctgctcaagttatttatgtcagtgctcatgctttggagtcaagtctgcagcctgaaaattctgtgcaaattaaaccttggaagcttgaaaatgatgacactcaactgcttgatctcattccatttctagaatatgttgctatggcaagacctcctgacatcagggctgttcttgcatcctatcaaggtagtgacattgctgctgagtttattgagcgctctaaggaacaccaaaggcgcatgcaagaacaaaagcattcaggacgcatatggcggcgatgatgactaaatagtctacatacttctatagacacatcaaacttttggcgcttcaatccaaatgaagagaatgaatccatcgtccatggattaatatttgtcaacttttggagatatcacccttgaacatttttaataaatgtttacattttgatgggtgtcttacagagatcaaacgttaccttttcagttttttttttggctagaacctttccagaattcttggccaacgttttgaaagtatctttatggcagattcacttggattagttttagattagtagaagctagtattatctgttcaacaaatctactgcacgcattctatgctggccttctttgactggtgagattgcaaatattcctgtggattgttgcaatcttgtgaaacgtactagctgaactgcg

SEQ ID NO: 33195 - protein, 363 aa, Panicum virgatum
  misc_feature: Ceres CLONE 1949510
  misc_feature (169)..(330): Pfam Name: NIF Pfam Description: NLI interacting factor-like phosphatase
  misc_feature: SWISSPROT Homolog: EC 3.1.3.16 Phosphoprotein phosphatase
MFRVARSRLLPRISALSFCTASPAAAAASSSSTPPVAAAAAAAASASEASSTSGDPSSQQPPVARKPWGTLKVAAFAAVFAAVGATGYASYAYSLEELDQMTREFRKKSKHPIPEDSSGFEKFQAMAYSAAMKAPVAAIELYLDVRSQIEDQIRVSNKCEPVSDKLLPDRPPQEQHVLTLVLDLNETLVYSDWKRERGWRTFKRPGVDAFLEHLGKFYEIVVYSDQLSMYVDPVVDRLDPKGNIRHRLSRVATKYENGKHYRDLSKLNRNPAQVIYVSAHALESSLQPENSVQIKPWKLENDDTQLLDLIPFLEYVAMARPPDIRAVLASYQGSDIAAEFIERSKEHQRRMQEQKHSGRIWRR

SEQ ID NO: 33196 - DNA, 940 bp, Panicum virgatum
  misc_feature: Ceres CLONE 1949514
  misc_feature: Encodes the peptide sequence at SEQ ID NO. 33197
aaaaccgacagccaagcgaggtagctcccagctcccagctccgcggttcccgttccactcggcatggctccgcaggcgtggattgtgggggagaagggcgaggacctccaagggcccaaggagttccttcccctctccaagcttgaagatattggtgtgctttattggcagttggatcctaagaagtctgaaagcgaagaagagcttgcaaaaatccgcaaagaaagaggatacagttacatggaccttattgagatatgtcctgacaaactggaaaactatgaggagaagctgaagaacttcttcactgagcacatgcacgctgacgaagagatccgctactgcttggaaggtagtgggtactttgatgtccgtgacagggatgacaagtggattaggatttggataaaggaaggagacatgatcatcctgcctgctggaatttatcatcggttcaccctggacagcacaaattatgtgaagctcatgaggcttttcatcggggaaccagtctggactgcgctgaacaggcctcaggagggccacccctcaaggcaagagtacgtgaagaatgtgatggggaacaatggatttgctctagcagcacactgaacctgtcgttgctgttcgttctgcaagatacaaacatacgcaaggtatatatggtcagtcagatgcgaaactttgctgtgttgttatggaacatcattctgcactagtttgtacacgtagaagatacacactgcatctgcatcgtgtgggaacgtacgatgtagtattttctcttgtgcctgcttgatacagatacccttggatgtttatgattgcagcagcagcagcagctgccagcaattctgtatatgtatgatgtatcttacctgaccttgtgtgtggtactaatgtctgtcaggcaatggaaatctcatggcatcgaggaccc

SEQ ID NO: 33197 - protein, 182 aa, Panicum virgatum
  misc_feature: Ceres CLONE 1949514
  misc_feature (4)..(153): Pfam Name: ARD Pfam Description: ARD/ARD' family
MAPQAWIVGEKGEDLQGPKEFLPLSKLEDIGVLYWQLDPKKSESEEELAKIRKERGYSYMDLIEICPDKLENYEEKLKNFFTEHMHADEEIRYCLEGSGYFDVRDRDDKWIRIWIKEGDMIILPAGIYHRFTLDSTNYVKLMRLFIGEPVWTALNRPQEGHPSRQEYVKNVMGNNGFALAAH

SEQ ID NO: 33198 - DNA, 460 bp, Panicum virgatum
  misc_feature: Ceres CLONE 1949543
  misc_feature: Encodes the peptide sequence at SEQ ID NO. 33199
actaaacaatctctcatacccacacttgggcgtccttggccgctgcatctctcggtttctcaatggcgccctccgctatgatccgctgcgccgccgccgtcgcgacgctcgccctcctcgacgctggcggcgaggccgcggtgttcgccgcggtgaaccagtgccccttcacggtgtgggcggcctccgcgccggggggcggcgggcgccagctgaaccgcggcgagacgtggcgcatcggcgtgcccgccggcacgacggcggcgcgcatcggggcgcgcacggggtgccaggtcgacgcggccgggcgcgagagctgccacgcgcgggaccgcagccgggtgctgcgctgctgcgtgtaccggcacacgccccccgcgctggcgcagtacacgctgacgcagttcgccatgctctacttcttcatcatctccctcatccacggcttcagcgagcccat

SEQ ID NO: 33199 - protein, 132 aa, Panicum virgatum
  misc_feature: Ceres CLONE 1949543
  misc_feature (32)..(132): Pfam Name: Thaumatin Pfam Description: Thaumatin family
MAPSAMIRCAAAVATLALLDAGGEAAVFAAVNQCPFTVWAASAPGGGGRQLNRGETWRIGVPAGTTAARIGARTGCQVDAAGRESCHARDRSRVLRCCVYRHTPPALAQYTLTQFAMLYFFIISLIHGFSEP

SEQ ID NO: 33200 - DNA, 237 bp, Panicum virgatum
  misc_feature: Ceres CLONE 1949543-R
tttttgccctaaaatagggttatgaggatggcgacaggactgcatactactagcacgaagaaataagaactggccggcttgtgcagcagccgacacagccccgggcttgtagaatccagtgtcctcaactggagaagctaatcaataaggacgtgtgatttctatatcaccataataaagtcattcagaacctttgcttaatttaaacaacggtccttactaataaagttgatttcc

SEQ ID NO: 33201 - DNA, 870 bp, Panicum virgatum
  misc_feature: Ceres CLONE 1949544
  misc_feature: Encodes the peptide sequence at SEQ ID NO. 33202
aaaaccataagcgccccccactgtttcccctatctccatttccaagagcaagacctgaggaagcagccatggcggtgtcgatcgagctcaccaaggagtacgggtacgtcgtgctggtgctggtggcctacgccttcctcaacttctggatgagcttccaggtcggcaaggcccgcaaaaagtacaaggtgttctaccccaccatgtacgccgtcgagtcggagaacaaggacgccaagctcttcaactgcgtgcagagggggcatcagaactcgctggagatgatgcccatgttcttcgtcatgctgctgctcggcggtctgcagcaccagaccatcgccgccggactgggcgccttctacacggtcgcgaggttcttctacttcaagggatacgccaccggcgtcccggagaaccgtctcaagattggggggctcaacttcctggctgtgtttgggctgatcatctgcacggcatctttcggcatcaacctggtcatcagggagacgctctgaagttcaggcttacacgtgatctgcagactgtattaacgggacaaattacttcttgtggcctgggtagtgaaactttgtgaggcagtcatctaggtttgtattagtcgtatactcgcatctttttttttcgtgttgataagcaaagtagcggatgtgtgcgtgtgcatgtgtttcacttttgttaatgccggaataagagatggaggagatggcttgaagcatgaaccttacagttcgtgctgcttgttagttgttactctgttttcgctgtaaaggattgtcgatggattgtgcctcattgtttgctgtaattttttatggaggtaaaatcggctggtaacagctctgcttttac

SEQ ID NO: 33202 - protein, 148 aa, Panicum virgatum
  misc_feature: Ceres CLONE 1949544
  misc_feature (9)..(140): Pfam Name: MAPEG Pfam Description: MAPEG family
  misc_feature: SWISSPROT Homolog: EC 2.5.1.18 Glutathione transferase
MAVSIELTKEYGYVVLVLVAYAFLNFWMSFQVGKARKKYKVFYPTMYAVESENKDAKLFNCVQRGHQNSLEMMPMFFVMLLLGGLQHQTIAAGLGAFYTVARFFYFKGYATGVPENRLKIGGLNFLAVFGLIICTASFGINLVIRETL

SEQ ID NO: 33203 - DNA, 685 bp, Panicum virgatum
  misc_feature: Ceres CLONE 1949551
  misc_feature: Encodes the peptide sequence at SEQ ID NO. 33204
cttctcgatcggattgggttgggggttctgggtaggtgtggtgtgctcgggagttggggcttcttcgttgctttgcttcgctcgtgcgcaagggagagagaagagggaggagaagtaggcggggaggcagatggcatcgaagcggatcctcaaggagctcaaggacctgcagaaggatcctcccacctcctgcagcgcaggcccagtcgcggaagatatgttccactggcaagcgaccataatgggtccatcagatagcccatacttcggcggcgtctttttggtcacaattcacttccctccagactacccattcaaaccgcctaaggtacacagttttgtagtagtggagtacataagaataagattactgcccatttcagtttgaattcgttttcttctgtttatgaccgtcaactcttatgagttaccggacgcccatttccgtaccacaacttgtccatattggtcctagattcccattagaattagtgacaaggaattgtgtgtaccagtttggaactggccccatttatgttctgcttgtgaacaaacactgaaactagccataacacattacagttttgtccacatcaatgctttatctgagaattggttgtttttagtttttactttgtcattctgctctatgctgtcatttagccttgtctaatgtgttgaggga

SEQ ID NO: 33204 - protein, 85 aa, Panicum virgatum
  misc_feature: Ceres CLONE 1949551
  misc_feature (5)..(85): Pfam Name: UQ_con Pfam Description: Ubiquitin-conjugating enzyme
  misc_feature: SWISSPROT Homolog: EC 6.3.2.19 Ubiquitin--protein ligase
  misc_feature: Useful for biocontainment applications
  misc_feature: Useful for making plants with modulated light quality sensitivity
  misc_feature: Useful for making plants with modulated low light sensitivity
MASKRILKELKDLQKDPPTSCSAGPVAEDMFHWQATIMGPSDSPYFGGVFLVTIHFPPDYPFKPPKVHSFVVVEYIRIRLLPISV

SEQ ID NO: 33205 - DNA, 279 bp, Panicum virgatum
  misc_feature: Ceres CLONE 1949551-R
tgacctagcaatttgctcgtgttatgtgcctttgttccagttctaatgtattgcattctgtcgttcgtgcatcgaacaatctctataatggaaggtgaaacattgattgtgttctccccgggtgtgatgcaatttgttgttggcaacttgcttgatggttatgtcactgatgattcacgtgaccgatgcattaggatcttctgctgctggtggcgccggacatggtccgaaattgtcattttcaattccaaattcaatgatttggatttctgctgctgc

SEQ ID NO: 33206 - DNA, 638 bp, Panicum virgatum
  misc_feature: Ceres CLONE 1949559
  misc_feature: Encodes the peptide sequence at SEQ ID NO. 33207
cgatgcgaccgccctcgctgctctccctcaccctcgactcggcgctcctccgcatcgcccacatcgccgacatctcccacctccccgaccacctcgtcatcgacctcttccgtggtgttccgagaggttctaggcctgttggtgcttagatcattttgattaccttacctgagaagatgtcttcggtaattcaagacagtgaggttgacattgtgattgcagcactccagcccaatctgaccaccttctttgaagcatggcggccatttttctctcgtttccacgtcattgttgtcaaagatccagacatgacacagaatcttcaaatccccactggctttgatctcaaggtttacacaaagtcagatattgatggagtgcttggcgccacgtccatcaacttctctggtcactcatgccgttactttgggtatcttgtctcacggaagaagtatgtgatttcaatcgatgacaattgcctcccagcgaaggacactgttgggtccactgttgatgctgttgcacagcacatggccaatatgaagacacctgccacacctttctttttcaacacgctttatgatccataccggaaaggtgctgattttgtccgtggttacccattcagcctgcgtgag

SEQ ID NO: 33207 - protein, 153 aa, Panicum virgatum
  misc_feature: Ceres CLONE 1949559
  misc_feature (1)..(153): Pfam Name: RGP Pfam Description: Reversibly glycosylated polypeptide
MSSVIQDSEVDIVIAALQPNLTTFFEAWRPFFSRFHVIVVKDPDMTQNLQIPTGFDLKVYTKSDIDGVLGATSINFSGHSCRYFGYLVSRKKYVISIDDNCLPAKDTVGSTVDAVAQHMANMKTPATPFFFNTLYDPYRKGADFVRGYPFSLR

SEQ ID NO: 33208 - DNA, 180 bp, Panicum virgatum
  misc_feature: Ceres CLONE 1949559-R
tcttacaaagcataattgtttggaatacttttttttcagttttaatctttgcttgtggaactcatgaagctgaataaacgacgttccagtatgcagggaatttggcagagtaattgaatatttgattgtatacgcttaagaacactaatgtactatcaaaagaacctttcatgttcttac

SEQ ID NO: 33209 - DNA, 679 bp, Panicum virgatum
  misc_feature: Ceres CLONE 1949567
  misc_feature: Encodes the peptide sequence at SEQ ID NO. 33210
acgtctccttctctaccgagcactaaactccattcgaattctagggttttgctgctctcccgagctctgaaggccgcatcaccgcattaggtgcggttcctcgcgtgcgaccgtaatggcgctgccgaaccaggggactgtccattaccccaccttcaagctcgtcatcgatggagatggcggaacgagtaaaaccacattcgtgaagaggcatctcactggagagtttgagaagaaatatgagccaaccattggtgtggaagttcatccgttggatttcactactaactgtggtaagatccgtttctactgctgggatacagctgggcaagagaagtttggtggcctcagggatggatactatatccatggccagtgtgcgatcattatgtttgatgttacctcaaggctgacttacaagaatgttcctacatggcataaggacctgtgcagggtgtgtgagaacatccccatcatcctgtgtggaaacaaggttgatgtgaagaacaggcacgtgaaggccaagcacgtcaccttccacaggaagaagaatctgcagtaatatgaaatatctgctaagagcaactacaactttgagaagccgttccttaaccttgcaatgaagctggctggggattccaacattaacattattgaagccgtatctctaaagcctcct

SEQ ID NO: 33210 - protein, 148 aa, Panicum virgatum
  misc_feature: Ceres CLONE 1949567
  misc_feature (15)..(148): Pfam Name: Ras Pfam Description: Ras family
MALPNQGTVHYPTFKLVIDGDGGTSKTTFVKRHLTGEFEKKYEPTIGVEVHPLDFTTNCGKIRFYCWDTAGQEKFGGLRDGYYIHGQCAIIMFDVTSRLTYKNVPTWHKDLCRVCENIPIILCGNKVDVKNRHVKAKHVTFHRKKNLQ

SEQ ID NO: 33211 - DNA, 149 bp, Panicum virgatum
  misc_feature: Ceres CLONE 1949567-R
atatttgcatcgtgtcaaggacatgggtttatttccgaatgcaggaaatctcgaaagacatgacaacatgaatttcaaggacccttaaaacatttcgatgtaagtttggaataatgaagataagagttaataatgtacagatcagcgtg

SEQ ID NO: 33212 - DNA, 959 bp, Panicum virgatum
  misc_feature: Ceres CLONE 1949571
  misc_feature: Encodes the peptide sequence at SEQ ID NO. 33213
atccctgatttcatttcacagcttgagcaagagatcaagcaaatcaaaaggaagcatggcagcgggcttgcaagtgtttggccagccagcatctactgatgttgccagggttctgacttgcctttttgagaagaaattggaatttgagcttgtccgcattgatacatttaaaacacatcacaagcttcctgaattcattaggctgcgggatccgaatgggcaggtgaccttcaagcatggtgacaaaactctcgttgattcaagagatatatgccggtacgtctgtaaccattttccaaatgatggaaacaagaccctttatggatctggggctctagaacaggcatcaatagaacagtggcttcaggcagaagctcagaactttggccctcccagctctgcactagtctttcagctggcattcgttcctcatctcagccatctaggtgttcgtcaggaccatgctgttattgctgaaaatgaggataagctgaagcagatcctcgatgtttatgatgaaatactctcgaagaatgaatacctggctggcgatgaattcaccttggccgacgtttctcaccttccaaactcgcattatatcgtaaatactgagagaggaaggaagctcttcwctaacaagaagaatgtggcaaagtggtatgacaaaatctcgaagcgtgagacatgggcgcaggttgtcaagatgcagaaggagcatccaggtgcattcgagtgatggcttaatttggcgagcagtgaaggtatcttgaatggcttcattatttgtgtcagtctggcttgtacagtgcagtgttcccatcagtgttttcgtgtcaaccaaaataatgtgaagccctattgtgatgtatgaatcttttgttttgaaacacgtttacctccatgtgtcgactgatctttgattaataaaattgcccgtttggcctacattttgttttgcg

SEQ ID NO: 33213 - protein, 226 aa, Panicum virgatum
  misc_feature: Ceres CLONE 1949571
  misc_feature (110)..(209): Pfam Name: GST_C Pfam Description: Glutathione S-transferase, C-terminal domain
  misc_feature (3)..(78): Pfam Name: GST_N Pfam Description: Glutathione S-transferase, N-terminal domain
  misc_feature: SWISSPROT Homolog: EC 2.5.1.18 Glutathione transferase
  misc_feature (193)..(193): Xaa is any aa, unknown, or other
MAAGLQVFGQPASTDVARVLTCLFEKKLEFELVRIDTFKTHHKLPEFIRLRDPNGQVTFKHGDKTLVDSRDICRYVCNHFPNDGNKTLYGSGALEQASIEQWLQAEAQNFGPPSSALVFQLAFVPHLSHLGVRQDHAVIAENEDKLKQILDVYDEILSKNEYLAGDEFTLADVSHLPNSHYIVNTERGRKLFXNKKNVAKWYDKISKRETWAQVVKMQKEHPGAFE

SEQ ID NO: 33214 - DNA, 1242 bp, Panicum virgatum
  misc_feature: Ceres CLONE 1949581
  misc_feature: Encodes the peptide sequence at SEQ ID NO. 33215
acctaactgaagaacatggtgagggttccaagtgcccatcccttgggcttactagtgaacaagcaaagatgataattggtaagaaagcctttatatgcaagaactgtaagtataagcaacatcagtgttctgcttgtggattattggggtcttcagacttaccatcaggagctgaggtattcaaatgtaaggactatgcctgtggtcatttttaccaccctaagtgtatttctgaactgcgacatcctgatagcaaagtccgggcctcccttttcgaacagcatgttgctgctggactgaaattcctgtgccatgtgcataaatgtagtgtgtgtcatggagaagagaataaggatgataaggatatgcagtttgcagtatgcaggctctgcccaacaacatatcaccggaagtgtttgcccagtgatatcccctttgcagcgaaggaaggccccaatggctacatttttcaaagggcgtgggatggcattcttcgtgatcaaattctgatatactgcatgaagcatgagatcataaaagagctagggattcccaggaggaaacttatcatctttcctgaggccaaaaatttttttgcacccaaagatccagaaagtacaccgaaagaacaagatattttgttcgaacaagagctacttggccacccagcatctgaaccatctcagactccaccgccacctgcaaccgtccagaatcagtgcttccgctccaatcctatggactcatttgcaccaagttccttgtataccgatccatacccagggtcatgtggttgggtcgatgactgaccatcctatcccgccccttgtagatgataccaatagtgacagatccttcgcaatgcgccaagacattggtagcttgggtttgttagatatcagaaaacgcaatttgtagaaagctgatagcctatccgagtccaagtggccggcccccatctacaatgatggtggataaacatgtgttcttgtttatgtgacatggtagacagcccctgcagtatagagtgatgctgtgggttgcatatgacataaaccccatccagagaattttggagattaaagtcaaatgtgattttggatttacctagaaccgacggctctcttattagatgcagattaaccatgaatgggaaaactgctagcatatggagagttattactgaattgtttataatatttcttttcttggattgatagtattcagtaaattgtcattggt

SEQ ID NO: 33215 - protein, 268 aa, Panicum virgatum
  misc_feature: Ceres CLONE 1949581
  misc_feature: SWISSPROT Homolog: EC 2.1.1.43 Histone-lysine N-methyltransferase
LTEEHGEGSKCPSLGLTSEQAKMIIGKKAFICKNCKYKQHQCSACGLLGSSDLPSGAEVFKCKDYACGHFYHPKCISELRHPDSKVRASLFEQHVAAGLKFLCHVHKCSVCHGEENKDDKDMQFAVCRLCPTTYHRKCLPSDIPFAAKEGPNGYIFQRAWDGILRDQILIYCMKHEIIKELGIPRRKLIIFPEAKNFFAPKDPESTPKEQDILFEQELLGHPASEPSQTPPPPATVQNQCFRSNPMDSFAPSSLYTDPYPGSCGWVDD

SEQ ID NO: 33216 - DNA, 1275 bp, Panicum virgatum
  misc_feature: Ceres CLONE 1949601
  misc_feature: Encodes the peptide sequence at SEQ ID NO. 33217
tttatcaagtaaatagggaacacagttttcctattgagaacagagttcagtatcttccattcaagatgctcccccaaggtcacccccatgatgcacaacttcaggaatttcaatattttgtggttattgactttgaagcaacctgtgacaaggtgaacaatccatttccacaagagatcattgagtttccatctgtcttggttaacagtgcaactgggaaactggaagaatgctttcaaacgtacgttcgtccaacatatcatcaatttttgactgacttctgcaaggagcttactggtatacaacagattcaggtggacagaggtgtgccactaggtgaagccttactcatgcatgataagtggctagaggacaagggcattaagaacacaaactttgctattgtcacctggtctaattgggactgccgaacaatgctggagtcagaatgcagatttaagagaatcaggaagcccccttatttcaacaggtggatcaacttgaaggtacctttccatgaagtgtatggggatgtccgttgcaacttaaaggaggcagttcagttggctggccttacatgggagggtcgtgctcactgtggactcgatgatgctcgcaacactgctcgcctcctggcacttatgatgcatcggggcttcaagttctctatcaccaactcacttgtttggcaaccggccccacagtcagcaacctgccttctatcccctgatcgctctccagatcctgtccaaccgcagcttaagccgaatgagatgctgggatctcctgtgcaggttaatccatatgccgcctccgcagggaaggacagagcaatgtactgctactgcggtgtgctgagcaggtggagcgttgtgcgcaagccaggacccatgcagggacgttacttctatggatgcggcaactggaccgccacgaggcgggcgatctgcccatactttgcatgggcatcgtagaggcatactgtgcttccgtccaagcagatctgaagggcaaaggacttggttctttaactaagggaggcgctatgttgcggttgcctcgcctctgctgcgcctcccgatccgtatatattatgatataactttgctcataagacaatggaagttcactaggtagtgtctaacctgtcatgctgacttctgttgatagaagagaatgggctcagatgctgcttaggtgtgatttatccatgaataatctaagtttgtggacactgtttttaacttaatggaactattgtaggtgtggcttgtg

SEQ ID NO: 33217 - protein, 323 aa, Panicum virgatum
  misc_feature: Ceres CLONE 1949601
  misc_feature (39)..(211): Pfam Name: Exonuc_X-T Pfam Description: Exonuclease
  misc_feature (278)..(323): Pfam Name: zf-GRF Pfam Description: GRF zinc finger
  misc_feature: SWISSPROT Homolog: EC 2.7.7.7 DNA-directed DNA polymerase
YQVNREHSFPIENRVQYLPFKMLPQGHPHDAQLQEFQYFVVIDFEATCDKVNNPFPQEIIEFPSVLVNSATGKLEECFQTYVRPTYHQFLTDFCKELTGIQQIQVDRGVPLGEALLMHDKWLEDKGIKNTNFAIVTWSNWDCRTMLESECRFKRIRKPPYFNRWINLKVPFHEVYGDVRCNLKEAVQLAGLTWEGRAHCGLDDARNTARLLALMMHRGFKFSITNSLVWQPAPQSATCLLSPDRSPDPVQPQLKPNEMLGSPVQVNPYAASAGKDRAMYCYCGVLSRWSVVRKPGPMQGRYFYGCGNWTATRRAICPYFAWAS

SEQ ID NO: 33218 - DNA, 835 bp, Panicum virgatum
  misc_feature: Ceres CLONE 1949603
  misc_feature: Encodes the peptide sequence at SEQ ID NO. 33219
acccctcgaaaagccgcggaaaagggcaggaaaaaggagggagggcgggatggacgcgttcatagactcggtgggctccatcttccgcggcggcgacgtccttccctggtgcgaccgcgacatcatcgccggttttgagagggagattgctgaggcagcaaatgaacaacagaaaaatgacagccttatgaggctttcctgggcgctggttcactctagacagcctgaagatgtcaaccggggcatcgggatgcttcaagcttcattggacaggcctagtagcccgctgcaaacaagggagaagctctatttgttggctgttggacactacagaactggggattatacaagaagccggcagcttttggaaagatgcttagagattcaacctgactggaggcaagccctgactttgcaaaggctcgttgaagaaaaaaccagaagagatggtatgattggcatggctatcatcactggcgcctttggacttgtgggacttgttgctggtggtataattgctgctgcctcgtcgtcatcctcatccaggaagaaatgaggatgttttgtgaagttaataagaaatcaagatgggcaaaaacttgatgacaagcagacatcatttttgtgcttcatgtgaagttttttttttgggtactctttacgtgtgacaccagccttctgttcatacgagagagatgtattgttaacatgatagtagtcagtagaggatgaggccctgtgaatcggtgatcgtgttgttccaacatttggactgttgtactctgtcgccgcagaacatgctgtcaccatataataagagaatacagtcatacac

SEQ ID NO: 33219 - protein, 168 aa, Panicum virgatum
  misc_feature: Ceres CLONE 1949603
  misc_feature (83)..(116): Pfam Name: TPR_2 Pfam Description: Tetratricopeptide repeat
MDAFIDSVGSIFRGGDVLPWCDRDIIAGFEREIAEAANEQQKNDSLMRLSWALVHSRQPEDVNRGIGMLQASLDRPSSPLQTREKLYLLAVGHYRTGDYTRSRQLLERCLEIQPDWRQALTLQRLVEEKTRRDGMIGMAIITGAFGLVGLVAGGIIAAASSSSSSRKK

SEQ ID NO: 33220 - DNA, 977 bp, Panicum virgatum
  misc_feature: Ceres CLONE 1949608
  misc_feature: Encodes the peptide sequence at SEQ ID NO. 33221
caggagatcactcacaagcttaaacacttcctcctcattgcttcggccctcttgcagcagctactccgtgcccagtgccaagcagcagcatccggtttgcctggatgtgccaaggttacacagcagcaagaagaagagcatcctgaggtgttcctccagccttgctgatggtccatccaccgttggttcttcagtaagatgggttcttgatcctgcaggttcattgattcccccattcttctagtagctctgcctctacatcgtgtccatctgcaatttagcactagttgcggtcctgaacatccatctcgtatcctttgattacccactctgtcatattattgttcttccccagcgttgtcagtattcaatggatggaattatgctcagatgcactttgcactgtcgatttcaggcgacggcgattggcgccacatcggctacaaagttgcacgccccggcgcgttcgagatagcctccgatgcggtgaccgttggtcgggtcgctgacaaagctgacatcgtcctccccattgccacagtttctggcacgcacgctcggctggagaagaaagacgggaggctgctggtgacggacctgggcagcaccaacggcacctacatcaacgagcgacgcctcaaccctggcttcgcaattcccattgaccccggcagcctactcatctttggtgacatccacctggcgatgtttcgtgtgaggaagatgatagttgaggtgcccagcgagacggataaaacccaacaagaaaccaagaccgaggtagtatcagctgcagttgaagatactacaagctagcaagttctgatgcgttcctagtgccccactagctactagtagaatgttcggaataaaaacctacacggtcatggactcatggtggccgcgttatgacggtttcagcaggaaccaggaattatgaagtaacaaaggcaccaattgtccatagtcagagtttc

SEQ ID NO: 33221 - protein, 141 aa, Panicum virgatum
  misc_feature: Ceres CLONE 1949608
  misc_feature (33)..(100): Pfam Name: FHA Pfam Description: FHA domain
  misc_feature: SWISSPROT Homolog: EC 1.14.13.90 Zeaxanthin epoxidase
MHFALSISGDGDWRHIGYKVARPGAFEIASDAVTVGRVADKADIVLPIATVSGTHARLEKKDGRLLVTDLGSTNGTYINERRLNPGFAIPIDPGSLLIFGDIHLAMFRVRKMIVEVPSETDKTQQETKTEVVSAAVEDTTS

SEQ ID NO: 33222 - DNA, 790 bp, Panicum virgatum
  misc_feature: Ceres CLONE 1949621
  misc_feature: Encodes the peptide sequence at SEQ ID NO. 33223
acttcctccattcgcgcttctcctctctctctctctctctctctctctctctctctctctctctctgtcgatgcccgtctccactccctccgtcagatccctcgcccgggccaccatggcggaccagctcgccgacgaccagatcgcagagctcaaggaggcyttcagmctcttsaamaaggasggmgacggcwgcatcaccaccaaggaactkggaactgkgatgcgctcattggggcagaacccyascgaggctgaactccaggacatgatcaatgaggttgatgcagatggcaacggaaccattgacttccctgagttcctcaacctgatggcacgcaagatgaaggacactgactctgaggaggagctcaaggaggccttccgtgtgtttgacaaggaccagaacggcttcatctccgcggctgagctccgccacgtcatgaccaaccttggcgagaagctgacagatgaggaggtggacgagatgatccgcgaagctgatgtggatggtgatggccagatcaactacgaggagttcgtgaaggtgatgatggccaagtgagatgtgctcttttgaagctagtttctctcctgatggtagtaactagtttagtgttgaaaactgactgcatttggttatcccttattccgatccgtgcgccaatgaacagatatgttgtttgttttcttccctgggatttcactgtatctgtaatttcttttggattcgtttgcgattgtattacatttatgttatctgggtacaatgatcatgccttcccctttg

SEQ ID NO: 33223 - protein, 149 aa, Panicum virgatum
  misc_feature: Ceres CLONE 1949621
  misc_feature (121)..(149): Pfam Name: efhand Pfam Description: EF hand
  misc_feature (85)..(113): Pfam Name: efhand Pfam Description: EF hand
  misc_feature (48)..(76): Pfam Name: efhand Pfam Description: EF hand
  misc_feature: SWISSPROT Homolog: EC 2.7.11.1 Non-specific serine/threonine protein kinase
  misc_feature: Useful for making plants with modulated salt sensitivity
  misc_feature (18)..(18): Xaa is any aa, unknown, or other
  misc_feature (20)..(20): Xaa is any aa, unknown, or other
  misc_feature (21)..(21): Xaa is any aa, unknown, or other
  misc_feature (23)..(23): Xaa is any aa, unknown, or other
  misc_feature (27)..(27): Xaa is any aa, unknown, or other
  misc_feature (36)..(36): Xaa is any aa, unknown, or other
  misc_feature (45)..(45): Xaa is any aa, unknown, or other
MADQLADDQIAELKEAFXLXXKXGDGXITTKELGTXMRSLGQNPXEAELQDMINEVDADGNGTIDFPEFLNLMARKMKDTDSEEELKEAFRVFDKDQNGFISAAELRHVMTNLGEKLTDEEVDEMIREADVDGDGQINYEEFVKVMMAK

SEQ ID NO: 33224 - DNA, 655 bp, Panicum virgatum
  misc_feature: Ceres CLONE 1949640
  misc_feature: Encodes the peptide sequence at SEQ ID NO. 33225
aaggattctaatgaagactgtttctcaattgacctctggaaaacagcctgttggtacaatggcctacatgggcaaagtacaacatctgatgcaatccaaatgtgcagtcaaaacagctgaagattggcttaaccctgctttcatacaagaggcatttgaagctagggctctcaggatggcggtaaactgtgcccagaacataggccaagcggcaaaccaagaaggtttctatgaacggtccccagatttgcttgagtctgcggtagctcacatccagttgatcattgtaaccaagtttatcgagaaggtacagcaggacattcctggacatggggtgaaggaacagctccagaacctctgcaatgtttatgccctctacattcttcacaagcacctgggtgatttcctggcaaccgggtgcatcacacccaagcagggagcgctggcaaacgagcagctgggcaagctctacgcacaggtgcgtccgaatgctgttgcgctggtgggcgcgttcaactacaccgaccactacctgggatcagtgctggggaggtacgacgggaacgtgtaccaggcactgtacgaggaggcgtggaaagaccctctgaacgagacggtggtgccggaggggtaccacgagtacctccgccccttg

SEQ ID NO: 33225 - protein, 217 aa, Panicum virgatum
  misc_feature: Ceres CLONE 1949640
  misc_feature (41)..(217): Pfam Name: ACOX Pfam Description: Acyl-CoA oxidase
  misc_feature: SWISSPROT Homolog: EC 1.3.3.6 Acyl-CoA oxidase
RILMKTVSQLTSGKQPVGTMAYMGKVQHLMQSKCAVKTAEDWLNPAFIQEAFEARALRMAVNCAQNIGQAANQEGFYERSPDLLESAVAHIQLIIVTKFIEKVQQDIPGHGVKEQLQNLCNVYALYILHKHLGDFLATGCITPKQGALANEQLGKLYAQVRPNAVALVGAFNYTDHYLGSVLGRYDGNVYQALYEEAWKDPLNETVVPEGYHEYLRP

SEQ ID NO: 33226 - DNA, 257 bp, Panicum virgatum
  misc_feature: Ceres CLONE 1949640-R
cagaatcatatcagaggtgtttgttgacagccaaatttggcacctgccgaggccgaccggtttgattggtcgacccgcccggttagaccggtctggtctgtacagtccgagtagaaataggttttttataaagggtcctcatgtaattttactcgtgaaggggtacgtcctccccggcctataaatataaaggctaaggccgattgagggatatacccaatcgaatcaatacaaaaatcgcattattttttatctct

SEQ ID NO: 33227 - DNA, 737 bp, Panicum virgatum
  misc_feature: Ceres CLONE 1949644
  misc_feature: Encodes the peptide sequence at SEQ ID NO. 33228
tcgtctccttgtcgtctctgtttcttcccacgttcctctctctctctctctctctctctcgcggccacccctttcctgccggcgacgaccgccgccacgtctacgccgggccctttgccggcgacgagccccgaaaagatcgactcttttatgagtccacaaggcacccaggatgaagtttttagaatacacccccttcgacagcataaatctgttcctcgaccaactcaacctcggcgattgtgcaatcagaggaaaccttgaagccttctcatgcaagcacactgcgacagaccgccggctttcaattagcctagaacatgagattcttgattacttaggaaagtcctctgacagtgacccttcttcaccagtggagcacctatcctccagatcaagccggaagacattgatatatctagttcttactcttgggcacatgtatccagattatgatttcagtgctgttcgggcacacttgttcttccaagaagaggagatggaaagtttcaagcagatgatagacacctacttatctgatgcttctaggcaatgggcagcaacaaatgagggcagttctcttctggacagtatgactaaagctattgatgaggttatcaaaatcagagagtgtgacatctacagctataacccagactctgatggagatccagttcaagagaaaggggccatatggtcattctactactttctctacaataggaagctaaagcgag

SEQ ID NO: 33228 - protein, 188 aa, Panicum virgatum
  misc_feature: Ceres CLONE 1949644
  misc_feature (25)..(188): Pfam Name: Maf1 Pfam Description: Maf1 regulator
MKFLEYTPFDSINLFLDQLNLGDCAIRGNLEAFSCKHTATDRRLSISLEHEILDYLGKSSDSDPSSPVEHLSSRSSRKTLIYLVLTLGHMYPDYDFSAVRAHLFFQEEEMESFKQMIDTYLSDASRQWAATNEGSSLLDSMTKAIDEVIKIRECDIYSYNPDSDGDPVQEKGAIWSFYYFLYNRKLKR

SEQ ID NO: 33229 - DNA, 322 bp, Panicum virgatum
  misc_feature: Ceres CLONE 1949644-R
cctttataaccaggaacataggccggccggcgttttgttcagacccggttgggtgtggttaatatatagcgtatatgccctattcccgttaggaagcttttaatataacttcccttttatcgtagcctgcggaagctatggctcttgttagcgttgtatatgcggattggagatttggtagcggcaaacttttaatccctgaggtttgaactgtcacgctatgttcgtactttagtgcttgctggaactgaatcctatgtcctgcttagttaaagaataaaatatttcagacaattgtgtaatcaaatttgctctactgttc

SEQ ID NO: 33230 - DNA, 1097 bp, Panicum virgatum
  misc_feature: Ceres CLONE 1949660
  misc_feature: Encodes the peptide sequence at SEQ ID NO. 33231
tctctctctctctctctcgtgtgccgcccccttccagttgtattcctttttcctttctggagcagttccctttctggagctgctccgggcgtgctctcacttcttcattttcctctcggccacccttggaattggaagacgacctcacgcggggcttcgaatattccttgtcttctcggctcggttaggcaccaacaccgcccttcggctccagtacgcgtcctcctctcctcccatctcaagaaatcgccgttgcagcaagtgaagctggaggaagcggaggggctcgcgatggggtccgagggaccgtcggctccggtcgtcgttcccagaaacttcaggctgctagaagaactagaacgtggtgagaagggcattggtgatgggacagtgagctacgggatggatgatgctgatgacatttatatgcggtcctggacaggaactatcattggccctcccaatactgttcacgagggacgaatctatcaattaaagcttttctgtgatacagattatccagataaaccaccaactgttcgatttcagactcgaatcaatatgacatgtgtgaacaaagaaactggattggttgaaccaagtctatttcctatgcttggaaactggcaaagggaacatacaatggaggacatcctaaccagcttaaaaagggagatgtcgactcctcagaatcgcaggctgcaccagcctcaagaaggtaatgaagaccaaagagtagagcagaaagggctgcctcatagatgtgtcatcatgtaacagatgtgcattgcaatgtacagcttgagttgagtagcatgactgcatgggatgcagaagtgaggaaccttctcaggaaatcgtgtaatttgtccaaactgcgcaagagttgcaataaagtatcgaggactctgttgatttgcctgcgcaccatgtaacatgttaccccattcaggttcagtgaaggacaatgagcttcacatcgctcattctgcctgtttgtaaacactctgtagtatgtaccgtcgggttatctgtctaggcctgttgttttatacaggaacagcgtattgataaatatcacagcctgattggttgtc

SEQ ID NO: 33231 - protein, 161 aa, Panicum virgatum
  misc_feature: Ceres CLONE 1949660
  misc_feature (17)..(159): Pfam Name: UQ_con Pfam Description: Ubiquitin-conjugating enzyme
  misc_feature: SWISSPROT Homolog: EC 6.3.2.19 Ubiquitin--protein ligase
MGSEGPSAPVVVPRNFRLLEELERGEKGIGDGTVSYGMDDADDIYMRSWTGTIIGPPNTVHEGRIYQLKLFCDTDYPDKPPTVRFQTRINMTCVNKETGLVEPSLFPMLGNWQREHTMEDILTSLKREMSTPQNRRLHQPQEGNEDQRVEQKGLPHRCVIM

SEQ ID NO: 33232 - DNA, 582 bp, Panicum virgatum
  misc_feature: Ceres CLONE 1949707-R
  misc_feature: Encodes the peptide sequence at SEQ ID NO. 33233
gacaataggattggtggcggtaatatatttccacattgcttgatactacattcttttgcttactttcatggtcaattatatccttacataatcattgcagaagctaatagcactgcacagaattttgttgacttcacagaagcagaggaagatcttgtttccagaatgcacaggcttgtggggaacagatgggagcttatagcaggaagaattccaggaaggacagcagaagaagtagagatgttttggtccaaaaaacaccaggaaaaatgaaaacggggccattactttatattgatctataaactatgtattaatatcacttgaaaatgtgcttataaataatgttaaccatgcaaagatgaaaaaagccatatagtattatgagctcactcgaggagcgatgtggattggcacttccaagttaagttagcagtgttatctgtgttcattttgtaattgcatcttgttataacatgatgtcaattttacaatagcaaagtattaaaaaacaccagaaaatgcgcattatgtgtacagtataatatgctacagataaagagatgagtacagctggctctt

SEQ ID NO: 33233 - protein, 90 aa, Panicum virgatum
  misc_feature: Ceres CLONE 1949707-R
  misc_feature (42)..(87): Pfam Name: Myb_DNA-binding Pfam Description: Myb-like DNA-binding domain
  misc_feature: The sequence is a functional homolog of SEQ ID NO 1090 in the 10/374,780 US patent application
  misc_feature: The sequence is a functional homolog of SEQ ID NO 1089 in the 10/374,780 US patent application
  misc_feature: The sequence is a functional homolog of SEQ ID NO 2147 in the 10/666,642 US patent application
  misc_feature: The sequence is a functional homolog of SEQ ID NO 2157 in the 10/666,642 US patent application
  misc_feature: The sequence is a functional homolog of SEQ ID NO 360 in the 11/435,388 US patent application
  misc_feature: The sequence is a functional homolog of SEQ ID NO 362 in the 10/714,887 US patent application
  misc_feature: The sequence is a functional homolog of SEQ ID NO 370 in the 11/435,388 US patent application
  misc_feature: The sequence is a functional homolog of SEQ ID NO 372 in the 10/714,887 US patent application
  misc_feature: The sequence is a functional homolog of SEQ ID NO 1071 in the 11/479,226 US patent application
  misc_feature: The sequence is a functional homolog of SEQ ID NO 1408 in the 10/666,642 US patent application
  misc_feature: The sequence is a functional homolog of SEQ ID NO 148 in the 10/374,780 US patent application
  misc_feature: The sequence is a functional homolog of SEQ ID NO 1808 in the 10/412,699 US patent application
  misc_feature: The sequence is a functional homolog of SEQ ID NO 234 in the 10/714,887 US patent application
  misc_feature: The sequence is a functional homolog of SEQ ID NO 234 in the 11/435,388 US patent application
  misc_feature: The sequence is a functional homolog of SEQ ID NO 286 in the 10/714,887 US patent application
  misc_feature: The sequence is a functional homolog of SEQ ID NO 42 in the 10/225,068 US patent application
  misc_feature: The sequence is a functional homolog of SEQ ID NO 468 in the 10/412,699 US patent application
  misc_feature: The sequence is a functional homolog of SEQ ID NO 758 in the 10/225,066 US patent application
  misc_feature: The sequence is a functional homolog of SEQ ID NO 1085 in the 10/374,780 US patent application
  misc_feature: The sequence is a functional homolog of SEQ ID NO 1086 in the 10/374,780 US patent application
  misc_feature: The sequence is a functional homolog of SEQ ID NO 2161 in the 10/666,642 US patent application
  misc_feature: The sequence is a functional homolog of SEQ ID NO 2163 in the 10/666,642 US patent application
  misc_feature: The sequence is a functional homolog of SEQ ID NO 374 in the 11/435,388 US patent application
  misc_feature: The sequence is a functional homolog of SEQ ID NO 376 in the 10/714,887 US patent application
  misc_feature: The sequence is a functional homolog of SEQ ID NO 376 in the 11/435,388 US patent application
  misc_feature: The sequence is a functional homolog of SEQ ID NO 378 in the 10/714,887 US patent application
DNRIGGGNIFPHCLILHSFAYFHGQLYPYIIIAEANSTAQNFVDFTEAEEDLVSRMHRLVGNRWELIAGRIPGRTAEEVEMFWSKKHQEK

SEQ ID NO: 33234 - DNA, 692 bp, Panicum virgatum
  misc_feature: Ceres CLONE 1949707
gtttatcctggccaaggattcacagatacagaggccattataggggttgaagccagctcaaaatagcctcaccgttccaggtgacaactggctcctctaatggatagcagcagaagcagcagccgggacaagaagtccaaagataacgatcgtcatgaagcaaaaggttcaccattgttgcttccctcacctggttttgctttacctttgctctctgcctcttctaaagtctgaattgcattttattgctgtcattatgtttaacaaaatggcttacatgatttaggcctcgtttagatacttaaacttttgtgtgtaaagtactatagcactttcgtttgtatttgataattattatcccgtcataggttaattaggctcaaaaaatttgtctcgcaaattatagacaaactgtgtaattagttattttgtttagctacatttaatactttctgcatgcgttgaaacattcgatgtgatgagaaatcttgtaaagttttggaattttgaaagcaactaaacatggccttagctattttaggagatctttcaccaagatatcctaaagcttcatgctttatttccacgtaaaagaaaaaaacagaaattagaaggtgcacagtaaccactataactgcaaaaatttgagatgacaaacaaaagaataggctattttactatcagaccaacct

SEQ ID NO: 33235 - DNA, 977 bp, Panicum virgatum
  misc_feature: Ceres CLONE 1949720
  misc_feature: Encodes the peptide sequence at SEQ ID NO. 33236
aatctctcatctcgtctcctgccgttcgcagtcagagcgcgccgccccctctcgcgtgcctcggcgatccctccaccccgcttccaagctgcagatctttgttaagaccttgactgggaagaccatcaccctcgaggtggagtcttctgacaccattgacaatgtcaaggccaagatccaggacaaggagggcatccccccggaccagcagcgtctcatcttcgctggaaaacagctcgaggacgggcgcacgcttgctgactacaacatccagaaggagagcaccctccacctggtgctccgcctaaggggaggcatgcagatcttcgtgaagaccttgactggcaagactatcacccttgaggtggagtcttccgacaccattgacaatgtcaaggcaaagatccaggacaaggaaggcatccccccggaccagcagaggctcatcttcgccggcaagcagctcgaggacgggcgcacacttgctgactacaacatccagaaggagagcaccctccacctggtgctccgcctgagaggaggcatgcagatcttcgtgaagaccttgactgggaagacaatcactctggaggttgagagctccgacaccatcgacaacgtcaaggccaagatccaggacaaggagggcatccccccggaccagcagcgtctswtytttgcsggcaagcagctsgaggatggccgcacccttgctgactacaatatccagaaggagtccaccctccacctggtgcttcgtctccgtggtggccagtaagccatcggttggttgttgaagctgctgctgttcctggaagcaggtcgctgctgtgaagggtgtcgtctttgaagtgtctgtggtgtttgtgtcgaaattgtatctggtttcatgaactggattgggtctgtgtttacccaaaacagttgcactgcagcagtatggggcatatgcatgaataagttatgtttgaacttag

SEQ ID NO: 33236 - protein, 258 aa, Panicum virgatum
  misc_feature: Ceres CLONE 1949720
  misc_feature (35)..(103): Pfam Name: ubiquitin Pfam Description: Ubiquitin family
  misc_feature (111)..(179): Pfam Name: ubiquitin Pfam Description: Ubiquitin family
  misc_feature (187)..(255): Pfam Name: ubiquitin Pfam Description: Ubiquitin family
  misc_feature: Useful for making plants with modulated nitrogen use efficiency
  misc_feature: Useful for making plants with modulated cold sensitivity
  misc_feature: Useful for making plants with modulated flowering time
  misc_feature (225)..(225): Xaa is any aa, unknown, or other
ISHLVSCRSQSERAAPSRVPRRSLHPASKLQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLXFAGKQLEDGRTLADYNIQKESTLHLVLRLRGGQ

SEQ ID NO: 33237 - DNA, 988 bp, Panicum virgatum
  misc_feature: Ceres CLONE 1949725
  misc_feature: Encodes the peptide sequence at SEQ ID NO. 33238
acgcaaagccaaacgagccgacaaggaagccgaatatctccaccggcctcggcctgcctcctcttccgcacgtagcaggttggtggtgataaggaaagcggaaaacgcacaccatgggatccaaagaacctctctttctcttgctcctctcgctgcttgtcgtctcggtgcttgcacaagccagggatgctgataacggcccagtctacaaggaacaaatctcttcaaccaagattcctgtccatcgcaagagtagtagcccaatatgctcagcctgcggaaacttcacgactcaagctctcagttatctcagtgagaagcaaacacaagataagatcagggaattccttcatgatgcttgttgtcagtcattctccttggaacggaagtgtgtagagttgatggactcttatgcaactatactgttttccaagattacggatatcaatccaaaagagttttgcaaacagtatggcctgtgcagggacatagcccttttctctggtgtgacaagtgacagcacttgtgtgttttgccatcacctgcttgatgaaattgtgtccaaactgaaagatccagacgcagagtttgagatcattcaaattctcattaaggagtgcaataagattgaaggtcatgcccagcagtgcaagagactggtcctgcaatacattcctctcatcctggtgaatggtgagaagtttctcgagaagaacgatgtgtgcgcgcttttacaagcgtgtccggccagcaaagtcttggaaggggtgttgctcagtgatgcttgaaggttgaaagaacgcgcgaagtatgtagcaatggtgcaaatagtgtgtacaaactagggcgagttgtacataataaggtcatgaatggatgaaggatgggtgtctcgtgtttctgcattcttttcatcttgtatcgtgaacacattgtattaagtaaactttcatatacatccagaaagtgcagatcgtgcagcattagt

SEQ ID NO: 33238 - protein, 224 aa, Panicum virgatum
  misc_feature: Ceres CLONE 1949725
  misc_feature (49)..(88): Pfam Name: SapB_1 Pfam Description: Saposin-like type B, region 1
  misc_feature (135)..(173): Pfam Name: SapB_1 Pfam Description: Saposin-like type B, region 1
  misc_feature (176)..(210): Pfam Name: SapB_2 Pfam Description: Saposin-like type B, region 2
MGSKEPLFLLLLSLLVVSVLAQARDADNGPVYKEQISSTKIPVHRKSSSPICSACGNFTTQALSYLSEKQTQDKIREFLHDACCQSFSLERKCVELMDSYATILFSKITDINPKEFCKQYGLCRDIALFSGVTSDSTCVFCHHLLDEIVSKLKDPDAEFEIIQILIKECNKIEGHAQQCKRLVLQYIPLILVNGEKFLEKNDVCALLQACPASKVLEGVLLSDA

SEQ ID NO: 33239 - DNA, 735 bp, Panicum virgatum
  misc_feature: Ceres CLONE 1949738
  misc_feature: Encodes the peptide sequence at SEQ ID NO. 33240
agggcgcacctttgccaggtcctttcctagcctcagggcggggctcatctcctcccttgtttcttaaaccatttcccttctctcggaatctctcctcccttgcgcttccttccctggcgacgacgactgggcgagcggcggcgcccagccctttgccggcgaggagcatccaccaggaaccccaataagtttactgcttccatcaagtgaggacctgcctgtctccgagaacttaattgctcctgatcttccgtggcacaagcatcatccgaaaaaatgccatcagtttatctttacatccctaatattattgggtatttcaggatcatcataaatttcaaagcttttgctatttgctattccaacaaggccctctttgctatcctttacttcatcagttttgtccttgatggcgtggatggttggtttgctcggaagtttaatcaagcatcaacatttggagctgtgttggacatggttacagatagggttagcactgcttgcttgttggcccttctctcccaattttacaggcctggcttagtcttcttgatactgcttgggttggatatcacaagccactggtttcaaatgtacagttctttcttgtcaggtaagactagccacaaagatgtaaagcacacaggcaattggcttctgaaattatattacgggcacaggccgttcatggccttctggtgtgtttcttgcgaggttttgtatattatcctcttc

SEQ ID NO: 33240 - protein, 152 aa, Panicum virgatum
  misc_feature: Ceres CLONE 1949738
  misc_feature (35)..(152): Pfam Name: CDP-OH_P_transf Pfam Description: CDP-alcohol phosphatidyltransferase
  misc_feature: SWISSPROT Homolog: EC 2.7.8.11 CDP-diacylglycerol--inositol 3-phosphatidyltransferase
  misc_feature: Useful for biocontainment applications
MPSVYLYIPNIIGYFRIIINFKAFAICYSNKALFAILYFISFVLDGVDGWFARKFNQASTFGAVLDMVTDRVSTACLLALLSQFYRPGLVFLILLGLDITSHWFQMYSSFLSGKTSHKDVKHTGNWLLKLYYGHRPFMAFWCVSCEVLYIIL

SEQ ID NO: 33241 - DNA, 553 bp, Panicum virgatum
  misc_feature: Ceres CLONE 1949738-R
gttttgttcagtttgtattgatattatccaaggaaaattcccgtgaggcttgtacaccatgattcatacatacagtggctacttcttgtgtgccttgacatctttctgactatgcttatctgttgggaagagacggcaacttgctgtgggaagaacataaagaaaacagaggagacaaacgatttacggagaaagtataggctgttaagttgtttgtcagtgtttgttcactatatagttggatgcagagcatgaccttttgttagctggagtggccttttgagtcgatctgaacgatgtttacaagctgcatttttcagagtccaagaatatatgaagtttttgaattgcaaaatttattcttccctgagagggttaaatagttgcctttagcgtgcactatcaaataggcatctgacttttttgttatcttaccttgtattccttacaattatctgatttttctggttatcttgccttgtgtgccttacaattatctatcggataatttgtttttttatgtgatcttgaatcttaagttcattctaaaggc

SEQ ID NO: 33242 - DNA, 1344 bp, Panicum virgatum
  misc_feature: Ceres CLONE 1949744
  misc_feature: Encodes the peptide sequence at SEQ ID NO. 33243
cgtgctattcgacgtgctcgtgttgggctgaagaatccaaaccgtcctattgctagcttcatattctctggacctactggagttggcaaatcagaattagcaaaggcgctggcagcctactactttggctcagaggaggctatgatcaggcttgacatgagtgagttcatggagagacatactgtctccaaactcattggatcacctccaggttatgttggctacactgagggaggtcaattgactgaagcagttcgtcgccgtccatacactgttgttctctttgatgagattgaaaaggcacatccagatgttttcaacatgatgcttcagatcttagaagatgggaggctaactgacagcaaggggcgcacagttgactttaagaacacactattgatcatgacatcgaatgttgggagcagtgtaattgagaagggaggccgcaagatcgggttcgaccttgactatgatgagaaagacactagctacaacaggatcaagagcctggtgaccgaggagttgaagcagtatttccgtccagaattcctaaacagattggatgagatgattgtgttccggcagctgacgaagttagaggtgaaggagattgcggacattatgctgaaagaagtgtttgacaggctgaaggctaaggacattgacctccaggttacagagaagttccgtgatagagttgttgacaaaggttacaacccaagttatggtgcccggcctttgcggcgcgctatcatgaggcttctggaggatagtctggctgagaagatgcttgctggtgaggtgaaagaaggtgactctgccattgtcgatgtggattctgatggcaaggttatagtcctgagtggcggtaatggtgttgctgagcccctggaacctgctctcagtacctactgaggtcgaaaactctttggtccgaaatatggccttctttacaagacagttgggttcctcatgatggcaaaactagattgacatcgctcgcccgcccactgcagactcttcagctttccttggtatttaaattccattggaagtgaggcagtaggaatgctatggaaaggaatcggcagagacgcagcgagaacactgtatgcttagaccttgagttgcgttgtttttgaaaaaaaaacttgggacttttcagtttcctgcaattacatgtatcattacttcattagggctctgcaagcatgatgacatggttatcgcttgcactgttgtacttattctcccagttgtgtatgaatgtaacttattcaagtcacagataacattggtagataatgatatgctgttatggcgcctgagaactcaggttgtttc

SEQ ID NO: 33243 - protein, 304 aa, Panicum virgatum
  misc_feature: Ceres CLONE 1949744
  misc_feature (15)..(190): Pfam Name: AAA_2 Pfam Description: ATPase family associated with various cellular activities (AAA)
RAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRKIGFDLDYDEKDTSYNRIKSLVTEELKQYFRPEFLNRLDEMIVFRQLTKLEVKEIADIMLKEVFDRLKAKDIDLQVTEKFRDRVVDKGYNPSYGARPLRRAIMRLLEDSLAEKMLAGEVKEGDSAIVDVDSDGKVIVLSGGNGVAEPLEPALSTY

SEQ ID NO: 33244 - DNA, 793 bp, Panicum virgatum
  misc_feature: Ceres CLONE 1949746
  misc_feature: Encodes the peptide sequence at SEQ ID NO. 33245
aagactgctctccccttcggcccttccccttccccttcccctggtccgtctccgcccagatccagatccagatccagggttcaatcaccacaccaggataagcaaccgagacaatggcggcagactctggagctcgtaggcagccaaccttcaccaaggttgaccagctgcgcccggggacccacggccacaacctcatcgtcaaggtagttgactccaagatggttgtccagaggggccgcgagggagggcagcagggcaggcagatgaggatcgccgagtgcttggtcggcgatgaaaccggcatcatcgtcttcaccgcaagaaacgaccaagtggatgtaatgaagcttggaacaactgttgaactgaggaatgcaaagattgacatgttcaagggttcgatgcggctcgcggtggacaagtggggaattgtgaaagctgctgaaagcccagttgagtttgcagtcaaggaggacaacaacctgtccttgattgagtttgagctggtgaccgtggtggagtgaagaccaccttttgtaggagggtggtgcgttatgttatgttgttgaacctatttggcaccaccaaagaaaataaaccagtcatggtttgatgttatcgtatgcatccgaggttggttatggttagtgatcgtcggcaatggacggcatctctctgagattgtagtggggtagcccatcctcattggacctgtcataatgcgttgagctgcctattgctgtaccatgacttggcgttgagctgcatattgccgtatcatgagttgccg

SEQ ID NO: 33245 - protein, 137 aa, Panicum virgatum
  misc_feature: Ceres CLONE 1949746
  misc_feature: Useful for making plants with modulated drought sensitivity
  misc_feature: Useful for making plants with modulated water use efficiency
MAADSGARRQPTFTKVDQLRPGTHGHNLIVKVVDSKMVVQRGREGGQQGRQMRIAECLVGDETGIIVFTARNDQVDVMKLGTTVELRNAKIDMFKGSMRLAVDKWGIVKAAESPVEFAVKEDNNLSLIEFELVTVVE

SEQ ID NO: 33246 - DNA, 1200 bp, Panicum virgatum
  misc_feature: Ceres CLONE 1949756
  misc_feature: Encodes the peptide sequence at SEQ ID NO. 33247
acatctctcgacctaccggccgcggcagccaaaccctagcctcgacccgcccttccggccaccgcgtcttcagcggggaaggatgagcaggcgctggagccgcacgatctacgtcgggaacctcccgggcgacatccgggagagggaggtggaggatctcttctacaagtatgggagaattgttgacattgacttgaaggtccccccgaggccacctggttatgcttttgttgagtttgaagatcctcgtgatgctgaagatgcaattgctgggcgtgatggatacaattttgatggacaccgcctaagagtggagcccgctcatggtggtagaagtaatgcttcctcatatgaccgttcaggtggctttggtggtggagcccgacgtggtgtgtcaaggcgctcagagtatcgtgttcttgtcactggactgccttcttctgcatcatggcaggatttgaaggatcatatgcggaaggctggtgatgtttgtttctctgaagtgtaccgtgaaggcggtggcaccattggaattgtggactacacaaactatgatgacatgaaatatgctataaagaagctggatgatactgaattcaggaatgcctttgggcgagcttatataagggtgaaggaatatgatggcaagcgtcgacgctcctactcacgtagccgaagcccaagtcgtagctacagcagaagcaggagcccgagcaaatcgccccgggctcgccgctcagcatctagatcccgttcaaggtctgtttcttcccgttcaaggtctgcatcaaaagggcgttctccgtcaagatcaccagcaagatctaaatctcctaatgcttctccagcaaatggtgaagcagcaagccccaagaagcagagcccaagcagaagcccatctggctcacgctctcctgatgccaaacctgaataaaactggtgccaccgatgaggcattgcagatgggagtccagagctcgtctttgtctggtcacgtgatgtcctccatattgttctagtaccatcgctgtcctagcaactgcgcaatgagattggatattaactatcagtttgtatcgttggacccccgactttgttatgttttctggcccgctgaagggctcatttttacttcaactttttgagattgttgaatgctatgtggctctggattatgttcactgaatcatgttgttccgg

SEQ ID NO: 33247 - protein, 283 aa, Panicum virgatum
  misc_feature: Ceres CLONE 1949756
  misc_feature (9)..(77): Pfam Name: RRM_1 Pfam Description: RNA recognition motif. (a.k.a. RRM, RBD, or RNP domain)
  misc_feature (112)..(179): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with altered alkaloid content
  misc_feature: Useful for making plants with altered lignin content
MSRRWSRTIYVGNLPGDIREREVEDLFYKYGRIVDIDLKVPPRPPGYAFVEFEDPRDAEDAIAGRDGYNFDGHRLRVEPAHGGRSNASSYDRSGGFGGGARRGVSRRSEYRVLVTGLPSSASWQDLKDHMRKAGDVCFSEVYREGGGTIGIVDYTNYDDMKYAIKKLDDTEFRNAFGRAYIRVKEYDGKRRRSYSRSRSPSRSYSRSRSPSKSPRARRSASRSRSRSVSSRSRSASKGRSPSRSPARSKSPNASPANGEAASPKKQSPSRSPSGSRSPDAKPE

SEQ ID NO: 33248 - DNA, 655 bp, Panicum virgatum
  misc_feature: Ceres CLONE 1949763
  misc_feature: Encodes the peptide sequence at SEQ ID NO. 33249
gttcgctaaaaggatttcctagtgattccaaagaagcttcaaagctgaatctcgtgtgccgcaagaacctggtaattgataagagcattcacactgcatatgtccgggcaatcagatctgcacagcatttcatttatatcgagaatcaatactttcttggttcttcatatgcttggccatcctatgtgaattcaggtgctgacaatctgataccaatagaattagccctcaaaattgcaagtaagattagagcaggagaacgctttgcagtgtacgtagtgataccaatgtggcctgaaggagtccctactgcagcatctgtgcaagaaatccttttcttccaggcccggacaatggagatgatgtataaaataattgcagatgaacttaaggcaatggacattaaggatttgcaccctcaagattacttgaacttcttttgtcttggaaatcgggaagaaccaacatcaaatggcattctggagtcagagaaatcttcagataaaagtgcagcggccttagctacaaaatatcggcggttcatgatctatgttcatgcaaaagggatgattgtggatgatgaatacgtcattctgggttcggcaaacatcaaccagagatccctggcaggttctagagatactgaaattgcaat

SEQ ID NO: 33249 - protein, 217 aa, Panicum virgatum
  misc_feature: Ceres CLONE 1949763
  misc_feature (180)..(207): Pfam Name: PLDc Pfam Description: Phospholipase D Active site motif
  misc_feature: SWISSPROT Homolog: EC 3.1.4.4 Phospholipase D
SLKGFPSDSKEASKLNLVCRKNLVIDKSIHTAYVRAIRSAQHFIYIENQYFLGSSYAWPSYVNSGADNLIPIELALKIASKIRAGERFAVYVVIPMWPEGVPTAASVQEILFFQARTMEMMYKIIADELKAMDIKDLHPQDYLNFFCLGNREEPTSNGILESEKSSDKSAAALATKYRRFMIYVHAKGMIVDDEYVILGSANINQRSLAGSRDTEIA

SEQ ID NO: 33250 - DNA, 214 bp, Panicum virgatum
  misc_feature: Ceres CLONE 1949763-R
tacctgtgaactttgtgactgtctaaacttggcgggattgtcgcaaaatttgtatcatacctgtaatcatccatagttggcgcagggaaagcccaagttgttaatggtgtttgtagagttgttcctctgcgagttctcccagcgtctgtaaatgaaccctaataggatccttgacggtgattccacttccattacgattgtaccacccgtttcg

SEQ ID NO: 33251 - DNA, 1147 bp, Panicum virgatum
  misc_feature: Ceres CLONE 1949771
  misc_feature: Encodes the peptide sequence at SEQ ID NO. 33252
aggtagctgtccctctatccatcccctttacttcgtctcccaactcaaccattctccctgtgtcatcaccagcaacaggaagatgggctcgttagatgccacacgagcggaactcggcctcgttgttctgtacctgaacaaagccgaggctagggacaagatctgcagggcgattcagtatggctcaaagttcataagcaacgggcagcccggcaccgcgcaggatgtcgatagatcgaccaccttggctcgaaaagttttccgtctcctcaagtgggtcaatgatcttcatgctcttatcagcccgcctgctaaagggactcctctcacacttgtccttcttggcaagtccaaaaacgcgctgctttcgacgttcttattcctggatcaatttgtgtggttaggacgaacaggaataatcaagaacaaggaggcgacggaccgggttgccaggatatccctctactgttggatggcttcttctgcctgcgctagtctagtggagcttggagagcttaagaggctatcgaaatcgatgaggaagcttgcaagagagctgaggcacactgataaatacgagaacgaacagtaccagaacaaaatgaagcagtcggatgagcggctcctggccctggtgaaggcggccatggacgtggtcgtggccatcgggcttcttcagctggcacccaagaaggtcacccccagagtgacgggagctctcggattcgtcacctcgctcatctcctgctatcagcaactcccttcccgtggccccgtggccaaagtcaaggcgtgagatgggtccgggtcctccctactatggaagtagccgtcgctggaaattgaggtagctatacttgagcatgcatggaccacgtggctcctacatctgcgctggctttcttcaaataaaaaacatctgcgctggccatggctgctccgatccgagcaggggttttgattcatttcatgcagaataacggagctcacatgtaccagggcgttgtacgttgtcaaatcatcgatcaaacatggcgtctgatatctgaagtagtacatgcgagagccaacattcgcaaaaggaaaaaaattgctactattttacagctccatatataaatctaacacgaacacctgcacagctctg

SEQ ID NO: 33252 - protein, 237 aa, Panicum virgatum
  misc_feature: Ceres CLONE 1949771
  misc_feature (11)..(226): Pfam Name: PEX11 Pfam Description: Peroxisomal biogenesis factor 11 (PEX11)
MGSLDATRAELGLVVLYLNKAEARDKICRAIQYGSKFISNGQPGTAQDVDRSTTLARKVFRLLKWVNDLHALISPPAKGTPLTLVLLGKSKNALLSTFLFLDQFVWLGRTGIIKNKEATDRVARISLYCWMASSACASLVELGELKRLSKSMRKLARELRHTDKYENEQYQNKMKQSDERLLALVKAAMDVVVAIGLLQLAPKKVTPRVTGALGFVTSLISCYQQLPSRGPVAKVKA

SEQ ID NO: 33253 - DNA, 1295 bp, Panicum virgatum
  misc_feature: Ceres CLONE 1949792
  misc_feature: Encodes the peptide sequence at SEQ ID NO. 33254
tgaagttaggcaactgaaggttatggccaatgcggatactcctgaggatgcactggcagcaagaaacaatggggcgcaaggaattggactatgccggacagagcacatgttcttcgcttcggatgagaggatcaaggctgtgaggcagatgattatggctcctacacttgaactgaggcagaatgcactagatcgtctcttgccttatcagaggtctgattttgaaggcattttccgtgctatggatgggcttccggtgacaattcggctactggaccccccacttcatgagtttcttcctgaagggaatgttgaggacattgtgagtgaattatgcgctgaaactggagccgatcaggaggaagcccttgcaagaatagaaaaactatcagaagtaaatccaatgcttggtttccgtgggtgcaggcttggtatatcgtatcctgaattaacagaaatgcaagctcgtgccatctttgaagctgctatagcgatgaccaaccaaggtgttcaagtttttccagagataatggttcctcttgttggaacacctcaggaactggggaatcaagtggcccttatccgtcaaactgctaacaatgttttcactgctatgggtaaaaccattgagtacaaaattggaactatgattgaaattcccagggcagctctagtggctgatgagatagcagagcaggctgaattcttctcttttgggacgaacgaccttacacagatgacgtttggctacggcagggatgatgtggggaagtttctccccatttatctttctcagggtatcctccaacatgatccctttgaggtgcttgatcagagaggagtgggcgagctggttaagtttgctacagagaggggacgcaaaactaggcctaacctgaaggtgggcatctgtggagaacatggtggggagcctcagtcagttgctttcttcgcaaaggctgggctggattatgtttcttgctcccctttcagggttccgattgctaggctggctgcagctcaggtgctcatctgagagcacctcctcatcggcaaccggatcgccagctcttggtgcatctggtgaagaataatcatacaggtccatgaagcggtggaaactctgctttctggcaaaggctgttgtatgtagtcttctctgtgtgcgcgcgcatgtaagccttaatgggtggtgttctgaatttcccttgaactggcatggtaatgtagtaccaaattaaacagcgatgatgacgaagagctatcgaatatattggcgattactagtgctgtcg

SEQ ID NO: 33254 - protein, 344 aa, Panicum virgatum
  misc_feature: Ceres CLONE 1949792
  misc_feature (1)..(344): Pfam Name: PEP-utilizers_C Pfam Description: PEP-utilising enzyme, TIM barrel domain
  misc_feature: SWISSPROT Homolog: EC 2.7.9.1 Pyruvate, phosphate dikinase
EVRQLKVMANADTPEDALAARNNGAQGIGLCRTEHMFFASDERIKAVRQMIMAPTLELRQNALDRLLPYQRSDFEGIFRAMDGLPVTIRLLDPPLHEFLPEGNVEDIVSELCAETGADQEEALARIEKLSEVNPMLGFRGCRLGISYPELTEMQARAIFEAAIAMTNQGVQVFPEIMVPLVGTPQELGNQVALIRQTANNVFTAMGKTIEYKIGTMIEIPRAALVADEIAEQAEFFSFGTNDLTQMTFGYGRDDVGKFLPIYLSQGILQHDPFEVLDQRGVGELVKFATERGRKTRPNLKVGICGEHGGEPQSVAFFAKAGLDYVSCSPFRVPIARLAAAQVLI

SEQ ID NO: 33255 - DNA, 919 bp, Panicum virgatum
  misc_feature: Ceres CLONE 1949794
  misc_feature: Encodes the peptide sequence at SEQ ID NO. 33256
gctttcgccaccgaggagggagggcgaccctccgatcggctccgccatggctggaactgctgttctcaacgagcgcatcctttcttccatgtcccagaaacatgttgctgctcatccatggcatgatttggagataggaccaggggctcctgaagtttttaactgtgtggttgagattcctagaggcagcaaggtgaagtatgagttggacaaggcatctggtctgatcaaggttgatcgtgtcctttactcctctgttgtttacccacacaactacggtttcattccacgcacactctgtgaggatagcgaccccatggacgtcctcatcctgatgcaggaacaagttgtccctgggtgttacctgcgagctcgtgctattgggctcatgcctatgattgatcagggagagaaagatgataagatcatagcagtctgcgctgatgaccctgaataccgtcactacacggacatcaaggaccttcctccacatcgccttcaagagattcgctgcttctttgaagattacaagaagaatgaaaacaaagaggttgcggtgaatgagttcctcccagcaaaagatgccatcgacgcaatcagatactctatggacctgtatggctcgtacatcatcgaaggactgaggaagtaacaagattgcagatgcttcatgatttactcagcagctcgagagtactgtagcacgacatatgttaacatgcacgaactgaaatcatgacaaaggaatattaccttgtgttcatgttgagactagcagcagtgccttttgtttccattatatatgccgtgtcaagtccaagcacttggctttgctgaaatcagtcgtcagaccaacatttgacagaacgattaccaaatagaatatcactgattacataaacgccatttgcttatcttc

SEQ ID NO: 33256 - protein, 201 aa, Panicum virgatum
  misc_feature: Ceres CLONE 1949794
  misc_feature (39)..(193): Pfam Name: Pyrophosphatase Pfam Description: Inorganic pyrophosphatase
  misc_feature: SWISSPROT Homolog: EC 3.6.1.1 Inorganic diphosphatase
  misc_feature: Useful for making plants with modulated nitrogen use efficiency
MAGTAVLNERILSSMSQKHVAAHPWHDLEIGPGAPEVFNCVVEIPRGSKVKYELDKASGLIKVDRVLYSSVVYPHNYGFIPRTLCEDSDPMDVLILMQEQVVPGCYLRARAIGLMPMIDQGEKDDKIIAVCADDPEYRHYTDIKDLPPHRLQEIRCFFEDYKKNENKEVAVNEFLPAKDAIDAIRYSMDLYGSYIIEGLRK

SEQ ID NO: 33257 - DNA, 923 bp, Panicum virgatum
  misc_feature: Ceres CLONE 1949795
  misc_feature: Encodes the peptide sequence at SEQ ID NO. 33258
acccatcgcgcgagtcagcagtcagcactagggtttttgccaagcagccgccgccgccgccgcctcactgccccccgcatcccatcctacccaccgagagaccaagatgacggcgcagaccgccgaggagctcgccgcccagatcgagcagcagaagctcgaggagcagaagaccgaggcagaggatgttgtggttgaggatgaggacgatgacgacgaggacgatgacgatgatgataaggatgatgaagatggacaagaaggcgatgccagtggcaaatcaaaacaaagcaggagtgagaagaagagccgcaaggccatgctgaaacttggcatgaagccgatcactggtgtcagccgtgtcactgtgaagaaaagcaagaatatactgtttgtcatctccaagccagatgtgttcaagagcccaaactcagacacctatgtcatcttcggtgaggccaagatcgaggacctcagctcccagctgcagacccaagctgcggaacagttcaaggctcctgacttgagccagatgatctccaagcctgagacatctggcctaggccaggaggacaatgaggaggaggttgatgagactggtgtcgagcccaaggacattgagttggtgatgacgcaggcatccgtctcgaggcccaaggctgtcaaggccctcaaggctgccgatggggacattgtcactgccattatggagctgaccacttagagcgttatttttggcatggtcgaaacattttccctctgtgagtgttctgcagcttgagcgttatttgtggactaatgcttcgataagttcttaatgtttgcttgcactttggtcaaggttgcaaaatggttctttgctagcttgtttacggctcatgctatctctggcaatgatatttcagccatgcctctgttttctt

SEQ ID NO: 33258 - protein, 205 aa, Panicum virgatum
  misc_feature: Ceres CLONE 1949795
  misc_feature (63)..(122): Pfam Name: NAC Pfam Description: NAC domain
  misc_feature (166)..(203): Pfam Name: UBA Pfam Description: UBA/TS-N domain
MTAQTAEELAAQIEQQKLEEQKTEAEDVVVEDEDDDDEDDDDDDKDDEDGQEGDASGKSKQSRSEKKSRKAMLKLGMKPITGVSRVTVKKSKNILFVISKPDVFKSPNSDTYVIFGEAKIEDLSSQLQTQAAEQFKAPDLSQMISKPETSGLGQEDNEEEVDETGVEPKDIELVMTQASVSRPKAVKALKAADGDIVTAIMELTT

SEQ ID NO: 33259 - DNA, 1011 bp, Panicum virgatum
  misc_feature: Ceres CLONE 1949832
  misc_feature: Encodes the peptide sequence at SEQ ID NO. 33260
gctggtggggtggccgatctagatcgcccccacagatctccgctcaccgccaccacttctctccctctctcgtggcgtcattccgggcgccgccgccctcttcgtcgggcccttcgccggcgacgagcatccaccaggatccaaagcgtgctacgacgtctcctacccatccgccatgattaatttcgtgctcctgatcagccgccagggcaaggtgaggctcaccaagtggtattcgccttacacccaaaaggagaggaccaaggtcattcgtgagctcagtggactcattattacgcgagggcccaaactctgcaactttgtcgagtggagaggttacaaggtcgtatacaggaggtatgccagtctgtatttctgcatgtgcattgatgctgatgacaatgagctcgaagtcctcgagatcatccatcatttcgttgagatactggaccgctattttggcagtgtatgtgaactggatttgatattcaattttcacaaggcctactacatactggatgagattcttatcgctggcgagcttcaagaatctagcaagaagaatgttgcaaggcttattgctgcacaggactcattagttgaggctgcgaaagaggaagccagctccataagtaacatcattgctcaagttacaaaataaaattctacaccactctaatgtgtgcccctttactctatcctgtcgttgttgtacaagtaaatgtaatgcactggactgttccgtgcatttgctctgttcatttttttctccaaaggaatacgtctctcaagactccagatcatttagaatgagcgtgatgtgtgactacattgtatgtgttcctttgcaagtaaaattggcatgttcctgactgctcacacatagttgtaaattcttattttactagcaaattactttctcttgatctcatagattgttcatgttgttttgcaatgtctgaaaacctgtgagagttgtgttggaggaaagaaacagtgcgagttatcagc

SEQ ID NO: 33260 - protein, 161 aa, Panicum virgatum
  misc_feature: Ceres CLONE 1949832
  misc_feature (1)..(142): Pfam Name: Clat_adaptor_s Pfam Description: Clathrin adaptor complex small chain
MINFVLLISRQGKVRLTKWYSPYTQKERTKVIRELSGLIITRGPKLCNFVEWRGYKVVYRRYASLYFCMCIDADDNELEVLEIIHHFVEILDRYFGSVCELDLIFNFHKAYYILDEILIAGELQESSKKNVARLIAAQDSLVEAAKEEASSISNIIAQVTK

SEQ ID NO: 33261 - DNA, 1132 bp, Panicum virgatum
  misc_feature: Ceres CLONE 1949838
  misc_feature: Encodes the peptide sequence at SEQ ID NO. 33262
atctcccctcctcctcctcctccttcctccaccaccaccgcccgggctggttgcagcaagcgagccttatcttcttcttcgtccgtccagaccgtcctggcactggctagtaggtgtcgcgagacagggagggtagcagcgagctgagactgagaggtttacggagggcggcgcggcggccatgaagatccagtgcggcgcgtgcgaggccgcggcggccacggtggtgtgctgcgccgacgaggcggcgctgtgcgcgcgctgcgacgtcgagatccacgccgccaacaagctcgccagcaagcaccagcgcctcccgctcgaggcgctctccgccaggctcccccgctgcgacgtctgccaggagaaggcggccttcatcttctgcgtggaggaccgggcgctcttctgccgggactgcgacgagcccatccacgtccccggcacgctctccggcaaccaccagcgctacctcgccaccggcatccgcgtcggcctcgcctccgcctccgcgtgcggcgacgccagcgacgcccacgactcggaccaccaccacgccccgcccaaggccaccgtcgagcccgccgtctccgccgcggcgcagcaggtgccctcaccgccgccgttcctgcctcagggctgggccgtcgacgacctcctccagttctccgactacgagtccggcgacaagctgcagaaggagtcgccgctcgggttcaaggagctcgagtggttcgccgacatcgacctcttccacgaccaggcgccgcccaaggccggcagggcgctggcggaggtcccggagcttttcggatcccaggcggcaagcggcgcggcgtactacaggccgagcaaagccggcgccggccttcgccagagcaagaaggcccggatcgaggtcaccgacgaggacgactacctcatcgtccctgaccttggctgaaaagaagagcgcgagagttttggttcttcgcctgttgtggtgttgtataccagaagaattctactgtgtacaagctaatgtcatgtgttgtgcatcttgactgtagtatggctcaactgtgaacattataattctggccactttgttgctatgctagcaacagagcctgtgtgatattttgatgatttc

SEQ ID NO: 33262 - protein, 253 aa, Panicum virgatum
  misc_feature: Ceres CLONE 1949838
  misc_feature (1)..(47): Pfam Name: zf-B_box Pfam Description: B-box zinc finger
  misc_feature (52)..(99): Pfam Name: zf-B_box Pfam Description: B-box zinc finger
  misc_feature: The sequence is a functional homolog of SEQ ID NO 465 in the 11/479,226 US patent application
MKIQCGACEAAAATVVCCADEAALCARCDVEIHAANKLASKHQRLPLEALSARLPRCDVCQEKAAFIFCVEDRALFCRDCDEPIHVPGTLSGNHQRYLATGIRVGLASASACGDASDAHDSDHHHAPPKATVEPAVSAAAQQVPSPPPFLPQGWAVDDLLQFSDYESGDKLQKESPLGFKELEWFADIDLFHDQAPPKAGRALAEVPELFGSQAASGAAYYRPSKAGAGLRQSKKARIEVTDEDDYLIVPDLG

SEQ ID NO: 33263 - DNA, 1187 bp, Panicum virgatum
  misc_feature: Ceres CLONE 1949839
  misc_feature: Encodes the peptide sequence at SEQ ID NO. 33264
gtagcctctctctctctctctgcacactccctcctgctctctctctctctacacagactgctgcacaaagccgccttcgtcttccactgctcgttcttgttcacacacacgcagcctcccggaaaagagaagcccgtctccctatttctccctcaggttggttcaggccatctacccattcggtggcttcagcagcagtgttcttcctgtcaacaagcaatctttctacagttttagctctgtagccatgatacaagcatgactggttcttgaacattacaaggctttggagagatgggatgtgctgcttccaggttagaagatgaggaggctgtcaagatgtgccgggacagaagggaattcatcaagcaggcactggagcagcgcaaccgatttgcatcatctcacattgcctacattgagtcacttaagcgcgtttcaatggctctccagcgttttgttgctggagatgatcaccatgaactcattttcgatacattcatctctcctgtcaagcaattggagccagagatgctcggcctaccttatggttcatatgagaagagaaccattcatgtctaaggtacttgaggtctggacctaacccatcagtgtcagttgaggagcatccacgaccggtggaaacagtccgtgtcgaatcacattatcccatggacaactacagtggcacggataggttcttccagactcattcctcaccgatgagatcgtcttcatactacccgccaccttataacaggccaagctatccacctccatctgcccaggaaccagcgaggaattcttcctattacatgccttatgacaggccaagctatgcacctccatcaccccaggagccaatgaggacatcttattatgcatctcatgacagggcaagctacccaccaccatcaccccaggagacagtgaggaattcttatcacacatcatatgacaggccaagctatccacctccctcaccccaggagcaggaatcatcaccatgggacttcttctggaacccattctcgtcgctagaaagctttgcatatcctcgccctcggagtagctatgaaaatgtggtcactgatgatgaattggcacggttacagcgggtacgagaggaggaaggaattccagaactcgaagaggaagatgatgagtgtcaagatcatgtaccaatg

SEQ ID NO: 33264 - protein, 95 aa, Panicum virgatum
  misc_feature: Ceres CLONE 1949839
  misc_feature: The sequence is a functional homolog of SEQ ID NO 168 in the 10/225,068 US patent application
  misc_feature: The sequence is a functional homolog of SEQ ID NO 228 in the 10/374,780 US patent application
MGCAASRLEDEEAVKMCRDRREFIKQALEQRNRFASSHIAYIESLKRVSMALQRFVAGDDHHELIFDTFISPVKQLEPEMLGLPYGSYEKRTIHV

SEQ ID NO: 33265 - DNA, 1059 bp, Panicum virgatum
  misc_feature: Ceres CLONE 1949851
  misc_feature: Encodes the peptide sequence at SEQ ID NO. 33266
tgactcctgcccaccgccgtcacttgcgcctcctcctaccgtgccctttttttctcaaaaaaaaaataccgtgcccttttcgctctgcttcttcttgcactcctcgatctcaccggcggcggaaatggcggaagttgaggcgcccacccaggaggtcaagctcttcggccgctggtccttcgatgacgtccaggtcaatgacatttctctggctgattaccttgccgtcagtcatacaaagcacgccatatatcttccccacactgctggaaggtattctgctaagaggttccgcaaggctcagtgcccaattgttgagaggctgacaaactctctgatgatgcacggccgcaacaatggcaagaaggtcatggctgttcgtattgtgaagcatgccatggagattattcacctgctgactgatgccaaccctattcaaattatcgtcgatgccatcataaacagtgggccaagagaagatgcgacccggattggatctgctggtgttgttagaaggcaagctgttgatatatctccattgaggcgcgtgaaccaggcaatctacctggttaccactggtgctagggaaagtgctttcaggaacatcaagaccattgccgagtgccttgcagatgagcttatcaatgcagctaaaggttcttctaacagctatgcgatcaagaagaaggatgagatsgagcgtgttgcaaaggccaaccgttgagcattctcatgcaaagcaatgttttggggtggaacgatgcctacttatgaatctactaccctgtttatttgtgaacttggcttggtgttggagctacagacttcgatgttccctaaaaacacaagtaccgttcctgatctggttgttttagctgcagtatgaattgaagttttgccacagctagtttgtcgtgttgacagctccatctctatcagtgtcaagacttgtaattataaatggtctgtaaacatgttctctatcttgtttctttgtcccaaaaccatgggaaatgtgctggagctcggtgtacctggtaatgcattagtgtttggctc

SEQ ID NO: 33266 - protein, 199 aa, Panicum virgatum
  misc_feature: Ceres CLONE 1949851
  misc_feature (44)..(199): Pfam Name: Ribosomal_S7 Pfam Description: Ribosomal protein S7p/S5e
  misc_feature: Useful for making plants with modulated biomass
  misc_feature: Useful for making plants with modulated flowering time
  misc_feature (191)..(191): Xaa is any aa, unknown, or other
MAEVEAPTQEVKLFGRWSFDDVQVNDISLADYLAVSHTKHAIYLPHTAGRYSAKRFRKAQCPIVERLTNSLMMHGRNNGKKVMAVRIVKHAMEIIHLLTDANPIQIIVDAIINSGPREDATRIGSAGVVRRQAVDISPLRRVNQAIYLVTTGARESAFRNIKTIAECLADELINAAKGSSNSYAIKKKDEXERVAKANR

SEQ ID NO: 33267 - DNA, 954 bp, Panicum virgatum
  misc_feature: Ceres CLONE 1949866
  misc_feature: Encodes the peptide sequence at SEQ ID NO. 33268
atcccacaactcccccacttcggccaccagacacacgtctcctcattttctcaggtcttctcttcttctgcacccaaacttccccccattctgctctgtcgtcaatttctccgtcctgaacagaaatacagatggcggggactgtgttcacgccctcccttgagggaatgaagcatgtcaagtcagagaacggcctgatcctgaccaagccgtttctcgaagtatgcaagcacatccttcctgtgctagagaaattcgggtcagccatggctattgtcaagactgatataggaggcaatatcacgaggctggagacaaaatatgcatctgatcctacaaagtatgagcagctgcacagtctggtgaaagtagaagttagtgcaaagactgccagaagttctagcagttgtactaacggtcttctctggctgacaagagccatggacttcttggttgcactgttccataatttggtacagcacccagattggcaaatgtcacaagcttgcaatgacgcatatagcaaaacactgaagaaatggcatggctggctagcgagttcaagcttttcggttgccataaagcttgcaccagacaggaagaagttcatggagatcatcagtggttcaggcaacatcaacacagacattgagaagttttgctcaacattctcccctttgctggcagaaaaccacaagtttctggccagtgtgggcatggatgatcttaaggcgtcttgatgcagtacactcgtttatcatttggcattctccatgccaagcttacacagaaacatgcatcatgcgttgttgaatttgtattgaggataatgaatctctgctctgtctaaatgtaatatttgtcacatccttgtttaatcatgaacacaggataacttctggctgaccgtgtcaattttcaatggatgagatttggtttgcaacttgtgttttt

SEQ ID NO: 33268 - protein, 202 aa, Panicum virgatum
  misc_feature: Ceres CLONE 1949866
  misc_feature (10)..(198): Pfam Name: GLTP Pfam Description: Glycolipid transfer protein (GLTP)
  misc_feature: Useful for making plants with modulated oxidative stress sensitivity
MAGTVFTPSLEGMKHVKSENGLILTKPFLEVCKHILPVLEKFGSAMAIVKTDIGGNITRLETKYASDPTKYEQLHSLVKVEVSAKTARSSSSCTNGLLWLTRAMDFLVALFHNLVQHPDWQMSQACNDAYSKTLKKWHGWLASSSFSVAIKLAPDRKKFMEIISGSGNINTDIEKFCSTFSPLLAENHKFLASVGMDDLKAS

SEQ ID NO: 33269 - DNA, 1143 bp, Panicum virgatum
  misc_feature: Ceres CLONE 1949867
  misc_feature: Encodes the peptide sequence at SEQ ID NO. 33270
tcctccccacccctcgacccgccgccaaacctcgtcgcgccgccgccaccggagagaagatggtcgggccaggcctctacaccgagatcggcaagaagaccagggatctgctgtacaggggctaccaaaccgaccacaagttcaccctcaccacctacacctccaatggcgtcgctatcacagctactagcacaaagaaagctgacctaatttttggtgagatccaatcacagataaagaacaagaacgtcaccatagatgtgaaagcaaactcaggatcaaatgtcattactacggttactgttgatgagattgctacaccaggactgaagactatcttgagctttgctgttcctgatcagagatctggaaagtttgagcttcagtacttgcatgatcatgctggggttaatgcaagcattggtctgactgccaatcctgtagtcaacctctccggctcctttggaaccaaggctgtggcagttggtgcagatatctcacttgataccgcatctgggagcttaaccaaatacaatgctggactgagcatcactcatgaagaccttatcgcatccctgaacctgaacaacaagggagacagcctaactgcagcttactaccacaatgttaacctattgactagcacagctgttggggcagagctgacccacagcttctcaaccaacgagaacaccctcgcctttggcacccagcacgctctggatccactgaccgtcgtgaaggcccggttcaacaattgtggcaaggccagcgcgctgatccagcatgagtggaggccaaagtcactggtgaccatctcgggtgaggttgacaccaagaccattgagaagagctcgaaggttgggatcgccgtggccctcaagccctgattgttttaccaagtccctttttctctttttaaagctcccagcgtgtacttatttcccagctgaaattgggaccaggtcggcttgggaaaacaaaaaactttgggttcccggcatcttttggtcgttgcagcctattgatttcatgaactgcgatgtttccttgaggattttttttgcagtcgccggtgtagcactctgttaaatgagcaaccttcacaataattcaagctcggtagaattctgaacttgtttg

SEQ ID NO: 33270 - protein, 276 aa, Panicum virgatum
  misc_feature: Ceres CLONE 1949867
  misc_feature (3)..(269): Pfam Name: Porin_3 Pfam Description: Eukaryotic porin
  misc_feature: Useful for making plants with modulated drought sensitivity
MVGPGLYTEIGKKTRDLLYRGYQTDHKFTLTTYTSNGVAITATSTKKADLIFGEIQSQIKNKNVTIDVKANSGSNVITTVTVDEIATPGLKTILSFAVPDQRSGKFELQYLHDHAGVNASIGLTANPVVNLSGSFGTKAVAVGADISLDTASGSLTKYNAGLSITHEDLIASLNLNNKGDSLTAAYYHNVNLLTSTAVGAELTHSFSTNENTLAFGTQHALDPLTVVKARFNNCGKASALIQHEWRPKSLVTISGEVDTKTIEKSSKVGIAVALKP

SEQ ID NO: 33271 - DNA, 683 bp, Panicum virgatum
  misc_feature: Ceres CLONE 1949873
  misc_feature: Encodes the peptide sequence at SEQ ID NO. 33272
gcgcttcgttcctcctcgtccctcggcatcgcctcctctccgtctccctgcagagagagcgccgcaaggcactgaaactcgcggcggcgtgttgtttgcttgcttgctggcaagagggagaaaaggaggaggaagagagcaggagatggcaggctgcgatggagccaagtcgccggcctccaaggaggaagaggcatgtgttgagaagaagtatggaggaattgcacccaagaagcctttgatatccaaggaccacgagcgcgcgtacttcgattcagcagactgggtgctcggcaagcaagctgcaaatagcagcacacggactgctgttgagtctctgaagcccaagctgaagcgaacgcctcaccaccagcttccccctcgcaagccgacctgcgcttccagctgagacgcacggtgagctggctgacctccaatccaaaagcctgcagcacttagctcgtagtagcatcacgcgcagcaatgtgcaaaagcgccgcaagaaatgaccacccctctgtgttcatgcagtgcagctgctggagggagtgctgggaggtaaggatagggctcggataaatgtttggccgctggtccgaaatcgtagggatggatcagaagcctgaggggcaatctggctacttgtcaattgcagcctctactatgtctgtcatcaagaacgg

SEQ ID NO: 33272 - protein, 87 aa, Panicum virgatum
  misc_feature: Ceres CLONE 1949873
  misc_feature (20)..(87): Pfam Name: Lg106 Pfam Description: Lg106-like protein
  misc_feature: Useful for biocontainment applications
MAGCDGAKSPASKEEEACVEKKYGGIAPKKPLISKDHERAYFDSADWVLGKQAANSSTRTAVESLKPKLKRTPHHQLPPRKPTCASS

SEQ ID NO: 33273 - DNA, 365 bp, Panicum virgatum
  misc_feature: Ceres CLONE 1949884-R
  misc_feature: Encodes the peptide sequence at SEQ ID NO. 33274
gaacccgagcagtttcagcctcgcagatgggaggggctgaaccagccggctggcaagagcttcgcgccgttcggaggtggactgcggctctgccctggatcggagattgtcaaagtggaggctgctttcttcctgcaccaccttgtgctcaactacaggtggaggatgggtgaagaggacgctcccatgctgcaccagtacgtggaattcaagaagggcctgcccatacagctcgagccggtcagctgatgctcatcaagcctttgcctcgctcgctcttcgtcaagactccaagagagatgaaataagttgagacgtcggacccccgccagccagccagtcctgaatcgcgatttacaagtcac

SEQ ID NO: 33274 - protein, 82 aa, Panicum virgatum
  misc_feature: Ceres CLONE 1949884-R
  misc_feature: SWISSPROT Homolog: EC 1.14.13.93 (+)-abscisic acid 8'-hydroxylase
  misc_feature: Useful for making plants with modulated oxidative stress sensitivity
EPEQFQPRRWEGLNQPAGKSFAPFGGGLRLCPGSEIVKVEAAFFLHHLVLNYRWRMGEEDAPMLHQYVEFKKGLPIQLEPVS

SEQ ID NO: 33275 - DNA, 490 bp, Panicum virgatum
  misc_feature: Ceres CLONE 1949884
taataatttttcccccctccctttgaaaacttctttccaccaaaccccaccaggtggtggtaccccctcttgtgggccccttgggcggcctccccccccccggcggggttccccccttacttcccctggtccccgggcgccctcccaagggccgcttccggtggccccctcttcgccaaaaccttcggtttcctccccccccccccttccaaacccgcggggggtttcttaaagaacaccttccccagttacggaacgtggttcaattcccccttcttcgctcccccggcgtggtcctcctgcaacaagaacttcacccctttctggctcaacaacaagaacccctggttcaattgaactacccccggccccttccccaccttctccggcaattcttcccccttgtggttccccgccaacccccccccccaattccgaagcttgttcccccccctctccgcctcaccgggcttcagggcttctaactccg

SEQ ID NO: 33276 - DNA, 972 bp, Panicum virgatum
  misc_feature: Ceres CLONE 1949889
  misc_feature: Encodes the peptide sequence at SEQ ID NO. 33277
attttctgcacgcgctcccgggtttcagctccggcgccatcagggcaggggggagcgatagttctgtgctattgggagaggagggtgaggaggaggaggttgcgagatggggtccggatctttcctcaaggtgctggccaagaacttcgacgtgctcgccgggccaataatatcacttgcttatcctctgtatgcttctgttagagcaatagagacaaaaaatcctgtagatgatcagcaatggctcacttattgggtgctgtactcctttatcactttgtttgagctaacttttgctccaattattgagtggcttcccttttggtcatatgcaaagctgtacttcaactgctggttggtcttaccttggttcaacggtgctgcttatgtttacgtccattttgtgcggccaatgtttgtgaaccgccaaatagtaaacatatggtatgtcccaagaaatgagaagtcaagtaaacctgatgatgtactgtcagctgcagagagatatattgaacagaatggaccagaagcatttgagaagctcatcagcaagtctacaaagtcttcaaaatcaaggaccacaaggcgttcgatcttggaggaggctgaggctgaaagagaatcctggggtgaaaatcctttctacgacaaaaacttccgacactaaactacttgaaggcgaattccccagttttctgttagtgttatggattttcaattgcgagatttccttgacaacatgcgcttcatgcagccttgctgggccacacggcctcgagacgaccttcatgtattcctgacttgaggactgtaccttgttgcatccactgctagcaattgtggactctactgtaaatggaggtagatgctagcgttgctgatttatgtgagcttttggctggtgtaatatcaacaacatcgcctgtgtcactaaaccttcaggaggatacaagcctagatttttcagtttcc

SEQ ID NO: 33277 - protein, 186 aa, Panicum virgatum
  misc_feature: Ceres CLONE 1949889
  misc_feature (7)..(104): Pfam Name: TB2_DP1_HVA22 Pfam Description: TB2/DP1, HVA22 family
MGSGSFLKVLAKNFDVLAGPIISLAYPLYASVRAIETKNPVDDQQWLTYWVLYSFITLFELTFAPIIEWLPFWSYAKLYFNCWLVLPWFNGAAYVYVHFVRPMFVNRQIVNIWYVPRNEKSSKPDDVLSAAERYIEQNGPEAFEKLISKSTKSSKSRTTRRSILEEAEAERESWGENPFYDKNFRH

SEQ ID NO: 33278 - DNA, 1885 bp, Panicum virgatum
  misc_feature: Ceres CLONE 1949905
  misc_feature: Encodes the peptide sequence at SEQ ID NO. 33279
cccgtgctcaccgctcaaaaccctccccatctcctcctcccactccggcggcggcggcggggcctcttctccggcgaggcctcctcctctacaccacagaaaaacatggatgtacctgttgaggaccctgtggagaataacctggctggaactcctcctacccttggcaatgaggaacaagccaatccttatgctgatgtgcaagagaagctcaatgaagaaccagaaaagccgtatgatggggaatccaaagacccaaaacctgatgagttggggaactccgagcatgcggatgtgaacaatgaagatgcgggggatctgagcaaagaggaccaagctacccccatgcagcaggagcctgccaatgtctatgttgaggaagctgggacaaagcagcagggtattgtggtgcctgatgaacagaaatggcctgggtggcctggagaaagcgtattccgtatactggttcctgtcacgaaggtgggtgctgtcattgggcgaaaaggagatttcatcaagaaaatgtgtgaggaatccaaagctcgcattaaggtcctcgagggcccacaaggcgtgccagaaagagctgtaatgatttcagcaaaggatgaacctgatgcagtgctatctccagctgtcgatgggttgcttagagttcataaaaggataactgatggtttagatgctgaaactgatcagcctcaacgaggcactgtcaccgctgggcctacaaggctactggttccagcttcccaagctggaagcctgattggcaagcaaggaggaactattaaatccatacaagatgcttcaaagtgtgctctccgaattcttgagaatgttcctcctgtggcattaaatgatgatagagttgttgagatacagggtgaacctcttaatgttcacaaagcagtggagctgattgcaagtcatttgagaaaatttcttgttgaccgcagtgttctccctttgtttgaatcccagatgaaagcatacaatgtgcacagagagcaacctatgccacctcctcagccatggggtccccctccaccctcaccctggggtcatccaccaaaccttcctcctggtcctggtggcccaggttatgttgggaatccacaatacatgcctccacgaccacaagacaactattaccctcctcctgatatgccccctgtagaaaagcaaccacactatggaatttcttcatatgggcgcgacgcacctccaagtgctccctcagggaatcagcaccaagcacatgggtcttctcaggtgacacacagcatgcaagttcctctttcctatgcagatgctgtgattggagcagctggtgccagcatcagctacatccgcaggcatagtggcgcaaccataagtattcaagaaggtgctcctggggagatgacagtggagataacaggaagcgcctcacaagtacaaactgctcagcagctgatcaagaatttcatggctgaagcttctccccagggcccaccaggtcctgctgcacccgctcaatctgttgacacgggctacagctcttcttacctaccatacggcggagcatcatacggatctcctccaggcagcgcagctccaggcccacacaatggaggaagctatggcgctgcaccatatccgccgaactacggatactagttggagggagaacttggtttcctagttgcagatcttggggaaagggggtattcaggttttgtttgctagtcacctagtctgttcatgtgttgagaacgaggtcgttaggatttctgaactaccttctggtgttgtaagctgctttctgttcccaatgcgcgtacgctctttctttgctctgtggttgcgtgaacttaccattaatccagtatttccatattcg

SEQ ID NO: 33279 - protein, 518 aa, Panicum virgatum
  misc_feature: Ceres CLONE 1949905
  misc_feature (208)..(273): Pfam Name: KH_1 Pfam Description: KH domain
  misc_feature (392)..(452): Pfam Name: KH_1 Pfam Description: KH domain
  misc_feature (116)..(178): Pfam Name: KH_1 Pfam Description: KH domain
  misc_feature: Useful for making plants with modulated flowering time
MDVPVEDPVENNLAGTPPTLGNEEQANPYADVQEKLNEEPEKPYDGESKDPKPDELGNSEHADVNNEDAGDLSKEDQATPMQQEPANVYVEEAGTKQQGIVVPDEQKWPGWPGESVFRILVPVTKVGAVIGRKGDFIKKMCEESKARIKVLEGPQGVPERAVMISAKDEPDAVLSPAVDGLLRVHKRITDGLDAETDQPQRGTVTAGPTRLLVPASQAGSLIGKQGGTIKSIQDASKCALRILENVPPVALNDDRVVEIQGEPLNVHKAVELIASHLRKFLVDRSVLPLFESQMKAYNVHREQPMPPPQPWGPPPPSPWGHPPNLPPGPGGPGYVGNPQYMPPRPQDNYYPPPDMPPVEKQPHYGISSYGRDAPPSAPSGNQHQAHGSSQVTHSMQVPLSYADAVIGAAGASISYIRRHSGATISIQEGAPGEMTVEITGSASQVQTAQQLIKNFMAEASPQGPPGPAAPAQSVDTGYSSSYLPYGGASYGSPPGSAAPGPHNGGSYGAAPYPPNYGY

SEQ ID NO: 33280 - DNA, 1020 bp, Panicum virgatum
  misc_feature: Ceres CLONE 1949906
  misc_feature: Encodes the peptide sequence at SEQ ID NO. 33281
cttttcgctctgcttcttcttgcactcctcgatctcaccggcggcggaaatggcggaagttgaggcgcccacccaggaggtcaagctcttcggccgctggtccttcgatgacgtccaggtcaatgacatttctctggctgattaccttgccgtcagtcatacaaagcacgccatatatcttccccacactgctggaaggtattctgctaagaggttccgcaaggctcagtgcccaattgttgagaggctgacaaactctccgatgatgcacggccgcaacaatggcaagaaggtcatggctgttcgtattgtgaagcatgccatggagattattcacctgctgactgatgccaaccctattcaaattatcgtcgatgccatcataaacagtgggccaagagaagatgcgacccggattggatctgctggtgttgttagaaggcaagctgttgatatatctccattgaggcgcgtgaaccaggcaatctacctggttaccactggtgctagggaaagtgctttcaggaacatcaagaccattgccgagtgccttgcagatgggcttatcaatgcagctaaaggttcttctaacagctatgcgatcaagaagaaggatgagatcgagcgtgttgcaaaggccaaccgttgagcattctcatgcaaagcaatgttttggggtggaacgatgcctacttatgaatctactaccctgtttatttgtgaacttggcttggtgttggagctacagacttcgatgttccctaaaaacacaagtaccgttcctgatctggttgttttagctgcagtatgaattgaagttttgccacagctagtttgtcgtgttgacagctccatctctatcagtgtcaagacttgtaattataaatggtctgtaaacgtgttctctatcttgtttctttgtcccaaaaccatgggaaatgtgctggagctcggtgtacctggtaatgcattagtgtttggttcatggatgggtaatataaaggcaaaggtaattgattc

SEQ ID NO: 33281 - protein, 199 aa, Panicum virgatum
  misc_feature: Ceres CLONE 1949906
  misc_feature (44)..(199): Pfam Name: Ribosomal_S7 Pfam Description: Ribosomal protein S7p/S5e
  misc_feature: Useful for making plants with modulated biomass
  misc_feature: Useful for making plants with modulated flowering time
MAEVEAPTQEVKLFGRWSFDDVQVNDISLADYLAVSHTKHAIYLPHTAGRYSAKRFRKAQCPIVERLTNSPMMHGRNNGKKVMAVRIVKHAMEIIHLLTDANPIQIIVDAIINSGPREDATRIGSAGVVRRQAVDISPLRRVNQAIYLVTTGARESAFRNIKTIAECLADGLINAAKGSSNSYAIKKKDEIERVAKANR

SEQ ID NO: 33282 - DNA, 922 bp, Panicum virgatum
  misc_feature: Ceres CLONE 1949916
  misc_feature: Encodes the peptide sequence at SEQ ID NO. 33283
aatctcatatcgtctcatcgttcggagcgcacaaccccgttccaaatccaaatcgctcttctcgtgaccctcggcgatccttcccccgcttcaagatgcagatctttgtgaagaccttgaccggcaagactatcaccctcgaggtggagtcctccgacaccattgataacgtcaaggcaaagatccaggacaaggagggcatccccccggaccagcagaggcttatcttcgccggcaagcagctggaggatggccgcactcttgcggactacaacatccagaaggagagcaccctccacctggtgctccgcctgaggggaggcatgcagatcttcgtgaagactttgaccggcaagactatcaccctcgaggtggagtcctccgacaccattgacaatgtcaaggcaaagatccaggacaaggagggtatccccccggaccagcagaggcttatcttcgccggcaagcagctkgaggatggccgcacccttgcsgactacaacatccagaaggagagcaccctccacctggtgctccgcctgaggggagggatgcagatctttgtgaagaccttgactggcaagactatcacccttgaggttgagagctccgacaccattgacaacgtgaaggccaagatccaggacaaggagggcatccccccggaccagcagcgacagcgactgatcgcctcgccgcgcgccgtgcttgccggtgaaaaaggtgcttggagaggactatctaccggaagctgtgtgatgtaatgtttcatgagtgccatgcgtgtgtgtgtgtgtgctaatcaagggagaaatgcaaaaaaaaaaaatcctttatgttggtgaatgtactcctaatgatggctccatggtgctagcttgtaataaaatgttaatgcagaaattggtctgctagcttgtgt

SEQ ID NO: 33283 - protein, 222 aa, Panicum virgatum
  misc_feature: Ceres CLONE 1949916
  misc_feature (6)..(74): Pfam Name: ubiquitin Pfam Description: Ubiquitin family
  misc_feature (82)..(150): Pfam Name: ubiquitin Pfam Description: Ubiquitin family
  misc_feature (158)..(219): Pfam Name: ubiquitin Pfam Description: Ubiquitin family
  misc_feature: Useful for making plants with modulated nitrogen use efficiency
  misc_feature: Useful for making plants with modulated cold sensitivity
  misc_feature: Useful for making plants with modulated flowering time
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRQRLIASPRAVLAGEKGAWRGLSTGSCVM

SEQ ID NO: 33284 - DNA, 620 bp, Panicum virgatum
  misc_feature: Ceres CLONE 1949942
  misc_feature: Encodes the peptide sequence at SEQ ID NO. 33285
aatgcatgttttattgagatatttctttaaccaaatgattattcttgccgaattgaccatctgatgcaggagtagcactgatgtttggtctttcaaccatttttctttcttaaggtgagggattggtacttggactcgttccgcgacatcagatacttcccagaagtgaggaatcacaacgacgagcttgctttcacacagatgattaaaatggtcaaggtgcggcacaataatgtggttccaacaatggctttgggagtgcagcagctgaaaaaccaactgtgccgcacaaggaaggttccctttggatccgacgagatccacgagttccttgatcgattctacttgtcaaggattggcatccgcatgctgatagggcagcatgtggctttgcatgatcctgaaccagagcctggtgtcataggcctcattaatacaagattgtcccccatacaggtggctcaagctgctagcgaagatgcccgtgctatttgtttaaggacatacggatcagctcctgatattaacatttatggtgatccaaattttacatttccatatgtcgcatcacacctatatctgatgttatttgaattggtgaagaactcgcttcgtgcagt

SEQ ID NO: 33285 - protein, 139 aa, Panicum virgatum
  misc_feature: Ceres CLONE 1949942
  misc_feature: SWISSPROT Homolog: EC 2.7.11.2 [Pyruvate dehydrogenase (acetyl-transferring)] kinase
MIKMVKVRHNNVVPTMALGVQQLKNQLCRTRKVPFGSDEIHEFLDRFYLSRIGIRMLIGQHVALHDPEPEPGVIGLINTRLSPIQVAQAASEDARAICLRTYGSAPDINIYGDPNFTFPYVASHLYLMLFELVKNSLRA

SEQ ID NO: 33286 - DNA, 258 bp, Panicum virgatum
  misc_feature: Ceres CLONE 1949942-R
ggctgcccttcttcttgtaatagaatccagtgctggtctgcaaatattgttctaatggcccagccacctatagctatagttggttgctgctccgtatcttctagccccctcaatttcatcttttagctctgctgcattgcgagcacaagcactcctacttcctatgatccctcgtcctggtttcagaaaaatagtatgattataatctctcatcctctcagaaattatcattacaaatgggctctgggagcgttactg

SEQ ID NO: 33287 - DNA, 995 bp, Panicum virgatum
  misc_feature: Ceres CLONE 1949965
  misc_feature: Encodes the peptide sequence at SEQ ID NO. 33288
ctctctctcgctcgctctcgtccccctcctcccgcagcggttcttccctcccttcctctcgccgccgccgccgccgccgttgccgtgttccgtttccttgcagatggcttccgccaaggtggagaaccgaggcgcgctgtccaagaggtcgcgcaacgacgtgtctgtaaaggagggggactggaattgtcctcagtgtggtaatgtcaacttcagttttagaaatgtttgcaaccgtggagcctgtggtgcaccgcgtccatcaccgagtccaagtccaagaatgatgccagcacctcctgctgctggatatgagcggtcacctctattttacggagggggtggtggggcgccatctccaatccctcttggatctggtagctatggtggtccatatccacaccttgggatgcgttatggttatggtccaccagtaggagctcctggttcatatggccttttctcttcgtatggtcaacctggaccgatgggtggcatgggatatggccctggacctgagctaggccgatacaactatgggtttagaggatctccaatgccggtttctagcccatggtctggtggagcattagtggaaaacaatgataacattgcttcacgaaagcgccgtggaggcccagatggactttctgagggtgactggacctgtcccaaatgtgacaatattaacttttccttcagaaccacctgcaacatgaagaaatgtggagccccgaggccaactcctggagctaacatgagttcagctcgcaaagacaaggatgcccctgaaggaagctggacctgcccagagtgcaacaacctgaactacccattccgcgcggtgtgtaacaggaaagggtgctcatacagcaagccgaccccggccaacaactgaacccaacctttccgttcattgtcgaaatattgttgtaccctagattgtgacctatatcagtcgtgttaaactgcagagacgtttttcctgttccgtt

SEQ ID NO: 33288 - protein, 264 aa, Panicum virgatum
  misc_feature: Ceres CLONE 1949965
  misc_feature (23)..(54): Pfam Name: zf-RanBP Pfam Description: Zn-finger in Ran binding protein and others
  misc_feature (183)..(214): Pfam Name: zf-RanBP Pfam Description: Zn-finger in Ran binding protein and others
MASAKVENRGALSKRSRNDVSVKEGDWNCPQCGNVNFSFRNVCNRGACGAPRPSPSPSPRMMPAPPAAGYERSPLFYGGGGGAPSPIPLGSGSYGGPYPHLGMRYGYGPPVGAPGSYGLFSSYGQPGPMGGMGYGPGPELGRYNYGFRGSPMPVSSPWSGGALVENNDNIASRKRRGGPDGLSEGDWTCPKCDNINFSFRTTCNMKKCGAPRPTPGANMSSARKDKDAPEGSWTCPECNNLNYPFRAVCNRKGCSYSKPTPANN

SEQ ID NO: 33289 - DNA, 1046 bp, Panicum virgatum
  misc_feature: Ceres CLONE 1949977
  misc_feature: Encodes the peptide sequence at SEQ ID NO. 33290
acccataatcgggcgcccgctgcgctccctccgccgccgcgaccaccaaggcgacgagacgatgctgcggatctaccgcttcctcccatccgcctccaggagaggttttgatctaaaagaacctctttggagtggttcgttgacattccaacaagctgtctcaacttcagcaggaaatcttgatgagaacctgtctggtaaaaagtttgcaagctatactgtgttcaagggaaaggctgcactttctattcatcctatactgccaagtttcagcaaaatggaatctggagcatatcggatgaacagaaatggatcagtaatgttgaccttccttcctgctgttggacaaaggaagtatgactatacaaagaaacagctttttgctctgtcacctactgaagttggatgcttgataagtcttgggcctgctgaatcctgtgagtttttccatgatccgtccatgaaatctagtcatgaaggacaggtgaaaaaatcgctgtcgcttactccccttggcagtgacagtggatactttgttaatataaccgttctgaacaacgtgcagaagactaccgatcgcctttcagtccctatcacaaaagctgagtttgcggtgatgcgcacagcactgagttttgcgttgccacacatcatgggctgggatcaggtgttgacgcmccatccagctcccctagctagcaacaaacaagcctaggatggagcgtccacccccggattttgaatgggaaaaggtgaagctttccttgtagcagcaagatggagtattttgggcatcactatgaagttgctgctgcaaagtttcgaatgttggtgtgcgttgattgtatctccctcctgatcgattcagaacacttgtctgctttagatttctgtaacttgagattgaaggcacgatggagcatgatggaccatattgtttgttcagtgcatgtataacttcaccatgcctactaagcgcatgtttctagtcgagtgagctggtagcactacagtttcctgtaaataatgtctgtgcttggtgttcc

SEQ ID NO: 33290 - protein, 217 aa, Panicum virgatum
  misc_feature: Ceres CLONE 1949977
  misc_feature (53)..(191): Pfam Name: Whirly Pfam Description: Whirly transcription factor
  misc_feature (206)..(206): Xaa is any aa, unknown, or other
MLRIYRFLPSASRRGFDLKEPLWSGSLTFQQAVSTSAGNLDENLSGKKFASYTVFKGKAALSIHPILPSFSKMESGAYRMNRNGSVMLTFLPAVGQRKYDYTKKQLFALSPTEVGCLISLGPAESCEFFHDPSMKSSHEGQVKKSLSLTPLGSDSGYFVNITVLNNVQKTTDRLSVPITKAEFAVMRTALSFALPHIMGWDQVLTXHPAPLASNKQA

SEQ ID NO: 33291 - DNA, 1435 bp, Panicum virgatum
  misc_feature: Ceres CLONE 1949986
  misc_feature: Encodes the peptide sequence at SEQ ID NO. 33292
agaaatacaaagcaaggaaagaactttgaaaagctatggctgtcccacaagttgataagaaaatgctcagtgaacttgaatccatgggattcccaaccactcgttcaatcagggcactccatttttcaggtaattccaatcttgaatctgctgtaaactggcttctggaacatgaaagtgacccagacattgatcagctaccattgattccacgagaaatccccattgaatgcggtgacacatcaaatgaagtaagaaatgacattcaaggaatgagggatcccgtgcaggagcagaaacgagaagaacggactgaaactggaagacagaatgagacatcccagttggaacgagaattaaatgcagatgaacaggaggaagaagatagaaagaggatattagcactatataagcaaaaacgagatgaggaaggaagagcaagagagcaaaaacgaaatcagttacaagatgatcagaggggagaggattcgagcttctaaagatcttatggaagcaaaacgaactcttgaggaaaatcaaagaaagcgcatgatggaaagtcgtatagcagatcamgaagaggagaaaagagcaagagagagaatacmacagcgtrtmwcmgatgataggggcagaaagmacgagaaggcttcctttgccgccctacaatcctgctggggcttcccttccgatcactacgccctcttgggtatgtcctgctggggcttcagttccgatctcgcctcccacctcggtaaaacctgctgggccttcacttccsmtcacwmcscccaccawggtaaamcctgctgggccttcagttccgatcacaacgcccacmaagcaggtaaaacctgttgaacgtgttgtaacttcagaacagctgagagattgcctgcgaactctgaagaagaatcacaaggatgacagtgccagagtcacaagagcataccaaacattgttgaagattatcgccaacattgttaagaacccagcagaggacaagttcaggaggattcggctcagcaaccctattttcaaggacagggtgggtaacctgcaaggaggcatagaattcctggagctgtgcgggttccagaggctcagcgccagcggctacctggtgatgcccagggacaggatcgacatgacgctcctcaacgccgccggagtcgagatcgcgtcggccatggagaacccctacttcgggctgctctccaagtgaacggaacagccactatcgatgttctcgtctgcttggtcgagtactgactgaaacggggtgtgcaaccagacggacttcatcgtaacgtgtcggggcgtcacggctgactggatctgtccccattgccagtgccattgtacagtcacccatcagaacaaatgtaccaaatctcatcccggagaaataaaatggaaccatgtacattggtgc

SEQ ID NO: 33292 - protein, 154 aa, Panicum virgatum
  misc_feature: Ceres CLONE 1949986
  misc_feature (6)..(43): Pfam Name: UBA Pfam Description: UBA/TS-N domain
  misc_feature: SWISSPROT Homolog: EC 3.1.2.15 Ubiquitin thiolesterase
MAVPQVDKKMLSELESMGFPTTRSIRALHFSGNSNLESAVNWLLEHESDPDIDQLPLIPREIPIECGDTSNEVRNDIQGMRDPVQEQKREERTETGRQNETSQLERELNADEQEEEDRKRILALYKQKRDEEGRAREQKRNQLQDDQRGEDSSF

SEQ ID NO: 33293 - DNA, 1060 bp, Panicum virgatum
  misc_feature: Ceres CLONE 1950000
  misc_feature: Encodes the peptide sequence at SEQ ID NO. 33294
aggttatctccgtttcttaaaccctttcccttctgtcggactctcttctcttgctcttctttccctggcggcgacgaccgggcgagcggcggcgacatttgtcacttctttgcccagccctgtgccggcgacgagcatccaccagattcaccatgagtaatgccggcactagattgctgaaaggcttgaggagggtcttagaacagcaaaagatttcagccgttttctgcagacgatctcaagcttggagttctactgtctctttttctgaccttgatgagaagggtgatatggactttgacaatgattataccgattcaaagagagagttacagccccagagcgtagatcccaaaaagggttggggattccgcggtgtacacagggctattatctgcggcaaagttggacaagtgcctgtgcaaaaaattttaaggaatgggcgtacagtaactgtttttaccgttggaactggtggcatgtttgaccagagggtaattgggcctgaggatttaccaaagccagctcagtggcatcgaatagctgttcataatgaccacctaggtgcttatgctgttcagaagctggtgaagaattctgcagtctatgttgagggtgatattgaaaccagggtctacaatgacagcattaatgatcaagtcagaaacatacctgagatatgcgtacggcgcgatggcaagatttgtctggttaaatcaggggacagtgctgctaacatatcattagatgaactcagagaagagctgttctagtgatagttaaggatgtcagtgcaagcagatcatgaggttgcttcttgcttgaggcacattgtatcttgtgcagtgcactagctggtgaaggcctatgatctgcgtcgaaggctgctggtcacatggccgtagctgtgatgaaggtacgaatagcagcagaagcctgtagttgattggaaaatgccgtaaaacttgggttcacgcctccatttctgattgtatttcttcctccatgttttcagcacataaacaatggtctatgaagcaactttttttttcgttgaagc

SEQ ID NO: 33294 - protein, 206 aa, Panicum virgatum
  misc_feature: Ceres CLONE 1950000
  misc_feature (76)..(187): Pfam Name: SSB Pfam Description: Single-strand binding protein family
MSNAGTRLLKGLRRVLEQQKISAVFCRRSQAWSSTVSFSDLDEKGDMDFDNDYTDSKRELQPQSVDPKKGWGFRGVHRAIICGKVGQVPVQKILRNGRTVTVFTVGTGGMFDQRVIGPEDLPKPAQWHRIAVHNDHLGAYAVQKLVKNSAVYVEGDIETRVYNDSINDQVRNIPEICVRRDGKICLVKSGDSAANISLDELREELF

SEQ ID NO: 33295 - DNA, 1030 bp, Panicum virgatum
  misc_feature: Ceres CLONE 1950004
  misc_feature: Encodes the peptide sequence at SEQ ID NO. 33296
taacctactacttggtccgacacttgcagcgtaccacagtctaggcctctacagttgtagttgtagattcgtttcgcgcctcttgcttgggccaatcaccaagtcgtcttctgttcaaccactgtgctcagctgtgccatcaattagttagtcatacatgtaattgtcatactgacagacgacataaaagaactaggtcggaagggggatacattgaaggtgcgagctggattctaccgcaatttcctccttcccaagggcaaggccacgcttctaaccccagaagtcctcaaggaaatgcaactcgaacaggagagaatagaagctgagaagaagcgggtcaaagaagagtcacaacaacttgctcgagtttttgaaaccatcggggctttcaagattccacgcaaaggcggaaaaggaaaacaaatctttggaagcgtcacagcacaggatgttgttgacataataaagtcacaacttaatagagatgtcgacaagaggcttgtgacagttccagaaatccgtgaaaccggggagtatgttgcagagattaagcttcacccggatgtgacagctcgagtaaggctgaatgtctatgcgaaatgagatgtgcagttactgaagctgaatggacggtgggggtctgggggagcctgatttcgccagagattttgctgaaaatgccaggcgttgtggtagaaaaatggaggtctggactggttcatcctgcctgtaaagttaattttcagtttgttgatttcgtggagtgaaaactagaaaagtttgtaaaccacagttggtttgaccgcagtttgtaaaccacagttggtttgaccgcagtttgtaaaccacagttggtttgaccgctgaagcatcccttgcatgtttatcatggctgaagaaaaatggctgcagcctttagcaaaaacagttagttcgatgaacaggcccccaaaggtagatgcgacaatcggctttccagggatatgttttcatttgtgttcgtcatatatatattttttttttgagc

SEQ ID NO: 33296 - protein, 102 aa, Panicum virgatum
  misc_feature: Ceres CLONE 1950004
  misc_feature (16)..(102): Pfam Name: Ribosomal_L9_C Pfam Description: Ribosomal protein L9, C-terminal domain
MQLEQERIEAEKKRVKEESQQLARVFETIGAFKIPRKGGKGKQIFGSVTAQDVVDIIKSQLNRDVDKRLVTVPEIRETGEYVAEIKLHPDVTARVRLNVYAK

SEQ ID NO: 33297 - DNA, 498 bp, Panicum virgatum
  misc_feature: Ceres CLONE 1950011-R
  misc_feature: Encodes the peptide sequence at SEQ ID NO. 33298
taggaatctgcctctaagaccaattagcacttgccctgtaataagtttagtggacactccagaagttaaggcaccccctgaacctgtgaaggaggttcccaaggagccaaagttcacctgccctatatgcatgaatgagctgacagaagcagcatccactgtctgcggtcacattttctgccagaagtgcatcaaggctgccattcaggctcagaagaagtgccctacctgccgaaagagccttaataaaaaccagcaccaccgggtatacctcccgacaacggagtaatccgatagtcattttggagcaagctgtgcagcacctgaccttcaccacattgtggcgattgtatggcggagctatttagagaggcttatcgatagcaatagagtattactgcgatttaacaagtggttttgccctcgcatgtgggacatcatgccaagctgtatcctcagtaaagtatatcctagtatcatctggatgtgggtgttatc

SEQ ID NO: 33298 - protein, 95 aa, Panicum virgatum
  misc_feature: Ceres CLONE 1950011-R
  misc_feature (40)..(77): Pfam Name: zf-C3HC4 Pfam Description: Zinc finger, C3HC4 type (RING finger)
  misc_feature: The sequence is a functional homolog of SEQ ID NO 2446 in the 10/374,780 US patent application
  misc_feature: The sequence is a functional homolog of SEQ ID NO 736 in the 10/225,066 US patent application
RNLPLRPISTCPVISLVDTPEVKAPPEPVKEVPKEPKFTCPICMNELTEAASTVCGHIFCQKCIKAAIQAQKKCPTCRKSLNKNQHHRVYLPTTE

SEQ ID NO: 33299 - DNA, 696 bp, Panicum virgatum
  misc_feature: Ceres CLONE 1950011
gaaaaaaaaccacaagtcttcctgccagctcgcaaccacaaaccctagtcgctcctcgcgactcagacgacgggctcgattcgttcctgtgtcctgttggcttcgctcaagcctgtatcttttactgcaacactatgaactcccctggcgctggaaggcggattccgaagaggcgacggacgactaagccgctttcacagccttttgacctgaactgcccccctgctgaaggggctggtgaggggggttcacctttcagcattatgcctgtctcacacatccaggcttccagcagtatgcctgtctcacacagtcaggcttccagtagcatgccacctgctactaatgagccacatattggcatgcatagttgccccattgatgtggaagccattgatgatgatgttgttatctattcttcaagatcactccctcaagtatgttattgtgcctttttctagtctctatttgtacatttgcatatttattttagtcaaattttgtttcttatatgattgtttaaagcggaagaatgacactgataatcaagttgtttgctttaaagtttcaggcaaggcaacagtcgaccgggactgaacgtattactgtgataatagatgatgattctgaaacgaacccagaaccagcaggggatgctcttgatgagcatgtgaatacactgctatccctgggcat

SEQ ID NO: 33300 - DNA, 1064 bp, Panicum virgatum
  misc_feature: Ceres CLONE 1950012
  misc_feature: Encodes the peptide sequence at SEQ ID NO. 33301
cttgttgtactcctgctattacccatccctgtcccaatcaactgatcgcccgcaaaacgagtagcagctgcagcaaggcaggcaggcgggcttgattcgccgaattcgcaggcgcagtttactcaattcacaccatgacttctttggacactgtgagaggagatcttgctttggtcattttgtacctaaacaaggctgaagcaagagataagatctgcagagctatacagtatggatcaaagtttctgagtaacggagaaccagggccagcgcagaatgtcgacaagtcaactagtctagctcggaaagttttcaggctttttaagtttgtcaatgacctgcatgctctaattagtcctcctgccaaaggaacgccacttccgctgatcttacttggaaagtcgaagaatgcaatgctgtcaactttcctcttcctggatcagattgtgtgggctgggaggacaggaatatacaagaataaggagcgagcggagttcctcagccggatagctttctattgcttcctcggttctaatacctgcacaaccattattgagcttgctgagctccaacggttatctgaatcgatgaagaagctagagaaggagctcaaacaccaagtgctgtacaagaacgagcaataccgaatgaagctgcagaagtccaacgagcggcgtctggctctgatcaagtcgagcctggacatagttgttgccgtggggctgcttcagctggcccccaaaaaggtgaccccccgcgtcactggggcgttcggctttgccagctcactgatcgcttgctaccagttgcttccgagcccacccaagagcaagtgatgcgatctgtagagggcagctggtggctccatccgctactgatggcatcgatgacgacaaataaatccggaagaaactctccgtgtagcatgtttggtagacacttgtattgttgacttggttatagtccattgtggctgattattgtacgatccaagttgtagcttgcggtgccgggacttgtcatcagttttcacgaaataagaaatggcccggaacttgtcattt

SEQ ID NO: 33301 - protein, 233 aa, Panicum virgatum
  misc_feature: Ceres CLONE 1950012
  misc_feature (11)..(226): Pfam Name: PEX11 Pfam Description: Peroxisomal biogenesis factor 11 (PEX11)
MTSLDTVRGDLALVILYLNKAEARDKICRAIQYGSKFLSNGEPGPAQNVDKSTSLARKVFRLFKFVNDLHALISPPAKGTPLPLILLGKSKNAMLSTFLFLDQIVWAGRTGIYKNKERAEFLSRIAFYCFLGSNTCTTIIELAELQRLSESMKKLEKELKHQVLYKNEQYRMKLQKSNERRLALIKSSLDIVVAVGLLQLAPKKVTPRVTGAFGFASSLIACYQLLPSPPKSK

SEQ ID NO: 33302 - DNA, 619 bp, Panicum virgatum
  misc_feature: Ceres CLONE 1950014
  misc_feature: Encodes the peptide sequence at SEQ ID NO. 33303
atcacgtttccccctggcacagccagcgcctctgtgtgtgcacggaagcaagcgcgttacagagcgcagagccaccacacccctcgatctcgcctccgccgccgcctcctttagatattgcctcatatggctcccgcggcgctgctccaccctgccctccgcaaaaaaagcgatgacgatcaacgtggatgcaacggtcaacgccatggaacctatcctgacgtgcagcgacgtgatgacgaattcctgatgtcgaacaagagtgacttgatgaacaagtattacaatcttgtaacgcgcttcactgaataccacgggggtcaatcattccatttcacccagtgatggcgtggagaaaccattcgtgaaaacatcaagaaatttgagctttttattgcccttcaattggggttcaagaaggaaatgaaggtcctggatatatgatgtacaattgggggacccttaagagaaatctccagaatcatctcaaaagaaataactgggttgaacaacaatgcttatgagatattgaggggaaatgatcgcattttctttgacaagtttgagtgaaccagtgtaactttataaagggagacttcatgaagatgccattggatga

SEQ ID NO: 33303 - protein, 72 aa, Panicum virgatum
  misc_feature: Ceres CLONE 1950014
  misc_feature: SWISSPROT Homolog: EC 2.1.1.41 Sterol 24-C-methyltransferase
MAPAALLHPALRKKSDDDQRGCNGQRHGTYPDVQRRDDEFLMSNKSDLMNKYYNLVTRFTEYHGGQSFHFTQ

SEQ ID NO: 33304 - DNA, 475 bp, Panicum virgatum
  misc_feature: Ceres CLONE 1950014-R
  misc_feature: Encodes the peptide sequence at SEQ ID NO. 33305
gcgatgcgtactaccttcctgactggtgctcaccctcagactatgtgagcatcgccaagtctctgtctctcgaggatgtcaagacagccgattggtcggagaacgtggccccattctggccggccgtgataaaatcagcactgacatggaagggcatcacctctctcctgacaagcgggtggaagacgatcagaggggcgatggtgatgccgctgatgatccagggctacaagaaggggctcatcaagttcaccatcatcacctgtcgcaagcccggaggagcgtaggaggtcaagttaccgtcgcggcgcctctgttcggcgcaataacgtagaaccaaatacctaccaatggcgagctagaaactagaaggcgccccgtcgtcgtcttctctttctttctgtacgcgcacgcacgtttggccatgtgccccattcccaataattttctaccactcgttgagatagcagatttc

SEQ ID NO: 33305 - protein, 94 aa, Panicum virgatum
  misc_feature: Ceres CLONE 1950014-R
  misc_feature: SWISSPROT Homolog: EC 2.1.1.95 Tocopherol O-methyltransferase
  misc_feature: The sequence is a functional homolog of SEQ ID NO 22 in US patent 7226745
  misc_feature: The sequence is a functional homolog of SEQ ID NO 36 in US patent 7244877
  misc_feature: Useful for making plants with modulated nitrogen use efficiency
DAYYLPDWCSPSDYVSIAKSLSLEDVKTADWSENVAPFWPAVIKSALTWKGITSLLTSGWKTIRGAMVMPLMIQGYKKGLIKFTIITCRKPGGA

SEQ ID NO: 33306 - DNA, 894 bp, Panicum virgatum
  misc_feature: Ceres CLONE 1950023
  misc_feature: Encodes the peptide sequence at SEQ ID NO. 33307
aacctgccctctcatctcatccttgttgcccgcctaccgccgccattctgcgctgcgcctccaccgctccacgctctcccgctgctctcaccaccgtctcgcgcgaagctactgagctcaagctagagaagatgtatacggcaaggaggaagatccagaaggacaagggtgtggagccaactgagtttgaggacacagttgcccaggcgttctttgacctcgagaatgggaatcaggagcttaagagtgacttgaaggacctttacatcaatggagcagtgcagatggacatgcctggcaacaggaaggctgttatcatccatgttccatacaggctacaaaagtcttacaagaagattcatgtgaagcttattcgggagcttgagaagaagttcagtgggaaggatgttgttctggttgcgactagaagaattgtgcggcccccaaagaagggttcagctgttgttcgtccccgtagctgcactcttaccaccgttcatgatggcattttggaagatgttgtgtatccggctgagattgttgggaagcgtgttaggtaccacttggatggtgcaaaaatcatgaaggtcttcctggatccaaaggagcgtaccaacactgagtacaagcttgacactttcagctcagtctaccggaggctttgtgggaaggaggttgtgtttgactaccccatggctgagagcgcttgagcccccttgtcctttagtcagctggctattacaatatgtttcgtctatctgaaacagacattaccatatatttcatgtgtgaaatagtgttcaacatcctgggacatgccaatctcgtttcttcttaaagctgtcttggattctgcaaatgttttgcattgcagtgcattatatatctgctgat

SEQ ID NO: 33307 - protein, 192 aa, Panicum virgatum
  misc_feature: Ceres CLONE 1950023
  misc_feature (6)..(191): Pfam Name: Ribosomal_S7e Pfam Description: Ribosomal protein S7e
  misc_feature: Useful for making plants with modulated biomass
MYTARRKIQKDKGVEPTEFEDTVAQAFFDLENGNQELKSDLKDLYINGAVQMDMPGNRKAVIIHVPYRLQKSYKKIHVKLIRELEKKFSGKDVVLVATRRIVRPPKKGSAVVRPRSCTLTTVHDGILEDVVYPAEIVGKRVRYHLDGAKIMKVFLDPKERTNTEYKLDTFSSVYRRLCGKEVVFDYPMAESA

SEQ ID NO: 33308 - DNA, 513 bp, Panicum virgatum
  misc_feature: Ceres CLONE 1950042
  misc_feature: Encodes the peptide sequence at SEQ ID NO. 33309
aaaacaaaccctgaccagaacccctcgccgccgacctcagttcccgaccgccaccgtctccggcgatgtcgcacttcaggcgctccggggcgccggagaaccgcgactccttctccctcctcgtcctcaacgtctccttccgcactacggccgacgacctcttcccggtcttcgaccgctacggcgatgtcgtcgacatcttcatcccgcgcgaccgcaggactggagattcgcgtggcttcgcgttcgtgaggtacaactacgaggacgaggcgcagaaggccgtcgacgggcttgatgggaggaaggtggatgggagggtgatcatggcgcagttcgcaaagtacggacccaatgctcaaaagattcataggggtaggattacagaagaaacttcaaagccaaggggtcatttcagaagccgcagtccgagatggaggtatcaaaatgattatcgggacagagattatagaaagcaaagccggagcagaagtagggagaggtatgaacagg

SEQ ID NO: 33309 - protein, 149 aa, Panicum virgatum
  misc_feature: Ceres CLONE 1950042
  misc_feature (18)..(89): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MSHFRRSGAPENRDSFSLLVLNVSFRTTADDLFPVFDRYGDVVDIFIPRDRRTGDSRGFAFVRYNYEDEAQKAVDGLDGRKVDGRVIMAQFAKYGPNAQKIHRGRITEETSKPRGHFRSRSPRWRYQNDYRDRDYRKQSRSRSRERYEQ

SEQ ID NO: 33310 - DNA, 136 bp, Panicum virgatum
  misc_feature: Ceres CLONE 1950042-R
ccccttttggaactccatccatatttagatattgtcatctcaatacggtttcttactgtagcctgtgacctgtatatttctagttacttgatggaacgaagaggggtttttttggataaaggtcaggatgcaagtt

SEQ ID NO: 33311 - DNA, 1282 bp, Panicum virgatum
  misc_feature: Ceres CLONE 1950087
  misc_feature: Encodes the peptide sequence at SEQ ID NO. 33312
atcccgtggtcgccgccgcatccaaagccactcccaaacccccgcttcccgtaccttctcgaagctccccgtggccgcctccacccgctccgatggccaaggaaccgatgcgcgtgctcgtcactggcgccgcaggacaaatcggatatgcgcttgttcccatgattgctagaggagttatgcttggtacagaccagcctgttattctgcacatgctcgacattccgccagcggctgaagctcttaatggtgttaagatggagttggttgatgctgcatttcctcttcttaagggtgttgttgcaacaactgatgttgtggaggcttgcactggtgtgaatgttgcggtcatggttggtggattccccaggaaggagggaatggaaaggaaggatgttatgtcaaaaaatgtttcaatctacaaagctcaagcatctgcccttgaagcccatgctgcccccaactgcaaggttctggttgttgccaacccagcaaataccaatgctcttatcttgaaagaatttgctccatctatccctgagaggaatgttacttgcttgacccgcctggaccacaacagggctcttggccagatttctgagagacttaatgttcaagtcagtgacgtgaagaatgttattatttggggtaaccactcgtccactcagtaccctgatgttaaccatgccacagtgaagacttccagtggagagaagcctgtttgtgagcttgttgctgatgatgcatggcttaatggggaattcatcacaaccgtccagcagcgtggtgctgcaatcatcaaggcgagaaagctctccagtgctctttctgctgccagctctgcttgtgaccacattcgtgattgggttcttggaacccctgagggaacatttgtttccatgggtgtgtactccgatggttcgtacggtgtgcctgctggactgatctactcattcccagtaacgtgcagtggtggtgaatggaaaatcgttcaaggccttcccatagacgagttctcgaggaagaagatggacgcgactgcccaggagctgtcagaggagaaggcgcttgcttactcatgcctcgagtaaactctacccatactcagagcaattgctgctcctatgttttgaataaaagaaactccagcgtcattcatagattctctcactcagaactgctgcacatctgcggtgcaggtcgctggcttcgcccagtgtgcatgaggcttgtagccctttttgccagatgatctgcaggacatttattgaaacttgcaact

SEQ ID NO: 33312 - protein, 332 aa, Panicum virgatum
  misc_feature: Ceres CLONE 1950087
  misc_feature (157)..(331): Pfam Name: Ldh_1_C Pfam Description: lactate/malate dehydrogenase, alpha/beta C-terminal domain
  misc_feature (6)..(155): Pfam Name: Ldh_1_N Pfam Description: lactate/malate dehydrogenase, NAD binding domain
  misc_feature: SWISSPROT Homolog: EC 1.1.1.37 Malate dehydrogenase
MAKEPMRVLVTGAAGQIGYALVPMIARGVMLGTDQPVILHMLDIPPAAEALNGVKMELVDAAFPLLKGVVATTDVVEACTGVNVAVMVGGFPRKEGMERKDVMSKNVSIYKAQASALEAHAAPNCKVLVVANPANTNALILKEFAPSIPERNVTCLTRLDHNRALGQISERLNVQVSDVKNVIIWGNHSSTQYPDVNHATVKTSSGEKPVCELVADDAWLNGEFITTVQQRGAAIIKARKLSSALSAASSACDHIRDWVLGTPEGTFVSMGVYSDGSYGVPAGLIYSFPVTCSGGEWKIVQGLPIDEFSRKKMDATAQELSEEKALAYSCLE

SEQ ID NO: 33313 - DNA, 1005 bp, Panicum virgatum
  misc_feature: Ceres CLONE 1950105
  misc_feature: Encodes the peptide sequence at SEQ ID NO. 33314
atcgccacaagttcgcgatctctcgatttcacaaatcgccgagaagacccgagcagagaagttccctccgatcgccttgccaagatgcagatctttgtgaagacactcactggcaagactatcacccttgaggtggagtcttctgacacaattgacaatgtcaaggcaaagatccaggacaaggaagggattcctccagaccagcagcgccttatcttcgctggcaagcagcttgaggatggccgtacacttgcagattacaacattcagaaggagtccacactgcaccttgtcctcaggctgcgtggaggcatgcagattttcgtgaagaccctcactggcaagacgatcaccctggaggtggagtcatctgacaccatcgacaatgtgaaggcaaagatccaggacaaggagggcatcccccctgaccagcagcgcctcatctttgcaggcaagcagttggaggatgggcgaactctggctgactayaatatccagaaagaatcmaccctgcacctsgtsctccgcctgcgtggtggaatgcagatctttgtgaagacgcttaccggcaagaccatcaccttggaggtggagtcttcggacaccatcgacaatgtgaaggcgaagattcaggacaaggagggcattcctccggaccagcrgcgcctcatctttgctggcaagcagctagaggacgggcgtaccctggcggattacaacatccagaaggagtccaccctccaccttgtcctgcgcctccgtggtggtttctgagcctagtgctcctgagttgccttttgtcgttatggtcaacctctggtttaagtcgtgtgaactctctgcattgcgttgctagtgtctggttgtggttgtaataagaacatgaagaacatgttgctgtggatcacatgactttttttttttgaaccggaagatcacatgactttcatggctttaagttcctgaactctgaaatctggacccccttttaagctctgaactcat

SEQ ID NO: 33314 - protein, 229 aa, Panicum virgatum
  misc_feature: Ceres CLONE 1950105
  misc_feature (6)..(74): Pfam Name: ubiquitin Pfam Description: Ubiquitin family
  misc_feature (82)..(150): Pfam Name: ubiquitin Pfam Description: Ubiquitin family
  misc_feature (158)..(226): Pfam Name: ubiquitin Pfam Description: Ubiquitin family
  misc_feature: Useful for making plants with modulated nitrogen use efficiency
  misc_feature: Useful for making plants with modulated cold sensitivity
  misc_feature: Useful for making plants with modulated flowering time
  misc_feature (193)..(193): Xaa is any aa, unknown, or other
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQXRLIFAGKQLEDGRTLADYNIQKESTLHLVLRLRGGF

SEQ ID NO: 33315 - DNA, 1034 bp, Panicum virgatum
  misc_feature: Ceres CLONE 1950114
  misc_feature: Encodes the peptide sequence at SEQ ID NO. 33316
gaactaaactgtaccccgaacagagccgtgcgctgcacgccggcgttggtagggtcgtcgtcgtcttgccgtcgcctgagaagaatcttatccagttccaccgagttgccatgctatcgatccatgtcatagaagtatggtaacatctggtaccagagactcgatcctggcatctcacgatcaccagatgcgccttcaagtcaccatgaagacggatgaacaatttgagcgtattctcaagatgctctaagaaaacaagcaagggatggttgagatcaaggccacgatgacggagatgcgtttggcgaaggatgaattcgaagcttggaaacccgaagtcgacaagagtgttgccgatctgcagatcgccgtcaacaccctcggccaccgcttcgacaagctcttctccaacaccgtccctgcctccccgcatctggatgcacccatcactcaccctgcaccagagattgtgggatcttcaccggcgctggccactgcccatctggtggcgacctccaaggaggctgcatttgggccacatggccatcgcgtcgaaacacacaactgggggtctggatttggagtggtgtataccattcctcatccgtctccagtcatagatgatctacagattccaatgtttgtgctcgaccgtcatccgcatcgatatcaagacaagatgatcacgcaagttctggtacaatggtcacactggcctgtggaactttctacttgggaagatgaggaagcactacgccagcagtttcctcgtgctccggcttggggacaagccggttctgaagaagggaggaatgttaccgcccgtgttgtgcctagatggcgtcatcgccttcggaggcgcgcgctccaggaaggcgttttttccaaaatcagctttagaattgctgggcctgattgggtccgttaaaactcagcccttgtaatagcgtagcccatttttctttcttgattgagtgtcatgaggatataagtcttgccgtcgcctgagaagaatcttatccagttccacccgg

SEQ ID NO: 33316 - protein, 220 aa, Panicum virgatum
  misc_feature: Ceres CLONE 1950114
  misc_feature (122)..(176): Pfam Name: Chromo Pfam Description: 'chromo' (CHRromatin Organisation MOdifier) domain
MVEIKATMTEMRLAKDEFEAWKPEVDKSVADLQIAVNTLGHRFDKLFSNTVPASPHLDAPITHPAPEIVGSSPALATAHLVATSKEAAFGPHGHRVETHNWGSGFGVVYTIPHPSPVIDDLQIPMFVLDRHPHRYQDKMITQVLVQWSHWPVELSTWEDEEALRQQFPRAPAWGQAGSEEGRNVTARVVPRWRHRLRRRALQEGVFSKISFRIAGPDWVR

SEQ ID NO: 33317 - DNA, 1103 bp, Panicum virgatum
  misc_feature: Ceres CLONE 1950132
  misc_feature: Encodes the peptide sequence at SEQ ID NO. 33318
aaaaacagcctccaccgcacacactgacaggctcccgacgcgcctccgccggccgcgcgcggttgccctgccctctctccgccgctcctccaccggtttctccaaccatgtataataactatgggaaccctcctgggatgcagatgccacagcagaattctcagccgggccagtttaacaatccattatatggtgcaagctcaggtctaattagatctgggctaggagtatatggggagaagttcttggattctagttcagaattcatgcaaagcaatatcaatagatacttctccaacccgcagtattacttccatgtgaatgatcaatatgtcaggaacaagttgaaagttatattgtttccattctttcacagggggcactggactcggataagtgaacctgttggtgggcgtttgtcctacaaacctccaatctatgacataaatgcaccagatctgtacatccctttcatggcatttggaagcttcatcattcttgctggttttacattaggtttcatgggaaagtttactccagaagctataaatctgcagttttccagggcactcattggatgggccttccagctcgtgatactgaaaggtttgctctactcaatgggcggtggtgaggtgccacttctcgacttggtagcatatggtggctacttatttgccgggctatcccttgctgttgttgtaaggctcatatgggcatactcgtattacatcatgatgccatggatgagcctgtgcatgggagtgttcttggtgaggacaatgaagagggtgcttttcacagagatgagaagcagcgagaggcactcatcgcgacagcattacttccttctcttcatggcaatagcacagtttcccctgttcttctggcttggcagcataggtgcatgatacagtttcctgtttgttttagttttgcggttcacattacaagtgatatttaagtatttaaatgtgttgtaaaaatagttggagaattgatctcaacaactgaagcagtttgagcatcaacagtatgttattgaccgactgtatagatcaagagtgctgcttgtgaagttatatgtgatgcttcccagactc

SEQ ID NO: 33318 - protein, 267 aa, Panicum virgatum
  misc_feature: Ceres CLONE 1950132
  misc_feature (34)..(263): Pfam Name: YIF1 Pfam Description: YIF1
MYNNYGNPPGMQMPQQNSQPGQFNNPLYGASSGLIRSGLGVYGEKFLDSSSEFMQSNINRYFSNPQYYFHVNDQYVRNKLKVILFPFFHRGHWTRISEPVGGRLSYKPPIYDINAPDLYIPFMAFGSFIILAGFTLGFMGKFTPEAINLQFSRALIGWAFQLVILKGLLYSMGGGEVPLLDLVAYGGYLFAGLSLAVVVRLIWAYSYYIMMPWMSLCMGVFLVRTMKRVLFTEMRSSERHSSRQHYFLLFMAIAQFPLFFWLGSIGA

SEQ ID NO: 33319 - DNA, 691 bp, Panicum virgatum
  misc_feature: Ceres CLONE 1950135-R
  misc_feature: Encodes the peptide sequence at SEQ ID NO. 33320
tgttttaaaaggatattatggtgagtgtggtaaaaagaggaggctacatggagattactggcttcagtgcttccgtaagagagcaggtctacaagatagcttcggtgaacttatgctccaatatcactggtcaaatccttgccagccttatcatgaatccaccaaaggaaggggatgaatcatatgctgcctacaaggcagagaaagatggaatccttcaatctctagctcgtcgtgcaaaggcattggaggatgcattcaacaatcttgagggaatttcgtgtaacaaggctgaaggagcaatgtaccttttccctcagattcatctgccacagaaggcaattgaggctgctaaagcagctaagaaagcacctgatgcattctatgcgcttcgtctccttgaagcaactggaattgttgtggtccctggatccgggtttggccaagttcccggaacatggcatatcaggtgcacgatcctgccgcaggaagacaagatccccgccgtgatcacccgcttcaaggcgttccatgaggcgttcatggccgagtaccgcgactaagctgttacaccatgtgaatgaacatggggtcatgtaatttatttttttgtaatatcagtctgtaatttgaactcgaactctcctgcttcttcccttatatgaaagcgcagtgctcctgcaaacttttc

SEQ ID NO: 33320 - protein, 181 aa, Panicum virgatum
  misc_feature: Ceres CLONE 1950135-R
  misc_feature: SWISSPROT Homolog: EC 2.6.1.2 Alanine transaminase
  misc_feature: Useful for making plants with modulated nitrogen use efficiency
MVSVVKRGGYMEITGFSASVREQVYKIASVNLCSNITGQILASLIMNPPKEGDESYAAYKAEKDGILQSLARRAKALEDAFNNLEGISCNKAEGAMYLFPQIHLPQKAIEAAKAAKKAPDAFYALRLLEATGIVVVPGSGFGQVPGTWHIRCTILPQEDKIPAVITRFKAFHEAFMAEYRD

SEQ ID NO: 33321 - DNA, 1256 bp, Panicum virgatum
  misc_feature: Ceres CLONE 1950135
aactgctcggccacaagctcggcacatgtgagttctccccccgtcctctcctaattttctagtgtttgtactcctctcctgattccctgtgcagcccttgcaaatctcggacattatactcttctccaagaaccactccttgttcatctttttgcttgttactccttgcctaggtcagcctcccaactttgtagtgcataatgtctgtgtgcttttctgtctggttcaaagcccatacagatctaggaggcacatagcaatgggcatctgatgctcactttggccttttgagaggacgcctcatctactctacctagaagtgccccccaagcagccatagacattcaattatattaccctgctaataattttaattttttaatcgaaattgcttcatagcaagtttttagaattcaatactatttgcctttttgagtagccattataattgtacatactatcttggtttagttagaaggcacatagagatgctgttgacgaagtcaggttggctgattcagattgcagcagaattcttttattagaggtgttctttgaggagccatacattagcattttcatgcttctgtttgtttctgttgccctctgcttatcagattttctagaccggatggctttatatggatatagaacaaacactcataaggcaaattctttacaacacatgatgtgcttctcgaataaccaattgctgtgatttgtatatttgcatttggttccgacaggtgcacatagcaaatggatcttttgagggaagggatcttgttctttgttcatcccttcttagattgattccgacagtaacatctatttctatgtcagtcttttcttttcttaattttattctttttgttttgcaaggaaagcacctcttcacacttcacattccacaaaatgaaccgcgcctgccaagctgcccaaatcggcacaggaccgagaacagagcacggccgtcgctcttgcctttgacacacacattgcctttcaaaatctgtatatgaacatacattgtctttcgtaataaattcagcaaaagaggctacatgacatgagaatttggtaaattccgatttgaaacaacaaaaaatcaccttcagtcagtaacaaatatcagttgcatatcagttgttcagttcgggttgcataacatagcaacgcacaaacagcagcctactggtacgaggatctggtgagccctcctctctcctccttgtcgtgccctggttgagctcctg

SEQ ID NO: 33322 - DNA, 619 bp, Panicum virgatum
  misc_feature: Ceres CLONE 1950164
  misc_feature: Encodes the peptide sequence at SEQ ID NO. 33323
attttcactccctatccagtttatcctctccctaatggcgcttcctctgcgccccgccgctccggcgccaccgccttggcgatgctccggcttgaggtcctcgccgcacgcatccctcctggacacggcctccaagcaaacatttcctgttccattaccagctgaccgggttgcaagattttccttatctgcaaagcgttctgcatctcggcttgtccagtcaatgactgatctcaccggttttagaagtgatgggatccatgcagccaatgaacattcacgtgatctcatgaggtccatatctgatcttcaggtacgatggaagttgtattatcctcttttgggaaagcatgtattttcggtagttgcatcatatatgttctgcctcctgcttgtttagcagaaccatgcgagcaagagtactctctccctaacatgcctttgctgtttgcaatagccatggttggtgctactgttggagggctcctcgcaagacagaggagaggggagcttgcacggctgaatgatcagttacgtcagataaatgctgcactgagaagacaagccaagattgaatcttacgctcctactttgagctatgccccagttggtagtaaga

SEQ ID NO: 33323 - protein, 100 aa, Panicum virgatum
  misc_feature: Ceres CLONE 1950164
  misc_feature: Useful for biocontainment applications
  misc_feature: Useful for making plants with altered alkaloid content
  misc_feature: Useful for making plants with altered lignin content
  misc_feature: Useful for making plants with modulated biomass
MEVVLSSFGKACIFGSCIIYVLPPACLAEPCEQEYSLPNMPLLFAIAMVGATVGGLLARQRRGELARLNDQLRQINAALRRQAKIESYAPTLSYAPVGSK

SEQ ID NO: 33324 - DNA, 273 bp, Panicum virgatum
  misc_feature: Ceres CLONE 1950164-R
  misc_feature: Encodes the peptide sequence at SEQ ID NO. 33325
aggacgcgggtgtcactgaagcatatggagcaatagcagactgctacaccgagcttggtgagcttgagaaggctggcgagttctacgacaaatacattgcaaggttggagagtgactgaaaagaagagcaccgatcagaaaatatgttagagcattgacaagtctaatggaatttctaccctttttcgcttgtcatgtagtttattgtagatttgcagttcccagatcgaattgagttttattaccaccaagcaaattctttttggcaggatt

SEQ ID NO: 33325 - protein, 38 aa, Panicum virgatum
  misc_feature: Ceres CLONE 1950164-R
  misc_feature: Useful for biocontainment applications
  misc_feature: Useful for making plants with altered alkaloid content
  misc_feature: Useful for making plants with altered lignin content
  misc_feature: Useful for making plants with modulated biomass
DAGVTEAYGAIADCYTELGELEKAGEFYDKYIARLESD

SEQ ID NO: 33326 - DNA, 1055 bp, Panicum virgatum
  misc_feature: Ceres CLONE 1950171
  misc_feature: Encodes the peptide sequence at SEQ ID NO. 33327
atcaagtgatcattcgcacttgcaaccttgcattgcattactagtagagagagatggccagagaaatggagaaggcaaggaaggccactacttcccctaagatctcaacgatgaatgctggtccaaagagcccagtaaggaatggaggaggtaattctccgcctcctaagaagaacacctctgagccacgaggacggaaaaatgagcagcaaatcgttcggaaaggaggtcaagaccatgatgagggcaaacgccgatctccaacttcacaaacctcgcccaagagatcaccaagactcgatcaacccctgagctactgtaggcttcatactgaggagagagcaataaggcgagccggttacaattatcaggttgcgagcaagataaatacacagcaaatcattcggagatttgaagagaagttagcacagttgatggaggagcacgaaataaagctgatgaggaaggagatggttcctaaggcccagctcatgccagcgtttgacaaaccattccacccacaaaggtctactaggccgctgacagtcccaaaggagccgagcttcctgaagctgagatgctgcatcggcggagagttccatcgccatttttgcttcaacgggtcatcagccaaggccatcaagtagagtagtagtccatctgcatgcgcctacaaccacaagattgatcaagtatttttgccgttgcacaatgaacatacatacgttttccaatcgacacacacgcatatatacgaaagaactggttgctgatcgatgtaaatttccccggccttagtagcttgcccctttaactttttctcccctttatcttttgtatatttcctgtcatcttttttcttttcttttcttttcttcctcctcttcttcttttattttgtcctcctcgatgtgatccacactgaaagctaggtaggaacgaaaccatgcatgcaaaaggggccatccgagatgatccggacgatgccctgcatgcgccatgtacgccctgtcgatctgatggcagtaataaagcaaggttgcatacagagtgcc

SEQ ID NO: 33327 - protein, 197 aa, Panicum virgatum
  misc_feature: Ceres CLONE 1950171
  misc_feature (91)..(147): Pfam Name: TPX2 Pfam Description: Targeting protein for Xklp2 (TPX2)
MAREMEKARKATTSPKISTMNAGPKSPVRNGGGNSPPPKKNTSEPRGRKNEQQIVRKGGQDHDEGKRRSPTSQTSPKRSPRLDQPLSYCRLHTEERAIRRAGYNYQVASKINTQQIIRRFEEKLAQLMEEHEIKLMRKEMVPKAQLMPAFDKPFHPQRSTRPLTVPKEPSFLKLRCCIGGEFHRHFCFNGSSAKAIK

SEQ ID NO: 33328 - DNA, 1070 bp, Panicum virgatum
  misc_feature: Ceres CLONE 1950183
  misc_feature: Encodes the peptide sequence at SEQ ID NO. 33329
cttcacttccgagcgatctctctctcctgctctccggcggaagcaccaacacccaccgatccgaatccgatcccttgggccctccgtccgaagcaggaacgcccacagatacgatcgatccgagcaatagccagcttcaattccacagttgacttcagaatgcaggtctttgtgaggagccccacaggcaagacaatctgtctcagggtccaaccatcagataccttgcatagtgttaagacaaaaattctggaacaacaccgccttgtctttgatggaaggcagctagatgataatcttacattggctgactataacatccagcataaatccactcttgacctccaagaaaagatgcagatctatctaatggatacactagtaggaatgagcatcactcttgaggttaacagctttgatactattgccaatgtgaaggccaagattgaatgtagtgagggatttcccaagggtcagcagtgtctcatctttggcaacaaacaattggaggacaacgacaccttggtgcaccacaacatttgcaatgagtccacccttctccttgtcctccacccacttccaaaaggtacgatgaagattttcgtgataaagctaactggaattaccctcactcttgaggttgacagcttggatactatcggcgatgtcaagatgcggatctatgagaaggatggtactcctcccagccagcaacgcatcatctatgccggcaggcaactggaggacagccgcaccctggctgactataatgtacagaaagagtctaccgttcacttggtgctccgccttgctggttcttgagatggatgacatgcatggtcactcaacaacaagtctcttgctgcagtcttattttttttccatgctagtagacaatagttgtgtgtcagtaaagctatcactgtactgtggtcttgttcattcaagttgctgtgtgtttatcagtaaaactttcgttacgttaatgtgtgaaatcatcaagagtagtcctcgtactcttggtctgtcttgacatcttgattgagcaatatagatgatcttgctagatc

SEQ ID NO: 33329 - protein, 220 aa, Panicum virgatum
  misc_feature: Ceres CLONE 1950183
  misc_feature (150)..(218): Pfam Name: ubiquitin Pfam Description: Ubiquitin family
  misc_feature (73)..(140): Pfam Name: ubiquitin Pfam Description: Ubiquitin family
  misc_feature (6)..(67): Pfam Name: ubiquitin Pfam Description: Ubiquitin family
  misc_feature: Useful for making plants with modulated nitrogen use efficiency
  misc_feature: Useful for making plants with modulated cold sensitivity
MQVFVRSPTGKTICLRVQPSDTLHSVKTKILEQHRLVFDGRQLDDNLTLADYNIQHKSTLDLQEKMQIYLMDTLVGMSITLEVNSFDTIANVKAKIECSEGFPKGQQCLIFGNKQLEDNDTLVHHNICNESTLLLVLHPLPKGTMKIFVIKLTGITLTLEVDSLDTIGDVKMRIYEKDGTPPSQQRIIYAGRQLEDSRTLADYNVQKESTVHLVLRLAGS

SEQ ID NO: 33330 - DNA, 735 bp, Panicum virgatum
  misc_feature: Ceres CLONE 1950192
  misc_feature: Encodes the peptide sequence at SEQ ID NO. 33331
ctgccggccgagtagagtgcgacctcagatcaggtgttgctcaggtgatgatgcaaagggacgtgcggacatgtgcaagggaggcaaggatgaagaaactagaccttcaagacgaaagtgtcttgtctgcctaggtgctgtagccctaatcagtgcaacaggcccaacgatttgtacaccaaatgtaatcgccgcagatatgacaaacaagtctgggatacagaaagctgtttgcagaaattgcaacggcagcggtgctgtgatatgtgacatgtgcggtggcacaggaaaatggaaggcgctcaacaggaagagggcaaaagatgtttatgaattcacagagtgtccgaattgctatggccgagggaagctggtctgcccagtctgtcttggaactgggctgccgaacaacaagggactcctccggcgaccagaagccaagcagttgcttgacaagatgtacaacggcaagatattgccaaggtcgtagagcgcacaggcaggcagccacaggattttgcatcaaccatcgtgtaggaatatcattcgagacaaatgtagctctcaagagtgtaactttgtgtaccaagttaaaaagttacagcttggattttagctttcagattaccacagatatgttgactaagtagccttctgaatgtcatttccaaatacattattgcacaaatatagtgattttaaatcgttcgcggtgcaccagagcatcaccaccat

SEQ ID NO: 33331 - protein, 162 aa, Panicum virgatum
  misc_feature: Ceres CLONE 1950192
  misc_feature (67)..(140): Pfam Name: DnaJ_CXXCXGXG Pfam Description: DnaJ central domain (4 repeats)
CRPSRVRPQIRCCSGDDAKGRADMCKGGKDEETRPSRRKCLVCLGAVALISATGPTICTPNVIAADMTNKSGIQKAVCRNCNGSGAVICDMCGGTGKWKALNRKRAKDVYEFTECPNCYGRGKLVCPVCLGTGLPNNKGLLRRPEAKQLLDKMYNGKILPRS

SEQ ID NO: 33332 - DNA, 1331 bp, Panicum virgatum
  misc_feature: Ceres CLONE 1950206
  misc_feature: Encodes the peptide sequence at SEQ ID NO. 33333
ggactcgagactttcaggtcacatctcctccctcttttttttttttttttttgcgagggacatctcctccctctgtttctcccttctctcggactctctccctggctctttcttccctgtcggcgacgactgggcgagcggcggcgccgtttgtcacgtcttcgccaagccttttgccggcgacgagcatcccccaggctgagataagttgaagcaaagttcaaggcaaaatgttttacggtggatatgcgtaccatggcaatacgtttgagcaaacgtaccgttgttatccagcatccttctttgataagccacacctggaaggtggtgacaaagtaataatgccaccatctgcccttgattgcctggcttccctccacatcgagtacccaatgctatttgaactgcacaatgatgcaactcaacggatttcacactctggtgttttggagtttgtggcagaagaaggcatgatcatcatgccctactggatgatgcaaaacatgcttcttcaagagggtgacactgtccgtgtgaaaaacgccacacttcccaagggtacatatgtgaagttgcaacctcacacaactgattttctggacatctcgaatccaaaagccatcctggagaaaactctgagaaatttctcctgtttaactacgggagacagcatcatggtggcttacaacaacaaacagtattatattgatattgttgaaacaaagcctgcttcagctgttagcattattgagacagactgtgaagtggattttgctcctccccttgactacaaagaacctgagaaaccacagcagcccacagttcctgccagcaaggcaactgctgaaggtggagatactgtagtcgaagatgaaccaaaattcaaaccatttactggttccggaaagcggttggatggtaaagcctcaaaactacaagcatccgaggttccatccagtgcaagttctgttccctcagattcaaacaaaagatcaaatcagcaagcatctgcacccgcaacttctggagctagcaattccactcgtcagaaaacaggaaagcttttttttggttcaagtgcaagcaacaataaagaaccacaaaaggctcctgctaaagaggaggaacccccgaagaaggacgagcccaagttccaagcttttagtgggaagagctactccttgaaacgttagctgcccattactggagtttagcgtatcatgttcagtggtagctgtagaccactgtgtcttaagtgtccaccagcatgtagatataatttgaattatgtaaatgtttatcttcatggaaatatggccatctttctattc

SEQ ID NO: 33333 - protein, 320 aa, Panicum virgatum
  misc_feature: Ceres CLONE 1950206
  misc_feature (10)..(184): Pfam Name: UFD1 Pfam Description: Ubiquitin fusion degradation protein UFD1
MFYGGYAYHGNTFEQTYRCYPASFFDKPHLEGGDKVIMPPSALDCLASLHIEYPMLFELHNDATQRISHSGVLEFVAEEGMIIMPYWMMQNMLLQEGDTVRVKNATLPKGTYVKLQPHTTDFLDISNPKAILEKTLRNFSCLTTGDSIMVAYNNKQYYIDIVETKPASAVSIIETDCEVDFAPPLDYKEPEKPQQPTVPASKATAEGGDTVVEDEPKFKPFTGSGKRLDGKASKLQASEVPSSASSVPSDSNKRSNQQASAPATSGASNSTRQKTGKLFFGSSASNNKEPQKAPAKEEEPPKKDEPKFQAFSGKSYSLKR

SEQ ID NO: 33334 - DNA, 985 bp, Panicum virgatum
  misc_feature: Ceres CLONE 1950211
  misc_feature: Encodes the peptide sequence at SEQ ID NO. 33335
attccagtcctcaatccgtcgagaaattctcgcgagcgatcgaaatctaagcgaagcgaagaggcctccccagatcctctcaagatgcagatctttgaagaccctcaccggcaagaccatcaccttggaggtggagtcatctgacaccattgacaatgtgaaggccaagatccaggacaaggagggcatccccccggaccagcagcgtctgatcttcgctggcaagcagctggaggatggccgcaccctggcggactacaacatccagaaagagtccaccctccacctggtgctccgcctgcgtggtggtatgcagatctttgtgaagaccctcaccggcaaaactatcaccttggaggtggagtcttctgacaccatcgacaatgtgaaggcgaaaatccaggacaaggagggcatccccccrgaccagcagcgtctgatcttcgctggcaagcagctggaggatggccgcaccctggcggactacaacatccagaaggagtccaccctccacctggtgctccgcctgcgtggtggtatgcagatctttgtgaagaccctcaccggcaagaccatcaccttggaggtggagtcttctgacaccatcgacaacgtgaaggcgaagatccaggacaaggagggcatcccgccgggccagcagcgtctgatcttcgccggcaagcagctggaggatggccgcaccctggcagactacaacatccagaaggagtccaccctccacctggtgctccgtctccgtggtggacagtaagtccatggagctgctgttgtccctgggttcacaagtctggtgccttgccttgtctctccaatggtgattgcctgcgtgtccttgtcatgcctgtctgatgtgagttttatgtcatctggttgtgttttgtgaacacttaactgctgctgtgcagcagtttggttgaactatgtaatgaataagtgagccctgaagttactatggtaatcttgt

SEQ ID NO: 33335 - protein, 256 aa, Panicum virgatum
  misc_feature: Ceres CLONE 1950211
  misc_feature (33)..(101): Pfam Name: ubiquitin Pfam Description: Ubiquitin family
  misc_feature (109)..(177): Pfam Name: ubiquitin Pfam Description: Ubiquitin family
  misc_feature (185)..(253): Pfam Name: ubiquitin Pfam Description: Ubiquitin family
  misc_feature: Useful for making plants with modulated nitrogen use efficiency
  misc_feature: Useful for making plants with modulated cold sensitivity
  misc_feature: Useful for making plants with modulated flowering time
FQSSIRREILASDRNLSEAKRPPQILSRCRSLKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPGQQRLIFAGKQLEDGRTLADYNIQKESTLHLVLRLRGGQ

SEQ ID NO: 33336 - DNA, 656 bp, Panicum virgatum
  misc_feature: Ceres CLONE 1950215
  misc_feature: Encodes the peptide sequence at SEQ ID NO. 33337
aatcccatcccgctctttccgatccactgcgcaggtcgtcgttgccctccacgccgtcatgccccgaggctgggaccttcaaagagcaataggactcatggaggctggagacgcaggaaacggttctgcagcagtggcacagataaagggaagtggggatgatgcctcctgcaaaccgctgcctccttgctgcgtcaaggccaaggcaggcgtgcctgaatctgaggccaagtgccatgataccgtggtttctggctggttcaccgaaccccggtcacgctttggtaaaacaagcaaagtgcagtactacaacaaccctatgtggcctggagaggctcattcactgaaagtggagaagattttgtaccaagggaaatcgccttaccaagagattttagttttcgagtcttcaacctatggaaacgttcttgtgcttgatggtatagttcagttgactgacaaggatgaatgcgcataccaggaaatggttactcaccttccactgtgctcaattccatcaccgaaaaatgttttggttgttggaggtggtgatggtggtgtactgcgggaaatagccagacatgattcagtggagactattgatatatgtgagattgatcagcttgttattgatgtttgcaaagaattctttccaa

SEQ ID NO: 33337 - protein, 186 aa, Panicum virgatum
  misc_feature: Ceres CLONE 1950215
  misc_feature (53)..(186): Pfam Name: Spermine_synth Pfam Description: Spermine/spermidine synthase
  misc_feature: SWISSPROT Homolog: EC 2.5.1.16 Spermidine synthase
MEAGDAGNGSAAVAQIKGSGDDASCKPLPPCCVKAKAGVPESEAKCHDTVVSGWFTEPRSRFGKTSKVQYYNNPMWPGEAHSLKVEKILYQGKSPYQEILVFESSTYGNVLVLDGIVQLTDKDECAYQEMVTHLPLCSIPSPKNVLVVGGGDGGVLREIARHDSVETIDICEIDQLVIDVCKEFFP

SEQ ID NO: 33338 - DNA, 517 bp, Panicum virgatum
  misc_feature: Ceres CLONE 1950215-R
  misc_feature: Encodes the peptide sequence at SEQ ID NO. 33339
cccaattgagaagatacaaggagctacaaaagctggaaaggagctcagattttacaattcagagattcatagggctgcttttgttctgccaacatttgtaagaagagaactggaatcatatactgctactaagacttctactgaaaaggagaaaccaaaagaatcagtttcaaaatcgcagaagataaagattttgccgaacaatgccattcttacagcttcctaggcttgaatcatactcgatctacctctgagttctgatgtatccaagccggagtcgtgtatagttgtattcttacagagaaaaaccagttggtgagatgttagtgacgtggcgccaggagcataagtatatactgggtttgtgagtgatgactgattgaataatgggggaattgaattgctgtgatgcctactggaataatgtgttcccctctgtttctgttgtttggtgtgcataatttcccaacttggaacttgtaagacctgttgatgtaatatagtccttgtttgcatc

SEQ ID NO: 33339 - protein, 74 aa, Panicum virgatum
  misc_feature: Ceres CLONE 1950215-R
  misc_feature: SWISSPROT Homolog: EC 2.5.1.16 Spermidine synthase
PIEKIQGATKAGKELRFYNSEIHRAAFVLPTFVRRELESYTATKTSTEKEKPKESVSKSQKIKILPNNAILTAS

SEQ ID NO: 33340 - DNA, 1049 bp, Panicum virgatum
  misc_feature: Ceres CLONE 1950218
  misc_feature: Encodes the peptide sequence at SEQ ID NO. 33341
gaggaagctgctccagaactggcttcattgaagaaggcctcggttgacacttgacaccaggaagatgggctcgttagatgccacacgagcggaactcggcctcgttgttctgtacctgaacaaagccgaggctagggacaagatctgcagggcgattcagtatggctcaaagttcataagcaacgggcagcccggcaccgcgcaggatgtcgatagatcgaccaccttggctcgaaaagttttccgtctcctcaagtgggtcaatgatcttcatgctcttatcagcccgcctgctaaagggactcctctcacacttgtccttcttggcaagtccaaaaacgcgctgctttcgacgttcttattcctggatcaatttgtgtggttaggacgaacaggaataatcaagaacaaggaggcgacggaccgggttgccaggatatccctctactgttggatggcttcttctgcctgcgctagtctagtggagcttggagagcttaagaggctatcgaaatcgatgaggaagcttgcaagagagctgaggcacactgataaatacgagaacgaacagtaccagaacaaaatgaagcagtcggatgagcggctcctggccctggtgaaggcggccatggacgtggtcgtggccatcgggcttcttcagctggcacccaagaaggtcacccccagagtgacgggagctctcggattcgtcacctcgctcatctcctgctatcagcaactcccttcccgtggccccgtggccaaagtcaaggcgtgagatgggtccgggtcctccctactatggaagtagccgtcgctggaaattgaggtagctatacttgagcatgcatggaccacgtggctcctacatctgcgctggctttcttcaaataaaaaacatctgcgctggccatggctgctccgatccgagcaggggttttgattcatttcatgcagaataatggagctcacatgtaccagggcgttgtacgttgtcaaatcatcgatcaaacatggcgtctgatatctgaagtagtacatgcgagagc

SEQ ID NO: 33341 - protein, 237 aa, Panicum virgatum; identical to SEQ ID NO: 33252
  misc_feature: Ceres CLONE 1950218
  misc_feature (11)..(226): Pfam Name: PEX11 Pfam Description: Peroxisomal biogenesis factor 11 (PEX11)

SEQ ID NO: 33342 - DNA, 631 bp, Panicum virgatum
  misc_feature: Ceres CLONE 1950234
  misc_feature: Encodes the peptide sequence at SEQ ID NO. 33343
aaatagactcggagaaacaagcatacacatggctacttccgttgctacgaccattccagctcctgtgtttcaccccacagtatggggggattactttatcaattttaccccagagccattgcagatctcagatgaaaagatggcagaaagaatcaaccaattaaaggaagacgtaagtggtatgttccaggctgccaagaataatgtcgtggagacaatgaacctagtagatgtggttcaacgtcttggaatagatcatcattttgaggagcagatagccactgccttagctcgccttcatagtgctgacttcaatagctcaagcctacatgaagttgctcttcggtttcgcctgcttaggcagcaagggttttgggtttctccagatgaatttaacaagttcaaaaatgaagatgggagctttatcagtggtatagagaatgacccaaagggcttgttgagtttatacaatgcagctcaccttcttactcatgatgaggggacacttgaagacgctatcttattttcaaggagacatctggaatcaatacagagtagtctcaagccccctttagctgatcaagttggccgtgcccttcaaataccatttaccaaggaccttaaagaggga

SEQ ID NO: 33343 - protein, 200 aa, Panicum virgatum
  misc_feature: Ceres CLONE 1950234
  misc_feature (19)..(199): Pfam Name: Terpene_synth Pfam Description: Terpene synthase, N-terminal domain
  misc_feature: SWISSPROT Homolog: EC 4.2.3.9 Aristolochene synthase
MATSVATTIPAPVFHPTVWGDYFINFTPEPLQISDEKMAERINQLKEDVSGMFQAAKNNVVETMNLVDVVQRLGIDHHFEEQIATALARLHSADFNSSSLHEVALRFRLLRQQGFWVSPDEFNKFKNEDGSFISGIENDPKGLLSLYNAAHLLTHDEGTLEDAILFSRRHLESIQSSLKPPLADQVGRALQIPFTKDLKE

SEQ ID NO: 33344 - DNA, 363 bp, Panicum virgatum
  misc_feature: Ceres CLONE 1950234-R
  misc_feature: Encodes the peptide sequence at SEQ ID NO. 33345
cagggatgacatgtcagcgttcaagaatggtaggaacaaattggatgtacccagtactgtggagtgctacatcaaggagcacaacgtctcaagtgatgttgccttgaccaagataagctcatttgttgaagatgcatggaaaaccataaatcaagcaccttttaagtatcctgccctacttccggttgtgcgaagagtcgccaggctagcaaagagcatgacacttttgttccttgacaagagagatgcatacacatacagcaaggacttcaaaaagacattggagagccatttcgtcaagcatatttgatataatattagcaaagaatacgtcaacaacaaagatatatatttttggcagcg

SEQ ID NO: 33345 - protein, 102 aa, Panicum virgatum
  misc_feature: Ceres CLONE 1950234-R
  misc_feature: SWISSPROT Homolog: EC 4.2.3.13 (+)-delta-cadinene synthase
RDDMSAFKNGRNKLDVPSTVECYIKEHNVSSDVALTKISSFVEDAWKTINQAPFKYPALLPVVRRVARLAKSMTLLFLDKRDAYTYSKDFKKTLESHFVKHI

SEQ ID NO: 33346 - DNA, 616 bp, Panicum virgatum
  misc_feature: Ceres CLONE 1950237
  misc_feature: Encodes the peptide sequence at SEQ ID NO. 33347
tctccgttctccccacctcccgcgaaagcagcagcagcagccatggccgcctcccgcgacctcctcgacgtcgacccgccggagcttcagttcccgttcgtgctctacaagcagatctcttgccccctgcggctcaccaacaggacagacagtaccgtcgcctttaaggtcaagacgacgagccccaggaagtactgcgtgcggcctaacgatggcgtcgtacccccacggtcctcctgcacagttgtagttacgatgcaagcgcagaaggtggtgcctcccgatttgcagtgcaaggacaaattcttggtgcagagcgtgattgtcagtgacggcttttcagccaaggacataacctcgcagatgttcgtgagagaagggggtaatgtggttgaggaggtgaagctgaaggttgcttatgtgatgccacctgaaccacaatcagagattgcagaagagcacgatggtttagagagaattttagtgcctatgcagcggaatgtggacaatggaaggagtacttcaggtgtgtcgagtggctctgcatctttgagatcagctgaggaggtgggatcacctgttgggcgaattgtgaagagtgaggaaatccctgaag

SEQ ID NO: 33347 - protein, 191 aa, Panicum virgatum
  misc_feature: Ceres CLONE 1950237
  misc_feature (7)..(108): Pfam Name: Motile_Sperm Pfam Description: MSP (Major sperm protein) domain
MAASRDLLDVDPPELQFPFVLYKQISCPLRLTNRTDSTVAFKVKTTSPRKYCVRPNDGVVPPRSSCTVVVTMQAQKVVPPDLQCKDKFLVQSVIVSDGFSAKDITSQMFVREGGNVVEEVKLKVAYVMPPEPQSEIAEEHDGLERILVPMQRNVDNGRSTSGVSSGSASLRSAEEVGSPVGRIVKSEEIPE

SEQ ID NO: 33348 - DNA, 423 bp, Panicum virgatum
  misc_feature: Ceres CLONE 1950237-R
ctgcacttgagcaaaataggaagtttcgagatgaattggaacttgtaaggcgtgaagccagtaaccagcagggcagcttctcgctggttctcataatagctatcgggctcctgtgcatcatactgggttatcttgtaaataaatgagaatttcatagcctaattgggtgctagttatggtaaataaaaggtaacatatcatgtgattcttagattcgtcgaccagctgccaatgctacgagccgtgcaacagcacgagcgtcaaattgacaaaagtgggttgtgtaatggcatctagtttgatccttgatgtattttaactaatcactgtaaaagtgattgctcttattatgtttgattcctgtatcaatcccattcaatttatcacctacattgtggataaatcttacagctacaatttatt

SEQ ID NO: 33349 - DNA, 1353 bp, Panicum virgatum
  misc_feature: Ceres CLONE 1950241
  misc_feature: Encodes the peptide sequence at SEQ ID NO. 33350
atccagatccaggtacgcatctctccttccttccttcccccgttggatggcgtcctcatctgcccccgacgacggacgccattggccttgagtggagatccgggcgcggttttaatcacaaagcgcaatggaccttccagtagcggatcctggaacagagagaggcgaagggccgctcattcaatgtccgtactgcgattcagaggcaatgcacaaactggcacagctcctgctccctggcctggctgcagtctgcgttgatggcacgacaggtgatctgttcagaaagccctccgttgtcgcggttgagttgaggaaggagatggtggactacatcacgcagaggagcgatactttcattgccgatgctctgatcgagtccgaagcgaatcaggaacccgagaatgagatgccggaggacccttttgaaatcgtttcaatttttatggatgatttcagcagcaccaagaggaatatcatcggccatgtctctgggtggctgctgagcgacaaccgtgaggataagattgatgactttgtccaggagatggagatgacccgcttctggcctctagataggagggaagccatcgccgaggtcctcctcaagaatgtcgacatcaagaccaagttccactgccctgagaagtatgaaaatgaggagcggctggctgatcacaaggaacaatgtagcttcagacctgttacttgcccaaatgacggatgccgagccaaagtttctgtccgctgcatggatgctcatgatgctgcttgcccgttcaaggtccttcagtgcgagcagaactgtgacaagcgcctcctgaggcgtgatatggataggcactgtgtcactgtctgcccaatgaggcccatgaagtgccccttcggctgcgattcctcattcgctgagcgcgatcttgagaagcactgcttggagtttcttcaggcacatttgcttaaggtccttaaggtgattcacaagaaagggcgttccgaagaagaacttaaggaacttgctcagaagctagaaaagtatgatgaacatggtaagctggctaaagctcaggatgcaagacctcttactaatgctgtgaaggaccttgaagcaaagatgaaaggtgaaccgtcgagttaaaggggtcttttatacagccaaatctcacaagatggataatgacatggattagttgaagagtttgttcctacgtacagcatacagagaagaatataagttctgttttatttttttgcttctttctctcccttcataatcaaatcaatttgtcagtattatattgtactattgctatgcgcctgcaattttgtacgagtatattgtttgttttggtatac

SEQ ID NO: 33350 - protein, 335 aa, Panicum virgatum
  misc_feature: Ceres CLONE 1950241
  misc_feature (212)..(267): Pfam Name: zf-TRAF Pfam Description: TRAF-type zinc finger
MDLPVADPGTERGEGPLIQCPYCDSEAMHKLAQLLLPGLAAVCVDGTTGDLFRKPSVVAVELRKEMVDYITQRSDTFIADALIESEANQEPENEMPEDPFEIVSIFMDDFSSTKRNIIGHVSGWLLSDNREDKIDDFVQEMEMTRFWPLDRREAIAEVLLKNVDIKTKFHCPEKYENEERLADHKEQCSFRPVTCPNDGCRAKVSVRCMDAHDAACPFKVLQCEQNCDKRLLRRDMDRHCVTVCPMRPMKCPFGCDSSFAERDLEKHCLEFLQAHLLKVLKVIHKKGRSEEELKELAQKLEKYDEHGKLAKAQDARPLTNAVKDLEAKMKGEPSS

SEQ ID NO: 33351 - DNA, 1069 bp, Panicum virgatum
  misc_feature: Ceres CLONE 1950259
  misc_feature: Encodes the peptide sequence at SEQ ID NO. 33352
aacggataacgctcttctccctcacctcgctcctctcctctccccttccctccccgcccatggcgaccgccatttcctccctgattacccctccggccctccacctccgctgccggagtactgcatcggcctccgtctctgtatctgcccgcctctccttccgtgcagtggcggcgccgcaggcccggggccgggggttggcgctgcgggtagccgcctcctcggcggtgttcgaggcgccggcggaggtggcggcgcggaagctctacgtcgggaacatcccccggactgtcaccaacgacgagctccgcgagatgtttgccgcgcacggcaccgtcgagcgggcagaggttatgtacgataagtacaccaatcggagccggcgctttggatttgtcaccatgagcactgctgaagaggccaatgctgcaattgaggctctcaacgggactgaggttggtggtagaaaaattaaagtgaatgtcacagagagtttcttgccaaacattgatcggtcagcaccagaaccggagcctgtatttgtggatagtcagtacaaggtttatgttggtaaccttgcgaagactgtgacaacggaagttcttaaaaatttcttctctgaaaagggccagatcctcagcgccacggtttcccacattcccgggacatcaaaatccaagggatacggctttgtcaccttctcttccgaggaagaagttgaagctgctgttgctactttcaataatgtggaattggaaggacaacccattcgtgtgaatagagcttagattagcaggaatttgcaggagcagtgaaggcggggggaacatctcggcaaatacatgtagaatgagggatacttggaggttagattttgataacagtgatcaagaccttcaatgtaatttcaatctgtcaaacaattttcgtaccgtaacagtgtatgtgaaggattttgcttgtcaaagtcattgttcatatgatcacagtttttcttatagtcacttccacatgattacaaaaaggaagaatggttttgtttttgtcatataccatctttgtatacttc

SEQ ID NO: 33352 - protein, 242 aa, Panicum virgatum
  misc_feature: Ceres CLONE 1950259
  misc_feature (69)..(140): Pfam Name: RRM_1 Pfam Description: RNA recognition motif. (a.k.a. RRM, RBD, or RNP domain)
  misc_feature (168)..(239): Pfam Name: RRM_1 Pfam Description: RNA recognition motif. (a.k.a. RRM, RBD, or RNP domain)
  misc_feature: Useful for making plants with altered alkaloid content
MATAISSLITPPALHLRCRSTASASVSVSARLSFRAVAAPQARGRGLALRVAASSAVFEAPAEVAARKLYVGNIPRTVTNDELREMFAAHGTVERAEVMYDKYTNRSRRFGFVTMSTAEEANAAIEALNGTEVGGRKIKVNVTESFLPNIDRSAPEPEPVFVDSQYKVYVGNLAKTVTTEVLKNFFSEKGQILSATVSHIPGTSKSKGYGFVTFSSEEEVEAAVATFNNVELEGQPIRVNRA

SEQ ID NO: 33353 - DNA, 997 bp, Panicum virgatum
  misc_feature: Ceres CLONE 1950280
  misc_feature: Encodes the peptide sequence at SEQ ID NO. 33354
gatccccacaaaggcagagccccaaccccaatcggagaagacttcccaatcccacccgcagaggaccaggaggagccatccctcaaccgcagtcgccggatcggaggacgccaaccactcgtcgccggacttcctccccgcccgccggtcaccatgagcttcatcttcggcaagaagaagaccccagccgagctgctgcgggagaataagcggatgctggagaagtccatcagggatattgagagggagaggcagggcctgcagaaccaggagaggaagctcatcaacgagatcaagaaggtggccaagcagggacagatgggagctgtaaaaatcatggcgaaggaccttatccgcacaaggcaccagataacaaaattttatgccctgaaatcccagctacaaggtgtatctcttcgcattcagacactgaaatcaacacaagcaatgggtgaagctatgaagggtgtcacaaaagctatgggacgaatgaacaggcagatgaatctgcctgctctgcagaagataatgcgggagttcgagatgcaaaatgagaagatggagatggttagtgaagtgatgaacgatgccatcgatgatgcattggagggcgacgaggaggaggaagagacagaagagctagtcaaccaagtcctcgatgaaattggcattgatgtcaactccgagcttgtcaaggctcctgccactgcagttgctcaacctgtcgcagcaggaaaagttccggctcaagctgaagccgcaggtggggtggatggtggaatagatgatgacttgcaggcacggcttgataacctgaggaagatgtgatgattggagtctgacagaattattcacacgctttgtttgtagttttgtaatttgaatatagccattgcggcaatccttttggcattggccatttgtacatagaatagaatatatctggtaccatgaactaggctttgcaatatatatattcctaatcccattgggtgcc

SEQ ID NO: 33354 - protein, 224 aa, Panicum virgatum
  misc_feature: Ceres CLONE 1950280
  misc_feature (17)..(187): Pfam Name: Snf7 Pfam Description: Snf7
MSFIFGKKKTPAELLRENKRMLEKSIRDIERERQGLQNQERKLINEIKKVAKQGQMGAVKIMAKDLIRTRHQITKFYALKSQLQGVSLRIQTLKSTQAMGEAMKGVTKAMGRMNRQMNLPALQKIMREFEMQNEKMEMVSEVMNDAIDDALEGDEEEEETEELVNQVLDEIGIDVNSELVKAPATAVAQPVAAGKVPAQAEAAGGVDGGIDDDLQARLDNLRKM

SEQ ID NO: 33355 - DNA, 569 bp, Panicum virgatum
  misc_feature: Ceres CLONE 1950296
  misc_feature: Encodes the peptide sequence at SEQ ID NO. 33356
caggcaattgttgcagataatgagactgggaaaaaggggtacactgttccattagaggtcatgcctgcaggacaattcgaaccattgtacagaactccattaagcattcaggatggagaattgccagtcctgccgatgtctgtatatggtgctattgccatggcacatagtgtggattcagatgaatactcctcaccaacgcagttcttcttctatctttatgacaagagaaacgtgagtaaaaaagcctagcactcatcatcatactttaagacatcaaactgcatattcttactatccaatttaaaagatcgaattgtataaggccaatcccagtgcaagtttcatagaggtttcatgcacatttaagacagtgacacgtcagcaactgtgatgacatggcaaggtaattatgaagaaagagagggaatgagtttcatcaggatgaaactgtgtatatactgtttcccagactatgaaacttgttgacacttgcattggggccataaaatttcatttcatgcacttgtgcccaatcacatgcctcacaattaaatgctatggctagc

SEQ ID NO: 33356 - protein, 83 aa, Panicum virgatum
  misc_feature: Ceres CLONE 1950296
  misc_feature: SWISSPROT Homolog: EC 5.2.1.8 Peptidylprolyl isomerase
QAIVADNETGKKGYTVPLEVMPAGQFEPLYRTPLSIQDGELPVLPMSVYGAIAMAHSVDSDEYSSPTQFFFYLYDKRNVSKKA

SEQ ID NO: 33357 - DNA, 946 bp, Panicum virgatum
  misc_feature: Ceres CLONE 1950299
  misc_feature: Encodes the peptide sequence at SEQ ID NO. 33358
agcaaacaactgaaattccccagtccggttccttccgtgcgatttgatctcgtcggaggcgcggccgcggttacccccaacccgccatcgaattcgatggcggccaacgccggcaacaagatccgcaacgccaagctggttcttcttggagatgtgggcgctggcaaatctagtttggttcttcggtttgtgaaaggacagtttgttgaattccaggaatcaacgattggagcagctttcttctctcagaccttggcggtcaatgatgagactgttaagtttgaaatctgggatactgctgggcaagagaggtaccatagcttggcacccatgtactataggggtgctgccgccgccatcgttgtctacgacattacgaatctggcctccttcactcgtgcgaagaaatgggtccaagaacttcaagctcaaggaaacccgaatacaatagtggctcttgctggcaacaaagctgatatgctagatgcaaggcaggtgccagcagaggaagcaaaaacatatgcacaggagaatggacttttcttcatggagacatctgccaaaactgcgatcaatgtgaatgacatattttatgagatcgcaaagagactgctccaagggcaacaggatccaagcccacaggctggaatggttctgaaccaaagaccaaatgagagaatggtcagcagttcttcatgctgctcttgaatctgtgtttcaacctcttactgccattgtgaaatgtatcagaggaagttaaacaaaatgtcccagtcttctgtgtggctgcattccagcctgataatgctccagcttccctcttcttttcttctcatgtgtttgtcatgtaaatgtcaatactagaacatcactgcacggatagtgttactgaagtgttgaatgtgctcttattatatgattgcgcccactccaatcagatttgcac

SEQ ID NO: 33358 - protein, 203 aa, Panicum virgatum
  misc_feature: Ceres CLONE 1950299
  misc_feature (13)..(174): Pfam Name: Ras Pfam Description: Ras family
  misc_feature (13)..(127): Pfam Name: Miro Pfam Description: Miro-like protein
  misc_feature: SWISSPROT Homolog: EC 2.7.11.1 Non-specific serine/threonine protein kinase
MAANAGNKIRNAKLVLLGDVGAGKSSLVLRFVKGQFVEFQESTIGAAFFSQTLAVNDETVKFEIWDTAGQERYHSLAPMYYRGAAAAIVVYDITNLASFTRAKKWVQELQAQGNPNTIVALAGNKADMLDARQVPAEEAKTYAQENGLFFMETSAKTAINVNDIFYEIAKRLLQGQQDPSPQAGMVLNQRPNERMVSSSSCCS

SEQ ID NO: 33359 - DNA, 775 bp, Panicum virgatum
  misc_feature: Ceres CLONE 1950309
  misc_feature: Encodes the peptide sequence at SEQ ID NO. 33360
ccgacgcgccgcctctctgcatctgtcgtcgccggtgactcggataaagctgcatttgatcctcagagatgatgaacgagtcttttcttgataggatggtttcccagcttcggtcaacatgcaagtactacactggatatcccaaggacctagggccatcaagaattataccattcacatctgagcgtcagtttgtacagctattgcatgaaggaaggcctgtagttgttgcctttactattaagtgcacttatacacagcatcttgataaagtactggaagaggctgctgccacattttatccacatatcaagtttgtcagagttgaatgcccaaagtatcctgggttttgcctcacgaggcaaaggaatgaatatccatttgttgaagtattttacaatccagaacaggctgcaagccaaggaaagagtgtggatcctaacatcaccaagtattctgtaaaagtgctacctttcaactatgatcagagcttgtatggatttcgggaatatttcaagaagcatggtttcaagtattctgaaacaaactaattctgtcaatagaaatatgcgatgtgagaacttctagggacttaacatggaggcattcattgtcggagttgaactgtggggctttattgatgtctttcctagttcaaggaatgcctgccatgtactcatgttagggtatcatgcctatagattagcactgcaatagcaaatgcctgctgaactatcgaccttcaatctggtaaattaaacatttccccaacctc

SEQ ID NO: 33360 - protein, 160 aa, Panicum virgatum
  misc_feature: Ceres CLONE 1950309
  misc_feature: SWISSPROT Homolog: EC 5.3.4.1 Protein disulfide-isomerase
MMNESFLDRMVSQLRSTCKYYTGYPKDLGPSRIIPFTSERQFVQLLHEGRPVVVAFTIKCTYTQHLDKVLEEAAATFYPHIKFVRVECPKYPGFCLTRQRNEYPFVEVFYNPEQAASQGKSVDPNITKYSVKVLPFNYDQSLYGFREYFKKHGFKYSETN

SEQ ID NO: 33361 - DNA, 1330 bp, Panicum virgatum
  misc_feature: Ceres CLONE 1950345
  misc_feature: Encodes the peptide sequence at SEQ ID NO. 33362
aaagtctgaatggcttgaatgcgaggcggcccaactcacggagggattaagctcggctggctcacatcatcttctcggatggatcattccgagactcgtgttcatcagcctggccatccgacggcatcctaaattctgaaatttctatcgtcgacaggggagtggcgccgcccttgccagttcttcgtcgggagcttcgccggcgacaagagaatctcggtggttctagctgaactcgcgcccctgctatgcacccagtttcagtctccttgcagcctttccctgcaactccggcaagcatacttgtcccaaggagcgcagctgggaggaattccatcgattttgccgagttgcggagagctggaaggtctagtggaaaccttgctatgaattccacacagaatcctgcccgtgggtcagaaacgtctgggagtgaggatttcaatgtgggggataaggatgccgtggtcattgtcgaccatgggtcacggcgccaagaatccaatctcgtgctcaatgactttgtcgagatgttcagggcacgaactggttataagatcgttgagcctgctcatatgaatgacgccgatctctggatgcttgcaggcgccaagggccttactggtctggttgctgctcaacctcaggagctggctgagcttactattaaggatgcttttggaaaatgtgtgcaacaaggggcatcccgtgttattgttagtccatatttcctttcccctggacgacattggaaacaagatatccctgctttagcagcagaagcatccaaggagctctcaaatataccctatattgtcactgcccctcttggactgcatgagcttatggtggatatcatgaatgatcgcatcaagtactgcctgcaacacgctgcaggtaatgtcgatgagtgtacagtatgtgctggaactggaaagtgccgcctctactcctgatggtgaatacctgggaggccacagttctctatatatgagtatatgactgttcatactgcctcttagaatctgaatagctgtggcagtggcatttcaatgccagcttttctctccgttttaccatttacaaggtctgggccaatatttttcttctgtaagagatctgacgagtgtatgtcccggtcccttatgtcccgtgcagccaaaattaccattgtaatcggctttgtgcatcttgaaattcgggactgtccatattctgagcagattgtcaaattagtcggacaggtggaccatcaagaaaagagtatagcatcattagctaaccttaagaacaattactgttgttatttgaacaacgaacaagatctagc

SEQ ID NO: 33362 - protein, 235 aa, Panicum virgatum
  misc_feature: Ceres CLONE 1950345
  misc_feature (78)..(206): Pfam Name: CbiX Pfam Description: CbiX
  misc_feature: SWISSPROT Homolog: EC 4.99.1.3 Sirohydrochlorin cobaltochelatase
MHPVSVSLQPFPATPASILVPRSAAGRNSIDFAELRRAGRSSGNLAMNSTQNPARGSETSGSEDFNVGDKDAVVIVDHGSRRQESNLVLNDFVEMFRARTGYKIVEPAHMNDADLWMLAGAKGLTGLVAAQPQELAELTIKDAFGKCVQQGASRVIVSPYFLSPGRHWKQDIPALAAEASKELSNIPYIVTAPLGLHELMVDIMNDRIKYCLQHAAGNVDECTVCAGTGKCRLYS

SEQ ID NO: 33363 - DNA, 1149 bp, Panicum virgatum
  misc_feature: Ceres CLONE 1950358
  misc_feature: Encodes the peptide sequence at SEQ ID NO. 33364
acacggctcgcccatttctctcgtctccttcgtcgtctctgtttcttcccacgttcctctctctctctctctctctctctctctctctctctcgcggccacccctttcctgccggcgacgaccgccgccacgtctacgccgggccctttgccggcgacgagccccgaaaagatcgactcttttatgagtccacaaggcacccaggatgaagtttttagaatacacccccttcgacagcataaatctgttcctcgaccaactcaacctcggcgattgtgcaatcagaggaaaccttgaagccttctcatgcaagcacactgcgacagaccgccggctttcaattagcctagaacatgagattcttgattacttaggaaagtcctctgacagtgacccttcttcaccagtggagcacctatcctccagatcaagccggaagacattgatatatctagttcttactcttgggcacatgtatccagattatgatttcagtgctgttcgggcacacttgttcttccaagaagaggagatggaaagtttcaagcagatgatagacacctacttatctgatgcttctaggcaatgggcagcaacaaatgagggcagttctcttctggacagtatgactaaagctattgatgaggttatcaaaatcagagagtgtgacatctacagctataacccagactctgatggagatccagttcaagagaaaggggccatatggtcattctactacttcttctacaataggaagctaaagcgagttgtgagctttcgatgttactgcactagcaaattatcagcagatgacttcctaactggtgtggcgtctgatggtgaagaggaagatgccttgattgacatggacatatgactgaccgcgttctgctcagaacctgttgtgtgtgtgtaatatatagcgtatatgccctattcccgttaggaagcttttaatataacttcccttttatcgtagcctgcggaagctatggctcttgttagcgttgtatatgcggattggagattcggtagcggcaaacttttaatccctgaggtttgaactgtcacgctatgttcgtactctagtgcttgctggaactgaattctatgtcctgcttagttaaagaataaaatatttcagac

SEQ ID NO: 33364 - protein, 224 aa, Panicum virgatum
  misc_feature: Ceres CLONE 1950358
  misc_feature (25)..(193): Pfam Name: Maf1 Pfam Description: Maf1 regulator
MKFLEYTPFDSINLFLDQLNLGDCAIRGNLEAFSCKHTATDRRLSISLEHEILDYLGKSSDSDPSSPVEHLSSRSSRKTLIYLVLTLGHMYPDYDFSAVRAHLFFQEEEMESFKQMIDTYLSDASRQWAATNEGSSLLDSMTKAIDEVIKIRECDIYSYNPDSDGDPVQEKGAIWSFYYFFYNRKLKRVVSFRCYCTSKLSADDFLTGVASDGEEEDALIDMDI

SEQ ID NO: 33365 - DNA, 827 bp, Panicum virgatum
  misc_feature: Ceres CLONE 1950361
  misc_feature: Encodes the peptide sequence at SEQ ID NO. 33366
ggagagatggctgagtggactaaagcggcggattgctaaacagaagcctcgtccgctcatctcctccctctgtttctccaccccttccccttctctcggactctctcgatccttgctcctctttcccttgcggcgacgactgggcgagcggcggcgccatttgttacgtcttcgtccagcccctttgccggcggcgagcatcctccaggtaattttcttgtctgtagcatagacaagatggttaatgcgatcaaggggttgttcatctcctgtgatatacctatggcacagtttattgttaatctgaatgcttcaatgccggcatcagagaggttcatcgtgcacatgctcgatcctacacacatgtttgttcagccccatgtggcagaaatgatcagaagcaaaataggggagttcagggaccagaatagctacgagaagccgcagtgaaggatcatcccaccttgcagtttgcattgtttccctccctcccaaagatgcataccttgcactcaaatctgcgcgactgctatagaatggttggttggatggcattgccatgcctcaccctgtcacccgtgatgatctagaataatgtatgtattcgtgtttctagtctcwgaagcagctgtatttcagtgacttatttgtatctcgggtgatctcttttttgtgccctttcgccattgggcaacccacttggtggcgccgataaattgaaagtgcgttgcctgcttaggaaagggtaagatgtcttgcatgtattgctgttgtggactcgactctgatgtttgtgagctttttatgagtcgatggttccgtgaaat

SEQ ID NO: 33366 - protein, 70 aa, Panicum virgatum
  misc_feature: Ceres CLONE 1950361
  misc_feature (1)..(70): Pfam Name: Tbf5 Pfam Description: Transcription factor TFIIH complex subunit Tfb5
MVNAIKGLFISCDIPMAQFIVNLNASMPASERFIVHMLDPTHMFVQPHVAEMIRSKIGEFRDQNSYEKPQ

SEQ ID NO: 33367 - DNA, 1006 bp, Panicum virgatum
  misc_feature: Ceres CLONE 1950387
  misc_feature: Encodes the peptide sequence at SEQ ID NO. 33368
gtgccttgcagcccgtctggtaagctggtgcagatcgagcacgccctgacggcggtgggctctggccagacctccctcgggatcaaagctgctaatggagttgttattgccactgagaagaaactgccgtctattttagttgatgaaacatctgtgcaaaagattcaagcgttgactccaaatattggagttgtttacagtgggacgggtccagatttccgcgttctcgtgaggaaaagccggaagcaagcacagcagtattaccgattgtacaaggaatctatacctgttacacagcttgtcagagaaaccgctgctgttatgcaggagttcacacagtctggcggtgtaagaccatttggtgtatctttgttgatagctgggtatgatgacaatggaccccagttgtatcaggtagatccatcaggatcatacttctcctggaaagcatcagcaatggggaaaaatgtgtccaatgcaaagacatttcttgagaagaggtacacagaagatatggagctcgatgatgccatccatactgcaattttgactctgaaagaaggatacgaagggcagatctcgtccaacaatattgagatcgggataattcgacctgaccgtgagttcagggttytgagccctgcggagatcaacgatttcytggaagaggtggagtaaagcctggccctcgacaattcgcgggttccaaagatgatgagaaatgcaaaagcccaagcagctcccaccgcctaagttcatcacatcttcaggattctttttccaaatcttttgagctgattatcagcggcatgtcgtagactcggtaggagcagctaggcttccaggtagatgtaggtgcgtcgtgcatgctgtaccctgcttgtcgcactgcccgccacttgcctggcgagcttacaatgtgcggtggtgcccgtcctcgtgtgtcccccgggggcccatgtacaacgtccatttcaccgtcccgatcagaggtcagccagcatcc

SEQ ID NO: 33368 - protein, 225 aa, Panicum virgatum
  misc_feature: Ceres CLONE 1950387
  misc_feature (19)..(203): Pfam Name: Proteasome Pfam Description: Proteasome A-type and B-type
  misc_feature: SWISSPROT Homolog: EC 3.4.25.1 Proteasome endopeptidase complex
VPCSPSGKLVQIEHALTAVGSGQTSLGIKAANGVVIATEKKLPSILVDETSVQKIQALTPNIGVVYSGTGPDFRVLVRKSRKQAQQYYRLYKESIPVTQLVRETAAVMQEFTQSGGVRPFGVSLLIAGYDDNGPQLYQVDPSGSYFSWKASAMGKNVSNAKTFLEKRYTEDMELDDAIHTAILTLKEGYEGQISSNNIEIGIIRPDREFRVLSPAEINDFLEEVE

SEQ ID NO: 33369 - DNA, 632 bp, Panicum virgatum
  misc_feature: Ceres CLONE 1950407
  misc_feature: Encodes the peptide sequence at SEQ ID NO. 33370
ttgtgaagatgtggatcgcagaaggctttgtgctgagcaggggaagcaaaacagcagaggaggtggctgagaggaacctcaccgagctgatcaactgcaatcttctggtaattgggcataatgacgagcaaggacgggtgagaacctgtaggatgcatcctattatgcgagatctggttcttgttgttgcgaaacaggagagatttggctctgcaaatgactatagaagaatgatacagatgaataaggatgttcgtcgtctgtcatcttatggatggaaagacaatactccaataaaagttaattttccccagcttcggactcttgtatcacttggaacagtttcatcctcccctggcatgttgtcatcaattttgtctgaagccacctaccttactgtgctcgagctacaagattctgaggtcactgaattaccagcatctatagggattctgttcaacctacgttacattggcttgcggcgcacgaaggtcaagttactccctgactctgttgtgaatctatctaacctcctcactttggacatcaagggaacaaaaatacagaggttaccaagaggactcgggaaggtcaagaagctacggcaccttatggctgatagatgtgctgat

SEQ ID NO: 33370 - protein, 209 aa, Panicum virgatum
  misc_feature: Ceres CLONE 1950407
  misc_feature: SWISSPROT Homolog: EC 3.1.13.4 Poly(A)-specific ribonuclease
VKMWIAEGFVLSRGSKTAEEVAERNLTELINCNLLVIGHNDEQGRVRTCRMHPIMRDLVLVVAKQERFGSANDYRRMIQMNKDVRRLSSYGWKDNTPIKVNFPQLRTLVSLGTVSSSPGMLSSILSEATYLTVLELQDSEVTELPASIGILFNLRYIGLRRTKVKLLPDSVVNLSNLLTLDIKGTKIQRLPRGLGKVKKLRHLMADRCA

SEQ ID NO: 33371 - DNA, 257 bp, Panicum virgatum
  misc_feature: Ceres CLONE 1950407-R
  misc_feature (236)..(236): n is a, c, t, g, unknown, or other
gaaacttcagaagtcagtggcacaacaatagaatgttcgagaagatgcaacacgttttaaagattgacatctaggagagccaaattgttacttctggtcgtgttcacagaactttctatgttgtagttttaatcgtcctccttttacaacgagtaggagcactacatttccatctgggttgtagttgaagactgtataacaacttgtcttgaaacattggcttgcaatgccttcanagatgttttgttttttggatc

SEQ ID NO: 33372 - DNA, 1169 bp, Panicum virgatum
  misc_feature: Ceres CLONE 1950465
  misc_feature: Encodes the peptide sequence at SEQ ID NO. 33373
aagatcaaagatgaaggctgctggtcagacccagaagcctgcaggaacaaccaggtaagtaggtaactgtaaacacagctgcagtcaatgtccggcagatttgaattggtcacttcgccctgggcgactgcaggactggtactctgttgccaagaggtgcacttgagtatgggaagcaaaccgggctggatgttgttactgtcaacccagccctggtcttcggtccccttctgcagccaacgctcaacacaagctgccagttcctcgtctacttcctgaaaggaggccctgatcaaatgaggaacaaactttggcacatcgttgatgttcgggataccgccgatgctcttttgctggtctatgaggcacctgaagcctctggtaggcacatctgcgcacctcacttcatcagcgcccgtgaccttctggacttactgaagagcatgtacactgagtaccctttcatgagcaaggagagcatctgtgacatggatcacccagctccaatgacgtctgacaagctgaagaaactggggtggaaggccaggccgttgaaggaaactatcgcggataccgttgagttctgcaagaacgctgggtttcttgaggatgtggaggggagtccctgccgttttcctgatgttttacacaaaatctagcttgagaaagaatcttattggatttcgttgkggcttcgatgtctcctcggacggatgttgcttctcggtgccttcggtttgggggttggcaacgtgaagtcggagctgctgcgtcagaggcgtggctcggcaacgatgacacatgtcgaccctccctacagctgggaatctacatcctccggggacgaggcgagagttcatgatcggaagtcggagctgctcttcacggggtgtcgagcttggcaacgataactggttgtggctacttacttcgggaccggtggtatgtggtttgtgggtggcctgccatgggaagtcggagctgttggcagctttgcttccatgctcggcaataataacctttggtagtgtgtcgtgtattgcactctatcgtgtcgcgtgggttggtagcctctcgggaggtcttttttaaattctcattgggctattgttttcttgtactcgattcctttcgacttaattgatcggcagagctcctgcctttagttc

SEQ ID NO: 33373 - protein, 120 aa, Panicum virgatum
  misc_feature: Ceres CLONE 1950465
  misc_feature: SWISSPROT Homolog: EC 1.1.1.219 Dihydrokaempferol 4-reductase
  misc_feature: Useful for making plants with altered carbohydrate content
MRNKLWHIVDVRDTADALLLVYEAPEASGRHICAPHFISARDLLDLLKSMYTEYPFMSKESICDMDHPAPMTSDKLKKLGWKARPLKETIADTVEFCKNAGFLEDVEGSPCRFPDVLHKI

SEQ ID NO: 33374 - DNA, 709 bp, Panicum virgatum
  misc_feature: Ceres CLONE 1950488
  misc_feature: Encodes the peptide sequence at SEQ ID NO. 33375
ccccccccccccccaatctaccacaaacaatccacgaaaccctagtccatacgggggcctcgaattggggtcttggcgctggggatttcagccgtctgggcatggatttggatctgtggatcgccaaggtcaaggaggggcagcacctcgccgagcacgagctccagtccctgtgcgaatacgtgaaggagattctcatcgaggagtcgaatgtgcagcctgtcaacagccctgtgacagtgtgtggtgacatccacgggcagtttcatgacctgatgaaactttttgcgactggagggcatgtccccgatacgaattacatatttatgggtgactttgtggatcgcggattcaacagcctagaggtcttcacaatccttttgctcctaagagcaaggtaccctgcccacataacccttctacgcgggaatcatgaaagcaggcagttgacacaggtgtatggtttttatgatgagtgtcagaggaagtatggaaatgccaatgcatggcgatattgtaccgatgtttttgattaccttactctttcagcaatcatcaatggcacggtcctttgtgttcatggtggcctttcacctgatgtacggactgttgatcagatacaagtcatcgatcgcaattgtgagattccccacgaagggcctttctgtgatctgatgtggagtgaccctgaagagatagatacatgggc

SEQ ID NO: 33375 - protein, 202 aa, Panicum virgatum
  misc_feature: Ceres CLONE 1950488
  misc_feature (43)..(198): Pfam Name: Metallophos Pfam Description: Calcineurin-like phosphoesterase
  misc_feature: SWISSPROT Homolog: EC 3.1.3.16 Phosphoprotein phosphatase
  misc_feature: The sequence is a functional homolog of SEQ ID NO 13 in US patent 7271316
MDLDLWIAKVKEGQHLAEHELQSLCEYVKEILIEESNVQPVNSPVTVCGDIHGQFHDLMKLFATGGHVPDTNYIFMGDFVDRGFNSLEVFTILLLLRARYPAHITLLRGNHESRQLTQVYGFYDECQRKYGNANAWRYCTDVFDYLTLSAIINGTVLCVHGGLSPDVRTVDQIQVIDRNCEIPHEGPFCDLMWSDPEEIDTW

SEQ ID NO: 33376 - DNA, 369 bp, Panicum virgatum
  misc_feature: Ceres CLONE 1950488-R
  misc_feature: Encodes the peptide sequence at SEQ ID NO. 33377
gtacatgtttgataaaggccttgtaactgtgtggtctgcgcctaattattgctacagatgtggcaatgttgcttctatactaagcttcagtgagaatatggaaagggaggtcaagttcttcacagagacagaggaaaataaccagatgcgagggccaaggagtgcagtcccatattttctttgaccctgtctgtacaatttttttttacctgtggatcttatttgtatgggctaaacggcattggataggtgttcatacttgtaggtttcagctcagaacgcaatctggtgcattgtatgtcaggttattttttcttgcctgtacaatagatattgaaagaaatactgctctttctcatgacctccatc

SEQ ID NO: 33377 - protein, 60 aa, Panicum virgatum
  misc_feature: Ceres CLONE 1950488-R
  misc_feature: SWISSPROT Homolog: EC 3.1.3.16 Phosphoprotein phosphatase
YMFDKGLVTVWSAPNYCYRCGNVASILSFSENMEREVKFFTETEENNQMRGPRSAVPYFL

SEQ ID NO: 33378 - DNA, 1095 bp, Panicum virgatum
  misc_feature: Ceres CLONE 1950493
  misc_feature: Encodes the peptide sequence at SEQ ID NO. 33379
aagcaaatcctatctcgaatctgtgaaccccaaccaaatgacgccgacggcgagcctcctcctcccggctccccccttcgtctccatctccgatgtgcgccgcctccagttcctcccgcgcggccgccaccgacctctcctctgctggagcggcgcggtgtggggctctgtgcggacccagatgctgtcttctttcgtcgggagcagaagatcgagccgcagaagcgttatctgcgcttccctgtttggggttggtgctcccgaagcattggtcattggagtggttgccttgttggtgttcggccccaagggtctagcagaggtagccaggaatttggggaagactttgcgtgctttccaaccaaccattagagagttacaggatgtatcaagggagttcaggagcacacttgaacgagaaattggaattgatgaggttcccccctccacgaattataggcccacaaccacgaataacaacgaacaacctgccgccaacccaaatgttaagcctgaagctgctccttatactagcgaggaactcatgaaagtaactgaagaacaaattgctgcatcagcggctgctgcctggaatactcaacctgccccatcacaagagcaagaagcagcaccccccaattcaaagtaccggcgctgctacatcaggaggtaatgatggtcccgcagctcctgctcctgcaaccgagtctggtccaagcgaagcaaatcagtctgagaaggtggaaagcgagcgaagcaaatcagtctgagaggcggaaagcgagcgataaagccagtggatgggaagagcaaatcagggcgaggaattttgctcagttttttttccctgaggcgggcgagggttgtatgaaatgcttatagtgcttaggcctattctgtttatcttgtgctgctgttgtagatgttgaagaaggctgtgtatatttcctggtagtgcgtctcacgctgccacggctgctgttgtgccgtcgtcagccttgtaacatttctgagcctgtcgtagccacgagagtttgttgtatggagcaatgagtttaatcatgactcaacggagaggcgattgattccgttctc

SEQ ID NO: 33379 - protein, 211 aa, Panicum virgatum
  misc_feature: Ceres CLONE 1950493
  misc_feature (72)..(154): Pfam Name: MttA_Hcf106 Pfam Description: mttA/Hcf106 family
MTPTASLLLPAPPFVSISDVRRLQFLPRGRHRPLLCWSGAVWGSVRTQMLSSFVGSRRSSRRSVICASLFGVGAPEALVIGVVALLVFGPKGLAEVARNLGKTLRAFQPTIRELQDVSREFRSTLEREIGIDEVPPSTNYRPTTTNNNEQPAANPNVKPEAAPYTSEELMKVTEEQIAASAAAAWNTQPAPSQEQEAAPPNSKYRRCYIRR

SEQ ID NO: 33380 - DNA, 982 bp, Panicum virgatum
  misc_feature: Ceres CLONE 1950499
  misc_feature: Encodes the peptide sequence at SEQ ID NO. 33381
attcctttttcctttctggagcagttccctttctggagctgctccgggcgtgctctcacttcttcattttcctctcggccacccttggaattggaagacgacctcacgcggggcttcgaatattccttgtcttctcggctcgcaagtgaagctggaggaagcggaggggctcgcgatggggtccgagggaccgtcggctccggtcgtcgttcccagaaacttcaggctgctagaagaactagaacgtggtgagaagggcattggtgaagggacagtgagctacgggatggatgatgctgatgacatttatatgcggtcctggacaggaactatcattggccctcccaatactgttcacgagggacgaatctatcaattaaagcttttctgtgatacagattatccagataaaccaccaactgttcgatttcagactcgaatcaatatgacatgtgtgaacaaagaaactggattggttgaaccaagtctatttcctatgcttggaaactggcaaagggaacatacaatggaggacatcctaaccagcttaaaaagggagatgtcgactcctcagaatcgcaggctgcaccagcctcaagaaggtaatgaagaccaaagagtagagcagaaagggctgcctcrtagatgtgtcatcatgtaacagatgtgcatkgcaatgtacagcttgagttgagtagcatgattgcttgggatgcagaagtgaggaaccttttcaggaaatcgtgttaattttgtgcaaactgcgcaagagttgcaataaagtatcgaggtctatgttgattggcgtgcgcaccatgtaacatgttaccccattcaggttcagtgaaggacaatgagcttcacatcgctcattttgcctgtttgtaaacagtatgtagtatgtaccgtcgggttatctgtgtaggcctgttgttttatacaggaacagggtattgataaatatcacagcctgattggttgt

SEQ ID NO: 33381 - protein, 161 aa, Panicum virgatum
  misc_feature: Ceres CLONE 1950499
  misc_feature (17)..(159): Pfam Name: UQ_con Pfam Description: Ubiquitin-conjugating enzyme
  misc_feature: SWISSPROT Homolog: EC 6.3.2.19 Ubiquitin--protein ligase
  misc_feature (156)..(156): Xaa is any aa, unknown, or other
MGSEGPSAPVVVPRNFRLLEELERGEKGIGEGTVSYGMDDADDIYMRSWTGTIIGPPNTVHEGRIYQLKLFCDTDYPDKPPTVRFQTRINMTCVNKETGLVEPSLFPMLGNWQREHTMEDILTSLKREMSTPQNRRLHQPQEGNEDQRVEQKGLPXRCVIM

SEQ ID NO: 33382 - DNA, 705 bp, Panicum virgatum
  misc_feature: Ceres CLONE 1950501
  misc_feature: Encodes the peptide sequence at SEQ ID NO. 33383
tttgcgctactgatcttgtaaatgagtatggtgcaactgtccaaagagcccatgacttcttgaaacattcccagcttatgtggaatcatcctggtgacctaagttactggcatcgtcatataacaaagggttcatgggctcattcaactgcagacaatggatggggtgtatctgataataccggagaagcactcaaggctacactcttactatcaatgatgaagagcagcattgttggtgatccaatacagagagataggttgcatgatgctgttgatttccttctatcaattatgaacaaagatggttccttttcaacgtacgaatgtgaaagaacttattcctggttagaggtaagttttgtatattacgttgcaacattacagcagagcatcttactctctaaccactatgcttttctttttcttctgtggagaacaactgatcgatgcctactttgaacagctaatgcctttcctgatttcgttctcgattgttccctccataggatgttgtaacttgtcaacgtaacgtaactaatcaattcagtcacctattcggtcatggtcagtctagactttgattctgtaagctgccaatactcaacagaccacaactgttatacatttatatgttacgtccatatataatagggatctagtttttttcaggtaatgtatagtacttcatgttattaatggcact

SEQ ID NO: 33383 - protein, 152 aa, Panicum virgatum
  misc_feature: Ceres CLONE 1950501
  misc_feature: SWISSPROT Homolog: EC 5.4.99.8 Cycloartenol synthase
  misc_feature: The sequence is a functional homolog of SEQ ID NO 15 in US patent 7186884
  misc_feature: The sequence is a functional homolog of SEQ ID NO 6 in US patent 7122717
CATDLVNEYGATVQRAHDFLKHSQLMWNHPGDLSYWHRHITKGSWAHSTADNGWGVSDNTGEALKATLLLSMMKSSIVGDPIQRDRLHDAVDFLLSIMNKDGSFSTYECERTYSWLEVSFVYYVATLQQSILLSNHYAFLFLLWRTTDRCLL

SEQ ID NO: 33384 - DNA, 682 bp, Panicum virgatum
  misc_feature: Ceres CLONE 1950504
  misc_feature: Encodes the peptide sequence at SEQ ID NO. 33385
ggcttgcctgaagatttggcaaagatatgtcttgcccttgttcctcgtagtcattttcctgttatgggtgcagtttccaagcggtggatgtcatttcttgagagcaaggagttaatagctgtaaggaaggaggttgggaaacttgaggagtgggtgtatgtcttaactccagaagcaggcacaaaggggtcccactggcagattttggagtgttcagggcaaacacaaagccctcttccgcgtatgcctggactaaccaaagctgggtttggtgtggttgttattggtgggaagctctttgttattgctggctatgctgctgaccatggaaaggaatatgtttcagatgaggtgtaccagtatgattcttgcctcaacaggtggactttgcttgctaagatgaatgtggctcgatgtgacttcgcctgcgcagagatcaatggggtgatatatgttgccggtggatttggtccaaatggtgacaatttgtctagtgtcgaagtttatgacccagaacagaatagatggacactgattgagagcctgcgcaggccaagatggggttgcttcgggtgcagcttcgaagggaagctttatgtcatgggtggccgttcaagcttcacaattggcaactcccgtttcgttgacgtgtacaatcctatcaaccatgcctggggtgagt

SEQ ID NO: 33385 - protein, 227 aa, Panicum virgatum
  misc_feature: Ceres CLONE 1950504
  misc_feature (86)..(135): Pfam Name: Kelch_1 Pfam Description: Kelch motif
  misc_feature (137)..(183): Pfam Name: Kelch_1 Pfam Description: Kelch motif
GLPEDLAKICLALVPRSHFPVMGAVSKRWMSFLESKELIAVRKEVGKLEEWVYVLTPEAGTKGSHWQILECSGQTQSPLPRMPGLTKAGFGVVVIGGKLFVIAGYAADHGKEYVSDEVYQYDSCLNRWTLLAKMNVARCDFACAEINGVIYVAGGFGPNGDNLSSVEVYDPEQNRWTLIESLRRPRWGCFGCSFEGKLYVMGGRSSFTIGNSRFVDVYNPINHAWGE

SEQ ID NO: 33386 - DNA, 253 bp, Panicum virgatum
  misc_feature: Ceres CLONE 1950504-R
tacaacttttatgggctcgttgcatcccaaacaataatttgacagttatgtgtcggttcattgaattgccatagcaccatgatgtgttcttacctcacttgtattgaactctagttctggccatagggccttccattgataattgtcattttgctgttcacccacgttataacagcaggcagctgtgttcgtagctgctgctcagttgtaatagttcatggttgcattgtggcaagcaaaatggttatcagtg

SEQ ID NO: 33387 - DNA, 572 bp, Panicum virgatum
  misc_feature: Ceres CLONE 1950519
  misc_feature: Encodes the peptide sequence at SEQ ID NO. 33388
atcccatcccatcgaatctaccagctagcaaggtaggaggggggtgattcgattgattgcctggcttccctcccctcaaatcgagatcgaaatccccatgctgatgttgctaggctaggagcctcgatgagattccccttcatcaatttcagttatctgcctgcttccccttcgtccgccggggtgcgcgcgacaagtatgtgccatgctacagcgccccgtgcaggttcccttcacttcacacatccaaccagttcttgacgagatacacctttcaagttttgaacaccgtgaaatgatcctctgatccgacatgggcctcaaggaacagcatccgcaacccaacaccactgatcaaactgatgccgatcactctcctactgctgatgaccaccacaatccagccatcccccgtgtatcaagctgcagcactgataacgattctggcctttcactttgccgggtctgtcattgcgacgagactgatttcagaggcgagtctgccctacgtttcttggacattgtgccgccttcgagagagccttccgacccaaagaccaacaatgatgcta

SEQ ID NO: 33388 - protein, 86 aa, Panicum virgatum
  misc_feature: Ceres CLONE 1950519
  misc_feature: Useful for making plants with modulated nitrogen use efficiency
MGLKEQHPQPNTTDQTDADHSPTADDHHNPAIPRVSSCSTDNDSGLSLCRVCHCDETDFRGESALRFLDIVPPSREPSDPKTNNDA

SEQ ID NO: 33389 - DNA, 604 bp, Panicum virgatum
  misc_feature: Ceres CLONE 1950523
  misc_feature: Encodes the peptide sequence at SEQ ID NO. 33390
aataagcagatctcatgcaagctgcagctgacgaacaagacagacaagcaggtcgcgttcaaggtcaagacaacgagcccgaagaagtactgcgtccggccaaacaatggcattgtggcaccccggtccacagccgatgttgttgttacaatgcaagcgcagcgggaggcgccaccggacatgcaatgcaaggacaaattccttgtgcaaagcgccattgtagccaaggagattgtgccaaaggaagtcaccggagacatgtttaccaaagaatcaggcaatgtggttgatgaagtgaaattgaaggtggtttatctcacgccgtccacccaaagcgagggatttgaggatggttctgcgggcagtttgaattatcaagagccatttgctttgatttcgaaactgatggaggagaagaattctgctgttgaactgaacaacaagcttcggcaagaattggaccttctgaggcgaaacatcagcaggcagcacggtggtttctcattagttttagtactggtggttgctattatgggaatactactaggtttcctcatgaagagatgagtgcataacgatttatcttgtttggcatttcttttca

SEQ ID NO: 33390 - protein, 188 aa, Panicum virgatum
  misc_feature: Ceres CLONE 1950523
  misc_feature (1)..(93): Pfam Name: Motile_Sperm Pfam Description: MSP (Major sperm protein) domain
NKQISCKLQLTNKTDKQVAFKVKTTSPKKYCVRPNNGIVAPRSTADVVVTMQAQREAPPDMQCKDKFLVQSAIVAKEIVPKEVTGDMFTKESGNVVDEVKLKVVYLTPSTQSEGFEDGSAGSLNYQEPFALISKLMEEKNSAVELNNKLRQELDLLRRNISRQHGGFSLVLVLVVAIMGILLGFLMKR

SEQ ID NO: 33391 - DNA, 1049 bp, Panicum virgatum
  misc_feature: Ceres CLONE 1950556
  misc_feature: Encodes the peptide sequence at SEQ ID NO. 33392
gttgtgccatctgtagctctataaattggtgcagctattggtcaccccgtatcaagtgatcattcgcactagcaaccttgcattgcattattagtacgtagagagcgatggccagagaaatggagaaggcaaggaaggccacttcttcccctaagacgtcaacgatgaatgctggtccaaagagcccagtaaggaatggaggaggttctccgcctcagaagaagaacacctctgagccacgaggacggaaaaatgagcagcaaatcgttcagaatggaggtcaagaccatgatgagggcaaacgccgatctccaacttcacaaacctcacccaagagatcaccaagactcggtcaacccctgagctactgtaggcttcacactgaggagcgagcaataaggcgagccggttacaattatcaggttgcaagcaagataaatacacaggaaattattcggagatttgaagagaagttagcacagttgatggaggagcgcgaaataaagctgatgaggaaggagatggttccgaaggcccagctcatgccatcgtttgacaaaccattccacccacaaaggtctacgaggccgctgacagtccccaaggagccgagcttcctgaagctgaaatgctgcatcggcggagagttccatcgccatttttgctacaacggatcagcagccaaggccatcaagtagtagcctatgcatgcgcctacaaagtacaagatgaagtatttttttgccgttgcctgatgaacctacatgcatatgtagaagtggttgctgatggatgtaaatttccccggccttagcttgccccttctttttctcctctttatcttttatatacttcctttcatctttttcttttcttttcctcttcttgtttttctcttccacgatgggatcatcacacagctgaaagcaaggtaggaattaaaccatgcaaaaggggccacttgatccgatccgatccggacgatgcatgcatgcgccatgtacgcctgtctgatggcagtaataaagcaaggttgcacatagagttcc

SEQ ID NO: 33392 - protein, 196 aa, Panicum virgatum
  misc_feature: Ceres CLONE 1950556
  misc_feature (90)..(146): Pfam Name: TPX2 Pfam Description: Targeting protein for Xklp2 (TPX2)
MAREMEKARKATSSPKTSTMNAGPKSPVRNGGGSPPQKKNTSEPRGRKNEQQIVQNGGQDHDEGKRRSPTSQTSPKRSPRLGQPLSYCRLHTEERAIRRAGYNYQVASKINTQEIIRRFEEKLAQLMEEREIKLMRKEMVPKAQLMPSFDKPFHPQRSTRPLTVPKEPSFLKLKCCIGGEFHRHFCYNGSAAKAIK

SEQ ID NO: 33393 - DNA, 1170 bp, Panicum virgatum
  misc_feature: Ceres CLONE 1950558
  misc_feature: Encodes the peptide sequence at SEQ ID NO. 33394
aaaacgagcgtgctcgacctcccccacctcgccactgctcctattttcttctcctgaacgctgcggaaagcatggcgtccgtcaccgcccgcgccccggtcgcggccctccgcccgtcgtcggcgtcgctcaggtcatccttcctcggccactctagacgcctcggccgcggggccgcggcgccgacaaggcggaccctcacggccgaggccaagggcgagtggctccccggcctcccctcacccgcctacctcgacggcagcctgccgggcgacaatgggttcgacccgctgggcctggcggaggacccggagaacctgcggtggttcgtgcaggcggagctggtgaacgggcggtgggcgatgctgggcgtggccgggatgctgatcccggaggtgctgaccaaggccgggctcatcagcgcgccgcagtggtacgacgccggcaagtcggagtacttcgcgtcgtcgtccacgctcttcgtcatcgagttcatcctcttccactacgtcgagatccggcggtggcaggacatcaagaaccccggcagcgtcaaccaggaccccatcttcaagagctacagcctgccgccccacgagtgcggataccccggcagcgtcttcaaccccctcaacttcgcccccacgctcgaggccaaggagaaggagctcgccaacgggaggctggcgatgctggcgttcctggggttcctgatccagcacgacgtcaccggcaaggggcccttcgacaacctgctgcagcacctgtccgacccatggcacaacaccatcatccagaacctctccggttgagtcgacgacggtgagcgatcgccaatttgacattgagacgacgcggtcgagtcgatcgatgtgagttccttcctgtggatcgatcatcagcgtgtgatgtgtgttcagtctggaggggagaattcagggcgtgtttgtaattgtcatgctggtgtgcatggtgaggaggagtatgaggagtgattgtggtatgtacattaatgacaggggaggttaagggtagaaattgtttgatcatcagtgtctatccgttctgggccttttacttgcttgtccgtaagtgcttaattctgtgtggaattaaacagatgtacaatagctacagctttgttggaagctagcaatcttagctttgttt

SEQ ID NO: 33394 - protein, 246 aa, Panicum virgatum
  misc_feature: Ceres CLONE 1950558
  misc_feature (56)..(218): Pfam Name: Chloroa_b-bind Pfam Description: Chlorophyll A-B binding protein
  misc_feature: Useful for making plants with modulated oxidative stress sensitivity
MASVTARAPVAALRPSSASLRSSFLGHSRRLGRGAAAPTRRTLTAEAKGEWLPGLPSPAYLDGSLPGDNGFDPLGLAEDPENLRWFVQAELVNGRWAMLGVAGMLIPEVLTKAGLISAPQWYDAGKSEYFASSSTLFVIEFILFHYVEIRRWQDIKNPGSVNQDPIFKSYSLPPHECGYPGSVFNPLNFAPTLEAKEKELANGRLAMLAFLGFLIQHDVTGKGPFDNLLQHLSDPWHNTIIQNLSG

SEQ ID NO: 33395 - DNA, 830 bp, Panicum virgatum
  misc_feature: Ceres CLONE 1950559-R
  misc_feature: Encodes the peptide sequence at SEQ ID NO. 33396
cgtcaggggcgtggaggctgtacctgctccagctccagcagcacccgcttcgcacaaagatgatcacggcggggtgcctcgccggcgtcagcgactccgtggcgcagaagctctccgggtaccagaagattgagaagcgcaggctgttcctcaagatgctctttggttttgcacatggtggcccatttggacattttttgcacaaaattctggattatatcttccaagggaagaaggataccaaaactatagctaagaaggttttgctggagcaagtgacatcttctccctggaacaatttgttgttcttgttctattatggatatgttgttgagaggaggcctttgaaggaggtgaccatcagggtgaagaaacagtatccttctgtgcaattgagtgcttggatgttttggccgattgttggctggataaaccatcagtacatgcctttgcaattccgtgtgatcttccacagctttgttgcatgttgttgggggatatttctcaacctccgtgcaagggctatgtctctgaagcaggcttagatggtattggaggagcaaaatagcagcgcagctccaacccgagtactaactggccaaagaccaaggatgctggactctatatcctgtactgtttagaaacaaaaatcttcttcaagccattctagtagttcaaggctttcgactatttatcctgcagtagtcggtttattcaattgtcaacacgtgcaaagacagattaagcttttgtgaaacgtgatggaaccgatgtatgacgaatttacctgcatttgagaacagctcattctctgttttttttttcttttc

SEQ ID NO: 33396 - protein, 180 aa, Panicum virgatum
  misc_feature: Ceres CLONE 1950559-R
  misc_feature (109)..(174): Pfam Name: Mpv17_PMP22 Pfam Description: Mpv17 / PMP22 family
SGAWRLYLLQLQQHPLRTKMITAGCLAGVSDSVAQKLSGYQKIEKRRLFLKMLFGFAHGGPFGHFLHKILDYIFQGKKDTKTIAKKVLLEQVTSSPWNNLLFLFYYGYVVERRPLKEVTIRVKKQYPSVQLSAWMFWPIVGWINHQYMPLQFRVIFHSFVACCWGIFLNLRARAMSLKQA

SEQ ID NO: 33397 - DNA, 459 bp, Panicum virgatum
  misc_feature: Ceres CLONE 1950559
gggaccgagacgccgacccaactacccgagcatcgcggaatccgccgctccccggaaaaaaaaaaatcaagcgagtacagtacaaagggcgcgtgcgcagtgctcggttgtggccctgtgggaggaggagtaggtgggtagatcgatcggagcggttcgggcggggtcggaggccggccgccatggcagcagcgggaggagcggggcgggggggaggggaaggaggaggaggggatgggatcgatctacttacctactcctcctcccagggggccactaccgagcactgcgcacgcgccctttgtactgtactcgcttgatttttttttttccggctcttgttctagtccgtgttgcataatctttcttgttttcagcatattgacaagcacaagatgttcctcaacatgctcttggattttgcagatggtggcccataaatacattcttctctgatgg

SEQ ID NO: 33398 - DNA, 1201 bp, Panicum virgatum
  misc_feature: Ceres CLONE 1950561
  misc_feature: Encodes the peptide sequence at SEQ ID NO. 33399
ctccctcggtgcttctcctctctcgaaccccctttgattcttccccttctaccttctgaatctgctatccggattatcccagcagctatcgccgtctggacactacaggcggccagggatcgcgcccctcgatccccctcttccccggatgtgatcgaggtttgcacttttctcaattttctgcaccggagccgctggatgtgaatgatggggtgcgtaccaacaaagcatgctggtcggtcaccgcattcactggatacacgggaagctgtggcccttgcttccgaaacatcttttacagtaagtgaagttgaggcactacatgacctcttcaggaaaataagtaattcaatcatcaaagataatctaattagcaaggaagaattccacgttgctctatttaggaataagacgaagcaaaatctctttgttgatagggtatttgacttgtttgatcaaaaacgaaatggtgttattgaatttggtgaatttgttcgatctcttagtgtgtttcatccagatgcacctgaagaacaaaaagttgcatttgcatttaagttgtatgacttaagacagactggctttattgaacggaatgagttaaaggagatggtgttggctctgctagacgaatcagatttggatattacagctgatgctgtcgagatgattgttgataggacatttgaccaggctgacacaaaaggtgatgggaggatcgatcaagaagaatggactgcatttgctaaagacaatccatatgtactaaggaatatgacccttccataccttaaggacatcaccatggtattcccaagctttgtggttcactcagaaatcagtgaagcagatatggctgcctaacctgaaaagtgagaagtaactgcaagcatgcaacacacatcctgatctaaatactgatgaaaggacatgctgcaagcttgatgaaatactgatgaaaggacatgctgcaagctttttcatcaagaaaaggtttgaaacacgtcattcaagcacccgttgtggttagaattgtggactggctgcaaatggtggaagtaggaaatgagttttgttgtcttacctacaagcaaaagagcaatgtagcatccaactccagcatcactgaccaaatgtcttaacatgcacaagacacagcaatttgtctatttctgcttttgttacgttggagaatgctcag

SEQ ID NO: 33399 - protein, 218 aa, Panicum virgatum
  misc_feature: Ceres CLONE 1950561
  misc_feature (155)..(183): Pfam Name: efhand Pfam Description: EF hand
  misc_feature: SWISSPROT Homolog: EC 2.7.11.17 Calcium/calmodulin-dependent protein kinase
  misc_feature: Useful for making plants with modulated salt sensitivity
  misc_feature: Useful for making plants with modulated drought sensitivity
  misc_feature: Useful for making plants with modulated water use efficiency
  misc_feature: The sequence is a functional homolog of SEQ ID NO 2 in US patent 7250555
MGCVPTKHAGRSPHSLDTREAVALASETSFTVSEVEALHDLFRKISNSIIKDNLISKEEFHVALFRNKTKQNLFVDRVFDLFDQKRNGVIEFGEFVRSLSVFHPDAPEEQKVAFAFKLYDLRQTGFIERNELKEMVLALLDESDLDITADAVEMIVDRTFDQADTKGDGRIDQEEWTAFAKDNPYVLRNMTLPYLKDITMVFPSFVVHSEISEADMAA

SEQ ID NO: 33400 - DNA, 619 bp, Panicum virgatum
  misc_feature: Ceres CLONE 1950575
  misc_feature: Encodes the peptide sequence at SEQ ID NO. 33401
ctatcagtttatctatgaaactgaaaagcacaatggaattgcagagctattggagattttgggaagtatcataaatggattcgcgttgcctcttaaggaagaacataaattgttccttgttcgagctttaattccacttcacaagccaaagtgcattgggatgtatcatcagcagttgtcttactgcatcacccagtttgttgaaaaggattgcaaacttgcagacacagttatcagaggcctattgaaatattggcccatcacaaacagctccaaggaggtgatgtttttgggagagttggaagagatattggaagctacgcaacctgcagagtttcagaaatgcatggtccctcttttccggcagattgcacggtgcctgaatagctcacactttcaggttgctgagcgagcattatttttgtggaacaacgaccatattgagagtttgatcaaacaaaatagtagggttatattgcctatcatatttcctgcactggagagaaataccaacgggcactggaaccaagctgttcaaagcctcactctaaatgtttgcaaacttttctccgaccatgatgctggtctattcgcggagtgtctgcggaaatatgaggaa

SEQ ID NO: 33401 - protein, 205 aa, Panicum virgatum
  misc_feature: Ceres CLONE 1950575
  misc_feature (1)..(205): Pfam Name: B56 Pfam Description: Protein phosphatase 2A regulatory B subunit (B56 family)
YQFIYETEKHNGIAELLEILGSIINGFALPLKEEHKLFLVRALIPLHKPKCIGMYHQQLSYCITQFVEKDCKLADTVIRGLLKYWPITNSSKEVMFLGELEEILEATQPAEFQKCMVPLFRQIARCLNSSHFQVAERALFLWNNDHIESLIKQNSRVILPIIFPALERNTNGHWNQAVQSLTLNVCKLFSDHDAGLFAECLRKYE

SEQ ID NO: 33402 - DNA, 325 bp, Panicum virgatum
  misc_feature: Ceres CLONE 1950575-R
ttgatcctgaggcttggcttcttttggcatgctaagatatgcagttgattgctgtaccatttagccttgtccgaagttggttacagtttctttcacctgctggttatgcatccttctcgtgggtagtcggtggatagaacccctagttaagagtctgaaaatgactcattgttgttgttattcttgagtctggcatgggccatcattattgtaaatggaagtacaatttttctctcctgagtacaatatgagcaagtatagctcgctgatcgcttcaagcgcattgcatactcgttattagaaatcctttcagtttcagttcatc

SEQ ID NO: 33403 - DNA, 904 bp, Panicum virgatum
  misc_feature: Ceres CLONE 1950578
  misc_feature: Encodes the peptide sequence at SEQ ID NO. 33404
aggggaagggaggaatagagagagatgtgctaacccatgaactgctcttatgcacgcgacagccataagcattgctattagggtttcatgcagggcaaagcagccggtttccgacgcctgatagccgccggaatctgcgagatctccacgagcagcgtcctcggataaggcagccggcacggcaatgccggttccccttgccccgtatccaactcctccggtgccattcacaccccccaatggggcccaaagccagcttgtctgcaccgggtgccggaatcttctcatgtatccagctggtgcgacgtctgtctgctgtgcagtttgcagcaccgtcaccgccgtgccggctccaggaactgagatggcacagttagtttgcggaggatgccacactctcctgatgtacatacgtggggcaacaagtgtacaatgttcttgctgccacactgttaatctggctatggaagcgaatcaagtcgcgcatgtaaattgcgggaactgccgtatgctgcttatgtaccagtatggcgctaggtctgtgaaatgtgcagtctgcaattttgtgacatcagttggggcctcacctggtgcagagcagaagcccagcagctgatgttcctgaaaatactgagatcacatatgaaggcagcttctgaaaaggatgctttgagtgcacatgtatagagttcttcgctgaagcaatttttccccctcctttatctccactcttcccatccattacgcgttccttcgatggacctggcgagcccgcggaataatgagagttttgggaaataattagtgctcaacttcgtcgacttgtctgtaaaactgaatgagacatacataaacatatggcgttttgtgtgtttctgaatttctgaatgttccttttgactgc

SEQ ID NO: 33404 - protein, 143 aa, Panicum virgatum
  misc_feature: Ceres CLONE 1950578
  misc_feature (104)..(128): Pfam Name: zf-LSD1 Pfam Description: LSD1 zinc finger
  misc_feature (66)..(90): Pfam Name: zf-LSD1 Pfam Description: LSD1 zinc finger
  misc_feature (27)..(51): Pfam Name: zf-LSD1 Pfam Description: LSD1 zinc finger
  misc_feature: Useful for making plants with modulated oxidative stress sensitivity
MPVPLAPYPTPPVPFTPPNGAQSQLVCTGCRNLLMYPAGATSVCCAVCSTVTAVPAPGTEMAQLVCGGCHTLLMYIRGATSVQCSCCHTVNLAMEANQVAHVNCGNCRMLLMYQYGARSVKCAVCNFVTSVGASPGAEQKPSS

SEQ ID NO: 33405 - DNA, 1133 bp, Panicum virgatum
  misc_feature: Ceres CLONE 1950592
  misc_feature: Encodes the peptide sequence at SEQ ID NO. 33406
ataccgcaactccacccaaaaccataaaaaccagtgcagcaacaatgagagataaaccttccagactctgaattttcagcatgttggcgccagcatcagcccaggtgcctcacaccatacgaccaattgcaaactgctttgggcttcatcgacgatctgtgctgaatttggaccgatatcacagatggcgggggactggaaagaagatgatcctttccactcgtggtgtgctcgaatccagcaatggtgcaccgtctggtggccttgtgaagaaaagaaagattgtggagcacattattctgcttcgagccaagccaaacatctcagacgctgaagagaaagatatgctggattatctatatacatcacaataccagatgagagggatactcacaatctcgttgggccgcatagaggagccaaatagcgagaactttacgcatgctgtcttcatgcgttttcagcagaaagaagacattgcgaagttccagagtagtgcctactattccaaaattcttgatgaccacgtaaaacctgtttcctatggctcagtttctgtagatttcgagtctgaggtggaagatgacattattcccctctttygtaggggagaggattttaactacggtgttgagtttatgttgctgatatctttcttggaaactgcatctcgagaggcaatggaggatgcatcatcttctctgcagaggctgatcagccaatgcagttcatttattgtgcaggcaacctgtggccactgtttgaatccggaaaacggatataatcacgctgcactgatccgctttccatcatctgatgactttaagttgttcagggagagcatggagtacaaggatatgtgggcatcaaagttccatccgattgtggagaaatccctccagatacatttcaccgtcgaccccgtggggaaccagctgatgtagaccagtcatgcctcagcactcttcaccgatcttgctgggagttgaactccatctctgctcattctggttgaaaaggatggaaatgttttactgtagtttgcgcactccgtcccaaagtgtcactgcaaattgtgctccagctccacaacttgttgttcaatatatataaataggagaagcgtgcttctt

SEQ ID NO: 33406 - protein, 287 aa, Panicum virgatum
  misc_feature: Ceres CLONE 1950592
  misc_feature (69)..(164): Pfam Name: Dabb Pfam Description: Stress responsive A/B Barrel Domain
  misc_feature (184)..(279): Pfam Name: Dabb Pfam Description: Stress responsive A/B Barrel Domain
  misc_feature (175)..(175): Xaa is any aa, unknown, or other
MLAPASAQVPHTIRPIANCFGLHRRSVLNLDRYHRWRGTGKKMILSTRGVLESSNGAPSGGLVKKRKIVEHIILLRAKPNISDAEEKDMLDYLYTSQYQMRGILTISLGRIEEPNSENFTHAVFMRFQQKEDIAKFQSSAYYSKILDDHVKPVSYGSVSVDFESEVEDDIIPLFXRGEDFNYGVEFMLLISFLETASREAMEDASSSLQRLISQCSSFIVQATCGHCLNPENGYNHAALIRFPSSDDFKLFRESMEYKDMWASKFHPIVEKSLQIHFTVDPVGNQLM

SEQ ID NO: 33407 - DNA, 719 bp, Panicum virgatum
  misc_feature: Ceres CLONE 1950619
  misc_feature: Encodes the peptide sequence at SEQ ID NO. 33408
agtcgagccgagcgctcctcctcctcctcctcctctctctctctctcttccccctcttcggttacccacccacctgaggggcgtctcgctgagctgcttgagcgcgccgtaccggtcgaggtccacctgtgctccgtctccgctgctacctgaagaaactccttataagttcctgcttttctctgtgggcgcatctgccactgtattggtaaagatgggttgctgctttatgtttggaaagaaagctgaacaggccgttcagggcgatgatgatgtacatagtgtgaaagtcttctcttacaatgagttgagaaaggctacacaagatttcagtggtggaaataagattggcgagggtggttttggttctgtcttcaggggagtgcttaaagatgggacagtagttgcagtgaaagttctatctgctacatcaaggcaaggtatccgggagtttttgactgaacttacagcaatatctgacatcaagcacgaaaatctggtcactcttatcggttgctgcgctgaaggctctcacagaatccttgtttacaattaccttgagaacaacagccttgctcagacattgctaggaaccaggtatagtaacattcggttcaactggcggacacgcgtcaaaattgctatgggtgttgcccgtggacttgcatttctccctgaagaaatccgacctcccattatccaccggggacataaaggcg

SEQ ID NO: 33408 - protein, 168 aa, Panicum virgatum
  misc_feature: Ceres CLONE 1950619
  misc_feature (39)..(168): Pfam Name: Pkinase_Tyr Pfam Description: Protein tyrosine kinase
  misc_feature: SWISSPROT Homolog: EC 2.7.11.1 Non-specific serine/threonine protein kinase
MGCCFMFGKKAEQAVQGDDDVHSVKVFSYNELRKATQDFSGGNKIGEGGFGSVFRGVLKDGTVVAVKVLSATSRQGIREFLTELTAISDIKHENLVTLIGCCAEGSHRILVYNYLENNSLAQTLLGTRYSNIRFNWRTRVKIAMGVARGLAFLPEEIRPPIIHRGHKG

SEQ ID NO: 33409 - DNA, 603 bp, Panicum virgatum
  misc_feature: Ceres CLONE 1950622
  misc_feature: Encodes the peptide sequence at SEQ ID NO. 33410
gattgctcatgtcctttgattcccttccgtgtgctgccgaaattccccttcctaccaacattttccacctccaaaatcgatgctggcctccactggtcttctgatccaagccggctggaatcctccatctccttcctgcaagatctgatactcaaggggaatcgagtacaactgccttgcaatgaggccggagacgcggcttgaatcggcggtgttccagctcaccccgacccgcaccaggtgtgatttagttgtggtggcgaatggaaggaaggaaaagatagcctctggtttgctgaacccattcatcgctcatcttaaggttgcacaagagcagattaccaagggaggctattccatcacacttgagccagatccagagattgatgcatcatggtttaccaggggaacagtggagagatttgttcgttttgtcagtacaccggaggtcctggagcgagtcacaacaatagagtccgaaatattgcagattgaagatgccatttccgtccaggtcaatgaaagccttggtttgagatctgcacctgtggaagaccgaaatgggaaattggtggactgcatggaagagctcaactgcttaga

SEQ ID NO: 33410 - protein, 140 aa, Panicum virgatum
  misc_feature: Ceres CLONE 1950622
  misc_feature: Useful for making plants with altered cell wall content and/or composition
MRPETRLESAVFQLTPTRTRCDLVVVANGRKEKIASGLLNPFIAHLKVAQEQITKGGYSITLEPDPEIDASWFTRGTVERFVRFVSTPEVLERVTTIESEILQIEDAISVQVNESLGLRSAPVEDRNGKLVDCMEELNCL

SEQ ID NO: 33411 - DNA, 575 bp, Panicum virgatum
  misc_feature: Ceres CLONE 1950633
  misc_feature: Encodes the peptide sequence at SEQ ID NO. 33412
atccagctcatacttccagttcaaacatcgtcttcagttccaggcaaggcggagcagcaaggcgatcacgatcagaaaggctgccgttttgtgttctccggcacggcagaggcactgctcgacttcaagcacggcatcaccagcgatccgaatggagccttgaacaattggaccacgaggtcccacttctgtcactggaatggtgtcaagtgcaccttggagcaaccacggcgcgtcagggggctccaactgacaagccaaagtttgtcaggccaaatcagctcatctcttggcaaccttactttccttcattaccttgacctctcctataataactttgttggtcccttacctcatctcggccgcctccaacaactgcatattctttatttatacaacaacagtttgtctgggataattcctgatgcacttacaaactgctccaacttgaccgccatagatttatcttcaaacttgctagtgggttcaattcctccgaaattaggtctactatccaatctaggatatctcaacttgatgtcaaatcaactcaatggaagcattcctggtgagct

SEQ ID NO: 33412 - protein, 191 aa, Panicum virgatum
  misc_feature: Ceres CLONE 1950633
  misc_feature (32)..(72): Pfam Name: LRRNT_2 Pfam Description: Leucine rich repeat N-terminal domain
  misc_feature: SWISSPROT Homolog: EC 2.7.11.1 Non-specific serine/threonine protein kinase
IQLILPVQTSSSVPGKAEQQGDHDQKGCRFVFSGTAEALLDFKHGITSDPNGALNNWTTRSHFCHWNGVKCTLEQPRRVRGLQLTSQSLSGQISSSLGNLTFLHYLDLSYNNFVGPLPHLGRLQQLHILYLYNNSLSGIIPDALTNCSNLTAIDLSSNLLVGSIPPKLGLLSNLGYLNLMSNQLNGSIPGE

SEQ ID NO: 33413 - DNA, 238 bp, Panicum virgatum
  misc_feature: Ceres CLONE 1950633-R
ctctttgggaaaacttacgaatttgactgtcttaaaccttcaaaataaccagcttgtagcaagggacaaacaggactgggaattcttgaatgcattaagtaactgtagatcgctacaacggcttaagttgcgtggaaacagcctgtctgggcaagttccatagagtatagggaaacttagtgccttgatttggcttggacttggtgagaacaattttagtggtacaattgatggatgg

SEQ ID NO: 33414 - DNA, 618 bp, Panicum virgatum
  misc_feature: Ceres CLONE 1950637
  misc_feature: Encodes the peptide sequence at SEQ ID NO. 33415
atccagtccccaatccgtcgagaaattcctcccgagccatcgaaatcgaagcgaagcgaagcggcctcccccgatcctctcaagatctttgttaagaccctcaccgacaagaccatcactttggaggttgagtcgtctgacaccattgacaatgtgaaggccaagatccaggacaaggagggcatccctccggaccagcagcgtctgatcttcgctggcaagcggcttgaggatggccgcaccctagcagactacaacatccagaaggagtccaccctccacctggtgctccgcctgcgtggtggtatgcagatctttgtgaagaccctcactggcaagaccatcaccttggaggtggagtcttccgacaccatcgacaatgtgaaggcgaagatccaggacaaggagggcatccccccggaccagcagcgtctgatcttcgccggcaagcagctggaggatggccgcaccctggcggactacaacatccagaaggagtccaccctccacttggtactccgtctgcgtggtggtatgcagatctttgtgaagaccctcactggcaagaccatcacctttggaggtggagtcttctgacaccattgacaacgtgaaggc

SEQ ID NO: 33415 - protein, 198 aa, Panicum virgatum
  misc_feature: Ceres CLONE 1950637
  misc_feature (108)..(176): Pfam Name: ubiquitin Pfam Description: Ubiquitin family
  misc_feature (32)..(100): Pfam Name: ubiquitin Pfam Description: Ubiquitin family
  misc_feature: Useful for making plants with modulated nitrogen use efficiency
  misc_feature: Useful for making plants with modulated cold sensitivity
  misc_feature: Useful for making plants with modulated flowering time
IQSPIRREIPPEPSKSKRSEAASPDPLKIFVKTLTDKTITLEVESSDTIDNVKAKIQDKEGIPPDQQRLIFAGKRLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITFGGGVF

SEQ ID NO: 33416 - DNA, 624 bp, Panicum virgatum
  misc_feature: Ceres CLONE 1950643
  misc_feature: Encodes the peptide sequence at SEQ ID NO. 33417
ttctacacaagcattcctgttttaactaccgtcctggacaaggatttatctaaaaagacagtgatgcaaaacccagagatattactttactgtcaagctggaaggcttctcaatccaagcacttttgctggttggtttggtcgatcattgtatcatgcaatcattattttcttgataaccattcatgcatatgcgaatgagaaaagtgatatggaggagctgtcaatggttgcactctcaggaagcatttggctgcaggcatttgttgtgacattggagatgaattccttcacttttgtccaactcctggccatatggggaaacttcattgccttctatgtcatcaacttcttcatcagcagtataccagcttcaggaatgtacacaatcatgtttcgcctttgcagacaaccatcatactggataacactggtgctgatcagtggagttggaatgggtcctgtattagctctgaagtatttcagatatacatacagacctagcgctatcaacattcttcagaaggccgagcgctcacggggcccaatgtacacccttgtgaatctggagtctcaactgaagtcagacaaagataatatggtatcgagttccacaatgccagtc

SEQ ID NO: 33417 - protein, 207 aa, Panicum virgatum
  misc_feature: Ceres CLONE 1950643
  misc_feature: SWISSPROT Homolog: EC 3.6.3.1 Phospholipid-translocating ATPase
FYTSIPVLTTVLDKDLSKKTVMQNPEILLYCQAGRLLNPSTFAGWFGRSLYHAIIIFLITIHAYANEKSDMEELSMVALSGSIWLQAFVVTLEMNSFTFVQLLAIWGNFIAFYVINFFISSIPASGMYTIMFRLCRQPSYWITLVLISGVGMGPVLALKYFRYTYRPSAINILQKAERSRGPMYTLVNLESQLKSDKDNMVSSSTMP

SEQ ID NO: 33418 - DNA, 148 bp, Panicum virgatum
  misc_feature: Ceres CLONE 1950643-R
ccggattccccgaaggccaaaaccaattgctttcagcggaattggtagttgggcagttttgttaaggtttctagatattgcccgaaaagataaactgaaaagacagaagtcttttgtattctacactgtattctttacaccttgtagc

SEQ ID NO: 33419 - DNA, 644 bp, Panicum virgatum
  misc_feature: Ceres CLONE 1950655
  misc_feature: Encodes the peptide sequence at SEQ ID NO. 33420
ccggcgccactcgctcgtgccccccgcgcctctctccggtccctactcgcgtctggatccctcctccgatctctcttctctcgggggagcagggaggaggaggatggaaggccctcccgtcgcgcttttcgacagcctcggggctgccaaaactttcttcttgctagctgggaccaatgtgattgaatcggaggagcgtgtcctgaagatggccaaacacattaaaagcatccccaccaagcttgggatcccacttgtgttcatatctagcttcgatgaacccaatcatacatcatcaaagtctttccgtggccctggtctggaagaaggactgaatatccttgataaggtgaaagcgacatatgaccttccagatgtcactgatgtgcatgacagccaccagtgtgaagctgttggaaaagttgctgacattatacagattccagctttcctctgtcgccagactgatcttctcgtgggtgctgctgagactggaaaaattatcgatatcaagaaaggacaattctgtgcaccctctgttatggtcaactctgcggagaaaataagacttgctggagatcctaatgtgatggtctgtgagcgtggtaccatgtttggctacaatgatctaattgttgacccac

SEQ ID NO: 33420 - protein, 180 aa, Panicum virgatum
  misc_feature: Ceres CLONE 1950655
  misc_feature (10)..(180): Pfam Name: DAHP_synth_1 Pfam Description: DAHP synthetase I family
  misc_feature: SWISSPROT Homolog: EC 2.5.1.55 3-deoxy-8-phosphooctulonate synthase
MEGPPVALFDSLGAAKTFFLLAGTNVIESEERVLKMAKHIKSIPTKLGIPLVFISSFDEPNHTSSKSFRGPGLEEGLNILDKVKATYDLPDVTDVHDSHQCEAVGKVADIIQIPAFLCRQTDLLVGAAETGKIIDIKKGQFCAPSVMVNSAEKIRLAGDPNVMVCERGTMFGYNDLIVDP

SEQ ID NO: 33421 - DNA, 424 bp, Panicum virgatum
  misc_feature: Ceres CLONE 1950655-R
  misc_feature: Encodes the peptide sequence at SEQ ID NO. 33422
ttggtgttgatggtattgtcatggaggtacatgtatgatcccttgaatgcgccatgtgatggcccaacccaatggccattgcgcaatttggaggagctattggaggaattgttagcaatcgttcgagttaccaagggaaagaagccgttcaagattgatctctcaccgttcctaggaatgatctggtttggtagattgagagcacaatgacactgtccagtggtttcaccagggcgtatttgtcattgttgtacttgttattgttttgggcatagctgccgtagacaagtgttatatatgacctatgtgaattgaatcctgtggttgctttgtgttgtttcattggttatcccaggttatgggacaatcaatatcatgcaaaataaatgtgattgcttgcggattaccagctttctgtttcggt

SEQ ID NO: 33422 - protein, 69 aa, Panicum virgatum
  misc_feature: Ceres CLONE 1950655-R
  misc_feature: SWISSPROT Homolog: EC 2.5.1.55 3-deoxy-8-phosphooctulonate synthase
LVLMVLSWRYMYDPLNAPCDGPTQWPLRNLEELLEELLAIVRVTKGKKPFKIDLSPFLGMIWFGRLRAQ

SEQ ID NO: 33423 - DNA, 652 bp, Panicum virgatum
  misc_feature: Ceres CLONE 1950657
  misc_feature: Encodes the peptide sequence at SEQ ID NO. 33424
aaggaacagcaagaacagaaaaccagaggagcaatcccagcaatggcagcaaggtgtgctctttctgccccatccagctgcttggttcgccaacccctctgcggcaacgagctcgccaagaaactcactccatgcctgctgccgtcgccaagagccgtgagggtgagagtgaatgctgcaaagcttcctccaggggttgaggtgcccagggtgcagccgaagttgagcgagcccttcttggggttcacccagactgccgagatctggaactccagggcctgcacgatgggactcatcggcaccttcatcgtggagctggtgctgaacaaggggattcttcagataattggggtggaggtggggaagggcctcgaccttcctctttaattgccaatctgatggcaaccttactctctctgtttttttttctttttgaaacctagctactatatatttctctaaacattattctgtcgaatgaagatactcatgcaattctgttgtgtaaccatatgacagagttttttaagttctcaaagctatctgtgctgcacttgagaaaatcaaaagtattagaatatgagtcctaaacagcatagaaagggttttcaatactttagttatcctcggagcatggatcatctggaagcac

SEQ ID NO: 33424 - protein, 114 aa, Panicum virgatum
  misc_feature: Ceres CLONE 1950657
  misc_feature: SWISSPROT Homolog: EC 4.99.1.1 Ferrochelatase
MAARCALSAPSSCLVRQPLCGNELAKKLTPCLLPSPRAVRVRVNAAKLPPGVEVPRVQPKLSEPFLGFTQTAEIWNSRACTMGLIGTFIVELVLNKGILQIIGVEVGKGLDLPL

SEQ ID NO: 33425 - DNA, 311 bp, Panicum virgatum
  misc_feature: Ceres CLONE 1950657-R
gaacagttgcatttttttatggatctgcccctaccctccagaatgccctgcaggcctttcaaagtaaagcacttctttggcaatttgcaggagcaaaagggcttgccgccctaggtcttggccgtgtaggatagtggagccattagtgtgtttggctgtggtcagatcctagatcttttcttttttgtaatagtttctcttttggtgaggttgttttttttccccccccccatttggttccagggggggagtggttttattgtaattggactatctcttctccttaatacaaagatacgcagctctcatgt

SEQ ID NO: 33426 - DNA, 724 bp, Panicum virgatum
  misc_feature: Ceres CLONE 1950659
  misc_feature: Encodes the peptide sequence at SEQ ID NO. 33427
atataccgcaactccacccaaaaccataaaaaccagtgcagcaacaatgagagataaaccttccagactctgaattttcagcatgttggcgccagcatcagcccaggtgcctcacaccatacgaccaattgcaaactgctttgggcttcatcgacgatctgtgctgaatttggaccgatatcacagatggcgggggactggaaagaagatgatcctttccactcgtggtgtgctcgaatccagcaatggtgcaccgtctggtggccttgtgaagaaaagaaagattgtggagcacattattctgcttcgagccaagccaaacatctcagacgctgaagagaaagatatgctggattatctatatacatcacaataccagatgagagggatactcacaatctcgttggaggagccaaatagcgagaactttacgcatgctgtcttcatgcgttttcagcagaaagaagacattgcgaagttccagagtagtgcctactattccaaaattcttgatgaccacgtaaaacctgtttcctatggctcagtttctgtagatttcgagtctgaggtggaagatgacattattcccctctttcgtaggggagaggtatctcaagctgccttattctggcgcaaattggtaccattctttactatgtaaaatacccattgcatttcaacagaaaagctggtccttgtgtcaggattttaactacggtggtga

SEQ ID NO: 33427 - protein, 192 aa, Panicum virgatum
  misc_feature: Ceres CLONE 1950659
  misc_feature (69)..(161): Pfam Name: Dabb Pfam Description: Stress responsive A/B Barrel Domain
MLAPASAQVPHTIRPIANCFGLHRRSVLNLDRYHRWRGTGKKMILSTRGVLESSNGAPSGGLVKKRKIVEHIILLRAKPNISDAEEKDMLDYLYTSQYQMRGILTISLEEPNSENFTHAVFMRFQQKEDIAKFQSSAYYSKILDDHVKPVSYGSVSVDFESEVEDDIIPLFRRGEVSQAALFWRKLVPFFTM

SEQ ID NO: 33428 - DNA, 361 bp, Panicum virgatum
  misc_feature: Ceres CLONE 1950659-R
ggaaaacggatatatcccggggccatgatccgctttccattcttctgatgactttaagttgttcagggagagcatggagtacaaggatatgtgggcatcaaagttccatccgattgtggagaaatccctccagatacatttcaccgtcgaccccgtggggaaccagctgatgtagaccagtcatgcctcagcactcttcaccgatcttgctgggagttgaactccatctctgctcattctggttgaaaaggatggaaatgttttactgtagtttgcgcagtccgtcccaaagtgtcactgcaaattgtgctccagctccacaacttgttcaatatatataaataggagaagcgtgcttctt

SEQ ID NO: 33429 - DNA, 1018 bp, Panicum virgatum
  misc_feature: Ceres CLONE 1950693
  misc_feature: Encodes the peptide sequence at SEQ ID NO. 33430
acggttagttgatctgtggccagttggtcgcgcggccttgctgtgcctcgatttgtttgattccgttcctcgctgctcctcggtttgatttgattgattccgagaggttggtggtgataaggaaagcggaaaacgcacaccatgggatccaaagaacctctctttctcttgctcctctcgctgcttgtcgtctcggtgcttgcacaagccagggatgctgataacggcccagtctacaaggaacaaatctcttcaaccaagattcctgtccatcgcaagagtagtagcccaatatgctcagcctgcggaaacttcacgactcaagctctcagttatctcaatgagaagcaaacacaagataagatcagggaattccttcatgatgcttgttgtcagtcattctccttggaacggaagtgtgtagagttgatggactcttatgcaactatactgttttccaagattacggatatcaatccaaaagagttttgcaaacagtatggcctgtgcagggacatagcccttttctctggtgtgacaagtgacagcacttgtgtgttttgccatcacctgcttgatgaaattgtgtccaaactgaaagatccagacgcagagtttgagatcattcaaattctcattaaggagtgcaataagattgaaggtcatgtccagcagggcaagagactggtcgtgcaatacattcctctcatcgtggggaatggtgagaagtttgaagagaaggagggaggggtgcttgtttatacaagcgtgtccggccagcgaagtcttggaaggggtgttgctcagtgatgcttgaaggttgaaagaacgcgcgaagtatgtagcaatggtgcaaatagtgtgtacaaactagggcgagttgtacataataaggtcatgaatggatgaaggatgggtgtctcgtgtttctgcattcttttcatcttgtatcgtgaacacattgtattaagtaaactttcatatacatccagaaagtgcagatcgtgcagcattagtc

SEQ ID NO: 33430 - protein, 222 aa, Panicum virgatum
  misc_feature: Ceres CLONE 1950693
  misc_feature (135)..(173): Pfam Name: SapB_1 Pfam Description: Saposin-like type B, region 1
  misc_feature (49)..(88): Pfam Name: SapB_1 Pfam Description: Saposin-like type B, region 1
MGSKEPLFLLLLSLLVVSVLAQARDADNGPVYKEQISSTKIPVHRKSSSPICSACGNFTTQALSYLNEKQTQDKIREFLHDACCQSFSLERKCVELMDSYATILFSKITDINPKEFCKQYGLCRDIALFSGVTSDSTCVFCHHLLDEIVSKLKDPDAEFEIIQILIKECNKIEGHVQQGKRLVVQYIPLIVGNGEKFEEKEGGVLVYTSVSGQRSLGRGVAQ

SEQ ID NO: 33431 - DNA, 1170 bp, Panicum virgatum
  misc_feature: Ceres CLONE 1950698
  misc_feature: Encodes the peptide sequence at SEQ ID NO. 33432
gccttcgtgctgaacagatgccccgttctggagaagctcctgattgtcggcagccggtggccggtttgccttcgcgttcggagccacagcctacggttggtggaggtgtgccagggtcttgtgccagaaatcactgtgctgcacgctccacgcctggagaggctcttgttgtggcaagcttggggtggtgatgatttatgcaacatgtcctccaagatcatgattgtccatgccccgaagctatgtttcctaggattcttggtgcccggaatgcacaaactggagattgggaacaccattatcaaggctcagagtaaggcaagcccaagcaccactgttccgagtgtgcagatgctggcagttcagctcaaacttgaaacccgcattgaagcgaggttgttgccgagtttcctcagatgctttcccaatgttgagacactctacatccagtccgagaatgatgacctcaagttctggggacctcaatgcactggtgctggcaaattaaatttgaagttctggaaggaggcagggtccattgaatgtgttcagcgccatatcaagaaggtggttctccgtgagttccgtgggacgagaagcgagcttgacttcctcaagttcatagctgagcaagcacaagttcttgaaaagatggtgattgtgttgacccatggtcattccccttctgatccartaggtacaaacctgargaccaaaatggtttttgcaaagtgggccaatgcacgctgtgagctgatgatttttcagactccatttcatcaagaaggtacagcttggtgcttcctatctgcatttgatctttctaacccagatccttttgatgtttcaaaatgtctggatgggaaatgtcaaaatcattagtgtgctgttcctgtatccatatgcaagacactgttttcaattgttggcaatgtgttttctgaagattggtaagcgttcagtgactttaagtgtagaacctatttagcctcatatggcttcgagaagacttgcgttgcttatgtaatctgttttctgcttcaagtgatatttcagtggacagcttgtggctaatgtttgctgatgggaaaatttatgcttcgcttgccatatgccagtttgtattagtgtcttccttacaaagaaatatattccatttggcatcgcgtc

SEQ ID NO: 33432 - protein, 293 aa, Panicum virgatum
  misc_feature: Ceres CLONE 1950698
  misc_feature (173)..(222): Pfam Name: FBD Pfam Description: FBD
  misc_feature (232)..(232): Xaa is any aa, unknown, or other
  misc_feature (237)..(237): Xaa is any aa, unknown, or other
AFVLNRCPVLEKLLIVGSRWPVCLRVRSHSLRLVEVCQGLVPEITVLHAPRLERLLLWQAWGGDDLCNMSSKIMIVHAPKLCFLGFLVPGMHKLEIGNTIIKAQSKASPSTTVPSVQMLAVQLKLETRIEARLLPSFLRCFPNVETLYIQSENDDLKFWGPQCTGAGKLNLKFWKEAGSIECVQRHIKKVVLREFRGTRSELDFLKFIAEQAQVLEKMVIVLTHGHSPSDPXGTNLXTKMVFAKWANARCELMIFQTPFHQEGTAWCFLSAFDLSNPDPFDVSKCLDGKCQNH

SEQ ID NO: 33433 - DNA, 713 bp, Panicum virgatum
  misc_feature: Ceres CLONE 1950711
  misc_feature: Encodes the peptide sequence at SEQ ID NO. 33434
gtaccaattgctctcacgagttatttttgacaaaggagctcttctcttcaccacagtaggaaacaatgcgactttccagcctaatccgaactctgtttatcaaacagagcacctttcttatttcaagtttgttggtcgagtggttgctaaagcattatttgatggtcaattgttggatgtccactttacccgttccttttacaaacacatcctcggtgctaaagtaacatatcatgatatagaggctatcgatcctgattactacaaaaatttgaagtggatgctggagaatgatgtaagtgaccttcctgatttaacattcagcatggatcctgacgaggaaaaacatattctctatgagaagactgaggtaactgattatgagctaaaacccggcggaagaaacatcagggtcacggaggaaacaaagcaagaatatgttgaccttgtagctgaacatatactgaccacagcaattcgtcctcaaattaatgcttttcttgagggcttcacagagttagttccaagggacctaatagccctatttaatgataaagaacttgaactactgatcagtggtcttcctgaaattgacctgaatgatctgaaggctaatgcggaatatatcggatattctgctgcatctcctgtcatccagtggttctggcaagttgttaaagctttcagcaaggaggacatggccagactactgc

SEQ ID NO: 33434 - protein, 237 aa, Panicum virgatum
  misc_feature: Ceres CLONE 1950711
  misc_feature (2)..(237): Pfam Name: HECT Pfam Description: HECT-domain (ubiquitin-transferase)
YQLLSRVIFDKGALLFTTVGNNATFQPNPNSVYQTEHLSYFKFVGRVVAKALFDGQLLDVHFTRSFYKHILGAKVTYHDIEAIDPDYYKNLKWMLENDVSDLPDLTFSMDPDEEKHILYEKTEVTDYELKPGGRNIRVTEETKQEYVDLVAEHILTTAIRPQINAFLEGFTELVPRDLIALFNDKELELLISGLPEIDLNDLKANAEYIGYSAASPVIQWFWQVVKAFSKEDMARLL

SEQ ID NO: 33435 - DNA, 578 bp, Panicum virgatum
  misc_feature: Ceres CLONE 1950711-R
gctttggctgatctgttgctccatggagtgctaaagagcgcactggtcattgtttttctgcttgccatgtacagattttgaaggcaattgagatggtcacagatgctatatataacatagatcgagccaaggagcgagcgttttgggaatgctcaggttgaagttgggatccaaaattttcttggaacagtcaatcaggatgtggggcgggtacagtattagagctctgcgacaacaagaatgctggtgtaactaagcttccatttgccttcaagttaaatagtcgaatgtaaattcgtttaatgctttataccaatcgttctggtcatttttgtactgcttcctccgattctgggagccagggcaggttctgcaaataaataagccatctggtaatgccatggctctatgtttatttaatcagctttttatgttttatctattattttttaaaagctcacgtattctgttatagcctcgtgcaaaaatgccttggaaggttctgcaattgaataccagctttcaagctcttaaacttgaataggaaggttatgtagttggtgtttttcagtcgattt

SEQ ID NO: 33436 - DNA, 1221 bp, Panicum virgatum
  misc_feature: Ceres CLONE 1950713
  misc_feature: Encodes the peptide sequence at SEQ ID NO. 33437
gttcaccgccgcctccaccgacctgttcctgacgccgcccgccgttcccctcccttcttctccgctgccggctgaagccacctgctcggcggctcccaactgagcggccaggatgcgggttaagaagcgttcgaagcaccgcaaagcggtcaagttctattccacctgcttcggcttccgcgagccttacaaggtcctcatcgacggcaccttcgtccaccacctcatcacccagcgcctctgcccggccgatgaggcactccgcgacctcctatcggcctccaggacgccagccctcttcacctccaagtgtatcgtcgcagagctcaggcgactcggcaagtcgcatgccgaatccttcgacgccgctcagcttctcgccacaaccaactgtgagcatgacaaggttgtcagtgcagtgaattgtgtcccaacactgataggtgataagaatcctgagcatttctttgttgccacccaagacgctgatctccgggaaaagctaagagagattcctggggttcctgtaatatatggactgaagaactccttatttatagagcaaccctctgttcagcaacgcaagtttgctcaattggacgaggagaagcgtctcaatatggatatatctgagtataagaagttaatgaaggcttcatcagaaggaaagacaacagctagtgaaaatggaagtgacggagaacaacatgagaggcctttcagttcccttgtaaaaaatgcacttggtgttgcagataaaagcaagtttaaaaggaacagagcaaagggtccaaacccactctcctgcaagaaaaagaaaccaaagccccagccctcagctattcaaaatcagggggctatggttgatggcgaggcaaagagaaagagggttcgtaagcggaagagaagccagaaagatgacaaacaagcagagacgacgagctaaatgagcttgtatactaagtttcagttctcttgctgcgtctccatcttgacccctgaggacctgaacaagaactaagtcaactaggggagacttcacttgggagaaaaagaactttgaagacgtatatcccacaagattcaggatgccatgccatgctccttatatgctgacaatgttatgccatgccatgccgaactcctatgctgacgatgttccttgcgatgtactagtacttgattgtttgcagtaatcatgatctctagaggctgtagctg

SEQ ID NO: 33437 - protein, 277 aa, Panicum virgatum
  misc_feature: Ceres CLONE 1950713
  misc_feature (51)..(152): Pfam Name: Fcf1 Pfam Description: Fcf1
MRVKKRSKHRKAVKFYSTCFGFREPYKVLIDGTFVHHLITQRLCPADEALRDLLSASRTPALFTSKCIVAELRRLGKSHAESFDAAQLLATTNCEHDKVVSAVNCVPTLIGDKNPEHFFVATQDADLREKLREIPGVPVIYGLKNSLFIEQPSVQQRKFAQLDEEKRLNMDISEYKKLMKASSEGKTTASENGSDGEQHERPFSSLVKNALGVADKSKFKRNRAKGPNPLSCKKKKPKPQPSAIQNQGAMVDGEAKRKRVRKRKRSQKDDKQAETTS

SEQ ID NO: 33438 - DNA, 316 bp, Panicum virgatum
  misc_feature: Ceres CLONE 1950725
  misc_feature: Encodes the peptide sequence at SEQ ID NO. 33439
attccagtccccaatccgtcgagaaattctcgcgagcgatcgaaatctaagcgaagcgaagaggcctccccagatcctctcaagatgcagatctttgtgaagaccctcaccggcaagaccatcaccatggaggtggagtcatctgacaccattgacaatgtgaaggccaagatccaggacaaggagggcatccccccggaccagcagcgtctgatcttcgctggcaagcagctggaggatggccgcaccctggcggactacaacatccagaaggagtccaccctccacttggtgctccgtctgcgtggtggtatgc

SEQ ID NO: 33439 - protein, 77 aa, Panicum virgatum
  misc_feature: Ceres CLONE 1950725
  misc_feature (6)..(74): Pfam Name: ubiquitin Pfam Description: Ubiquitin family
  misc_feature: SWISSPROT Homolog: EC 3.1.2.15 Ubiquitin thiolesterase
  misc_feature: Useful for making plants with modulated nitrogen use efficiency
  misc_feature: Useful for making plants with modulated cold sensitivity
  misc_feature: Useful for making plants with modulated flowering time
MQIFVKTLTGKTITMEVESSDTIDNVKAKIQDKEGIPPDQQRLIFAGKQLEDGRTLADYNIQKESTLHLVLRLRGGM

SEQ ID NO: 33440 - DNA, 543 bp, Panicum virgatum
  misc_feature: Ceres CLONE 1950725-R
  misc_feature: Encodes the peptide sequence at SEQ ID NO. 33441
aagcagctggaggatggccgcaccctggcggactacaacatccagaaggagtccaccctccatctggtgctccgcgtgcgtggtggtatgcagatctttgtgaagaccctcaccggcaagaccatcaccttggaggtggagtcttctgacaccatcgacaatgtgaaggcgaagatccaggacaaggagggcatcccaccggaccagcagcgtctgatcttcgccggcaagcagctggaggatggccgcaccctggcagactacaacatccagaaggagtccaccctctacctggtgctccgtctccgtggtggacagtaagtccatggagctgctgttgtccctgggttcacaagtctggtgccttgccttgtctctccaatggtgattgcctgcgtgtcctgtggtcgtgtccttgtcatgcctgtctgatgcgagttttatgtcgtctggttgtgttttgtgaacacttgctgctgtgcagcaatttggttgaactatgtaatgaataagtgagccatgaagttactatggtaatcttgc

SEQ ID NO: 33441 - protein, 106 aa, Panicum virgatum
  misc_feature: Ceres CLONE 1950725-R
  misc_feature (35)..(103): Pfam Name: ubiquitin Pfam Description: Ubiquitin family
  misc_feature: SWISSPROT Homolog: EC 3.1.2.15 Ubiquitin thiolesterase
  misc_feature: Useful for making plants with modulated nitrogen use efficiency
  misc_feature: Useful for making plants with modulated cold sensitivity
  misc_feature: Useful for making plants with modulated flowering time
KQLEDGRTLADYNIQKESTLHLVLRVRGGMQIFVKTLTGKTITLEVESSDTIDNVKAKIQDKEGIPPDQQRLIFAGKQLEDGRTLADYNIQKESTLYLVLRLRGGQ

SEQ ID NO: 33442 - DNA, 695 bp, Panicum virgatum
  misc_feature: Ceres CLONE 1950740
  misc_feature: Encodes the peptide sequence at SEQ ID NO. 33443
aggctcagatcagattccgatcacccgtgttccgcccccaatctcctcgtgttcgctcgtgtcgctgtttccagggacgcctccggctcgtcgctccacagagatctccgcctcccacaagatgcagatctttgttaagaccctgactggcaagaccatcactcttgaggtcgagagctcagacaccattgacaatgtcaaagccaagatccaggacaaggagggcatccccccggaccagcagaggctcattttcgctgggaagcagctagaggatggtcgcaccctggctgactacaacatccaaaaggagtctactctccaccttgtcctgcgtctgaggggtggcatgcagatttttgtgaagactctcactgggaagaccatcactctcgaggtcgagagctccgacaccatcgacaatgtcaaggccaagattcaggataaggagggcatccccccggaccagcagaggctcatctttgctggcaagcagcttgaggatggtcgtacgctagctgactataacatccagaaggagtccaccctccaccttgtcctgcgtctgaggggtggcatgcagatatttgtgaagaccctcaccgggaagaccataactcttgaggttgagagctccgacaccatcgacaatgtcaaggcaaagattcaggaaaaaaagggaatcccacctgatc

SEQ ID NO: 33443 - protein, 191 aa, Panicum virgatum
  misc_feature: Ceres CLONE 1950740
  misc_feature (6)..(74): Pfam Name: ubiquitin Pfam Description: Ubiquitin family
  misc_feature (82)..(150): Pfam Name: ubiquitin Pfam Description: Ubiquitin family
  misc_feature: Useful for making plants with modulated nitrogen use efficiency
  misc_feature: Useful for making plants with modulated cold sensitivity
  misc_feature: Useful for making plants with modulated flowering time
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQEKKGIPPD

SEQ ID NO: 33444 - DNA, 768 bp, Panicum virgatum
  misc_feature: Ceres CLONE 1950745
  misc_feature: Encodes the peptide sequence at SEQ ID NO. 33445
gaaagtgtcctcgtccttcagttccagcctccgaatctctctgcatctctgtgatcgaggaagagaggaggtgccaacaaacatggtgcacgggaagctggaggttctccttgtctccgccaagggccttgaggacaccgattttctcaataacatggacccctacgtgatccttacatgccgcacccaggagcagaaaagcagcgttgcaaatggagcaggaagtgaccctgaatggaacgaaaccttcatcttcactgtctctgacgataccccgcagcttagcctcaagatcatggacagcgacgtcaccaacgatgatttcgttggtgaagcaagcatcccgctggaggctgtgtttcaggaaggcagccttcccccgacagttcacccagtcgtcaaggaggataaatactgtggagagatcaagcttgcactcaccttcactccagcagtggaaactcgccgccctgacaacgagggtacttacagcagctggaattgatctgcccgatgtgtgcactgagcaatagcataatttactgaagagttactactgttatgcaacattattttgctttgtcatgaactgaatatttgcatgtaactttcagcattgtgataactattcagaattgttggtttgcgcacctcacggggcgtcgcctgcagaattaccatcttttgaggaaaaaagttataactctgaaaggatgtacaatactaaattttcaaacagcaacataattacagtcttatcagttcagc

SEQ ID NO: 33445 - protein, 140 aa, Panicum virgatum
  misc_feature: Ceres CLONE 1950745
  misc_feature (6)..(86): Pfam Name: C2 Pfam Description: C2 domain
  misc_feature: SWISSPROT Homolog: EC 2.7.11.13 Protein kinase C
  misc_feature: Useful for making plants with modulated nitrogen use efficiency
MVHGKLEVLLVSAKGLEDTDFLNNMDPYVILTCRTQEQKSSVANGAGSDPEWNETFIFTVSDDTPQLSLKIMDSDVTNDDFVGEASIPLEAVFQEGSLPPTVHPVVKEDKYCGEIKLALTFTPAVETRRPDNEGTYSSWN

SEQ ID NO: 33446 - DNA, 145 bp, Panicum virgatum
  misc_feature: Ceres CLONE 1950758-R
  misc_feature: Encodes the peptide sequence at SEQ ID NO. 33447
ttttctctacccttgggcaaagagtttcgacgttttgggtgtatccgtttttattgaagctttcatttttgtgcttatcctagttgttggtttagtttatgcatggcgaaaaggagccttggaatggtcttaactgaatattcag

SEQ ID NO: 33447 - protein, 43 aa, Panicum virgatum
  misc_feature: Ceres CLONE 1950758-R
  misc_feature: SWISSPROT Homolog: EC 1.6.99.5 NADH dehydrogenase (quinone)
FLYPWAKSFDVLGVSVFIEAFIFVLILVVGLVYAWRKGALEWS

SEQ ID NO: 33448 - DNA, 647 bp, Panicum virgatum
  misc_feature: Ceres CLONE 1950758
atacattatctaaatcgatccactttaaataaaatagaaaaaatcgaaagaaaaaaaaaaaagaaagagtaaataataaaactagatattctgtttcataattctgaaatagagttctttttttttagtattactcctcattaggatgcatacattagttatcctattttaattaggttctaatctaatttagtagtaagtagtttcttttttatttaatagtctctgactatcattaaataaagggtggagcaattcttttttctaaagattttagagaaagcgagacaaagtgaagcgaaagagttttctttgtataagaattaggtctatatcatatctaaatagaagagaaataaaaaaaaaagggaatggggattccattggatgaatccttaaggagagacatgttacaaaagaaacaaaggctaaagtaagccgctttttgcctttagtttgagcgtattcttgtttcaccgaggaaaagagagaagttctggataaattgacaatgtcatgtcaacttgaattgattaattcagttccggctattccacattaatgggagtacatttatgtttctgctttacgaatatgatattttttggacatttctaataatggcaagccttattcctattttggta

SEQ ID NO: 33449 - DNA, 1143 bp, Panicum virgatum
  misc_feature: Ceres CLONE 1950791
  misc_feature: Encodes the peptide sequence at SEQ ID NO. 33450
tggtccgccattcccctgcgcatctggagctgttctgtctaaacccacaaaccctagccgctgcgccgccggcgccgccgccgcagccatgaacgccttcaggttcctcggggacatgacccacctcttctccgtcctcgtcctcctcctcaagatctacgccaccaagtcctgctcaggggtgtcgaggaagacgcaagagctgtacatgttggtgttcgtctcgaggtacctggacctcttcacggactacatctcgctctacaactccgtgatgaaggtggtgttcatcaccagctcggcggcgatcgtatggtgcatgcgccgccacccgcaggtgcgccgaacgtacgacaaagagcaggacaccttccgccatgtggtgatcgtcgccgccgcattcctgctcgcgctggtattcaatgagcggttcaccttccgggagatatgttgggcattttcaatctatttggaagcagtggcaattctcccacagttagtgttgctccagagaagcagaaatgtggataacttgactgggcaatatgttttcttccttggggcctaccgcgcgctctacattctaaactggatttaccgttatttcacggagggtcatcacagcagatggatcccttggcttgctggtttggtgcaaacagctctgtatgcagatttcttttactaatatttcttaagttggaagaacaacgtgaagctcgagttgcctgcttgatgtgccaaaagactgcacactacgcgactctagtgttctagagattagctgattatatgggcagggagagacttggtaatgaggtggagcagttgcaattgataccatatcctgggtcttgcctgcgagaattgatctttgtgtttcccatggcaaagtctatacgtttcggaagctaacggttgctgctgcacagaagtagactagtcccttttttgtatctgctaccttcgatttgaaaaatcacattcacatacatttcagctgctctgttgtttacttgctctgtttcacttctcggaaacaaaaacttatgattccagtgcccatccagttttttgtagaacagatgtgctgattcggttgcgtatatgcgtttgatggtggtccgagttgtgcgattggac

SEQ ID NO: 33450 - protein, 199 aa, Panicum virgatum
  misc_feature: Ceres CLONE 1950791
  misc_feature (1)..(199): Pfam Name: ER_lumen_recept Pfam Description: ER lumen protein retaining receptor
MNAFRFLGDMTHLFSVLVLLLKIYATKSCSGVSRKTQELYMLVFVSRYLDLFTDYISLYNSVMKVVFITSSAAIVWCMRRHPQVRRTYDKEQDTFRHVVIVAAAFLLALVFNERFTFREICWAFSIYLEAVAILPQLVLLQRSRNVDNLTGQYVFFLGAYRALYILNWIYRYFTEGHHSRWIPWLAGLVQTALYADFFY

SEQ ID NO: 33451 - DNA, 540 bp, Panicum virgatum
  misc_feature: Ceres CLONE 1950801
  misc_feature: Encodes the peptide sequence at SEQ ID NO. 33452
caaacctgagccaaaacctctaaccggagccactccaaaacctgaacctaaacccttgtccgagcctaagccggagcccaaacctgatccaaagccggagcccaaacctgactccatttcctgatccttaacctgagccatagcccgaaccatagccaatgcccgaacccattcctgatccaaagcccgaaccaaaaccgcctaagcctgaacctaaaccggaacctatgcccgatccgaagcctgaacctgagccaaagcccgaaccagagcctaacccttattctgaaccctagcccgaacctgatccgaagcctgagcctttaccggaacctaatccggaacctaatcctgagccgaagccctaacccaaaccgaagccggaacctaatcctgagcccaaaccaaatccatagctcgaacctaagcctatacccgatcctgatcccgagcccatagcgaaaccggacccacctcatatcccacctgcagctgactgctgatgaagtgaccgctagctattttgtatgacgttgcaga

SEQ ID NO: 33452 - protein, 45 aa, Panicum virgatum
  misc_feature: Ceres CLONE 1950801
  misc_feature: Useful for making plants with altered lignin content
  misc_feature: Useful for making plants with modulated biomass
  misc_feature: Useful for making plants with modulated flowering time
  misc_feature: Useful for making plants with modulated salt sensitivity
  misc_feature: Useful for making plants with altered carbohydrate content
MPEPIPDPKPEPKPPKPEPKPEPMPDPKPEPEPKPEPEPNPYSEP

SEQ ID NO: 33453 - DNA, 429 bp, Panicum virgatum
  misc_feature: Ceres CLONE 1950801-R
  misc_feature: Encodes the peptide sequence at SEQ ID NO. 33454
gatatggcggtggctatggtggtggttatggaggaggatatggtagtggcagcgggtatggtggaggtgggggctatggagggggatctggaggaggtggacaccatggtggatggaattaagtggtagagctaggcacgtttctagatgtcaaataattaagaaacacattgtgatgataggtttgaatgttgcatggcactttggtgatacaaatcatgtttacgtatggtataaaacatggtgatggatgtacggttgtgtacattagatggatttaatcctgttttgcatgaagtgtggtaataagagctaggcagctagccatgtatggcagtgtgcactagctggcttttagaaccggtacctcatcatgtatggacctatgtatacatataaataaatgactatcctttaaagtcgggtatc

SEQ ID NO: 33454 - protein, 39 aa, Panicum virgatum
  misc_feature: Ceres CLONE 1950801-R
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: Useful for making plants with modulated nitrogen use efficiency
  misc_feature: Useful for making plants with altered lignin content
  misc_feature: Useful for making plants with altered alkaloid content
  misc_feature: Useful for making plants with altered terpenoid content
  misc_feature: Useful for making plants with modulated phosphate use efficiency
  misc_feature: Useful for making plants with modulated flowering time
  misc_feature: Useful for making plants with modulated biomass
  misc_feature: The sequence is a functional homolog of SEQ ID NO 110 in the 10/225,066 US patent application
  misc_feature: The sequence is a functional homolog of SEQ ID NO 128 in the 10/666,642 US patent application
  misc_feature: The sequence is a functional homolog of SEQ ID NO 136 in the 10/374,780 US patent application
  misc_feature: The sequence is a functional homolog of SEQ ID NO 44 in the 11/375,241 US patent application
  misc_feature: The sequence is a functional homolog of SEQ ID NO 850 in the 11/435,388 US patent application
  misc_feature: The sequence is a functional homolog of SEQ ID NO 791 in the 10/374,780 US patent application
  misc_feature: The sequence is a functional homolog of SEQ ID NO 2135 in the 10/666,642 US patent application
  misc_feature: The sequence is a functional homolog of SEQ ID NO 28 in the 10/675,852 US patent application
  misc_feature: The sequence is a functional homolog of SEQ ID NO 330 in the 11/435,388 US patent application
  misc_feature: The sequence is a functional homolog of SEQ ID NO 332 in the 10/714,887 US patent application
  misc_feature: The sequence is a functional homolog of SEQ ID NO 792 in the 10/374,780 US patent application
  misc_feature: The sequence is a functional homolog of SEQ ID NO 88 in the 10/675,852 US patent application
  misc_feature: The sequence is a functional homolog of SEQ ID NO 110 in the 10/714,887 US patent application
  misc_feature: The sequence is a functional homolog of SEQ ID NO 110 in the 11/435,388 US patent application
  misc_feature: Useful for making plants with modulated heat sensitivity
  misc_feature: Useful for making plants with modulated low light sensitivity
  misc_feature: The sequence is a functional homolog of SEQ ID NO 1844 in the 10/374,780 US patent application
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
  misc_feature: The sequence is a functional homolog of SEQ ID NO 1391 in the 10/374,780 US patent application
  misc_feature: The sequence is a functional homolog of SEQ ID NO 12 in US patent 7087810
  misc_feature: The sequence is a functional homolog of SEQ ID NO 644 in the 10/666,642 US patent application
  misc_feature: Useful for making plants with modulated time to senescence
  misc_feature: The sequence is a functional homolog of SEQ ID NO 2854 in the 10/374,780 US patent application
  misc_feature: The sequence is a functional homolog of SEQ ID NO 464 in the 10/225,066 US patent application
  misc_feature: The sequence is a functional homolog of SEQ ID NO 1091 in the 10/412,699 US patent application
  misc_feature: The sequence is a functional homolog of SEQ ID NO 1279 in the 10/666,642 US patent application
  misc_feature: The sequence is a functional homolog of SEQ ID NO 636 in the 10/374,780 US patent application
  misc_feature: The sequence is a functional homolog of SEQ ID NO 134 in US patent 7294759
  misc_feature: The sequence is a functional homolog of SEQ ID NO 2 in US patent 7220894
  misc_feature: The sequence is a functional homolog of SEQ ID NO 2318 in the 10/374,780 US patent application
  misc_feature: The sequence is a functional homolog of SEQ ID NO 240 in the 10/225,066 US patent application
  misc_feature: The sequence is a functional homolog of SEQ ID NO 124 in the 10/714,887 US patent application
  misc_feature: The sequence is a functional homolog of SEQ ID NO 124 in the 11/435,388 US patent application
  misc_feature: The sequence is a functional homolog of SEQ ID NO 795 in the 10/374,780 US patent application
YGGGYGGGYGGGYGSGSGYGGGGGYGGGSGGGGHHGGWN

SEQ ID NO: 33455 - DNA, 893 bp, Panicum virgatum
  misc_feature: Ceres CLONE 1950813
  misc_feature: Encodes the peptide sequence at SEQ ID NO. 33456
gagcttatcgcttatcatctgcgcctccccatctctcccctgctcctccgcttcctcgtgatccatccaaaccagcttgctgagatctggggaatcgaggttaattctcggatcttgttgtttgggtttgttgcaggggtagctatgtcgaattccgaggagcaccacttcgagtcgaaggccgacgctggggcgtccaagacctacccgcagcaggctggtaccatccgcaagaacggcttcatcgtcatcaagggccgcccctgcaaggtggtggaggtttctacctcaaagactggtaagcacggtcatgctaaatgccactttgttgctatcgacatattcaatgggaaaaagcttgaagatattgtcccgtcttcccataattgtgatgtgccacatgtgaaccgcactgagtaccagctgattgacatatctgaggatggatttgtgagccttcttacttctgatggcaacaccaaggacgatcttagactcccaactgatgagactctcctgggtcagatcaaagaaggatttgacagcgggaaggaccttgtggtgactgtccagtcctccatgggggaggagcagatctgcgcgctgaaggatgttggccccaagtagcttccctaaagaaggcctggaacagagggagcaactgtatctcaaaacttaaatcgaaaaaggcgtgtatcgccacgaaggattggtaccgagacattcaccctagcttgagctggcttttgctgtagtaaactcaagtgcagtgattgctgggcgtggcatcgtatctgactatcattatctgtggttacatttgggaccctgtattttctatggttttatgccctctgcttagtatcaataataaatattggtttggaacggtc

SEQ ID NO: 33456 - protein, 160 aa, Panicum virgatum
  misc_feature: Ceres CLONE 1950813
  misc_feature (86)..(155): Pfam Name: eIF-5a Pfam Description: Eukaryotic initiation factor 5A hypusine, DNA-binding OB fold
  misc_feature (30)..(64): Pfam Name: KOW Pfam Description: KOW motif
MSNSEEHHFESKADAGASKTYPQQAGTIRKNGFIVIKGRPCKVVEVSTSKTGKHGHAKCHFVAIDIFNGKKLEDIVPSSHNCDVPHVNRTEYQLIDISEDGFVSLLTSDGNTKDDLRLPTDETLLGQIKEGFDSGKDLVVTVQSSMGEEQICALKDVGPK

SEQ ID NO: 33457 - DNA, 1512 bp, Panicum virgatum
  misc_feature: Ceres CLONE 1950818
  misc_feature: Encodes the peptide sequence at SEQ ID NO. 33458
gcagaggcaaagaatattgaagtatcatatcaaaagagcaaggttagatttgctgggcaggatgaaaaagaagaaaatgattggggggaggagggttctataattgagcagataacagaaagcctggtgattgatgacaatgttgaggccaagggagtattattgaaaaagactgtcccaaggagtaaggatttcagatcagacttttcaagagggcatcatgtatcaaaccagcgaataagatttcagagaaggaacagaccatgtcgatatgacatagatcgattcacacctagtttcttgtcaatttttgaatcattggtcccctcagaggaggaaatcgcaaggcagaagcaactgttaacatctttaagcagaataataaacaaggaatggcctaattcaaaactatacctctatggatcatgtgccaattctttcggtttctcaaatagtgatattgatctttgtctctcaatcgatgacaagggaatgagcaaggttgatattatattgaaactggcagacattctacaagctggaaatcttcagaatattcagccattaactcgagcaagggtcccaatagtgaagcttacggatccggaaacagggctttcctgtgatatatgtgtcaataatcttttggcagttgttaacacgaaacttctacgagattatgcacaaatagatagaaggttacaacagttggcatttattgtgaagcattgggctaaatctcggcgtgtaaatgaaacttaccaagggacactttctagttatgcctatgtaataatgtgcatccacctcctacagttgcgaagaatactcccatgcctacaggaaatggaggccacttattttgtcacggtggatgaaaataactgtgcttatttcgaccaagtggacaagctaagtaactacggtgctcacagcagagacaccgtatcacggctgctctgggcctttttccattactgggcatacgagcatgattacacaagggatgtcatatcaattcgtactggaaggattattagtaaggagaggaaggattggacgagacgggttggaaatgacaggcatctcatatgcatcgaagatccatttgagctctcccatgatctcggtcgcgtcgttgacaagttcaccatcaagatacttcgggaggaatttgagcgagctgcaaatatattacagtttgatccgaaccccagcgccacgctctttgagccatacgtgccccctccaataccgaacctgatgcaagaaggaactgtgaatgccgcagaagttgacctatgatcacagtatctggtgcttcatgatgttgtatgttctgaagtaatgtcgtaatatgtttcgtgcatagctgtacaacagagagttattggctgtgtaggtccaggtggttgacagtacttggctgcctcataggatggcagattagcgaagtatgttgtgcgggaggtccatatcaacctttgctagtgtttatttaacttcattttt

SEQ ID NO: 33458 - protein, 434 aa, Panicum virgatum
  misc_feature: Ceres CLONE 1950818
  misc_feature (315)..(374): Pfam Name: PAP_assoc Pfam Description: Poly(A) polymerase
  misc_feature (121)..(235): Pfam Name: NTP_transf_2 Pfam Description: Nucleotidyltransferase domain
  misc_feature: SWISSPROT Homolog: EC 2.7.7.19 Polynucleotide adenylyltransferase
AEAKNIEVSYQKSKVRFAGQDEKEENDWGEEGSIIEQITESLVIDDNVEAKGVLLKKTVPRSKDFRSDFSRGHHVSNQRIRFQRRNRPCRYDIDRFTPSFLSIFESLVPSEEEIARQKQLLTSLSRIINKEWPNSKLYLYGSCANSFGFSNSDIDLCLSIDDKGMSKVDIILKLADILQAGNLQNIQPLTRARVPIVKLTDPETGLSCDICVNNLLAVVNTKLLRDYAQIDRRLQQLAFIVKHWAKSRRVNETYQGTLSSYAYVIMCIHLLQLRRILPCLQEMEATYFVTVDENNCAYFDQVDKLSNYGAHSRDTVSRLLWAFFHYWAYEHDYTRDVISIRTGRIISKERKDWTRRVGNDRHLICIEDPFELSHDLGRVVDKFTIKILREEFERAANILQFDPNPSATLFEPYVPPPIPNLMQEGTVNAAEVDL

SEQ ID NO: 33459 - DNA, 636 bp, Panicum virgatum
  misc_feature: Ceres CLONE 1950820
  misc_feature: Encodes the peptide sequence at SEQ ID NO. 33460
atccaactcacctcacggtacacacatcccttcatccagcgaagggagcaggaaaggctgctgtgttgggcgctcatcagggcaagctcaggttcctattctttgttcttcagactactgatactactagccttaagatcttttatattatgcttttttgttaccttctctcaagttgccgcacttatttttgccagtgaaaaacatgttacaaagttaagcctttatgtcgcttggcacaagcttttgccccatttagggctgtagcaatgcactaagtttattaaatctgtactagctccctgtgaatacgccgcaaaagtttttactctatattgtgcaggttacaaaggctgctatgttttccgagcgacctgttaccatgcttgtactgctcgcgtggctgctgctgtctctggatggtagcatgatcaactgcgcaacgaccccagataacagcaccgatgtgctttcactgcaagattttaagcatgagatctccggcgatccaaccagggttttggactcttggaactccaccatctcccactgcatgtggcagggtgtcagatgcagcctagcgcatccacgacgcgtagtggctctggagctccccggcctaaacttggttggcca

SEQ ID NO: 33460 - protein, 84 aa, Panicum virgatum
  misc_feature: Ceres CLONE 1950820
  misc_feature (25)..(65): Pfam Name: LRRNT_2 Pfam Description: Leucine rich repeat N-terminal domain
  misc_feature: SWISSPROT Homolog: EC 2.7.11.1 Non-specific serine/threonine protein kinase
MLVLLAWLLLSLDGSMINCATTPDNSTDVLSLQDFKHEISGDPTRVLDSWNSTISHCMWQGVRCSLAHPRRVVALELPGLNLVG

SEQ ID NO: 33461 - DNA, 654 bp, Panicum virgatum
  misc_feature: Ceres CLONE 1950820-R
  misc_feature: Encodes the peptide sequence at SEQ ID NO. 33462
caaaattagcacctccattggaaacttgaccttccttaagacactgaacctgtccgcgaacattttatctggtcaattaccgcctttcaaccatctgcaaagactgcaaatcctggacctgagctccaactctctgcatgataatatcccagatgctctcgccaactgttcctacttaagggggctgtccctccggaagaataatctatttggtgaaattccaccaaaactaggcctcttgtctaacctctcagttttaaggatttcttataataatctcactggaagcatccctccaagtctcggcaacatcacacgcatagacacaataaatattgcatctaatatgctcaccggaagcattccagatgagcttgcaaaattagcaaacatatcgacgttattcttaggtgataatagactattaggtaagtttccgcgtgctctgtataatttatcctctcttgaaaacctagggttggagataaatgacctaggtggcagattaccaaataatattggtgatctcctccctaatctccaatggcttttgttgaatcaaaacaagtttgacggacatatcccagcttccctaggcaatatttcagggatttacagcttggatttgaataataataatttcactgggattcc

SEQ ID NO: 33462 - protein, 217 aa, Panicum virgatum
  misc_feature: Ceres CLONE 1950820-R
  misc_feature: SWISSPROT Homolog: EC 2.7.11.1 Non-specific serine/threonine protein kinase
KISTSIGNLTFLKTLNLSANILSGQLPPFNHLQRLQILDLSSNSLHDNIPDALANCSYLRGLSLRKNNLFGEIPPKLGLLSNLSVLRISYNNLTGSIPPSLGNITRIDTINIASNMLTGSIPDELAKLANISTLFLGDNRLLGKFPRALYNLSSLENLGLEINDLGGRLPNNIGDLLPNLQWLLLNQNKFDGHIPASLGNISGIYSLDLNNNNFTGI

SEQ ID NO: 33463 - DNA, 878 bp, Panicum virgatum
  misc_feature: Ceres CLONE 1950824
  misc_feature: Encodes the peptide sequence at SEQ ID NO. 33464
agccacaccagcgcaaagcaactcgcataaataaaaaatagaaaaaagaaaacccccgcagccacagaggaagaataatccattcgccttgcttgcgcctcccgtctgcgtgcgatcgacgcagagaaggcgcgggcgctcaacgccaccgccaccctccggctccgatccgatggccttcatgcgctcgcactcaaatgcatcttccggcatgggagttgctcctaacatcagggagacattcgtcgagcttcagatgaagaaggcattccgatatgttatcttcaaaatcgaggaaaagcaaaagcaggtggttgttgagaagaccggtgctactactgaaagctatgatgactttttggcctccctcccagaaaatgattgcagatacgctctgtatgattttgatttcgtcactggggagaatgtgcagaaaagcaagatatttttcattgcctggtccccatcgacttcccgcattcgtgcaaagatgctgtactccacctccaaggaccgcatcaagcatgagcttgatgggttccactacgagatccaggcaaccgacccatcagaggtggacatcgaagtcctcagggagcgggctcactgaagctggtttacctatgaaggggacctgtggagggccttggaacttcagccagattcaaattctatattcaatgatgctccagccatggtatttgttaataagttcatgtaagcatatgatttagtcgtgatgcgtgactctagctggtgaagcgctatcgaaggtctttctgtatgagatcttgagcctgtaaacggagcaatttgcaaactcatggtattgtggtaatgatactggttactggaagtactggttgtggattatttgg

SEQ ID NO: 33464 - protein, 145 aa, Panicum virgatum; identical to SEQ ID NO: 10146
  misc_feature: Ceres CLONE 1950824
  misc_feature (18)..(145): Pfam Name: Cofilin_ADF Pfam Description: Cofilin/tropomyosin-type actin-binding protein
  misc_feature: Useful for making plants with modulated time to senescence

SEQ ID NO: 33465 - DNA, 405 bp, Panicum virgatum
  misc_feature: Ceres CLONE 1950841
  misc_feature: Encodes the peptide sequence at SEQ ID NO. 33466
gctatcccgaggttcgccgccgcatgctaagtcactgccataccctcgcttcccatgccttctcgaagctccccgtcgccgcctccacccgctccgatggccaaggaaccgatgcgcgtgctcgtcaccggcgccgcatgacaaatcggatatgcgcttgttcccatgattgctagaggagttatgcttggtacagaccatcctgttattctgcacatgctcgacattccgccagcggctgaagctcttaatggtgttaagatggagttggttgatgctgcatttcctcttcttaagggtgttgttgcaagaactgatgttggggaggcttgcactggtgtgaatgtggcggccatggttggtggattccccaagaaggagggaatggaaaggaaggatgttatg

SEQ ID NO: 33466 - protein, 79 aa, Panicum virgatum
  misc_feature: Ceres CLONE 1950841
  misc_feature: SWISSPROT Homolog: EC 1.1.1.37 Malate dehydrogenase
MIARGVMLGTDHPVILHMLDIPPAAEALNGVKMELVDAAFPLLKGVVARTDVGEACTGVNVAAMVGGFPKKEGMERKDV

SEQ ID NO: 33467 - DNA, 251 bp, Panicum virgatum
  misc_feature: Ceres CLONE 1950841-R
gacgggattgctcaggagcagtcagaggagaagggaatggtttactcatgcttagggtaatctctaaccatagtctgagcatttgctgcttataggttaagaattaaggaaaatttcagtgtcaatgtatcgattctttcactcggaagcattgcaccttggcggtgcaggtggttggcttctcctcagtgtgtaagaggcttgtaacccaaattgcatgatgatacgcaggacatttagagaaacttgcg

SEQ ID NO: 33468 - DNA, 397 bp, Panicum virgatum
  misc_feature: Ceres CLONE 1950857
  misc_feature: Encodes the peptide sequence at SEQ ID NO. 33469
agagagagagagagagagagaagtttgcttcagtcccatgcggtggtggtggtgtggctgtggcagcagctgcccctgctgctggtggagctgctcccgcagctgaggccaagaaagaagagaaggtggaggagaaggaagagagtgatgatgatatgggcttcagcctcttcgactaagctgtgcggtcaccagagttgtgtcttttcggcaggaaaaccagagtcgccatgtttggagtttaaccttgttttatgttgcaaagcacccgaaaagactgctacagtctggatatgtagtgattcagccataggtggctacactggttgttggtgtttactggtgaaccagagtttatgcatcatatattaagaatcagttacctagttcgttgatg

SEQ ID NO: 33469 - protein, 58 aa, Panicum virgatum
  misc_feature: Ceres CLONE 1950857
  misc_feature (1)..(57): Pfam Name: Ribosomal_60s Pfam Description: 60s Acidic ribosomal protein
  misc_feature: Useful for making plants with altered oil content
  misc_feature: Useful for making plants with modulated biomass
REREREKFASVPCGGGGVAVAAAAPAAGGAAPAAEAKKEEKVEEKEESDDDMGFSLFD

SEQ ID NO: 33470 - DNA, 1594 bp, Panicum virgatum
  misc_feature: Ceres CLONE 1950861
  misc_feature: Encodes the peptide sequence at SEQ ID NO. 33471
gcaggttccggctgcttccatcccaccacggagtcccgaaccttctcgagcaccccctctccggctctccccaccccttccacgcagaaaacaatgagcaggcgcaacagccgcaccatctatgtaggtaacctccctggggacatccgtgagagggaagttgaggacctcttctacaagtatggtcgaattttggatattgacctgaagatacctccaagacctcctggatatgctttcgttgagttcgaggacccacgtgatgctgatgacgcaatttatgggcgtgatggatataactttgatggctacaggttgcgggttgaattagctcatggtggaagaggtcagtcttactcttatgatcgttctagcagctatagcagcgctcgccgtggaggtgtttctaggcgctctgattaccgtgttatggtcacgggtttaccttcatcggcatcgtggcaagatctgaaggaccacatgcggcgcgccggtgatgtttgtttctctgatgtataccgtgaggctggagaaactattggaattgtggattacacaaactatgacgacatgaaatatgcgatcaggaagcttgatgactcactgttcaagaatgcattttctagggcgtatatcagagtgagggagtatgatgctagatcacaaagcagaagccgtagccgctcgtactcgagaagctccagttacagcaggagcaggagtccaaaatctgtttctcggtcaccatcacctgtggatgaaagatctggccatgccggcgatctggggactgcattgatagattattggatgtattgagaatcgaagtggatggtttgggactttggatagtagagctggattgtgatgcatgtatgacaagtgggctacaaccagtcctaggagcaagataggactgacagtaaggatatgtggatctcgtggtgtgtcgactatattgtgcttcaatttcaatggctcaatataacatcaacatcaacatcaacaaagccttttaatcccgagcaagttggggtaggctagagttgaaacccaacaaagaccattatttatggttctggcacgtgaatcgcggctttccaagcactcctatccaaggacaaatctttagatcactatcaagatcccgatcccctgtctcttctccttctggtggaagatctgcgagcagaagcccgaggagcagaagcgcatcccgttctcattctcctgtgagatctgattgaactaggggacccttgaagcggtgagcaactgtaaccagagagaaggaagctgagaacatgcattaccatctcaatgacctgaatgattctgttgttgccactgcaccccctcattttggaggtttcctcttatttagtatttaataattacattatattgctaaagagacttattatgcctagcgcagtggtgtaaactgaacttttgtgtactgggttcccggcactcaggtttcatctactctccggtagcctgtttttaattgacacttctctttcaattggtcgcttgtaatattgcatagttgaggggtcgatgtattcggttatttggttgctgtgtccgg

SEQ ID NO: 33471 - protein, 241 aa, Panicum virgatum
  misc_feature: Ceres CLONE 1950861
  misc_feature (9)..(77): Pfam Name: RRM_1 Pfam Description: RNA recognition motif. (a.k.a. RRM, RBD, or RNP domain)
  misc_feature (112)..(179): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with altered alkaloid content
  misc_feature: Useful for making plants with altered lignin content
MSRRNSRTIYVGNLPGDIREREVEDLFYKYGRILDIDLKIPPRPPGYAFVEFEDPRDADDAIYGRDGYNFDGYRLRVELAHGGRGQSYSYDRSSSYSSARRGGVSRRSDYRVMVTGLPSSASWQDLKDHMRRAGDVCFSDVYREAGETIGIVDYTNYDDMKYAIRKLDDSLFKNAFSRAYIRVREYDARSQSRSRSRSYSRSSSYSRSRSPKSVSRSPSPVDERSGHAGDLGTALIDYWMY

SEQ ID NO: 33472 - DNA, 1114 bp, Panicum virgatum
  misc_feature: Ceres CLONE 1950865
  misc_feature: Encodes the peptide sequence at SEQ ID NO. 33473
ggctcaagaaaaggagaagccttcgccggtttgcccctgcctctgcctttgcgttgcttctccgcctgcagtttcctctgcacttcttctccttccgccgaactccatcatcgaattcgaatcgaagtcgccggccgccatgagcagcaacagcatcgagtacgattacctcttcaagctgctcctcatcggcgactcatccgtcggcaagtcctgcctcctcctccggttcgctgacgattcgtatgttgacacttacatcagtaccatcggtgttgatttcaaaattcgaactgtcgagctcgatggaaagacagtcaagctacagatttgggacacagcaggccaagaaaggttcaggacaatcacaagcagttactaccgaggagctcatggaatcattattgtatatgacgttacggacatggacagcttcaataacatcaagcagtggctgagtgagattgataggtatgccaatgacagtgtatgcaagctgctagttgggaacaagtgtgatttggtcgatagtaaggttgttgataccgaaacagcaaaggcttttgcggattcattaggaattccctttattgagacaagtgcaaaggaatccatcaatgttgaggaagctttcctaaccatgtcatcagaaataaagaaaaggatggcaacccaaccgagcgtggagagaagacccaccgtccacgttcacatgaaagggcagccaatacagcagaagagcagctgctgctcgtcataaacagtcaaaggcttccagaaagcaagggagggtatacctgcagacctgcagtgctccattcctatcatctgggggggacttcaagtttggtgagtggttggatggatgctgcaagactttgttcagtcaagattatattggaaaaggcactggatggaatggatactaaatgtgtgtcattttagcggtatatagatgtctatccttagacagattagcattaattgcacagtttgtatcagtattaagctgcaaaatgtaccaactaatcttaaaacctgcagttaattgcatgatatacggtgtgagtgctggttgctgtttgtttaatatgataattgagcttgtctatcc

SEQ ID NO: 33473 - protein, 206 aa, Panicum virgatum
  misc_feature: Ceres CLONE 1950865
  misc_feature (13)..(174): Pfam Name: Ras Pfam Description: Ras family
  misc_feature (13)..(127): Pfam Name: Miro Pfam Description: Miro-like protein
  misc_feature: SWISSPROT Homolog: EC 2.7.11.1 Non-specific serine/threonine protein kinase
  misc_feature: Useful for making plants with altered lignin content
  misc_feature: Useful for making plants with modulated oxidative stress sensitivity
  misc_feature: Useful for making plants with altered alkaloid content
MSSNSIEYDYLFKLLLIGDSSVGKSCLLLRFADDSYVDTYISTIGVDFKIRTVELDGKTVKLQIWDTAGQERFRTITSSYYRGAHGIIIVYDVTDMDSFNNIKQWLSEIDRYANDSVCKLLVGNKCDLVDSKVVDTETAKAFADSLGIPFIETSAKESINVEEAFLTMSSEIKKRMATQPSVERRPTVHVHMKGQPIQQKSSCCSS

SEQ ID NO: 33474 - DNA, 1109 bp, Panicum virgatum
  misc_feature: Ceres CLONE 1950870
  misc_feature: Encodes the peptide sequence at SEQ ID NO. 33475
actcgttttcttgaatcgtccgcaacctcaagctcttgtcgccggcagtctcaagggacgagagtctgagattacctgtggctctctttctatctgcaagatccaccagaatcacacgctcacgcagccacacgacaaaatccaggaaaggaacaatcttgggttctggaacccactggtagccatcggtcctccttgattaatactaagcgcacagggcggcgctcacaaatcgacagccaagcgaggtagctcccagttccgcagttcccgttccacgctcggcatggctccgcaggcgtggattgtggaggagaagggcgagggcctccaaggccccaaggagttcctgcccctctccaagcttgaagatattggtgtgctttattggcagttggatcctaagaagtctgaaagcaaagaagagcttgcaaaaatccgcaaagaaagaggatacagttacatggaccttattgagatatgtcctgacaaactggagaactatgaggagaagctgaagaacttcttcactgagcacatgcacgctgacgaggagatccgctactgcttggaaggcagtgggtactttgatgtccgtgacaaggatgacaagtggattaggatttggataaaagaaggagacatgatcatcctgcctgctggaatttatcatctgttcaccctcgacagcacaaattatgtgaagctcatgaggctcttcatcggggaaccagtctggactgcgctgaaccggcctcaggagggccaccccgcaagacaggagtacgtgaagaatgtgatgggaaacactggattcgctctagcagcacactgaacctgccgttgccgttcgttcagcgagatacaaacatacaatttcttgaactcttttacatcacggcatatatggaccaagagtcggatgcgaaaacattgctgtgttgtgatggaacatcatgccgcacttgcttgtacacgtagaagatactgcatctgcatcctatgggaacgtacgatgtaccagtattttccgttgtgtttgcttgatacagatacccttggatgtacgtggttgcagcagcagctgccaacaatgctttatttatgtg

SEQ ID NO: 33475 - protein, 182 aa, Panicum virgatum
  misc_feature: Ceres CLONE 1950870
  misc_feature (4)..(153): Pfam Name: ARD Pfam Description: ARD/ARD' family
MAPQAWIVEEKGEGLQGPKEFLPLSKLEDIGVLYWQLDPKKSESKEELAKIRKERGYSYMDLIEICPDKLENYEEKLKNFFTEHMHADEEIRYCLEGSGYFDVRDKDDKWIRIWIKEGDMIILPAGIYHLFTLDSTNYVKLMRLFIGEPVWTALNRPQEGHPARQEYVKNVMGNTGFALAAH

SEQ ID NO: 33476 - DNA, 603 bp, Panicum virgatum
  misc_feature: Ceres CLONE 1950885
  misc_feature: Encodes the peptide sequence at SEQ ID NO. 33477
gactcgagactttcaggtcacatctcctctcttttttttttttgcgagggacatctcctccctctgtttctcccttctctcggactctctccctggctctttcttccctgtcggcgacgactgggcgagcggcggcgccgtttgtcacgtcttcgccaagccttttgccggcgacgagcatcccccaggctgagataagttgaagcaaagttcaaggcaaaatgttttacggtggatatgcgtaccatggcaatacgtttgagcaaacgtaccgttgttatccagcatccttctttgataagccacacctggaaggtggtgacaaagtaataatgccaccatctgcccttgattgcctggcttccctccacatcgagtacccaatgctatttgaactgcacaatgatgcaactcaacggatttcacactctggtgttttggagtttgtggcagaagaaggcatgatcatcatgccctactggatgatgcaaaacatgcttcttcaagagggtgacactgtccgtgtgaaaaacgccacacttcccaagggtacatatgtgaagttgcaacctcacacaactgattttctggacatctcgaatc

SEQ ID NO: 33477 - protein, 127 aa, Panicum virgatum
  misc_feature: Ceres CLONE 1950885
  misc_feature (10)..(127): Pfam Name: UFD1 Pfam Description: Ubiquitin fusion degradation protein UFD1
MFYGGYAYHGNTFEQTYRCYPASFFDKPHLEGGDKVIMPPSALDCLASLHIEYPMLFELHNDATQRISHSGVLEFVAEEGMIIMPYWMMQNMLLQEGDTVRVKNATLPKGTYVKLQPHTTDFLDISN

SEQ ID NO: 33478 - DNA, 417 bp, Panicum virgatum
  misc_feature: Ceres CLONE 1950885-R
gatggtaaagcctcaaaactacaagcatccgaggttccatccagtgcaagttctgttccctcagattcaaacaaaagatcaaatcagcaagcatctgcacccgcaacttctggaactagcaattccactcgtcagaaaacaggaaagcttttttttggttcaagtgcaagcaacaataaagaaccacaaaaggctcctgctaaagaggaggaacccccgaagaaggacgagcccaagttccaagcttttagtgggaagagctactccttgaaacgttagctgcccattactggagtttagcgtatcatgttcagtggtagctgtagaccactgtgtcttaagtgtccaccagcatgtagatataatttgaattatgtaaatgtttatcttcatggaaatatggccatctttctattt

SEQ ID NO: 33479 - DNA, 1024 bp, Panicum virgatum
  misc_feature: Ceres CLONE 1950892
  misc_feature: Encodes the peptide sequence at SEQ ID NO. 33480
agaggatcatgttccgactgcagaggatctgattccctcagctcagggcctcaggttatgtctgtttcttgaaccctctccggctttcccttctctcggactctctcgtccttgctcttccttccctggcggcgacgactgggcgagcggcggcgacatttgtcacttcttcgcccagccctttgccggcgacgagcatccaccagattcaccatgagtaatgccagcactggattgctgaaaggcttgaggatggtcttgcaacagcaaaagatttcagccgttttctgcagacgatctcaagcttggagttctactgtctctttttctgaccttgatgagaagggtgatattgactttgacgatgattatacagattcaaagagagagctacagccccagagcgtagatcccaaaaagggctggggatcccgcggcgtccacagggccatcatctgcggcaaagttggacaagtgcctgtgcaaaaaattttaaggaatgggcgtacagtaaccgtttttaccgttggaaccggtggcatgtttgaccagagggtaattgggcctgaggatttaccgaagccagctcagtggcatcgaatagctgttcataatgaccacctaggtgcttatgctgttcagaagctggtgaagaattctgcagtctatgttgagggtgatattgaaacgagggtctacaatgacagcattaatgatcaagtcagaaacatacctgagatatgtgtacgacgtgatggcaagattcgtctgattaaatctggggacagtgctgctagcatatcattagatgagctcagacaagggctgttctagttatagttaaggatgtcagtgcaagcagatcatgaggttgcttcttgcttgaggcaagtttgagtatgtttattcttactattataagcagtgctaatttaagtgttatgcttgcatactattctgactggattttcattcgtttgaactatgccttatagtaccaaattccaaatttacaaatcctcgg

SEQ ID NO: 33480 - protein, 206 aa, Panicum virgatum
  misc_feature: Ceres CLONE 1950892
  misc_feature (76)..(187): Pfam Name: SSB Pfam Description: Single-strand binding protein family
MSNASTGLLKGLRMVLQQQKISAVFCRRSQAWSSTVSFSDLDEKGDIDFDDDYTDSKRELQPQSVDPKKGWGSRGVHRAIICGKVGQVPVQKILRNGRTVTVFTVGTGGMFDQRVIGPEDLPKPAQWHRIAVHNDHLGAYAVQKLVKNSAVYVEGDIETRVYNDSINDQVRNIPEICVRRDGKIRLIKSGDSAASISLDELRQGLF

SEQ ID NO: 33481 - DNA, 1089 bp, Panicum virgatum
  misc_feature: Ceres CLONE 1950893
  misc_feature: Encodes the peptide sequence at SEQ ID NO. 33482
cttttccgcaggctccaccaagcagccagcaggaggcttagcagcagaagagcagaagcctcccctaccttcgctatgcagcccatcaaggtgtacgccgaccggcggtcgcagccctcccgaaccgtcatcatcttctgcagggtgaatcagatcgatttcgaggagatcacggtggatctgttcaagtctcagcacctcactgccgaattcagaaaaataaacccgacgggacaagtgcctgcaattgttgatggaagattcaaactatatgagagtcatgctattttgaggtatcttgcgtccgtgttccccggagttgcagatcactggtatcctgctgacttgttcactagagccaaaattgagtcaatcttggattggcatcactcaaatttgcgtcgtggtgcagcaacccttgtaatgcacacagcactggctccctttcttggtcttgcaacaagtcctgatgctgtaaaacaagcagaaaaacttctaatgcagtcactaggaaggattgaatcagtgtggctgaaggatgatgcaaagttcttgctaggtagcccccaaccatcaattgcagatctaagccttgtttgtgaaataatgcagttggagatccttggcaatgacgtacgtgaccgatttctgggagctcatgagaagatcctcatctggatggataatgtgaagaaagccaccagccctcattttgtggaagcccatgagctccttttccaagtggaggccagcaggctaaacaatgctgctgcagcaaaccagacttccgagccaagcacgaagctcaaaattgtgtcaaagctctgagctgtagaggggaagatactgttgcaacttgcaagtataaatagaacattgcaataagcgttgggaagagatgatgggcgctgtgaagattgtggagctttgcatagatcagcaagtaacccccaccatactaagtggttccttgcggatcatattgtgttgtccgtgaggaaagtttaaaataaaactggacttgtatgaaaactgcttatctacgctgtacatgatccttactagtgaatccattgcctgaattgactt

SEQ ID NO: 33482 - protein, 250 aa, Panicum virgatum
  misc_feature: Ceres CLONE 1950893
  misc_feature (2)..(77): Pfam Name: GST_N Pfam Description: Glutathione S-transferase, N-terminal domain
  misc_feature: SWISSPROT Homolog: EC 2.5.1.18 Glutathione transferase
MQPIKVYADRRSQPSRTVIIFCRVNQIDFEEITVDLFKSQHLTAEFRKINPTGQVPAIVDGRFKLYESHAILRYLASVFPGVADHWYPADLFTRAKIESILDWHHSNLRRGAATLVMHTALAPFLGLATSPDAVKQAEKLLMQSLGRIESVWLKDDAKFLLGSPQPSIADLSLVCEIMQLEILGNDVRDRFLGAHEKILIWMDNVKKATSPHFVEAHELLFQVEASRLNNAAAANQTSEPSTKLKIVSKL

SEQ ID NO: 33483 - DNA, 1110 bp, Panicum virgatum
  misc_feature: Ceres CLONE 1950905
  misc_feature: Encodes the peptide sequence at SEQ ID NO. 33484
aaaaaaaggacggcggctctctcttctctctctcggccttctttcctagcggcgacgccagggcgagtggcgtggcggccggcggctctctcttctctttctcacgccttctctctctccgtctctcggccttcttctttccttgccagctcttcttcgtcgggagcttcgccggccgacaaggagttggcttccattatcctccgccgctgatgtcgaggctgcgtgctttgtggcaagcttccttcaacgcctccaagagagctcttgtatggagttcagatgatctaatgccaccaagcgaaaggtatatcttcaatttcaactcaaaagatgagctgaagaggtggcatttgtactcagattcagagtacggaggtttgtcttctgcatcattggagataactgatagcactgctggtgcagatacttcattgactggtgtgttttctggtaatctttcatcggatatgtctgaggactcaacatggaggatcaggcgctatggattctgcggaatgcgatcaaagaagtttgatggtttcattgaccttgatgcatatgatacaatagcaatgaagatcaaaggggatggaagatgctacatatctaccatatacacagagaattgggtgaattcaccaggacaacaagaagataattcatggcaggcttttgtgcacacacctcaggacagatggcaaatactgaaaatccctcttgatcactatttacctacatggagaggaaatgtgattgaggcaaagttggaaatgaatcctgctcgtattgtgggaatgtctctctctgtaaatgcagaaggtggtgttcctggtgccaagactgggactggtgattttaggctagaagttgattggatcaaggcattgagaacagtgtgaggtccactggcattttcttactcttctgtttcacgcggcgctgccattgctggaattttgtcagcgaccaatacctgatgactacacgagtaaacagtagttcagagtgccccactcctgtatgtacttttaggtgtatgaaatgtttgctggtaaacatggaaggctgctgcagttcggcaccaatgaataataaatactgttttcc

SEQ ID NO: 33484 - protein, 229 aa, Panicum virgatum
  misc_feature: Ceres CLONE 1950905
  misc_feature (35)..(225): Pfam Name: CIA30 Pfam Description: Complex I intermediate-associated protein 30 (CIA30)
MSRLRALWQASFNASKRALVWSSDDLMPPSERYIFNFNSKDELKRWHLYSDSEYGGLSSASLEITDSTAGADTSLTGVFSGNLSSDMSEDSTWRIRRYGFCGMRSKKFDGFIDLDAYDTIAMKIKGDGRCYISTIYTENWVNSPGQQEDNSWQAFVHTPQDRWQILKIPLDHYLPTWRGNVIEAKLEMNPARIVGMSLSVNAEGGVPGAKTGTGDFRLEVDWIKALRTV

SEQ ID NO: 33485 - DNA, 966 bp, Panicum virgatum
  misc_feature: Ceres CLONE 1950907
  misc_feature: Encodes the peptide sequence at SEQ ID NO. 33486
gaaactcattcagaagagcatatgccctcattccccagttcaacagatgttaaacaggattcgcctcttgctccccaccctccttccccgcctacccccgaagaacctgtggaagaagcacctaaaacatatgcttcagtgttgcgaacaaaagcgaaggccacaatggggactgcagagtcacaacaggctcaacagttggctcagcaggtgcaaactgtcccggtgcatgaaaaatctaactcggacaacaaccgggttgttagcacccctgatgatgaagaagagtttatttcagtttatgttgggaatctttcgccatctacttcagtctttgatcttgagaaggtgtttcaggcttttggaagaattaaacctgacggagttgctatccgaagccgcaaggaggctggagtcttctttggctttgttgagtttgaagacatgtctggtattcagaatgctttaaatgcatcgccgatagaattgaacggtcgtttagtacatgttgaggagaggaggcctaactgtggattcccaagtgccagaagacggggtcgaggaaaggaccaagctggtggacgatatgacggggagtatcctactcgatcgaagggaaccgggtaccagaaaaagggtggacgccagtatgacagctactactagttttgtacttgctctgctggtggatggccatgtgccgttggtgttatctacctggtgcggttctggccatagttttgccgaaagtcacaatggtgtggggactagcatttctgcttttgctgacattgagcagaatcgtttttggggatgggcttctgttgccgttttgttgcgtcatagtagtttttgcgcctcagctacagtgacctgttaaaatgttgatcatgctgtcgccccgattggtgtcttttgaaaacacattagaagttttgacaaatgttagcgaacagtttcagtgtc

SEQ ID NO: 33486 - protein, 221 aa, Panicum virgatum
  misc_feature: Ceres CLONE 1950907
  misc_feature (100)..(170): Pfam Name: RRM_1 Pfam Description: RNA recognition motif. (a.k.a. RRM, RBD, or RNP domain)
ETHSEEHMPSFPSSTDVKQDSPLAPHPPSPPTPEEPVEEAPKTYASVLRTKAKATMGTAESQQAQQLAQQVQTVPVHEKSNSDNNRVVSTPDDEEEFISVYVGNLSPSTSVFDLEKVFQAFGRIKPDGVAIRSRKEAGVFFGFVEFEDMSGIQNALNASPIELNGRLVHVEERRPNCGFPSARRRGRGKDQAGGRYDGEYPTRSKGTGYQKKGGRQYDSYY

SEQ ID NO: 33487 - DNA, 1021 bp, Panicum virgatum
  misc_feature: Ceres CLONE 1950933
  misc_feature: Encodes the peptide sequence at SEQ ID NO. 33488
aaggatcgtcaagcctgcccggattgaggggaagtagtagggggtgtgtccgagcagggctttccctgttagcaggaagtacaacagtcaagacagtaccaagaatcatgagtgaaacagggtacacagtacaagtcactaacctctctagcagggtatctgaaaacgatcttcatgaattcttttcgttctctggtcctattgagtatatagaacttatcagatcgggagaatatggctctactgcttatgtgacattcaaggaacgctatgccttggaaactgcagcattgcttagtggggctactattgtggatcagccagtatgcataacttattggggacaacctgaggagagttttaatttctgggataggccaagttgggaggttgaggaggaaatcgaatacaggaactaccaagcatgccagttcaacactactccacaggaagctttgacagtggctcaagatgttgtgaagacgatgttagcaaggggatatgtgctaagcaaggatgctttggctaaggctagagccttcgatgagtcccgtgggttaacagcatcagctacagccaaggccgcagagctgagcaagagatttggtttaactgacagggtcaatgctggtgttagtgcaatcaatgctggtgttggtgcaatgcgatcagtggacgagacataccgcgtatctgagacgacgaagactgttgcgactgccaccggaagaacagcagctaaggtggcaaacagcatcgtcactagcagctacttctctgcaggagccatgatggtgtctgacgcttttactagggctgccaaggcggcagcagatttggctgctcatggtaggcagagttaagtgaaaataaacagtcaatgcatcctttcagttattaaacatgtggacaaacaccaaaatatgatgcttcaaatgttcgatgtatattataacagacaacaatattgtaaaaggagacgaacttgtttgtgaccgtgcagtcatgtttgtgatcgtgt

SEQ ID NO: 33488 - protein, 251 aa, Panicum virgatum
  misc_feature: Ceres CLONE 1950933
  misc_feature: Useful for making plants with modulated biomass
MSETGYTVQVTNLSSRVSENDLHEFFSFSGPIEYIELIRSGEYGSTAYVTFKERYALETAALLSGATIVDQPVCITYWGQPEESFNFWDRPSWEVEEEIEYRNYQACQFNTTPQEALTVAQDVVKTMLARGYVLSKDALAKARAFDESRGLTASATAKAAELSKRFGLTDRVNAGVSAINAGVGAMRSVDETYRVSETTKTVATATGRTAAKVANSIVTSSYFSAGAMMVSDAFTRAAKAAADLAAHGRQS

SEQ ID NO: 33489 - DNA, 667 bp, Panicum virgatum
  misc_feature: Ceres CLONE 1950936
  misc_feature: Encodes the peptide sequence at SEQ ID NO. 33490
caaataaagtttacaatgatcaaggaattccagcagcattcagagttcctgcaggtgctgtgattccatttggatctatggaggattccctaaaaaaaagtggatcattagaatcctacacaaagcttctagagaggattgaagccgctcaaattgaaaatggtgaacttgatagactaacatcagagcttcaagcaatggtttcccttctttctccatccaaagaaatcattgaatctttgaaaaatacattcgatcagaatgttcgactaattgtcagatctactgctaacgtggaggatttggctggtatgtcagccgctgggctatatgaatcaattcctaatgtcagcctctctgacccaagttcctttggagctgcggttggacgggtttgggcatcattatacacaaggagagcagtccttagccgccgagcggctggtgtccctcagaaagatgcaaagatggccattcttgttcaagaaatgctgcagccagatctctcctttgtgcttcacactgttagcccatctgatcatgatcccaagttggtcgaggccgaggttgcccctggactgggagaaacccttgcttctggaacccgtggcaccccttggagactctcgtgtgacaaatttgatggcggagtcaccactctagcttt

SEQ ID NO: 33490 - protein, 221 aa, Panicum virgatum
  misc_feature: Ceres CLONE 1950936
  misc_feature (4)..(221): Pfam Name: PPDK_N Pfam Description: Pyruvate phosphate dikinase, PEP/pyruvate binding domain
  misc_feature: SWISSPROT Homolog: EC 2.7.9.5 Phosphoglucan, water dikinase
NKVYNDQGIPAAFRVPAGAVIPFGSMEDSLKKSGSLESYTKLLERIEAAQIENGELDRLTSELQAMVSLLSPSKEIIESLKNTFDQNVRLIVRSTANVEDLAGMSAAGLYESIPNVSLSDPSSFGAAVGRVWASLYTRRAVLSRRAAGVPQKDAKMAILVQEMLQPDLSFVLHTVSPSDHDPKLVEAEVAPGLGETLASGTRGTPWRLSCDKFDGGVTTLA

SEQ ID NO: 33491 - DNA, 355 bp, Panicum virgatum
  misc_feature: Ceres CLONE 1950936-R
ccatagtaaataaagttttgttaagatgagtgtgattacttggttaggtgaataaaaatggatgcatggctgaagaaatttatgggttctgaagcacacatagcagttattcaagtccttttaaacatcttgcctgaagtaaaataatgagttgggccaggtccagccatgctcttggatgaattttgcgaacagcaaacttgagtataatgtaacgtcttgtagtgacctcgtttggatgtaataatcataatctacaggacatgtaatgtaatatctagctagagatgagaacatatccatcattatcgtagctgcttacagcgagcaaccgtagaaaaaggtacttcaatcc

SEQ ID NO: 33492 - DNA, 517 bp, Panicum virgatum
  misc_feature: Ceres CLONE 1952554
  misc_feature: Encodes the peptide sequence at SEQ ID NO. 33493
ctattcatgaagacagcatttgctgcatttccatgttggaagcttgattcttgatactttctgctgaaatgtaagaaaggtgacaggcatatcgtacctcttgagtattaatttgcatgataacaacactcacaccaattcttcaggtaactgtcaacaacactatgtatcacaagagctgcttcaagtgctgccatggaggatgcaccatcagcccttcgaactacatcgcgcacgaggggaagctctactgcaagcatcatcacatccagctgatcaaggagaaggggaacttcagccagctcgagaatgatcatgagaagacatcacaggctggatcgctggaggacgaagaagcagagtactaatctttgagcatttccacagatgaataatgaatctccttgcatttgctcgagagcaatatacctttctatggcacggtttggtttcagttttaccaatggaggtcatgagcactcagagaacaatgatacgtcgtcttgtatcttcatgt

SEQ ID NO: 33493 - protein, 83 aa, Panicum virgatum
  misc_feature: Ceres CLONE 1952554
  misc_feature (6)..(54): Pfam Name: LIM Pfam Description: LIM domain
  misc_feature: Useful for making plants with altered carbohydrate content
  misc_feature: Useful for making plants with modulated heat sensitivity
  misc_feature: The sequence is a functional homolog of SEQ ID NO 428 in the 10/412,699 US patent application
  misc_feature: The sequence is a functional homolog of SEQ ID NO 616 in the 11/435,388 US patent application
  misc_feature: The sequence is a functional homolog of SEQ ID NO 992 in the 11/479,226 US patent application
MITTLTPILQVTVNNTMYHKSCFKCCHGGCTISPSNYIAHEGKLYCKHHHIQLIKEKGNFSQLENDHEKTSQAGSLEDEEAEY

SEQ ID NO: 33494 - DNA, 1232 bp, Panicum virgatum
  misc_feature: Ceres CLONE 1952561
  misc_feature: Encodes the peptide sequence at SEQ ID NO. 33495
gcatcggctgcagcaaggaggcaggccacaccccttgtagtgcgcgcttctcgcctgcgccatagccaccggcacagtgacccccgtgcaccacctcgccgccgcggcagcagcagcagcagcgacgggagcgaggcggaggctaggctagagagagagagagagagagagagagagacgtacgggtagccgccgcgaggtagaccgagaagtgaggaaggagaagcagagggaggtgagcggccatgacgatgaggcagtcgaggttcaagaggatctgcgtcttctgcggcagcagccagggcaagaagcggagctaccacgacgccgccattgagctcggcaacgagctggtggcgcggagcatcgacctggtgtacggcggcggcagcatcgggctgatggggctcgtctcccaggccgtctacgacggcggccgccacgtcatcggggtcattcccaagacgctcatgacaccggagatcagcggcgagacggtcggggaggtgcgtccggtggccgacatgcaccagaggaaggcggagatggcgcgccagtccgacgcattcatcgccctgcccggagggtacgggacgctggaggagctgctcgaggtcatcacgtgggcgcagctgggcatccaccacaagccggtcgggctgctgaacgtggacggctactacaacgcgctgctgaccttcatcgacaaggccgtggaggaggggttcatcaaccccagcgcccgccgcatcatcgtgctcgcgcccaccgcgcaggagctcatggacaagctcgaggagtacgtgccgtaccacgacagggtggcgtccacgctcaactgggagatgggccacctaggctactgacgtggcgtctgaagcaatcatcaagaacggggcaggcgattggaaccattgatcggtgaaggaaggaggaggaggaggagaagaagcttagctagccgtcggattgggattttaatttttctccctatttaacttgacgcgtgcagatcggtttggagtgttggtttgtatatgatggtggccttgtgtttgcttccactgggggtgcaatgctgtagcagcgaaaaggacttgaccggtttcctctccccgcccctgctgctgtatggtctagtagtagtattagcagctagtgcctgcctatgtatgttagtttcaagaagctgaattcgattgactacagcaactcagcaagtgtgttatact

SEQ ID NO: 33495 - protein, 206 aa, Panicum virgatum
  misc_feature: Ceres CLONE 1952561
  misc_feature (53)..(186): Pfam Name: Lysine_decarbox Pfam Description: Possible lysine decarboxylase
MTMRQSRFKRICVFCGSSQGKKRSYHDAAIELGNELVARSIDLVYGGGSIGLMGLVSQAVYDGGRHVIGVIPKTLMTPEISGETVGEVRPVADMHQRKAEMARQSDAFIALPGGYGTLEELLEVITWAQLGIHHKPVGLLNVDGYYNALLTFIDKAVEEGFINPSARRIIVLAPTAQELMDKLEEYVPYHDRVASTLNWEMGHLGY

SEQ ID NO: 33496 - DNA, 1210 bp, Panicum virgatum
  misc_feature: Ceres CLONE 1952569
  misc_feature: Encodes the peptide sequence at SEQ ID NO. 33497
accatcgcaactcctacccagtctcagctcgtcccggcaacctcccttcccacccccacaatgtcgggcaacatcgccttcggccggttcgatgactccttcagcgcggcctctctcaaggcctacatcgccgagttcatctccaccctcatcttcgtcttcgctggcgtcggctccgccatcgcctacaccaagttgtccggcggcgcacctcttgacccttcgggtctgatctccgtggcggtgtgccacgggttcgggctcttcgtcgcggtcgccatcggcgccaacatctccggcggccacgtcaaccccgccgtcaccttcggcctcgccctcggcggccagatcaccatcctcaccggcatcttctactggatcgcccagctcctcggcgccatcgtcggcgccgtcctcgtccagttctccaccggcgtggcgaccccgacccacggcctctccggcatcggcgcgttcgagggcgtcgtgatggagatcatcgtcaccttcggcctcgtctacaccgtgtacgccaccgcggccgaccccaagaagggctccctcggcaccatcgcccccatcgccatcggattcatcgtcggcgccaacatcctcgtcgccgggcccttctccggcgggtccatgaacccggcccgctccttcggccccgccgtggccagcggcgacttcaccaacatctggatctactgggtcggcccgctcatcggcggcggcctcgccggcatcgtctaccggtacatctacatgtgcggcgaccatgcccccgtcgccggcagcgacttctaagcgcccccaagaagaggcgccgttgcattgttgtttggtttctctcaatcctagtgttggcagcataaagtgagggtcaggctgtgatgggcagcatcgcagcttgtcgttgtttggtttagatcaaagccccagagtctatgcacatgcgtttggatatgattggtcatgtttctccatttgctccgtttttgtaacgtggttagtgtgaagttggtggggttccagaaccagagcgttcctgttgattcttattgcgagatttgcaataactttattcggtctctacattcttcgtcgtctgtttggatagattaaagttagatgttaaattttagtatatattaagcactcctacctttactaaattttcttagtcttatcaaaagtcccgatcatctcg

SEQ ID NO: 33497 - protein, 248 aa, Panicum virgatum
  misc_feature: Ceres CLONE 1952569
  misc_feature (12)..(231): Pfam Name: MIP Pfam Description: Major intrinsic protein
  misc_feature: SWISSPROT Homolog: EC 1.9.3.1 Cytochrome-c oxidase
MSGNIAFGRFDDSFSAASLKAYIAEFISTLIFVFAGVGSAIAYTKLSGGAPLDPSGLISVAVCHGFGLFVAVAIGANISGGHVNPAVTFGLALGGQITILTGIFYWIAQLLGAIVGAVLVQFSTGVATPTHGLSGIGAFEGVVMEIIVTFGLVYTVYATAADPKKGSLGTIAPIAIGFIVGANILVAGPFSGGSMNPARSFGPAVASGDFTNIWIYWVGPLIGGGLAGIVYRYIYMCGDHAPVAGSDF

SEQ ID NO: 33498 - DNA, 635 bp, Panicum virgatum
  misc_feature: Ceres CLONE 1952570
  misc_feature: Encodes the peptide sequence at SEQ ID NO. 33499
ggtggctttgtttcaaacttgccaggagatgttcctcgggtatgtggtcagttggctgtctccagagcttttggagacaggaatctaaaatcactattgagatcagagcccgatataaaagtcgaagacatagatcacactgcggagctacttgtcctcgcgagcgatggcctttggaaggtgatgaacaatcaggaggttgttgatttggccaaaaggtacaaggatccatatgcagctgccaggcaattaaccgccgaagcgctaaaaagggagagtaaagatgacatatcatgcattgttgttcggttcaaggcgtaaatggatcgcaggcgactcacggagaatctccgtggagagaagaaaactagtaagttaggctgcctgacaacaatattggtaatcaaatggatgaataatcacagggggcgttggttgtaaatgatttgttggctccattgtataaatatgctaggattattttggtttggcgatttcgaaggtataggtgtgagggcccgagagctatctaaatatagctatcatctgtaaataatggttgcagatagtggaagttgacaggtgctccactgtgaatttgtgagagtacgtttagcagacatttcatagttgcc

SEQ ID NO: 33499 - protein, 106 aa, Panicum virgatum
  misc_feature: Ceres CLONE 1952570
  misc_feature: SWISSPROT Homolog: EC 3.1.3.16 Phosphoprotein phosphatase
GGFVSNLPGDVPRVCGQLAVSRAFGDRNLKSLLRSEPDIKVEDIDHTAELLVLASDGLWKVMNNQEVVDLAKRYKDPYAAARQLTAEALKRESKDDISCIVVRFKA

SEQ ID NO: 33500 - DNA, 528 bp, Panicum virgatum
  misc_feature: Ceres CLONE 1952591
  misc_feature: Encodes the peptide sequence at SEQ ID NO. 33501
acgctcgctcgaacacgagcactgcaccctctcatctgccggtgctagctcctcctagctttctcccccacttcagccggtagcctcttcttgagagaagctagcaggaagagggatcgagcaagatgatgagcggcaaggctctccttgtcgccgtgctcttggtgggcgtcgcctcccggtgctccggcagcaggggcctgcagggggatcacatcgctgagcagaagtacggtggcggtggctacggtggcggaggcggcggatacggcggtggcggcggccgccgcgcaggccgccatgttcaagaaggccaactacgcctgccactactgatccatcgatgacgacgaagctgcttcttccatcatttcgtcggcgtagacgcgtagtatctagcgcttgtgttaaataaataagacgtgtgtacgtgactgtgtgtgtgtccgatccccagcgtcgccttcgttcgtttcagcgcgtcgtcgtcttcccatgactcccatgaatacatgatgatgcatgacc

SEQ ID NO: 33501 - protein, 73 aa, Panicum virgatum
  misc_feature: Ceres CLONE 1952591
  misc_feature: Useful for making plants with altered lignin content
  misc_feature: Useful for making plants with modulated biomass
  misc_feature: Useful for making plants with modulated nitrogen use efficiency
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: Useful for making plants with modulated flowering time
  misc_feature: The sequence is a functional homolog of SEQ ID NO 1001 in the 10/412,699 US patent application
  misc_feature: The sequence is a functional homolog of SEQ ID NO 502 in the 10/374,780 US patent application
MMSGKALLVAVLLVGVASRCSGSRGLQGDHIAEQKYGGGGYGGGGGGYGGGGGRRAGRHVQEGQLRLPLLIHR

SEQ ID NO: 33502 - DNA, 1196 bp, Panicum virgatum
  misc_feature: Ceres CLONE 1952598
  misc_feature: Encodes the peptide sequence at SEQ ID NO. 33503
aagccgaagcggcggccggtggctctgcgcttcgacgtcgccgcagcaacaccaccagacaggcttcttgccagttgccatggggggccttgctgctcctgtatcctgaactaaatcgatctaatctgcccagattccatcatctgaagctttcgtcaatggcggcgcgcggcggcgcgctctgcttctcatcctcgtccgccgccgccgtcacgtgcaggagggcgggtggctgcaggccggaaccgccgcgtttcttggtcgtcagctgcgacgccaggacagcggacgtctactcctccctgcccctggccgcgaagctgctgggtcctcccacgaccttcaacgcggcgaagctcaaggtggagttcgccggggaggatccgctgctgcggggcaagaagcagcctttccccagagcctacaccctgacccactgcgacttgacggccaacctgacgctcgccgtgaccggggggcccatgaccagcgagcagctgcggagctggcagtcgacgctgcagcgggacgacgtggtggccgagtggaaggaggcggccgccggcgccggggagatggcgctgcacgtgcattgcttcgtcagcggcgccaacctcctgcaggagctggcggcgggtttcagatactacgtcttctccaaggagctgccgctggtcctcaaggctgtggttcacggcgacgcggcgctcttctcggagcggtcggagctgatggaggccaaggtgtgggtgcacttccactccagctcccgcaagtacaaccggatagagtgctgggggccgctcagggaggccaccaagaggaacctgcacctgctggatgggcggctggacgaactgcagagcgcaatcaccaggagcaggaggcgacgcaagtgggcgagcccagacacaatcttcaacgccctggtggcactactgctttgacagatcgagcaagggatgagcattcctttgcaaccctttgctctgctgctgaatactgatacgggcatgtgcattcttcaattctgctctgctctgcttgacaccccagttgccatttgcaatgtgggtgctttctccctttttcaggactggtgattgcttggcttgctgctccagtccagtagtagttgtcaacatcaagtttggcaagcgaatcctgtagtaatgtacaataccaagaaattcagc

SEQ ID NO: 33503 - protein, 262 aa, Panicum virgatum
  misc_feature: Ceres CLONE 1952598
  misc_feature: Useful for making plants with modulated time to senescence
  misc_feature: Useful for making plants with modulated abscission
MAARGGALCFSSSSAAAVTCRRAGGCRPEPPRFLVVSCDARTADVYSSLPLAAKLLGPPTTFNAAKLKVEFAGEDPLLRGKKQPFPRAYTLTHCDLTANLTLAVTGGPMTSEQLRSWQSTLQRDDVVAEWKEAAAGAGEMALHVHCFVSGANLLQELAAGFRYYVFSKELPLVLKAVVHGDAALFSERSELMEAKVWVHFHSSSRKYNRIECWGPLREATKRNLHLLDGRLDELQSAITRSRRRRKWASPDTIFNALVALLL

SEQ ID NO: 33504 - DNA, 671 bp, Panicum virgatum
  misc_feature: Ceres CLONE 1952622
  misc_feature: Encodes the peptide sequence at SEQ ID NO. 33505
gtcccggccatatcctccgccgacgatcgagctgctagtagagcctagagctagtaattacgcaccgcagcaatggcctgcggccactccgcctccgcgctcgtgctgctggtggcggtggtggtggccgcctccgctgcctgccgctgctgcctcgccgcgccggcgggggcgctggtgacgcgcgtgccggggttcgctcagcagcagctgccgtcgaagcactacgccgggtacgtgacggtggacgaggcgcacgggcggcgcctcttctactacctggtggagtcggaacgcgaccccgccggggaccccctcgtgctctggctcaacggcggcccgggctgctccagcttcgacggcttcgtctacgagcacggaccattcaactttgagtcaggagggtcagctggaagcctgccaaagcttcatctaaatccatatagctggtccaaggtgtctagtgtgatatacttggactcccctgctggtgttgggctgtcatactcgaagaatgtttcagattatgacaccggcgatcttaagactgctgctgattcacattcttttcttctcaagtggtttcagctctaccctgagttcctgaaaaatccattttacatagctggagaatcgtatgccggggtttatgttcctacccctttcacatg

SEQ ID NO: 33505 - protein, 199 aa, Panicum virgatum
  misc_feature: Ceres CLONE 1952622
  misc_feature (40)..(199): Pfam Name: Peptidase_S10 Pfam Description: Serine carboxypeptidase
  misc_feature: SWISSPROT Homolog: EC 3.4.16.5 Carboxypeptidase C
MACGHSASALVLLVAVVVAASAACRCCLAAPAGALVTRVPGFAQQQLPSKHYAGYVTVDEAHGRRLFYYLVESERDPAGDPLVLWLNGGPGCSSFDGFVYEHGPFNFESGGSAGSLPKLHLNPYSWSKVSSVIYLDSPAGVGLSYSKNVSDYDTGDLKTAADSHSFLLKWFQLYPEFLKNPFYIAGESYAGVYVPTPFT

SEQ ID NO: 33506 - DNA, 606 bp, Panicum virgatum
  misc_feature: Ceres CLONE 1952622-R
  misc_feature: Encodes the peptide sequence at SEQ ID NO. 33507
catcatgatgctgggagtatgatcagttatcacaagaaccttacaagccagggctaccgtgctctcatttacagtggcgaccatgatatgtgtgtaccttacactgggagtgaagcatggaccgtatcattaggttatggagtcgttgattcgtggcgaccgtggttcaccaatgaacaagtttctgggtacacccagggatatgaaaagggcctcacttttgcaactattaagggtgctggccacactgttcctgagtataaaccacaggaatcattggctttctacagccgttggcttgctggttctaaattgtgaagctcttgagtcatgaatgctgctgctgatgggaggcatatttccgtgcaacaaagcacaacatgaagaaattggataacccatggaacaataaggccgtcagaggatcaaagttcctagcgccaaccttggacagtgttgtattcttttctgcaaatattacatcaacgcagctgttttatttacatgcatttttcatgccttcgcggtgacaaacatttgtgaaaaaaatcgttaacattttgaaatcccaaaggtatcaatgtatactattttgttttgatccgc

SEQ ID NO: 33507 - protein, 105 aa, Panicum virgatum
  misc_feature: Ceres CLONE 1952622-R
  misc_feature: SWISSPROT Homolog: EC 3.4.16.5 Carboxypeptidase C
  misc_feature: Useful for biocontainment applications
  misc_feature: Useful for making plants with modulated biomass
  misc_feature: Useful for making plants with modulated flowering time
HHDAGSMISYHKNLTSQGYRALIYSGDHDMCVPYTGSEAWTVSLGYGVVDSWRPWFTNEQVSGYTQGYEKGLTFATIKGAGHTVPEYKPQESLAFYSRWLAGSKL

SEQ ID NO: 33508 - DNA, 675 bp, Panicum virgatum
  misc_feature: Ceres CLONE 1952656-R
  misc_feature: Encodes the peptide sequence at SEQ ID NO. 33509
tcccccgacttacacgcggtcgccgaagccgaagcggacgccacccacctacacgccgacccccaagcccactcccccgacctacacgccgtcgccgaagccgaagccgacgccgcccacctacacgccgacccccaagcccactcccccgacctacaccccgtcaccgaagccgaagccgacccccaccccgaagccgactcctccgacctacaagccgacccccaagcccactcctccgccctacactccaacccccaagccgacgccgccgccgacctacaagcctgcccccaagccgacgccgccgacctacaagcctgctcccaagccgacgccgccggtgtcctacacccccagcccgccgccgccctactacaagtgagatctctgctactctgctgtgtcaagctcggagcataggaaggtgatggaagagtttgcgccagcaaaccggccggccaagagataagctgaagatgagaggcccttccttgatcctcctcttacgttcgctgccgtctatatcatctatcctagctagagaggagggaataatgcacgcagagctctgcagcgccctgctatgttttctgttgtccgtttagttcgtgttcgtcgtctgtctttgcagccgtattgtgtgtgggtaatggtattgctactattggtgtc

SEQ ID NO: 33509 - protein, 127 aa, Panicum virgatum
  misc_feature: Ceres CLONE 1952656-R
  misc_feature: Useful for making plants with altered carbohydrate content
PPTYTRSPKPKRTPPTYTPTPKPTPPTYTPSPKPKPTPPTYTPTPKPTPPTYTPSPKPKPTPTPKPTPPTYKPTPKPTPPPYTPTPKPTPPPTYKPAPKPTPPTYKPAPKPTPPVSYTPSPPPPYYK

SEQ ID NO: 33510 - DNA, 653 bp, Panicum virgatum
  misc_feature: Ceres CLONE 1952656
agaccatcagccacactgaccagagcttggagtgtgagtgagggagagtgccagtgagagagggagcgagaggatgggtggcaaggcagctctgctgctggccctggtggccgtgagcctggccgtcgagatccacgccgacgccggctacggctacggcggcgggtacgggccgacgccggccaccccgaccccgaagccggagaagccacccaagggcggcaagccgcccaaggagcacaggcccaagccggagaagccgcccaaggagcacaagcctcccacctacaccccaagcccgaagccgacgccgcccacgtacactcccactcccaagcccgctccgccgacgcccaagccgacgccgccgacctacactcccacgcccaagcccgctcccccgacgtacaccccgacgcccaagccaccggcgaccaagccgccgacacccatgccgaccccgccgacgtacactccctcgccgaagcccacgccgccgacctacaccccgacacccaagccgccgacctacaccccgaagcccaagcccactccgccaacgtacaccccgaagccgaagccccctcccccgacttacacgccgtcgccaaagccgaaaccgacgccacccacctacacgccgaacccccaag

SEQ ID NO: 33511 - DNA, 596 bp, Panicum virgatum
  misc_feature: Ceres CLONE 1952664-R
  misc_feature: Encodes the peptide sequence at SEQ ID NO. 33512
agacgaggatctgtaacaagtgggagatgactgggtactgcccgttcgggagcaagtgccactttgctcatggagcagctgaacttcacaagtatggtgggggacttgtcgacatagacagcagggatgccgcgtccactcccgactcgaagcaagctggtgcttctgcaaaagctcctgcagattctgctgctgcatccaccgcgatgccccctcacgcagacgtgtaccatctaggcatccagtcgcagcgttccaccatcgtcagccagaggtctgggcacgtgcaaaggcccattcagaagtggaagggtcctgacaagatcagcaggatctatggtgattggatagacgagaatgagtaggaaggcaagccctcgcttagtacctggctgccttcatctcagctggtgcaagccgcttagaagctgtagatggcactgcaaaccctagtcccagaagaatgtgcagtgttggtatgaatattatgttgctgcaggtcatgttgtctctgttgtatgcatgcttaagagaagatcaactctaagacctatattgggaaggaaaactgcaagaacatagcatggttgttgttc

SEQ ID NO: 33512 - protein, 120 aa, Panicum virgatum
  misc_feature: Ceres CLONE 1952664-R
  misc_feature (1)..(25): Pfam Name: zf-CCCH Pfam Description: Zinc finger C-x8-C-x5-C-x3-H type (and similar)
  misc_feature: The sequence is a functional homolog of SEQ ID NO 644 in the 10/666,642 US patent application
TRICNKWEMTGYCPFGSKCHFAHGAAELHKYGGGLVDIDSRDAASTPDSKQAGASAKAPADSAAASTAMPPHADVYHLGIQSQRSTIVSQRSGHVQRPIQKWKGPDKISRIYGDWIDENE

SEQ ID NO: 33513 - DNA, 300 bp, Panicum virgatum
  misc_feature: Ceres CLONE 1952664
accgtacccctcctccacccacacccacacacaccaaaacgtcacccccgacagcccaagttcccaagctcagaatttccagcatgttggagcccgcatcgcccgaggagcctcacaccatacgacctgttacaaactgctttgggctacatcgacgatgtgacccatctcactgatggcaagggactggaaaaaagatgattctttacactcgtggggtgctcgaatcaagaagaggtgcaccaacccgcggccttgaaaaaaaaaaaaagattgtggaacaacattattctgcttata

SEQ ID NO: 33514 - DNA, 1154 bp, Panicum virgatum
  misc_feature: Ceres CLONE 1952681
  misc_feature: Encodes the peptide sequence at SEQ ID NO. 33515
ctagagacacccagcgccgcagcccgcagccactccacctcccgagcccccaggcggccaggcaccaggtgcggcggcggcggcggcggcggcggcaagatggcggtgggcaagaacaagcggatcagcaaagggaagaagggcggcaagaagaagaccgtcgatccattcgcgaagaaggattggtatgatatcaaggcgccctctatcttctccgtgcgcaacattggaaagacactcgtgtccaggacacagggtactaagattgcttctgagggtctgaagcaccgtgtcttcgaggtctccctagctgatcttcagagtgatgaagaccaagcctacaggaagatcaggctccgtgctgaagacgtccagggtcgtaatgtccttaccaacttctggggaatggattttacgacagacaagctccggtcgcttgtcaggaagtggcagactttgattgaggcccatgttgatgttaagaccactgataactacatgctgcggctcttctgcattgggtttacaaagaggagacccaaccaagtgaagcgcacttgctacgcacaggcctcccagatccgccagatacgccgtaagatggttgagatcatggccaaccaggcctctacctgtgacctgaaggagttggtttccaagtttattcctgaggtcataggcaaggagattgaaaaggctacctcaagcatcttcccgttgcaaaatgtcttcatccggaaggtcaagattctcaaggcccccaagttcgaccttgggaaactgatggaggtccatggggattacacaaaggaggatgttggtgtgaagcttgagaggcctgctgagggtgatgaggccgtggttggccaggaggctgctgcagctgagtaggatagtttatgatcactattttgctacttaatatatttgaaggatatatgtactgttacctttctgtctgagaacaagggcggctttatttcggcgatctggtagtatgtctgaaaacaggtcattcgtttgtggttatttggattttggatcgcaagttctggtatcatccacgtggtgtttaccttgttgcctgagggttagtttggtgattactgtccatgctaggttctgtgtggtgaatgcctttatcttgtttgagt

SEQ ID NO: 33515 - protein, 263 aa, Panicum virgatum
  misc_feature: Ceres CLONE 1952681
  misc_feature (11)..(222): Pfam Name: Ribosomal_S3Ae Pfam Description: Ribosomal S3Ae family
MAVGKNKRISKGKKGGKKKTVDPFAKKDWYDIKAPSIFSVRNIGKTLVSRTQGTKIASEGLKHRVFEVSLADLQSDEDQAYRKIRLRAEDVQGRNVLTNFWGMDFTTDKLRSLVRKWQTLIEAHVDVKTTDNYMLRLFCIGFTKRRPNQVKRTCYAQASQIRQIRRKMVEIMANQASTCDLKELVSKFIPEVIGKEIEKATSSIFPLQNVFIRKVKILKAPKFDLGKLMEVHGDYTKEDVGVKLERPAEGDEAVVGQEAAAAE

SEQ ID NO: 33516 - DNA, 590 bp, Panicum virgatum
  misc_feature: Ceres CLONE 1952690
  misc_feature: Encodes the peptide sequence at SEQ ID NO. 33517
gtaagaatcctgggaaaccatcagaagaatttgctgcgtacattaggcagagaggttatgaccttcatgatgtgaaggcttatgggcagatgcttgagaatgctggttttcatgacgtcatcgcggaagaccgcactgaacagttccttagtgttctacggagggagctagctgaggttgaaaagaacaaagaggctttcctagcagacttcagccaggaggactacgacgacatcgtgaacggctggaacgcgaagctgaaacggagctctgccggtgagcagaggtggggtctgttcattgctaccaagtgattcagcctgcctggcaccggatggggctctatcttccgaataagaatggctgtggttgtggcttctgcttctagatcggcgattcgtcctagaagtagaggatcttcagaataaaaatgggtgctgctcgtgttgttgttgttgtgtctacgctactagaacatcagttaggtgatttgtgctgtgcaaccagggttgcagaacgcgtgctgcgcgttccagttcatgtggtgcgtgtactgcgagctactattatcagagagtcgatttcaccag

SEQ ID NO: 33517 - protein, 103 aa, Panicum virgatum
  misc_feature: Ceres CLONE 1952690
  misc_feature: SWISSPROT Homolog: EC 2.1.1.103 Phosphoethanolamine N-methyltransferase
  misc_feature: The sequence is a functional homolog of SEQ ID NO 40 in US patent 7151202
KNPGKPSEEFAAYIRQRGYDLHDVKAYGQMLENAGFHDVIAEDRTEQFLSVLRRELAEVEKNKEAFLADFSQEDYDDIVNGWNAKLKRSSAGEQRWGLFIATK

SEQ ID NO: 33518 - DNA, 603 bp, Panicum virgatum
  misc_feature: Ceres CLONE 1952694
  misc_feature: Encodes the peptide sequence at SEQ ID NO. 33519
aactagcaaatcagctctaccagaagaaattctctggcccgagatgggaggctttggccaagaaaggtgccaagaaacagaggttattgtgggcatccactggcgtcaagaatcctgcttaccctgacaccctttacgtggacagtttgattggacctgacacggtcaacacgatgcccgacaatgcgttgcaggcattcatcgaccacggcactgtttcacggacagtggatgctaatgtatctgaggcggaaggtgtatacagtgcactggagaagcttggcattgactgggatgaggtcgggaagcagcttgagctggaaggtgtggactcgttcaagaagagcttcgatagccttcttgtgagcctgcaggagaagggcaacagcctcaagacggcagtgtagaactgaaatgatttggtactgtcaggtgaacgattactaaataaaatgctggcttgctggctctccgttttgtgactgtacggttgctctcggttttctgaatcggctttgtattctaggcttgccttgctgtcattgtgtaaccaatgttcatggcttgtaattgctatgcgtatccgattaataatttttgagc

SEQ ID NO: 33519 - protein, 134 aa, Panicum virgatum
  misc_feature: Ceres CLONE 1952694
  misc_feature: SWISSPROT Homolog: EC 2.2.1.2 Transaldolase
LANQLYQKKFSGPRWEALAKKGAKKQRLLWASTGVKNPAYPDTLYVDSLIGPDTVNTMPDNALQAFIDHGTVSRTVDANVSEAEGVYSALEKLGIDWDEVGKQLELEGVDSFKKSFDSLLVSLQEKGNSLKTAV

SEQ ID NO: 33520 - DNA, 565 bp, Panicum virgatum
  misc_feature: Ceres CLONE 1952695-R
  misc_feature: Encodes the peptide sequence at SEQ ID NO. 33521
cagcactcacaagagagatgtcattcggggatcaaacggtgtcccccgctgcagctgagaggcctgctgccatgaggattgacagcgagacgcttgtacagaacagggacagcgggatgcagcggtacagggagaagaggaagaatcgcaggtatgagaagcacatccgctacgaatcgaggaagctgagggcggacacgaggaagcgggtgaaagggcggtttgtcaagtcgaccgaagcaaatgccgtcaatggcggatgaaccaagggcctttgaagatcgagctcggtgcgttgcgtttagtaggatggagctactaacatccgaaggtggtggtacggtgctacacctatgcatgatgctattgttggattgccgcgcagccgagccaaattttgcgttgaagcaatcgtggccattggtcaatcaatgctagagaatgcacggtacgcttgtagttgtaagaaacgacacccctttttgctgctgccatcagaacagaaataggtagcttacagtacttgtttaccatgatggttttagtacgagcgaatggtgatgcg
